United States Patent 7,314,974 (EXPRESSION OF MICROBIAL PROTEINS IN PLANTS FOR PRODUCTION OF PLANTS WITH IMPROVED PROPERTIES) - sequence listing, part 7

SEQ ID NO: 24353 - DNA, 1767 bp, Deinococcus radiodurans
atggagacctcaactttgcaacccaaatccgaattttttgcggcgctgcgccacttcgcgggctattaccggccctaccgcctgaccctgtacgccgacctgctgtgcgccctgctggtggcgggcatcacgctggtctatccgctgtgtgccggctacatcacccgcacggtgctgaccctgacgccgcagcaggcgtggcccgaattgctgcgtgtgggcgggctgatggtgggcctgctggccgtgcaggtcgccgccaacagctttctggactatcagggccacatgatgggcacgtttatcgagcgcgacatgcgccgcgacctgttcgcgcacctgcaaaagctgcccttcgggttctacgacactcaccgcaccgggcagctgatgagccgcgtcacgggtgacctctacgacattggcgaacttgcgcaccacggccccgaggacctgtttatcgcgctggtgtcgttcgtgggcgtgttcgtgattctggcgggcctcaacctgccactcacgctgatcctgctggcattcctgccattcatggcggcctacgcgctgtatttcaacgtgcagctcaaccgcgcgctcctgcaaagccgccagcgcatcggcgaggtgaacgcgcaggtggaggactcgctggcaggcatccgggtggtgcagtcgtttaccggtgaagggaccgaggcgcggcgtttcggcgcggccaacgacctgtttgtggaaggccgccggggcgaataccgcgccgaactgtatttctaccagggcatgacagcgtttacggggctgatgaccatcgccgtactgatgttcggcggctgggccatcctgcaaggcggtctgcggatagacgggctggtgacgtatctgatgtgcgtgggcatcctgctggaacccatccgccggctcgtaaatctagcgcgggtgttgcaggagggcgtgaccggcttccagcgtttccgcgagatgatggcggtcacgccggacatcgtggacgcgccgggtgccgccgagctacagaacgtgcgcggcgaggtggagtttcagggcgtgagtttcggctactcacctgacgcaccgcccgtgctgcgcgatctcaacctgaagatcagggccggagaattcgtcgcgctggtcggcgcttcgggcgtgggcaaatccacgttgtgcgccctgattccgcgcttttacgacgtaagcgccgggcaggtgttggtggacggccacgatgtgtgtggcgtaacactggcaagcctgcgccgcagcgtgggcgtagtgcagcaggacgtgtacctgttttccggcacggtgatggagaacatccggtatgggcggcccggcgcgacggaagccgaggccatggacgcggcgcggcaggccggagcgcacgatttcatcacgcggctgccccagggctaccacaccgacatcgggcagcgcggcgtgaagctttccggggggcagaaacagcgcctgagcattgcccgcgtgttcctgaaagacccgcctatcctgattttcgacgaggccaccagcagtctcgacaacgaatccgagcggctggtgcaggagtcgctggaacggctggcccgccggcgcaccacgctggtcattgcccaccgcctcagcacagtacgaaacgcccaccgtatcgtcgtcctgacggaaaacggcgtcgcggaggaaggctctcacgcagagttgctggccctcggcggcgaatacgcgcggctgcaagcgttgggccggttgtga

SEQ ID NO: 24354 - DNA, 750 bp, Deinococcus radiodurans
atgatcgtcaagtacggcggcaatgccatgaaaagcctcgacctgcgccgcgccgtggcccgtgaactcgggacgctgcgcggcgcaatgccgctcgtggtcgtgcacggcggcgggccggtcatcgaacgcgaactcgcggcgcggggcgtagcgagcgaatttatcggcggcctgcgcgtgaccacgcccgaggcgatggacgtggtggaaatggcgctgtgccagcttaataagcagctttcgcaggacattgggcaggcggtggggctgatgggccgcgacgacgagttgctgcgtgctgaagtgctcgacccccagctcgggcgggtgggccgcgtgaccggcgtgaatgccgggctgctgcggacgctgctcggcgcggggctcaccccggtggtgggctgcgtggcggtgggcgaggacggtgaggcgctcaatgtcaacgctgacacggtggccggcgcagtggccggggcgctgggcgagggggccgtcttcctgaccgacgtggacggcgtgtaccgcgcctaccccgacccggacagccgcgccgcgcagctcacccgcgccgaggtggaagacggccttgcggcgggctggattgccgggggcatgattcccaaagtgcgggcggcgctcgacgcactggggcggggcgcccccttcgccatcatcgccagcgggatgacggcgggcgtactcgcgcaggcggcgcggggggaggccggaacgcgcatcgtgccctga

SEQ ID NO: 24355 - DNA, 2544 bp, Deinococcus radiodurans
atgaagaccctcgacctcgacatctcaggaatgacctgtgcggcctgcgtggggcgggtggagcgcgggctcaggaaggtggagggcgtgcaggaagcccacgtcaacctggcgaccgagcgggccagcgtgacctacgacccagctttaacgaacgccgccgcgctggtgcaaaaggtcgtggacaccggctacgacgcgcctaccgccgaactgtcgtttccggtggcgggcatgacctgcgcggcttgcgtgggccgggtggagcgggcgctgaacaagacggacggcgtgctggacgcctcggtgaatctggcgaccgagcgggccagcgtgcgctacctgcctgccagcgtcagccccgccgaactgaaaagcgctgtggtgaacgcgggctacgacgtgccggaggaacagacgcaggccgcctctcgcctagaactggaacgggcgcgcaaggccgaggaacttgccgggctgcggcgctcgctgaccttctcggcggtgttcagcgtgccgctgctgctcctcagcatggtcccgatgctctacccgctgctgcaccactggctgctgggcacgctgggcgagcgcgccatgaacgtgctgatgttgctgctggccgcgccggtgcagttcggccccggcctgcgcttttaccgcacggggtgggccgccctgcgtcaccgcagccccgacatgaacacgctggtgatgctgggcacgtccgccgcctttttctacagcctcgcggtgacgctgtggccgcagctcttcccggcaggcagccgccacgtctactttgaagcgtcggcggtggtcatcacactgattttgctgggcaaatacttcgaggcgctcgccaaaggccgcagcagtgaagccatgcggacgctgttgcaactgcaaccacaaagcgcgcgggtgcagcgcggcacggaggtcgtggaggtgccggtggacggcgtgcgggtaggcgacaccgtgctggtgcgctccggcgagcggctgccggtggacggcgaggtgctgagcggcgagagttacgtggacgagtccatgctgaccggcgaaagcgtgcccgtccacaaggcggcgggcgcgaaagtcaccggcggcacggtcaacggcaccggctcgctgaccttccgggcgacgggggtgggcgccgacaccgccctggcgcggattatccggctggtggaggacgcgcaggcgagccgtccgccgattcagggccttgccgaccgggtggtggcgcagttcgtgccgctggtgctggcaattgcgctcgtcactttcctggcgtggctgtacgtgggcgggccgtcggcgctgtcgaacgcgctgattcacaccgtcgccgtcctcatcatcgcctgcccgtgcgcgatgggcctcgccacgccggtctctatcatggtgggctcgggccgcgccgcgcagctcggcgtgctgtttcgcagcggggccgcgctggaaggcctgggcgaagcgcagacggtggcgctcgacaagaccgggaccgtgacgcggggcgtgatggaagtgacggacgtggtcgtggatgggagatgggtgatgggtgatggggaactgctgagactcgccgccattgccgagggaccgtccgagcatccgctggcccgggcgattgagcgggccgccactctttcaccctcgccccttgcgggagagggcctggcgcagccaggggtgagggggcgtgtgaccaacgaacccgccccatcccccacgctccctcaaccctcctcgttccaggctcttcccggctacggcctgcgcgccgaggtggacggtcggcgggtagaaatcggcgccgcccgcttcatggcgcagctcggcctgccgctgggcgaactgggggcaaaggccgacgaactcgccgcccgcgcccgtacgccggtcttcgcggcggtggacggtcaactcgccggattgctgggcgtggccgaccccatccgtgaaggcagcgccgaggccattcgcaccctcacggcgcaggggctggacgtggcaatggtgacgggcgacgcacgggcgaccgccgaagcggtggcgcgtgaagccggtgtcaaccgcgtgctggccgaggtattgcccgaaggcaaggcgcaggcggtggccgaactccagcagtgcggtcagcgggtggccttcgtgggcgacggcatcaacgacgcgcccgccctcgccggggccgacgtgggcgtggccatcggcactgggaccgacgtggccgtggaaactgccgacgtgatcctgttgggcggcgacctgcgcagcgtgccgaacgcggtggcgctcagccgcgccgtgattcgcaacatcaagctcaacctgttctgggccttcgcctacaacgtgctgctgattccggtggcggcgggagtccttgcaccctggggcctgggcctctcgccggtgctggccgccgccgcaatgggcttgagcagcgtctttgtgatgagcaacgccctgcggctacgtgggtttacgccgcccctgtctgtcaaaggctaa

SEQ ID NO: 24356 - DNA, 1086 bp, Deinococcus radiodurans
atgacccagacgcctccccccgcacccggcccctccggcgtgcgtcaggccgtgcgcgacattccggcctatccgtttacgcccatcgacgtgccgtacaagctcgaccagaacgagaatccctacgattttccgcccgagctcaagcaaaaggccgccgagcggatgctcgcccacccctggaaccgctatcccgacctgcacgccgacacgctgcgcgccgccattgccggctacgagggctgggacgcggcaggcgtggtgattacgccgggcagcaacgtcctcatcaagattctgaccgaactcggtggcatcgggcagacggtgctgaccaccgaccccacattcagcgtctataccctcgaagccgcgatgctgggcgccgaactggtgctgacgccgctgaaccccgacttctcgctgccggtggaggcgaccttgcaggccctcgccgcccacgcgccgggcgtgttctacgtaacgcagccccacgcgccgaccggccacagcgaccgcccggaggacgtgcgtcgggtggtagaagttgccgaccgcctcggctgggtgacggtgatcgacgaggcgtactcccagtacgcgggcaccgattaccgcgagctggtgcgggcgggcaagcacgtcctctccctgcggaccttttccaaggcctgggggctggcaggcgtgcgggccgggtacctgctgaccaaccccgaactcgccgggcacctgcaaaagctggtgtcggccttcaccattaactttttgacgcaggccgtcatcgaaaccgcgctcgaacaccccgagtacatgcgcgagcgggtggccgaggcgattgccgagcgtgggcggatttacgcggcggtgcagggccaccccacctgcaccatcttcccgagcaatacgaacttttttctgctgaagacgcccgacgccgacgccgcctaccggcacctgctggagcacggcatcgtctgccgccgccaggacaaactgcgtggactggacggctgcctgcgcatcgcggtaggcacgcccgctgaaaacgacgccctgattgcggcgattctcgcgctgcgctga

SEQ ID NO: 24357 - DNA, 1950 bp, Deinococcus radiodurans
atgacccatcccaacgaccacattgacgcgatgctgcacgaaacgcgcgtcatccaccccagcgccgaatttcaggccgggacgcgggtcagccgcgcagagtacgagcgccgctaccgccagagcctcgaccagcccgacgacttctggtcagaggtggcccatgacctccactggatgaaggactgggaccgggtgctcgactggcaggagccgcacgcgcagtggttcgtgggggggcagacgaacatcgcctacaacgcgctcgaccgcaacgtgcagcgcggcctcggcgacaagcgggccatcatctgggaaggcgaggacggcgaggtgcggacctacacctacgccgaactgctgcgcgaggtttgcaaggcggcgaacgccctggaagaactcggcgtggtggccggcgaccgagtgaccctctacatgcccctgattcccgaggccgccatcgccatgctcgcctgcgcccgcatcggcgcggtgcattccatcgtgttcggcggcttctcggtctcggcgctggccgaccgcatcaacaacgcgcagagcaagctgctcatcaccgccgacgccggctatcgccggggcaagccggtcacgctcaaaatcaacgccgacgaggcggccaagctcgccccctgcctggaacacgtcctggtggtcaagcgcgccggcattccgctggagtggtggaccgaaggccgcgacctgtggtggcacgacgtagtggaccgccagagcgatcagcacgaggccaccgcgctcgacagcgagcacccactgttcatcctctacacctccggcagcaccggcgcccccaaaggcgtgcagcacacgaccggcggctacatggtgggcacttacctcaccacccagacggtcttcgacctgcgtgacgacgacatttactggtgcaccgccgacatcggctggattaccggccacagctacagcgtgtacggcccgctgctcaacggcgcgacggtggtgatgtatgagggcgctcccaaccagcccgactggggccgcttctgggacatcgtgcaaaagcaccgggtcaccatcctgtacaccgcgccgaccgccattcgctcctttatgcagcacggcgacgagattccgggccgctacgacctcgccagtttgcgcctgctggggtcggtgggcgaacccatcaaccccgaggcgtggatgtggtactaccgcgtcatcggcggcgagcgctgcccggtcgtggacacctggtggcagaccgaaaccggctccatcatgctgaccacactgccgggcgcctttcccagcaagccgggcagcgcggggctgccgatgttcggcgtggagcccgcgctgatgacccgtgacggcgaagagatcggcgacgacgacggcggcctgctcgtcatcaagcggccctggccctccatgctccgcacggtctacggcgacgacgaacgctaccgcaagagctactggggcgagattccgcacgtgtacttcgctggcgacggcgcccgccgcgaccacgacgggtactacacgattgtcgggcgggtcgatgacgtgctcaacgtctccggacaccgactgggcaccatggaaatcgaatcggcgctggtggcgcaccctgacgtgtccgaagccgcagttgtcggcagacccgacccagtgaagggggagagtgtggtggcctacgtgctgctgcaagacgggcacaccgccgaccccgccgccctacgcgcccacgtcagcagcgaaatcggcgccctggcccggcccgacgccatctacattgccgacgccctccccaagacccgcagcggcaaaatcatgcgccgcttcctgaggcaacttgccgccggacagccggtgcagggcgacaccagcaccctggaagaccccaccgttctggaacgactgcaagcctcccctgccctttga

SEQ ID NO: 24358 - DNA, 1200 bp, Deinococcus radiodurans
atgcgtgacgctgtaatcgtttccgctgttcgtacccccgttgggcgcggtgtcaaaggcaccctcgccaacacccgccccgacgacctcgccgccctggtcatgaacgaagccatcaagcgtgcgggcgtggacgccggagtcgtggaagacgtgtacctcggctgcgccatccccgaagccgagcagggcctgaacgtggcccgcctcgccgcgctgcgcgccggactgcccgacagcgtgggcggcgtgaccgtcaaccgcttctgctccagcggcctgcaaaccatcgccatggcggcggcggccattcagaccgggcaggccgacgtgatgctggccggcggcgtggaaagcatgagcatgctgcccatgagcggccacaaccccagccccaaccccgacctggtggacgaccgccccggcgcctacatcggcatgggcatgaccgccgagaacgtggccgccaagtacggcgtaagccgcgaggaccaggacaagttcgcctacgccagccaccagaaggccgccgctgcgcaggacgccggcaagttcgacgccgaaatcgtgccggtgccggtgcgcaaagacagcgtgaagggaaccaagctgaagtccgacacggtcatgttcgacaaggacgaactgattcgccgcgacgccaacctggaagacatggccaaagtgcgcccggccttcaagctgggcggcagcgtgagcgcggccaactccagccccttctccgacggcgcggctgccgtgctgctgatgagcggcgaaaaggcgcaggaactgggcgtgaagcccctggcgaagttcatcggcttcgcggtggcgggcgtggcccccgaagtgatgggtatcggccccgtggccgccgtgcccaaggtgctcaagcagaccggcctgacgctggacgacattgacctgatcgagctgaacgaagccttcgccgcgcagagcctcgccgtggtgcgcgaactcggcatcgacgaaagcaagctgaacgtgaacggcggcgcgattgcgctgggccacccgctcggctgctcgggcgccaagctgaccaccaccgccatctacgaactcgggcgccgaggcggcggcaaagccttgattaccatgtgcatcggcggcggcatgggcgcggcgggcatcatcgaggtctaccccgccgaaacggcgcaggctgccgactga

SEQ ID NO: 24359 - DNA, 576 bp, Deinococcus radiodurans
ttggcccacctcggtcacgggacggcgggccgcttcgctgagcgtgagcatgaacgcaggctagcgtgtacccccgggtgtggggggtattgggtcggtggctaccgcgccggcggtcagcggtttgtaagccagtcaactgctatcctgacgtccggtatggaacggacttttgccatgatcaagcccgacggcgtgcgccggggcctgacccctgaaattctcgcccgcattcacaacaaaggctaccgcgtggtcggcctcaagcagatgatgatgccccgcgaaaccgccgagcagcactacggcgagcaccgcgagcgtcctttcttcggtgaactggtggacttcatcaccggcgggccggtcgtcgccatcgcgctggaaggcgaaaacgccatcgccggctggcgggccatgatgggcgcgaccaaccccgccaacgccgcccccggcaccatccgcgccgacttcgccaccagcaccggcgagaacgtgacccacggcagcgacagccccgagagcgccgagcgcgaactggcgctgtttttcggggacggcgaacttctttcctga

SEQ ID NO: 24360 - DNA, 1758 bp, Deinococcus radiodurans
gtggccctcaccgccgcgtccatcagcgagagcctctgctcccgctgtcttcacgtttccggccctggaggttttcccatgagaagcaacatgatgcccgtgcccctcaccatccccttcattctggagcgtgcccgcaccgggtttgccgaacgcgagatcgtcagtctgctgccagcgggcaaagacgcgcagggtcagcccatcgcccaaacccaccgcaccacctacggtgaggtggcggaccgggcactgcgcctcggcgcgggcttgcaagcactggggctgcaacctggcgaccgggtggcgacgctggcggtcaattccttccgacatctggaggcgtacctcggcgtgccgagcgcgggcttcgtgctgcacaccgtcaacatccggctgcaccccgagcaggtggcctggattctcaaccatgccgaggaccgggtgctcctcattgaaaatgtctttgcggcgatgattccggccattcgggcggcctgccccaagctggaacacgttttcgtgctgggcggcctgccgcaacccatccccggtgtggcggactacgaccagtgggtgatgagccaagagccgctgacgcactatccgcagctcgacgagaacgacgccgccgccatgtgctacaccagcggcaccaccggcaaccccaagggcgtgctgtactcgcaccgctccaccgtgctgcactcgttggcgagcgcccccaaagacgcgctgaacgtaggcgaagccgacagtgtgctgcctatcgtgccgatgtttcacgtcaatgcctggggcttgccctacacctgcgccatgtacggggccaagcaggtcttcagcggcgtgttcaccgacggcaagtccattgcccagctcatgcaggacgagggcgtgacgagcacggcgggcgtgccgaccatctggatgggcctgctgagcgaactcgaccgcgccaagcaggcgggcgaaccctacgacctcagcgggctggagcgcctgatcgtggggggcagcgccgcgcccgagtcgctgattcgcgccttcgaggagcggcataacctgcgcctgctgcacgcctggggcatgaccgaaacccatcccctcggcaccgccagcaccctgccgctcaatatggacccgcgcagcgacgagggctacgcgctgcgggccaaacagggccgtccggtgccgctggtggaactggaaatcgtggacgacgacagcaacgtgctgccccacgacggcgcggcgatgggccggctgctgtgccggggcccctggatcgccgacagttacttcaaaggtgagggcgcgagcagcttcctgaccctggacggcaacctgtggttcgacaccggcgacatcgccacgctggacgagcgcggctacatgcacattcaggaccgttccaaggacctcatcaagtcgggcggcgagtggatcggctcggtggaactggaaaacgcgatcatggcccacccggcggtcgcgcagtgcgccgtgatcgccatggacgaccccaagtgggacgagcgcccgctggcggtggtggtgctgcgccccggtcaggcggccacgcacgaggagctgaccgagttcatcgcgcccaagttcgccaagtggtggctgcccgacgccaccgtgttcaccgacgccctgcccatcggcgccaccggcaagttcctcaagcgcgagctgcgcgaggagtaccggggctaccggcagcagaacttcccgcaacgtcaggactga

SEQ ID NO: 24361 - DNA, 927 bp, Deinococcus radiodurans
atgacccaaccgaacagctggaccattccccatctccccgtcgccggttatgcctgggaagtcgccgacccggcgggcgccgtgctgctcacgcacgcactcgccgaatacgcgcagcggtatcaggaccgttatcactgcctgattccggcgctgaacgcggcgggctacagcgtctacagctacgacctgcgcggtcacggcgcgtcgccgggcgaggtgagcatggtggacgccttcgtgcaggtggacgaccacctcgccgcccgcgccgccctgcgggagcgttgcccggacctgccgctctacctctttgcccacagcgccggggccctgtttacggcgggcagcgtgatggccgacccacagggcatcagcggcgtcatcctgtcaagcccgatgctccaggccgggcaagatcagatagccctggtgcggcacctgctgccgctggcctccaagctggcgccggggctcgccatcgtgccgatcaacaaggcggggctctcgcggctgccggaagaggtggcggcgtaccaggccgacgagcgcatctatcaggggcaggtcactttgctcaccgcgagcaccatgatgcagctctcgcagcagctctggccgacctactcgaactgggcgctgcccacgctggtcttctacggcaccggcgatcaggtgtcctacatggacggcctgcccgacttcgtggcgcagcttcacacccccgacaaggcgctcaaggtcttcaagggtgggtatcacgaactcctcaacgactgtgaccgcgaggaagtgctggcgctcattctcgactggctgtgggaacgccgcccggtgaaagaccccggcaatgaacagatgcagcacaacctgggccgcctcgcccggctgcggcagcggcggcagggaatacggggaagcgcctga

SEQ ID NO: 24362 - DNA, 1392 bp, Deinococcus radiodurans
gtggttcatatgaatgggagggtgggtctaggtccgcctgccacccgccgaggagaagtcatgcccaagatattccgcagtctgtatgttcaggtcatcatcgccatcgtgctcggcattctggtcggtgcattgtttcccaagtttggagaggccctcaagccgctcggcgacatcttcgtcaagctgatcaaaatggtgattgcgccgattatcttcgctaccgtggtgagcggcgtggcgcacatgcgcgacacccgcaaggtgggccgggtgggcggcaaggcgctgatctatttcgaggtcgtctcaacgctggcgctgattatcggcatggtggtgatgaacgtgctgcggcccggtgcgggcatgaacgtggaccccgccaccctcgacacggcgggcctgacgaagtacaccgaggccgccggggaaatgacagtatgggaccatatcctcaagatcatccctgataccctggtcagcgcctttacgggcggcgaactgctgccggtgctgctggttgcgctgttgttcggtttcgccctgatgcggctcggcaagctcggcgaccagattctttacggcattgacgctctgaatcaggttgtcttcgtgattctggggttcatcatgcgcctggcacctatcggggcgtttggggcgatggcgtttaccgtgggtaaatacggtctcaaatcgctcaccagcctcggctacctgatgggcagcttctacctcacctgtttgctgttcatcttcgtggtgctggggctgattgcgcgggcggcgggcttcagcatcttcaagctgattcgctacatccgcgaagaactgctgatcgtgctgggcacgagttcgagcgagtcggcgctgccccgcctgatgatgaaactggagcatgccggggccgagaagagcgtggtggggctggtggtgcccaccgggtactcgttcaaccttgacggcaccagcatttacctcacgatggccgcgctcttcatcgcgcaggcgacgaacacgccgctgggcctcggcgagcagctcagcctgctggcggtgctgctgctgacctccaagggcgcggcgggcgtgacggggagcggctttatcaccctggccgccacgctcggcgctgtcgggcacgtgccggtggcaggcatggcgctgattctgggcatcgaccgcttcatgagcgaggcgcgcgccctgaccaacttcatcgggaacgcggtggcgacgctggtggtggcccgcagcgagaacgccgtggacatgaaccgcctgacgcgggcgctgaacggcgaggacctgccgaccaccgagcccgacgtggcgagcgaggaacgcggcgagggccgtgaaatcgacagctcgcgtccggtgacgtga

SEQ ID NO: 24363 - DNA, 1443 bp, Deinococcus radiodurans
ttgccactttggcgcggtggtacgctcaggagcgatatggatacctttgacgttctggtgattgggggcggccccgcggggtacgtggcggccattcgtgcggcgcagctcgggttcaaaacggcctgtgtggacgccttcgagcggggcggcaagcccagcctgggcggcacctgcctgaacgtgggctgcattcccagcaaggcgctgctcgattcctccgagcgcttcgagatgatttcgcacgacaccgccgagcacggcattcaggtggcccagcctcagatcgatgtcagcaagatgctcgcccgcaaggacggcgtggtggacaagctgaccggcggcgtcgctttcctcttcaggaagaacaaggtcacgtccttccacggctacggcaagctcgtgcgccaggacggccaggagtgggtcgtggacgcagcgggcaccgaagtcaaggccaagaacgtgatcgtggcaacgggcagcaacccccgcgccctgcccggtgtgcccttcggcggccacatcgtggaaaacagcggcgccctgcaaattgaccaggtacccggcaagctcggcgtgatcggcgcgggcgtgatcggcctcgaactcggcagcgtgtggcggcgcctcggcgctcaggtgaccatcctcgaagcgatgcccggcttcctgatggccgccgacgacgcgattgccaaagaagccctcaaacagttccagaagcagggcctcgacttccacttcggcgtcaagatcggcgaaatcaagcaggacgacagcggcgtgactgtcacctatgaggaaaacggctcgcaggtgaccgcgcagttcgacaagctgatcgtgtccattggccgcgtgcccaacaccgggggcctgaacgccgacggcgtgggtctggcgctcgacgagcgcggcttcgtcaaggtggaccagcactaccgcaccaacctccccggcgtgtacgccatcggcgacgtgatcggcggcgccatgctggcgcacaaggccgaggaagaaggcgtggcgctcgccgaaatgatcgccggacaggccgggcacgtgaactacgacgtgattccctggatcatctacaccagccctgaaatcgcctgggcaggcctgaccgagaagcaggccaaggaacgcggcctgaatgtcaagaccgggcagttccccttcagcgccaacggacgcgccctgggccacggcgacccgcgcggcttcgtcaaggtcgtggccgacgcccagaccgacaagctgctcggcgtgcacatgatcggcggtggcgtgtcggaactcatcggcgaaatcgtcgccatcatggaattcggtggcagcgccgaggacctcgcccgcaccatccacgcccaccccacgctctccgaagtggtcaaggaagcggcgctggcggtggacaagcgcgccattcacatgtga

SEQ ID NO: 24364 - DNA, 852 bp, Deinococcus radiodurans
atgaccccgccctcgccgctgaaatccgccgcctggctgctcgcgcagcggccgggcgccgtgcgcgtgctcgactgccgctacgccctgagcgacccgctgctcgggcgcctcgcctatctggaagggcatattcccggcgcggtctacgccgacctcgaaaccgacctcagcgggccggtgcagcccggcggcgagggcgggcgccacccgctgcccgacccgccggtgctggcagactggctcggcgcggcgggcatcggcaacggcgacgtggtggtgtgctacgacgacccgggcggcggccagggcttttacgcggcgcgggcgtggtggctgctgcgctggctggggcaccgcgaggtgtatgtgctcgacggcggctggcccgcgtacctcgcggcggggggcgaagcgagcaccgaggaaccgcaccccgtgcccacgacttttacgccggacgtgcagcccgaactggtagcgacggcgcaggacgtacagaaccgggaggacggggtgctgctcatcgattcgcgcgcgccagaacgctaccggggcgacagcgagccgctcgataaaaaagccgggcacatccccggcgcggtcaaccggcctttcagcgccgcgctggacgagcaggggcagttccgggcgggcgccgagcaggcggggcgactggccgccggagacgcccccaccatcatctactgcggcagcggggtgagtgcgacccccaacctgctcgcccgcgaactcgccggggtgccgctggggccgaacaaccgcctgtacgccgggtcgtggagcgactgggtgagcgacgagggcaggccggtggcaacgggggaatga

SEQ ID NO: 24365 - DNA, 1053 bp, Deinococcus radiodurans
gtgccgcagcccgcaccgctcgattttgtggtggtcggcctcaatcaccagaccgcgccagtcgaggtccgcgagcgcgtcgccgtgcggcccgaggaagaaggcgcgctgctcggccacctcgcgcgccacgccgacgaggtgctgctgctcgccacctgcaaccgcaccgaggtctatctcgccggggtgcacggcgacccgctcgccgccttcgagggcgcctggggccacgcgctgctcgatcacctctacgtgtaccggggcgaggccgccgtgcggcacctctaccgcgtgacggcggggctcgacagcctcgtcatcggcgaaacccagattcagggacaggtcaaacgtgcctggcaaagtgcccgcgagcgcggtctgagcggcaccctgatgaacaaagtggtgcagggcgcactggcggcgggcaagcgggtgcgctcgcacaccggcctgagcgacaaggtggtcagcgtgtcgagcgccgccgtggaactcgcgcaggccgcgctcggtgagctctcgcagcgccgcgccctgattctgggggcgggcgaaaccgccgagctgactctgacccacctgcgggcggcaggcgtgcaggacgtgctggtggtcaaccgcaccgccgagcgggcccgcgccctcgccgaaaaactggggggccgcgcctgccccgccgaggaactgtccgccgcgctccccgaagtcgacgtggtcatcgcatcgagcgccgcgccgcactacgtggtcaccgcccagaacgtgcgcgaggcgctcgccgggcgtccgggccgcgccatgttcctgattgacatcagcgtgccgcgcatccttgaccccgagattgccagcgtgcccggcgcgcacctctacaacctcgacgacctgaccgccgtcgtgcagcgcaatatgcagagccgccgcgccgcgctcccgcaggccgaagcgatcatccgcgaactcggctcggacctcagccgctggtatctgacccgtgagacgcagctcgcccggcaagcggagctggccttggcgtgtgattga

SEQ ID NO: 24366 - DNA, 1737 bp, Deinococcus radiodurans
atgcccaagtcgccccccgtgtcccgctactacgatgtcaaacgcgacgagcagggccagcgttacatcgaggtcaaagtcaccggcctcgccctgctgcaaaacccgctgctgaacaagaccaccggctttacccccgaggagcgccgtgaactgggactcgaagggctgattccgccgcacatcagctcgttcgaggagcagaagcaccgcacctacctgcgctacctcgaagcgccgaccgaccttgcccggcacgagtacctgcgggcgctgcaagaccgcaacgaggtgctgtattacgcgattctggaagaccacctcgaagaaatgctgccgatcatctataccccaacggtgggcgaggcggtcaagctgtactccaacaattaccgctacccgcgcggctttacggtcagcaccaacgacatcgagcgggtcgaggaaatgctcgacaacgtgacggtgaacgacgtgcggatgatcgtcgccaccgattcgagcgcgattctcgggattggcgaccaggggttcggcggcatggccatcagcatcggcaagctctcgctgtacacggcggcgggcggcgtggggccggacaagacgctgccggtcgaactcgacgtgggcaccaaccggcaggacctgatcgacgaccctctctatctcggcgtgcatcaccgccgctggcaggggcagcagtacgacgagttcgtggacgccttcgtggaggcggtctcggcccgttatcccaaggcgattattcagtgggaggatttctcgcgcggaacggctttccgggtgctggagcgctaccgcaaagtggtgccgagcttcaacgacgacattcagggcaccggggcgatggcgctcgctgggctgctgcgggcgagccgcatgaaaggcgaattcctgaccgagcaggtgttcgtggtggtcggcgcgggcgcagcgggcatcggcgtggcaagcgccattcggcaagggctggaagccgagggactagcgccggaagaagcggggcggcgggtgtacgtggtggaccgctacggcctgctgatggaagggcagcccgacctggagccgcagcagatgcccttcgtgcgccgccggggagacctggagggctggacgttcgggggcgagtaccccacgctgcacgaggtgcttgttcatgcccgcgccaccgccctcctgggctttaccggggtgccgggcctgttccggcaggaagacatcgaagcgatgctggcgcacacgccccggcccatcgtctttccgctgtccaacccgtcgagccatgtcgaggcgcgccccagcgatatcgtggcgtggacgcgcggcggcgctatcgtggcgaccggcagcccctttcccgacgtgccctacgacaacgagcggattccggtggggcagggcaacaacgcttttatcttccccggtctggggttcggggcggtggtcagccgcgcccgcgaaatcaccgacaatatggtgatggccgctgccctgacgctggcggaatacaccacgcagcaccacccccacctcgtgtacccgccgatcagcgagctgcgggaactgagcattcacgttgccgtgcgggtggcggagcaagcgattcaggacggggtgtgcgccgagcggcgggtccgcaacatggaccgtgaacagctcgcagcgctcatccgcgagcgggcgtggctgccccggcccctgcctctgcggcgggaatag

SEQ ID NO: 24367 - DNA, 1011 bp, Deinococcus radiodurans
ttggctcggcgtaggctgccctccatgacccacggtaacagttctcagagcgacagaccccgcatcatcagtcccctggcaccccgcgccgacgctgccgaggtcgtgcgcggcgtggacctgaagggcaaaactgccgtcgtgactgggggcgcttccggcctcggcaccgagacggcccgcgccctgctgctcgcgggtgcccacgtcatcctgccggtgcgtgaccgtgccaagggtgagcgggtggctgcggagttgcgccagagcaccggcggcacggtggaactggtggacctcgacctcggctcgctcgcgtcggtgcggcggggcgcggcggagattcggcagctcgcgccgcgaatccacattctcatcaacaacgcgggcgtgatggcgacgccgcagagccgcaccgtggacggcttcgagacgcagttcggcaccaaccacctcggccacttcctgctgacccgtgagctgttgccggcgctgatggccgctgcgcctgcgcgggtcgtcgccctgacgagcagtgggcaccgccgcagcgacatcgtgtgggacgacctcaacttcgagcgccgcccttacgacccctgggacgcctacggccagagcaagaccgccaacgcgctgtttgccgtgggcctgacgcagcgctatgccgaccagggcctcaccgccaacgccgtgcaccccggcggcatcatgaccggcctgcaaaagtttgtgccactggaagaccagcgccgcatgggctggcaggacgaacacggcaccctcaacccggtgttcaagacccccgccgagggcgcgtccaccagcgtgtgggcggccacctctccgcaattgtacggggtgggcggcctctttctggaagacctgcaacatagcacgccgctcgacgagtccgcgcccaacccgctgttcgggtacaagccctacgcgctcgaccatgagagcgcccggcgactctgggcgctgagcgaggcgctggtgggggagtga

SEQ ID NO: 24368 - DNA, 717 bp, Deinococcus radiodurans
atgacgccgcccgctgctcccctgacccgcagcccctacactgccgccatgactcccgccgccaccatccccgagggcctgcgcgccgtcgtcttcgacttcgacggcaccattctggacaccgaaacccgcgagtttcaccactggcaagagctgtaccgcgagcatgggcgtgagctcgcgctcagcgactggcaacgcggcgtgggcacctgggacgccttcgacccctgggccgggctgcccgagcaggtgcaggccgaccgggaaaatgtccgcgcccggctgcacgacaccatcgtttcagacattgccggacaagacctgcgccccggcgtgcgggcggtgctggaaggcgtgaaggccgccgggctgcgcctcgccctggcgacgagcagtgaccgtgagtgggtcacccgttggatgcgccagcacaacctgctggacctgttcgaggcggtggcgacccgcgacgacgtgcgccgcgtcaagcccgaccccgagctgtacctgctcgccgccgcgcggctgggcctgcgccccgaggagtgccttgccgtcgaagattcctttaatggggccaccgctgccgtcgccgccggaatgcgtctggtcgtcgtgcccaacgacgtgacgcgcacccagcctttccccgccgagtggcggcggttggaggacgggtacgcgggggggctggccgggttgctaggggaatga

SEQ ID NO: 24369 - DNA, 987 bp, Deinococcus radiodurans
atgacgcagggctctgctttgcctgtgctgggcgctggcggctggggcacggcgctcgcggtggccgccgcacgggccggacaaccggcgcggctctgggctcggcgtcccgactttgccgcccggctggccgaggtgcgcgagaaccgcgagtacctgccgggcgtgctgctgccccccgaggtagcggtcacgtctgacctgcccggcgcggtggccggcgccgacttcgccctgctggttgtaccaagtgtgggcgtgcccgaactgctggccgggctgccgcgcgaactgggcgtggtgctgtgcgccaagggtctcgcgcccgacggcagccgcctgagcgagtacgcggcggggctcggctttgaccgggtggcggtcctgagcggccccaaccacgccgaggaaataggccggggcctgcccgccgccacggtggtcgccagccgcgacccggcccttgccgccgccgtgcagaccgcgctgatgtcgcccagcctgcgggtctacaccagccgtgacgtgcccggcgtggaactcggcggcgtcctgaaaaacgtgatcgcggtggctgccggcatgggcgacggtctgcacctcggcgacaatgccaaggcgaccctcctgacccgtggcctgcgtgaaatgaaccgctacctgcgttcactcggcgccgaggaggaaacggtctacggcctgagcgggctgggcgacctgatcgccaccgccaccagcccccacagccgcaaccgggcagcgggcgaggcgattgcccggggcgagagcccgcagcaaggcggcaaggtggtcgagggcctgcgtaccgctggcctgctcgacgcctgggccgctgcccacggccacgacctgcctatcgtgcgggcggtggcgcaggtcacgcgcggcgagtggtcccccgcagaaggcgtgcgtcacctgatgggccgtgaggcgaaaggggagacggaagccggggagccgtaa

SEQ ID NO: 24370 - DNA, 1395 bp, Deinococcus radiodurans
atgaccaaaacccgccaagaaaccgacacgatgggcaagatggacgtggacgccagccgctactggggcgcacagaccgagcgcagcatccacaacttcccgattgggcgcgacaccttcgtgtggggccgccccgtcatccgggcgctgggcatcctgaaaaagggcgcggcgcaggccaacgccgaactcggtgaactgcccgccgacgtggccgacctcatcgtgaaggccgccgacgaagtgattgccggcaaactcgacgaacactttccgctggtagtgttccagaccggctcgggcacccagagcaacatgaacgccaacgaggtgatttccaaccgcgccatcgaactcgccggcggcgaaatgggcagcaagaagccggtccaccccaacgaccacgtgaaccgcggccagagctccaacgacaccttccccactgccatgcacatcgcggtggtgctggaactcaacgagcggctgtacggcgcggtcggcaagctgcgcgacaccctgcacgccaaggccgagcagtacaaggacctcgtgaaagtgggccgcacccacctgcaagacgccacgcccatcacgctggggcaggaaatcggcggctgggtggcgcaactcgactacgcgctgtccgaagtcaagcacgcgggcgaaggcctgctcgacctcgccatcggcggcaccgccgtgggcaccggcctgaacgcgcaccccaaattcggtgatctggccgccaagaagtacgaagaagaaaccggctaccacttccgcagcgccgagaacaagttcgccgccctgagcgcccacgacgcgctggtgcagacctcggcggccctgcgtaccctggccggcgccctgatgaagatggcgaacgacgtgcgctggctggcgagcggcccgcgcaacggcatcggcgaaatcaccattcccgagaacgagcccggctccagcatcatgcccggcaaggtgaaccccacccagagtgaggccatgacgatggtcgccacccgcgtgttcggcaacgacgccaccgtcgcttttgccggcagccagggcaacttccagctgaacgtgttcaagccagtgatggttcacgccgtgctggaaagcattcgcctgatttccgacgcctgcctggccttcaacgaccactgcgcggtgggcatccagcccaacgaggccaagatcaaggaaaacctcgacaagaacctgatgcaggtgaccgccctcaatcgccacatcggctacgacaaggctgccgcgattgccaagaaggcccacaaggaaggcaccagcctcaaggacgccgcgctggccctgggctacgtgaccgaggacgaattcgcccagtgggtcgtgccgctgggcatgactcacaactga

SEQ ID NO: 24371 - DNA, 543 bp, Deinococcus radiodurans
ttgagttctcaagcggcattgtgtggaaccgtgccgtcccgtcaagacattgttgccatcgctgcccagactgaaaaccgcgtcatcgggcgtgatggcgggatgccctggcatttgccggctgactttgcacattttcgggcactcagcgttggcaagccaaatattatggggcgcaaggtctttgacacactgagacgtaagcctttgcccgaacgggtcaacattgtgctcacccgcaacgagaacttgaaattcgacggctgtctcatcgcccattcgcccgaagaagccctccaactcgccggagacgctcccgaaatcgccatcatcggcggcgaggagatttaccggctctactgggaccggctgacccggctggagatgacgctgattcacgcggaactggacggcgataccttcttccccgaaatcgggcctgagtgggaactggcgcaggaaaccttccgacccgccgacgagaagaatcgctacgacctgactttccagacgtggcgacggcggggctctgggcaaccatga

SEQ ID NO: 24372 - DNA, 1449 bp, Deinococcus radiodurans
atgaaacactttgaccgtgccaccaaaatcgtggcgactgtcggccccgccagccgcagcaccgaagttctcgggcgcatgatcgacgttggcctgaacgtggtccgcctcaacttcagccacggcgacctcgaagaccaccgtcagacggtgcagatggtgcgtgacctcgccgtgagcaagggcgtgaccatcggtatcctgcaagacctgcaaggccccaagattcgggtgggccgctttgccgaaggttcggtgaccctgaatcccgggcagaagttcgtcatcacgatggacgaggtggagggcaatgccgagcgcgtgggcagcacctacaagggcctcgccggtgacgtgacccccggcatgacgctgctgctcgacgacggcaacatgagcctgcgggtggaccacgtgcgcggcaacgacattcagacgactgtcctgatcggcggcacgttgaaaaacaacaagggcatcaacgtgcccgaagccgacctgaccgtgcccgcactgtcggaaaaagatgtgcaggacatggaatttggcgcgagcctcggcgtggactgggtggccttgagcttcgtgcgctcgcgcgatgacctgctgctcgcccggcattacctcgcccgcttcggcagccgcgccaagctgatggccaaaatcgagaagccgcaggcggtggaccgcttcgccgacatcctcaaggaagtggacggcgtgatggtggcgcgcggcgacctcggtgtggaaatgcgccccgagcaggtgccgaccatccagaaacgcatcatccgcatgtgccgtgaggcgggcaagccggtcattacggccacccagatgctcgaaagcatgatcaacctgccgcgccccacccgcgccgaggcgtcggacgtggcgaacgctatttatgacggcaccgacgcggtgatgctttccgccgaatcggcggcgggccagtacccggtcgagtcggtcgctatgatggaccgtattgcccgcgaggccgaagcgagcgagctttaccagttgatgcagcgtcaggtcgtgatggacaccgagcaggcgcaggacgccattgcgctcgccgcctgcaacatcggggctaagctcgaagcgcccgccatcgtgacctttaccagcacgggcggggcggccacccgcatttccaagaaccgtccgccgctcgccatcgtcgcgctgacccccaacgagatcacccgcaaccagctcgcgctttcctggggcgtctaccccatgctcagcgaagaccccgaggacaccgatgacatggtacgcatcgccaacgacgagctgaaaaagagcggcctggccgacgtgggcgaccgctacgtgattacggcgggcgtgcccttcggcgtgcgcggcaccaccaatatgctgcgcgtggaaaagttgaaggccgaggacttgtcggaccgcgtttaa

SEQ ID NO: 24373 - DNA, 2463 bp, Escherichia coli
atgcgagtgttgaagttcggcggtacatcagtggcaaatgcagaacgttttctgcgtgttgccgatattctggaaagcaatgccaggcaggggcaggtggccaccgtcctctctgcccccgccaaaatcaccaaccacctggtggcgatgattgaaaaaaccattagcggccaggatgctttacccaatatcagcgatgccgaacgtatttttgccgaacttttgacgggactcgccgccgcccagccggggttcccgctggcgcaattgaaaactttcgtcgatcaggaatttgcccaaataaaacatgtcctgcatggcattagtttgttggggcagtgcccggatagcatcaacgctgcgctgatttgccgtggcgagaaaatgtcgatcgccattatggccggcgtattagaagcgcgcggtcacaacgttactgttatcgatccggtcgaaaaactgctggcagtggggcattacctcgaatctaccgtcgatattgctgagtccacccgccgtattgcggcaagccgcattccggctgatcacatggtgctgatggcaggtttcaccgccggtaatgaaaaaggcgaactggtggtgcttggacgcaacggttccgactactctgctgcggtgctggctgcctgtttacgcgccgattgttgcgagatttggacggacgttgacggggtctatacctgcgacccgcgtcaggtgcccgatgcgaggttgttgaagtcgatgtcctaccaggaagcgatggagctttcctacttcggcgctaaagttcttcacccccgcaccattacccccatcgcccagttccagatcccttgcctgattaaaaataccggaaatcctcaagcaccaggtacgctcattggtgccagccgtgatgaagacgaattaccggtcaagggcatttccaatctgaataacatggcaatgttcagcgtttctggtccggggatgaaagggatggtcggcatggcggcgcgcgtctttgcagcgatgtcacgcgcccgtatttccgtggtgctgattacgcaatcatcttccgaatacagcatcagtttctgcgttccacaaagcgactgtgtgcgagctgaacgggcaatgcaggaagagttctacctggaactgaaagaaggcttactggagccgctggcagtgacggaacggctggccattatctcggtggtaggtgatggtatgcgcaccttgcgtgggatctcggcgaaattctttgccgcactggcccgcgccaatatcaacattgtcgccattgctcagggatcttctgaacgctcaatctctgtcgtggtaaataacgatgatgcgaccactggcgtgcgcgttactcatcagatgctgttcaataccgatcaggttatcgaagtgtttgtgattggcgtcggtggcgttggcggtgcgctgctggagcaactgaagcgtcagcaaagctggctgaagaataaacatatcgacttacgtgtctgcggtgttgccaactcgaaggctctgctcaccaatgtacatggccttaatctggaaaactggcaggaagaactggcgcaagccaaagagccgtttaatctcgggcgcttaattcgcctcgtgaaagaatatcatctgctgaacccggtcattgttgactgcacttccagccaggcagtggcggatcaatatgccgacttcctgcgcgaaggtttccacgttgtcacgccgaacaaaaaggccaacacctcgtcgatggattactaccatcagttgcgttatgcggcggaaaaatcgcggcgtaaattcctctatgacaccaacgttggggctggattaccggttattgagaacctgcaaaatctgctcaatgcaggtgatgaattgatgaagttctccggcattctttctggttcgctttcttatatcttcggcaagttagacgaaggcatgagtttctccgaggcgaccacgctggcgcgggaaatgggttataccgaaccggacccgcgagatgatctttctggtatggatgtggcgcgtaaactattgattctcgctcgtgaaacgggacgtgaactggagctggcggatattgaaattgaacctgtgctgcccgcagagtttaacgccgagggtgatgttgccgcttttatggcgaatctgtcacaactcgacgatctctttgccgcgcgcgtggcgaaggcccgtgatgaaggaaaagttttgcgctatgttggcaatattgatgaagatggcgtctgccgcgtgaagattgccgaagtggatggtaatgatccgctgttcaaagtgaaaaatggcgaaaacgccctggccttctatagccactattatcagccgctgccgttggtactgcgcggatatggtgcgggcaatgacgttacagctgccggtgtctttgctgatctgctacgtaccctctcatggaagttaggagtctga

SEQ ID NO: 24374 - DNA, 954 bp, Escherichia coli
atgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaa

SEQ ID NO: 24375 - DNA, 1917 bp, Escherichia coli
atgggtaaaataattggtatcgacctgggtactaccaactcttgtgtagcgattatggatggcaccactcctcgcgtgctggagaacgccgaaggcgatcgcaccacgccttctatcattgcctatacccaggatggtgaaactctagttggtcagccggctaaacgtcaggcagtgacgaacccgcaaaacactctgtttgcgattaaacgcctgattggtcgccgcttccaggacgaagaagtacagcgtgatgtttccatcatgccgttcaaaattattgctgctgataacggcgacgcatgggtcgaagttaaaggccagaaaatggcaccgccgcagatttctgctgaagtgctgaaaaaaatgaagaaaaccgctgaagattacctgggtgaaccggtaactgaagctgttatcaccgtaccggcatactttaacgatgctcagcgtcaggcaaccaaagacgcaggccgtatcgctggtctggaagtaaaacgtatcatcaacgaaccgaccgcagctgcgctggcttacggtctggacaaaggcactggcaaccgtactatcgcggtttatgacctgggtggtggtactttcgatatttctattatcgaaatcgacgaagttgacggcgaaaaaaccttcgaagttctggcaaccaacggtgatacccacctggggggtgaagacttcgacagccgtctgatcaactatctggttgaagaattcaagaaagatcagggcattgacctgcgcaacgatccgctggcaatgcagcgcctgaaagaagcggcagaaaaagcgaaaatcgaactgtcttccgctcagcagaccgacgttaacctgccatacatcactgcagacgcgaccggtccgaaacacatgaacatcaaagtgactcgtgcgaaactggaaagcctggttgaagatctggtaaaccgttccattgagccgctgaaagttgcactgcaggacgctggcctgtccgtatctgatatcgacgacgttatcctcgttggtggtcagactcgtatgccaatggttcagaagaaagttgctgagttctttggtaaagagccgcgtaaagacgttaacccggacgaagctgtagcaatcggtgctgctgttcagggtggtgttctgactggtgacgtaaaagacgtactgctgctggacgttaccccgctgtctctgggtatcgaaaccatgggcggtgtgatgacgacgctgatcgcgaaaaacaccactatcccgaccaagcacagccaggtgttctctaccgctgaagacaaccagtctgcggtaaccatccatgtgctgcagggtgaacgtaaacgtgcggctgataacaaatctctgggtcagttcaacctagatggtatcaacccggcaccgcgcggcatgccgcagatcgaagttaccttcgatatcgatgctgacggtatcctgcacgtttccgcgaaagataaaaacagcggtaaagagcagaagatcaccatcaaggcttcttctggtctgaacgaagatgaaatccagaaaatggtacgcgacgcagaagctaacgccgaagctgaccgtaagtttgaagagctggtacagactcgcaaccagggcgaccatctgctgcacagcacccgtaagcaggttgaagaagcaggcgacaaactgccggctgacgacaaaactgctatcgagtctgcgctgactgcactggaaactgctctgaaaggtgaagacaaagccgctatcgaagcgaaaatgcaggaactggcacaggtttcccagaaactgatggaaatcgcccagcagcaacatgcccagcagcagactgccggtgctgatgcttctgcaaacaacgcgaaagatgacgatgttgtcgacgctgaatttgaagaagtcaaagacaaaaaataa

SEQ ID NO: 24376 - DNA, 1131 bp, Escherichia coli
atggctaagcaagattattacgagattttaggcgtttccaaaacagcggaagagcgtgaaatcagaaaggcctacaaacgcctggccatgaaataccacccggaccgtaaccagggtgacaaagaggccgaggcgaaatttaaagagatcaaggaagcttatgaagttctgaccgactcgcaaaaacgtgcggcatacgatcagtatggtcatgctgcgtttgagcaaggtggcatgggcggcggcggttttggcggcggcgcagacttcagcgatatttttggtgacgttttcggcgatatttttggcggcggacgtggtcgtcaacgtgcggcgcgcggtgctgatttacgctataacatggagctcaccctcgaagaagctgtacgtggcgtgaccaaagagatccgcattccgactctggaagagtgtgacgtttgccacggtagcggtgcaaaaccaggtacacagccgcagacttgtccgacctgtcatggttctggtcaggtgcagatgcgccagggattcttcgctgtacagcagacctgtccacactgtcagggccgcggtacgctgatcaaagatccgtgcaacaaatgtcatggtcatggtcgtgttgagcgcagcaaaacgctgtccgttaaaatcccggcaggggtggacactggagaccgcatccgtcttgcgggcgaaggtgaagcgggcgagcatggcgcaccggcaggcgatctgtacgttcaggttcaggttaaacagcacccgattttcgagcgtgaaggcaacaacctgtattgcgaagtcccgatcaacttcgctatggcggcgctgggtggcgaaatcgaagtaccgacccttgatggtcgcgtcaaactgaaagtgcctggcgaaacccagaccggtaagctattccgtatgcgcggtaaaggcgtcaagtctgtccgcggtggcgcacagggtgatttgctgtgccgcgttgtcgtcgaaacaccggtaggcctgaacgaaaggcagaaacagctgctgcaagagctgcaagaaagcttcggtggcccaaccggcgagcacaacagcccgcgctcaaagagcttctttgatggtgtgaagaagttttttgacgacctgacccgctaa

SEQ ID NO: 24377 - DNA, 822 bp, Escherichia coli
atgcatgatgcaaacatccgcgttgccatcgcgggagccggggggcgtatgggccgccagttgattcaggcggcgctggcattagagggcgtgcagttgggcgctgcgctggagcgtgaaggatcttctttactgggcagcgacgccggtgagctggccggagccgggaaaacaggcgttaccgtgcaaagcagcctcgatgcggtaaaagatgattttgatgtgtttatcgattttacccgtccggaaggtacgctgaaccatctcgctttttgtcgccagcatggcaaagggatggtgatcggcactacggggtttgacgaagccggtaaacaagcaattcgtgacgccgctgccgatattgcgattgtctttgctgccaattttagcgttggcgttaacgtcatgcttaagctgctggagaaagcagccaaagtgatgggtgactacaccgatatcgaaattattgaagcacatcatagacataaagttgatgcgccgtcaggcaccgcactggcaatgggagaggcgatcgcccacgcccttgataaagatctgaaagattgcgcggtctacagtcgtgaaggccacaccggtgaacgtgtgcctggcaccattggttttgccaccgtgcgtgcaggtgacatcgttggtgaacataccgcgatgtttgccgatattggcgagcgtctggagatcacccataaggcgtccagccgtatgacatttgctaacggcgcggtaagatcggctttgtggttgagtggtaaggaaagcggtctttttgatatgcgagatgtacttgatctcaataatttgtaa

SEQ ID NO: 24378 - DNA, 1149 bp, Escherichia coli
ttgattaagtcagcgctattggttctggaagacggaacccagtttcacggtcgggccataggggcaacaggttcggcggttggggaagtcgttttcaatacttcaatgaccggttatcaagaaatcctcactgatccttcctattctcgtcaaatcgttactcttacttatccccatattggcaatgtcggcaccaatgacgccgatgaagaatcttctcaggtacatgcacaaggtctggtgattcgcgacctgccgctgattgccagcaacttccgtaataccgaagacctctcttcttacctgaaacgccataacatcgtggcgattgccgatatcgatacccgtaagctgacgcgtttactgcgcgagaaaggcgcacagaatggctgcattatcgcgggcgataacccggatgcggcgctggcgttagaaaaagcccgcgcgttcccaggtctgaatggcatggatctggcaaaagaagtgaccaccgcagaagcctatagctggacacaagggagctggacgttgaccggtggcctgccagaagcgaaaaaagaagacgagctgccgttccacgtcgtggcttatgattttggtgccaagcgcaacatcctgcggatgctggtggatagaggctgtcgcctgaccatcgttccggcgcaaacttctgcggaagatgtgctgaaaatgaatccagacggcatcttcctctccaacggtcctggcgacccggccccgtgcgattacgccattaccgccatccagaaattcctcgaaaccgatattccggtattcggcatctgtctcggtcatcagctgctggcgctggcgagcggtgcgaagactgtcaaaatgaaatttggtcaccacggcggcaaccatccggttaaagatgtggagaaaaacgtggtaatgatcaccgcccagaaccacggttttgcggtggacgaagcaacattacctgcaaacctgcgtgtcacgcataaatccctgttcgacggtacgttacagggcattcatcgcaccgataaaccggcattcagcttccaggggcaccctgaagccagccctggtccacacgacgccgcgccgttgttcgaccactttatcgagttaattgagcagtaccgtaaaaccgctaagtaa

SEQ ID NO: 24379 - DNA, 3222 bp, Escherichia coli
atgccaaaacgtacagatataaaaagtatcctgattctgggtgcgggcccgattgttatcggtcaggcgtgtgagtttgactactctggcgcgcaagcgtgtaaagccctgcgtgaagagggttaccgcgtcattctggtgaactccaacccggcgaccatcatgaccgacccggaaatggctgatgcaacctacatcgagccgattcactgggaagttgtacgcaagattattgaaaaagagcgcccggacgcggtgctgccaacgatgggcggtcagacggcgctgaactgcgcgctggagctggaacgtcagggcgtgttggaagagttcggtgtcaccatgattggtgccactgccgatgcgattgataaagcagaagaccgccgtcgtttcgacgtagcgatgaagaaaattggtctggaaaccgcgcgttccggtatcgcacacacgatggaagaagcgctggcggttgccgctgacgtgggcttcccgtgcattattcgcccatcctttaccatgggcggtagcggcggcggtatcgcttataaccgtgaagagtttgaagaaatttgcgcccgcggtctggatctctctccgaccaaagagttgctgattgatgagtcgctgatcggctggaaagagtacgagatggaagtggtgcgtgataaaaacgacaactgcatcatcgtctgctctatcgaaaacttcgatgcgatgggcatccacaccggtgactccatcactgtcgcgccagcccaaacgctgaccgacaaagaatatcaaatcatgcgtaacgcctcgatggcggtgctgcgtgaaatcggcgttgaaaccggtggttccaacgttcagtttgcggtgaacccgaaaaacggtcgtctgattgttatcgaaatgaacccacgcgtgtcccgttcttcggcgctggcgtcgaaagcgaccggtttcccgattgctaaagtggcggcgaaactggcggtgggttacaccctcgacgaactgatgaacgacatcactggcggacgtactccggcctccttcgagccgtccatcgactatgtggttactaaaattcctcgcttcaacttcgaaaaattcgccggtgctaacgaccgtctgaccactcagatgaaatcggttggcgaagtgatggcgattggtcgcacgcagcaggaatccctgcaaaaagcgctgcgcggcctggaagtcggtgcgactggattcgacccgaaagtgagcctggatgacccggaagcgttaaccaaaatccgtcgcgaactgaaagacgcaggcgcagatcgtatctggtacatcgccgatgcgttccgtgcgggcctgtctgtggacggcgtcttcaacctgaccaacattgaccgctggttcctggtacagattgaagagctggtgcgtctggaagagaaagtggcggaagtgggcatcactggcctgaacgctgacttcctgcgccagctgaaacgcaaaggctttgccgatgcgcgcttggcaaaactggcgggcgtacgcgaagcggaaatccgtaagctgcgtgaccagtatgacctgcacccggtttataagcgcgtggatacctgtgcggcagagttcgccaccgacaccgcttacatgtactccacttatgaagaagagtgcgaagcgaatccgtctaccgaccgtgaaaaaatcatggtgcttggcggcggcccgaaccgtatcggtcagggtatcgaattcgactactgttgcgtacacgcctcgctggcgctgcgcgaagacggttacgaaaccattatggttaactgtaacccggaaaccgtctccaccgactacgacacttccgaccgcctctacttcgagccggtaactctggaagatgtgctggaaatcgtgcgtatcgagaagccgaaaggcgttatcgtccagtacggcggtcagaccccgctgaaactggcgcgcgcgctggaagctgctggcgtaccggttatcggcaccagcccggatgctatcgaccgtgcagaagaccgtgaacgcttccagcatgcggttgagcgtctgaaactgaaacaaccggcgaacgccaccgttaccgctattgaaatggcggtagagaaggcgaaagagattggctacccgctggtggtacgtccgtcttacgttctcggcggtcgggcgatggaaatcgtctatgacgaagctgacctgcgtcgctacttccagacggcggtcagcgtgtctaacgatgcgccagtgttgctggaccacttcctcgatgacgcggtagaagttgacgtggatgccatctgcgacggcgaaatggtgctgattggcggcatcatggagcatattgagcaggcgggcgtgcactccggtgactccgcatgttctctgccagcctacaccttaagtcaggaaattcaggatgtgatgcgccagcaggtgcagaaactggccttcgaattgcaggtgcgcggcctgatgaacgtgcagtttgcggtgaaaaacaacgaagtctacctgattgaagttaacccgcgtgcggcgcgtaccgttccgttcgtctccaaagccaccggcgtaccgctggcaaaagtggcggcgcgcgtgatggctggcaaatcgctggctgagcagggcgtaaccaaagaagttatcccgccgtactactcggtgaaagaagtggtgctgccgttcaataaattcccgggcgttgacccgctgttagggccagaaatgcgctctaccggggaagtcatgggcgtgggccgcaccttcgctgaagcgtttgccaaagcgcagctgggcagcaactccaccatgaagaaacacggtcgtgcgctgctttccgtgcgcgaaggcgataaagaacgcgtggtggacctggcggcaaaactgctgaaacagggcttcgagctggatgcgacccacggcacggcgattgtgctgggcgaagcaggtatcaacccgcgtctggtaaacaaggtgcatgaaggccgtccgcacattcaggaccgtatcaagaatggcgaatatacctacatcatcaacaccacctcaggccgtcgtgcgattgaagactcccgcgtgattcgtcgcagtgcgctgcaatataaagtgcattacgacaccaccctgaacggcggctttgccaccgcgatggcgctgaatgccgatgcgactgaaaaagtaatttcggtgcaggaaatgcacgcacagatcaaataa

SEQ ID NO: 24380 - DNA, 1569 bp, Escherichia coli
atggatagaggtgcaatggatatcattggcggacaacatctacgtcaaatgtgggacgatcttgcggacgtttacggtcataaaacggcgctgatttgtgaatccagcggcggagtcgttaaccggtatagttatcttgagttaaatcaggagattaaccgcacggcaaacctgttttatacgctggggattcgcaaaggcgacaaggttgcactacatctcgacaactgcccggaatttatcttttgctggttcgggctggcaaaaattggcgcgattatggtgccgattaacgcccgcctgttgtgcgaggaaagcgcgtggatcctgcaaaatagccaggcgtgcctgctggtgaccagtgcgcaattctatcctatgtatcaacagattcagcaggaagatgccactcaattgcggcacatttgcctgacagatgtggcacttcccgctgatgatggcgtgagttcgtttactcaactgaaaaatcaacaacctgccaccttgtgctatgcaccgccgctatcgactgacgatacggcggaaattctcttcacctccggcaccacctcccgaccgaaaggtgtggtgattacccattacaacctgcgcttcgctggatattactccgcctggcagtgtgcactgcgtgacgatgacgtctacctgacggtaatgcctgcgtttcatatcgattgccagtgtactgcggcgatggcggcgttttctgccggggccacctttgtgctggtcgagaaatacagcgcccgcgccttctggggacaggtacagaagtaccgcgccaccgttaccgaatgtattccgatgatgatccgtacgttgatggtacagccgccttcagcgaacgatcagcaacaccgcctgcgggaagtgatgttttatctcaacttgtcggagcaggaaaaagatgcgttttgtgaacgcttcggcgttcgcttgctgacgtcttatgggatgacggaaaccattgtgggcattatcggcgatcgtcctggcgataaacgacgctggccgtcgattggtcgggtggggttttgctacgaagcggagatccgcgacgatcacaatcgcccgctcccggctggtgagatcggtgaaatctgcattaaaggcatacctgggaaaaccatcttcaaagagtactttctcaacccacaagccactgcgaaagtgctggaagccgatggctggctgcataccggcgataccggataccgcgacgaagaggactttttttatttcgtcgatcgccgctgcaatatgattaaacgtggcggcgagaatgtctcctgcgtggagctggaaaatattatcgccgcgcacccgaaaattcaggacatcgtggttgtgggtattaaagattcgattcgcgatgaagccatcaaagcatttgtggtgctgaatgaaggtgaaacattgagcgaagaggaatttttccgcttctgcgaacaaaatatggcgaaatttaaagtgccctcttatctggagatcagaaaagatctgccacgtaattgctcggggaaaataattagaaagaatctgaaataa

SEQ ID NO: 24381 - DNA, 1143 bp, Escherichia coli
atggattttaatttaaatgatgagcaggaactgtttgtcgccggtatccgcgaactgatggccagcgaaaactgggaggcctattttgccgagtgcgaccgtgacagcgtctacccggaacgttttgtcaaagcactggcggatatgggtatcgacagtctgctgatccctgaagagcacggtggtctggacgcggggtttgttactctcgccgccgtgtggatggagctgggacgtctgggggcaccaacctatgtgctgtaccagttgccgggcgggttcaacaccttcctgcgcgaaggcacacaagagcagatcgacaaaattatggctttccgcggcaccggtaagcagatgtggaactcagcgattaccgaaccgggcgcgggctccgacgtgggtagcctgaaaacgacttatacccgtagaaatggtaagatttatcttaatggtagtaagtgttttattaccagcagcgcctacaccccgtacatcgtggtgatggcgcgcgacggggcttctccggacaaacctgtctacaccgaatggtttgttgatatgagcaaaccgggcatcaaagtgaccaaacttgaaaagctcggtctgcgtatggatagctgctgtgaaatcacctttgacgacgtggaactggacgagaaagacatgttcggtcgggaaggtaacggctttaaccgcgtcaaagaagagttcgaccatgaacgtttcctggtagccctcaccaactacggtacggcgatgtgcgcctttgaagatgcggcgcgctacgccaatcagcgcgtgcagtttggcgaggctattggtcgtttccagttgattcaggaaaaattcgcccacatggcgatcaaattaaactccatgaaaaacatgctgtatgaagcagcgtggaaagcagacaacggcaccatcacctctggcgatgcagcgatgtgcaaatacttctgcgccaatgcggcatttgaagttgtggatagcgcaatgcaggtgctgggcggtgtcgggattgcgggcaaccaccgcatcagccgcttctggcgtgatctgcgtgtagaccgcgtctccgggggatctgacgaaatgcagatcctgacgctgggtcgtgcggtgctgaagcaataccgctaa

SEQ ID NO: 24382 - DNA, 1332 bp, Escherichia coli
atgcaaccgtccagaaactttgacgatctcaaattctcctctattcaccgccgcattttgctgtggggaagcggtggtccgtttctggatggttatgtactggtaatgattggcgtggcgctggagcaactgacgccggcgctgaaactggacgctgactggattggcttgctgggcgcgggaacgctcgccgggctgttcgttggcacatcgctgtttggttatatttccgataaagtcggacggcgcaaaatgttcctcattgatatcatcgccatcggcgtgatatcggtggcgacgatgtttgtttcatcccccgtcgaactgttggtgatgcgggtacttatcggcattgtcatcggtgcagattatcccatcgccacctcaatgatcaccgagttctccagtacccgtcagcgggcgttttccatcagctttattgccgcgatgtggtatgtcggcgcgacctgtgccgatctggtcggctactggctttatgatgtggaaggcggctggcgctggatgctgggtagcgcggcgatcccctgtttgttgattttgattggtcgattcgaactgcctgaatctccccgctggttattacgcaaagggcgagtaaaagagtgcgaagagatgatgatcaaactgtttggcgaaccggtggctttcgatgaagagcagccgcagcaaacccgttttcgcgatctgtttaatcgccgccattttccttttgttctgtttgttgccgccatctggacctgccaggtgatcccaatgttcgccatttacacctttggcccgcaaatcgttggtttgttgggattgggggttggcaaaaacgcggcactagggaatgtggtgattagcctgttctttatgctcggctgtattccgccgatgctgtggttaaacactgccggacggcgtccattgttgattggcagctttgccatgatgacgctggcgctggcggttttggggctaatcccggatatggggatctggctggtagtgatggcctttgcggtgtatgcctttttctctggcgggccgggtaatttgcagtggctctatcctaatgaactcttcccgacagatatccgcgcctctgccgtgggcgtgattatgtccttaagtcgtattggcaccattgtttcgacctgggcactaccgatctttatcaataattacggtatcagtaacacgatgctaatgggggcgggtatctcgctgtttggcttgttgatttccgtagcgtttgccccggagactcgagggatgtcactggcgcagaccagcaatatgacgatccgcgggcagagaatggggtaa

SEQ ID NO: 24383 - DNA, 480 bp, Escherichia coli
atgatcagtctgattgcggcgttagcggtagatcgcgttatcggcatggaaaacgccatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgggtacggacgatcgcgtaacgtgggtgaagtcggtggatgaagccatcgcggcgtgtggtgacgtaccagaaatcatggtgattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcggtaa

SEQ ID NO: 24384 - DNA, 2352 bp, Escherichia coli
gtggcgcaggcaggttttatcttaacccgacactggcgggacaccccgcaagggacagaagtctccttctggctggcgacggacaacgggccgttgcaggttacgcttgcaccgcaagagtccgtggcgtttattcccgccgatcaggttccccgcgctcagcatattttgcagggtgaacaaggctttcgcctgacaccgctggcgttaaaggattttcaccgccagccggtgtatggcctttactgtcgcgcccatcgccaattgatgaattacgaaaagcgcctgcgtgaaggtggcgttaccgtctacgaggccgatgtgcgtccgccagaacgctatctgatggagcggtttatcacctcaccggtgtgggtcgagggtgatatgcacaatggcactatcgttaatgcccgtctgaaaccgcatcccgactatcgtccgccgctcaagtgggtttctatagatattgaaaccacccgccacggtgagctgtactgcatcggcctggaaggctgcgggcagcgcatcgtttatatgctggggccggagaatggcgacgcctcctcgcttgatttcgaactggaatacgtcgccagccgcccgcagttgctggaaaaactcaacgcctggtttgccaactacgatcctgatgtgatcatcggttggaacgtggtgcagttcgatctgcgaatgctgcaaaaacatgccgagcgttaccgtcttccgctgcgtcttgggcgcgataatagcgagctggagtggcgcgagcacggctttaaaaacggcgtcttttttgcccaggctaaaggtcggctaattatcgacggtatcgaggcgctgaaatccgcgttctggaatttctcttcattctcgctggaaactgtcgctcaggagctattaggcgaaggaaaatctatcgataacccgtgggatcgaatggacgaaattgaccgccgtttcgccgaagataaacctgcgctggcaacttataacctgaaagattgcgagctggtgacgcagatcttccacaaaactgaaatcatgccatttttactcgaacgggcaacggtgaacggcctgccggtggaccgacacggcggttcggtggcggcatttggtcatctctattttccgcgaatgcatcgcgctggttatgtcgcgcctaatctcggcgaagtgccgccgcacgccagccctggcggctacgtgatggattcacggccagggctttatgattcagtgctggtgctggactataaaagcctgtacccgtcgatcatccgcacctttctgattgatcccgtcgggctggtggaaggcatggcgcagcctgatccagagcacagtaccgaaggttttctcgatgcctggttctcgcgagaaaaacattgcctgccggagattgtgactaacatctggcacgggcgcgatgaagccaaacgccagggtaacaaaccgctgtcgcaggcgctgaaaatcatcatgaatgccttttatggcgtgctcggcaccaccgcctgccgcttcttcgatccgcggctggcatcgtcgatcaccatgcgtggtcatcagatcatgcggcaaaccaaagcgttgattgaagcacagggctacgacgttatctacggcgataccgactcaacgtttgtctggctgaaaggcgcacattcggaagaagaagcggcgaaaatcggtcgtgcactggtgcagcacgttaacgcctggtgggcggaaacgctgcaaaaacaacggctgaccagcgcattagaactggagtatgaaacccatttctgccgttttctgatgccaaccattcgcggagccgataccggcagtaaaaagcgttatgccggactgattcaggagggcgacaagcagcggatggtgtttaaagggctggaaaccgtgcgcaccgactggacgccgctggcccagcagtttcagcaggagctatacctgcgcatcttccgcaacgagccatatcaggaatatgtacgcgaaaccatcgacaaactgatggcgggtgaactggatgcgcgactggtttaccgtaaacgccttcgccgtccgctgagcgagtatcagcgtaatgtgccgcctcatgtacgcgccgctcgccttgccgatgaagaaaaccaaaagcgtggtcgccccttgcaatatcagaatcgcggcaccattaagtacgtatggaccaccaacggcccggagccgctggactaccaacgttcaccactggattacgaacactatctgacccgccagctacaacccgtggcggagggaatactcccttttattgaggataattttgctacacttatgaccgggcaacttgggctattttga

SEQ ID NO: 24385 - DNA, 1503 bp, Escherichia coli
atgacgatttttgataattatgaagtgtggtttgtcattggcagccagcatctgtatggcccggaaaccctgcgtcaggtcacccaacatgccgagcacgtcgttaatgcgctgaatacggaagcgaaactgccctgcaaactggtgttgaaaccgctgggcaccacgccggatgaaatcaccgctatttgccgcgacgcgaattacgacgatcgttgcgctggtctggtggtgtggctgcacaccttctccccggccaaaatgtggatcaacggcctgaccatgctcaacaaaccgttgctgcaattccacacccagttcaacgcggcgctgccgtgggacagtatcgatatggactttatgaacctgaaccagactgcacatggcggtcgcgagttcggcttcattggcgcgcgtatgcgtcagcaacatgccgtggttaccggtcactggcaggataaacaagcccatgagcgtatcggctcctggatgcgtcaggcggtctctaaacaggatacccgtcatctgaaagtctgccgatttggcgataacatgcgtgaagtggcggtcaccgatggcgataaagttgccgcacagatcaagttcggtttctccgtcaatacctgggcggttggcgatctggtgcaggtggtgaactccatcagcgacggcgatgttaacgcgctggtcgatgagtacgaaagctgctacaccatgacgcctgccacacaaatccacggcaaaaaacgacagaacgtgctggaagcggcgcgtattgagctggggatgaagcgtttcctggaacaaggtggcttccacgcgttcaccaccacctttgaagatttgcacggtctgaaacagcttcctggtctggccgtacagcgtctgatgcagcagggttacggctttgcgggcgaaggcgactggaaaactgccgccctgcttcgcatcatgaaggtgatgtcaaccggtctgcagggcggcacctcctttatggaggactacacctatcacttcgagaaaggtaatgacctggtgctcggctcccatatgctggaagtctgcccgtcgatcgccgcagaagagaaaccgatcctcgacgttcagcatctcggtattggtggtaaggacgatcctgcccgcctgatcttcaatacccaaaccggcccagcgattgtcgccagcttgattgatctcggcgatcgttaccgtctactggttaactgcatcgacacggtgaaaacaccgcactccctgccgaaactgccggtggcgaatgcgctgtggaaagcgcaaccggatctgccaactgcttccgaagcgtggatcctcgctggtggcgcgcaccataccgtcttcagccatgcactgaacctcaacgatatgcgccaattcgccgagatgcacgacattgaaatcacggtgattgataacgacacacgcctgccagcgtttaaagacgcgctgcgctggaacgaagtgtattacgggtttcgtcgctaa

SEQ ID NO: 24386 - DNA, 1095 bp, Escherichia coli
gtgatgtcgaagaattaccatattgccgtattgccgggggacggtattggtccggaagtgatgacccaggcgctgaaagtgctggatgccgtgcgcaaccgctttgcgatgcgcatcaccaccagccattacgatgtaggcggcgcagccattgataaccacgggcaaccactgccgcctgcgacggttgaaggttgtgagcaagccgatgccgtgctgtttggctcggtaggcggcccgaagtgggaacatttaccaccagaccagcaaccagaacgcggcgcgctgctgcctctgcgtaagcacttcaaattattcagcaacctgcgcccggcaaaactgtatcaggggctggaagcattctgtccgctgcgtgcagacattgccgcaaacggcttcgacatcctgtgtgtgcgcgaactgaccggcggcatctatttcggtcagccaaaaggccgcgaaggtagcggacaatatgaaaaagcctttgataccgaggtgtatcaccgttttgagatcgaacgtatcgcccgcatcgcgtttgaatctgctcgcaagcgtcgccacaaagtgacgtcgatcgataaagccaacgtgctgcaatcctctattttatggcgggagatcgttaacgagatcgccacggaatacccggatgtcgaactggcgcatatgtacatcgacaacgccaccatgcagctgattaaagatccatcacagtttgacgttctgctgtgctccaacctgtttggcgacattctgtctgacgagtgcgcaatgatcactggctcgatggggatgttgccttccgccagcctgaacgagcaaggttttggactgtatgaaccggcgggcggctcggcaccagatatcgcaggcaaaaacatcgccaacccgattgcacaaatcctttcgctggcactgctgctgcgttacagcctggatgccgatgatgcggcttgcgccattgaacgcgccattaaccgcgcattagaagaaggcattcgcaccggggatttagcccgtggcgctgccgccgttagtaccgatgaaatgggcgatatcattgcccgctatgtagcagaaggggtgtaa

SEQ ID NO: 24387 - DNA, 1374 bp, Escherichia coli
atgatggaaggtcaacagcacggcgagcagctaaagcgcggccttaaaaaccgccatattcagcttatcgcgctgggtggcgcgatagggaccgggttattcctgggtagcgcctccgtaatacagtccgcagggccagggattatcctgggttacgccattgctggttttatcgcctttctgatcatgcgtcagctgggtgaaatggtggtcgaagaacctgtcgcaggctcctttagccactttgcttataaatactggggcagttttgccggtttcgcctctggctggaactactgggtactgtacgttttagttgccatggctgagctgactgccgtgggtaaatacattcagttctggtatccggaaatccccacctgggtttctgccgccgtattctttgtggtgattaacgccatcaacctgaccaacgttaaagtgtttggcgagatggagttctggtttgccattatcaaagttatcgcggtggtagcgatgatcatcttcggcggctggctgctattcagtggcaacggcggcccgcaggcgaccgttagcaacctgtgggatcagggtggtttcctgccgcacggcttcaccgggctggtgatgatgatggcgattatcatgttctcgttcggtggtctggaactggtggggatcaccgcagcagaagctgataacccggagcaaagtataccgaaagcaactaaccaggttatctaccgcatcctgattttctatattggttcgttagccgttctgctctcactgatgccgtggacccgcgttaccgccgataccagtccgtttgtgctgatcttccacgagttaggcgatacctttgtggcgaatgcgctgaacatcgtggtactgactgcggcgctctccgtgtacaacagctgcgtatattgcaacagccgtatgctgtttggtctggcacaacagggtaatgcgccaaaagcgctggcgtctgtcgataaacgtggtgtaccagtaaataccattctggtgtctgcactggtaacggcgttgtgcgtactgattaactaccttgccccagagtccgctttcggactgttaatggcgctggtggtatctgcactggtaatcaactgggcgatgattagcctggcgcatatgaaattccgtcgcgccaagcaggaacaaggcgtggtaactcgcttccctgctctgctttatccgctgggtaactggatctgcctgctgtttatggcggcggtactggtgattatgctgatgaccccaggaatggcgatttcggtatacctgatcccggtatggctgatcgtgttaggtatcggctatctgtttaaagagaaaaccgccaaagccgtaaaagcgcattaa

SEQ ID NO: 24388 - DNA, 1893 bp, Escherichia coli
atggctatcgaaatcaaagtaccggacatcggggctgatgaagttgaaatcaccgagatcctggtcaaagtgggcgacaaagttgaagccgaacagtcgctgatcaccgtagaaggcgacaaagcctctatggaagttccgtctccgcaggcgggtatcgttaaagagatcaaagtctctgttggcgataaaacccagaccggcgcactgattatgattttcgattccgccgacggtgcagcagacgctgcacctgctcaggcagaagagaagaaagaagcagctccggcagcagcaccagcggctgcggcggcaaaagacgttaacgttccggatatcggcagcgacgaagttgaagtgaccgaaatcctggtgaaagttggcgataaagttgaagctgaacagtcgctgatcaccgtagaaggcgacaaggcttctatggaagttccggctccgtttgctggcaccgtgaaagagatcaaagtgaacgtgggtgacaaagtgtctaccggctcgctgattatggtcttcgaagtcgcgggtgaagcaggcgcggcagctccggccgctaaacaggaagcagctccggcagcggcccctgcaccagcggctggcgtgaaagaagttaacgttccggatatcggcggtgacgaagttgaagtgactgaagtgatggtgaaagtgggcgacaaagttgccgctgaacagtcactgatcaccgtagaaggcgacaaagcttctatggaagttccggcgccgtttgcaggcgtcgtgaaggaactgaaagtcaacgttggcgataaagtgaaaactggctcgctgattatgatcttcgaagttgaaggcgcagcgcctgcggcagctcctgcgaaacaggaagcggcagcgccggcaccggcagcaaaagctgaagccccggcagcagcaccagctgcgaaagcggaaggcaaatctgaatttgctgaaaacgacgcttatgttcacgcgactccgctgatccgccgtctggcacgcgagtttggtgttaaccttgcgaaagtgaagggcactggccgtaaaggtcgtatcctgcgcgaagacgttcaggcttacgtgaaagaagctatcaaacgtgcagaagcagctccggcagcgactggcggtggtatccctggcatgctgccgtggccgaaggtggacttcagcaagtttggtgaaatcgaagaagtggaactgggccgcatccagaaaatctctggtgcgaacctgagccgtaactgggtaatgatcccgcatgttactcacttcgacaaaaccgatatcaccgagttggaagcgttccgtaaacagcagaacgaagaagcggcgaaacgtaagctggatgtgaagatcaccccggttgtcttcatcatgaaagccgttgctgcagctcttgagcagatgcctcgcttcaatagttcgctgtcggaagacggtcagcgtctgaccctgaagaaatacatcaacatcggtgtggcggtggataccccgaacggtctggttgttccggtattcaaagacgtcaacaagaaaggcatcatcgagctgtctcgcgagctgatgactatttctaagaaagcgcgtgacggtaagctgactgcgggcgaaatgcagggcggttgcttcaccatctccagcatcggcggcctgggtactacccacttcgcgccgattgtgaacgcgccggaagtggctatcctcggcgtttccaagtccgcgatggagccggtgtggaatggtaaagagttcgtgccgcgtctgatgctgccgatttctctctccttcgaccaccgcgtgatcgacggtgctgatggtgcccgtttcattaccatcattaacaacacgctgtctgacattcgccgtctggtgatgtaa

SEQ ID NO: 24389 - DNA, 1425 bp, Escherichia coli
atgagtactgaaatcaaaactcaggtcgtggtacttggggcaggccccgcaggttactccgctgccttccgttgcgctgatttaggtctggaaaccgtaatcgtagaacgttacaacacccttggcggtgtttgcctgaacgtcggctgtatcccttctaaagcactgctgcacgtagcaaaagttatcgaagaagccaaagcgctggctgaacacggtatcgtcttcggcgaaccgaaaaccgatatcgacaagattcgtacctggaaagagaaagtgatcaatcagctgaccggtggtctggctggtatggcgaaaggccgcaaagtcaaagtggtcaacggtctgggtaaattcaccggggctaacaccctggaagttgaaggtgagaacggcaaaaccgtgatcaacttcgacaacgcgatcattgcagcgggttctcgcccgatccaactgccgtttattccgcatgaagatccgcgtatctgggactccactgacgcgctggaactgaaagaagtaccagaacgcctgctggtaatgggtggcggtatcatcggtctggaaatgggcaccgtttaccacgcgctgggttcacagattgacgtggttgaaatgttcgaccaggttatcccggcagctgacaaagacatcgttaaagtcttcaccaagcgtatcagcaagaaattcaacctgatgctggaaaccaaagttaccgccgttgaagcgaaagaagacggcatttatgtgacgatggaaggcaaaaaagcacccgctgaaccgcagcgttacgacgccgtgctggtagcgattggtcgtgtgccgaacggtaaaaacctcgacgcaggcaaagcaggcgtggaagttgacgaccgtggtttcatccgcgttgacaaacagctgcgtaccaacgtaccgcacatctttgctatcggcgatatcgtcggtcaaccgatgctggcacacaaaggtgttcacgaaggtcacgttgccgctgaagttatcgccggtaagaaacactacttcgatccgaaagttatcccgtccatcgcctataccgaaccagaagttgcatgggtgggtctgactgagaaagaagcgaaagagaaaggcatcagctatgaaaccgccaccttcccgtgggctgcttctggtcgtgctatcgcttccgactgcgcagacggtatgaccaagctgattttcgacaaagaatctcaccgtgtgatcggtggtgcgattgtcggtactaacggcggcgagctgctgggtgaaatcggcctggcaatcgaaatgggttgtgatgctgaagacatcgcactgaccatccacgcgcacccgactctgcacgagtctgtgggcctggcggcagaagtgttcgaaggtagcattaccgacctgccgaacccgaaagcgaagaagaagtaa

SEQ ID NO: 24390 - DNA, 2391 bp, Escherichia coli
atggcaattaacaatacaggctcgcgacgattactcgtcacgctaacagccctttttgcagcgctttgcgggctgtatctactcattggcggaggctggctggtcgcgattggcggctcctggtactaccctatcgctggccttgtgatgctcggcgtcgcctggatgctgtggcgcagtaaacgcgccgcgctttggctatacgcagccctgctgctcggcaccatgatttggggcgtctgggaagttggtttcgacttctgggcgctgactccgcgcagcgacattctggtcttcttcggcatctggctgatcctgccgtttgtctggcgtcgcctggtcattcctgccagcggcgcagttgccgcactggtggtcgcactgctgattagcggtggtatcctgacctgggccggatttaacgatccgcaggagatcaacggcaccttaagcgccgatgccacacctgctgaagctatctcccccgtagccgatcaggactggcctgcctatggtcgtaatcaggaaggtcaacgcttttcgccgctgaaacaaattaacgccgataacgtccataatctgaaagaagcctgggtgttccgtactggcgatgtgaagcagccgaacgatccgggtgaaatcaccaatgaagtgacgccgattaaagtgggcgacaccctttacctgtgtaccgctcaccagcgcctgtttgcgcttgatgccgccagcggcaaagagaaatggcattacgatcctgagctgaaaaccaacgagtctttccagcacgtaacctgccgtggtgtctcttatcatgaagccaaagcagaaaccgcttcgccggaagtgatggcggattgcccgcgtcgtatcattcttccggtcaatgatggtcgactgattgcgattaacgctgaaaacggcaaactgtgcgaaaccttcgccaataaaggcgtgctcaatctgcaaagcaatatgccagacaccaaaccgggtctgtatgaaccgacttcgccaccgattatcaccgataaaaccatcgtgatggccggttcagttaccgataacttctcaacccgcgaaacgtctggcgtgatccgtggttttgatgtcaacaccggggagctgctgtgggcttttgatcccggcgcgaaagatccgaacgcaatcccgtctgacgaacacacctttacctttaactcgccaaactcctgggcaccagcggcctatgacgcgaagctggatctggtctatctgccgatgggcgtgaccacgccggatatctggggcggtaaccgcacaccggaacaggaacgttatgccagctcgattctggcgctgaatgccactaccgggaaactggcgtggagctaccagaccgttcaccacgacctgtgggacatggatcttccggcacagccgacgctggcggacatcaccgttaatggtcagaaagtgccagttatttacgctccggcgaaaaccggcaacatttttgtgctcgatcgtcgtaatggcgaactggtggttccggcaccggaaaaaccggttccccaaggtgcagcgaaaggcgattacgtaaccccaactcaaccgttttctgaactgagcttccgtccgacgaaagatttgagcggtgcggatatgtggggagccaccatgtttgaccaactggtgtgccgcgtgatgttccaccagatgcgctatgaaggcattttcaccccgccatctgaacagggtacgctggtcttcccgggtaacctggggatgttcgaatggggcgggatttccgttgatccaaatcgtgaagtggcgattgccaacccaatggcactgccgtttgtttcgaaactgatcccgcgtggtcctggcaacccgatggagcagccgaaagatgccaaaggcacgggtacggaatccggcattcagccacagtacggtgtaccgtatggtgtcacgctcaacccgttcctctcaccatttggtctgccatgtaaacagccagcatggggttatatctcggcgctggatctgaaaactaatgaagtggtgtggaagaaacgtattggtacgccgcaggacagtatgccgttcccgatgccggttccggtgccgttcaatatgggtatgccgatgctgggcgggccaatctccacggcgggtaacgtgctgtttatcgccgctacggcagataactacctgcgcgcttacaacatgagcaacggtgaaaaactgtggcagggtcgtttaccagcgggtggtcaggctacgccaatgacctatgaagtgaatggtaagcagtatgtggtgatctccgcaggcggtcacggttcatttggtacgaagatgggcgactatattgtggcttatgcgctgccggatgatgtgaagtaa

SEQ ID NO: 24391 - DNA, 549 bp, Escherichia coli
atggttagagatatgaaacatactgtagaagtaatgatccccgaagcggagattaaagcgcgtatcgccgaactgggtcgtcagattactgagcgttacaaagacagcggcagcgatatggtgctggtgggtctgctgcgtggctcatttatgtttatggcggacctgtgccgtgaagttcaggtatctcatgaagtcgactttatgaccgcctccagctacggtagcggcatgtccaccacccgtgatgtgaaaatcctcaaagatctggatgaagatatccgtggcaaggacgtgctgattgttgaagatatcatcgactcggggaatacactgtcgaaagtgcgtgagatcttaagcctgcgcgaaccgaagtcgctggcgatttgtacgctgctggataaaccgtcccgtcgtgaagtgaacgtcccggtagaatttatcggtttctcgatcccggatgagtttgtggtgggttacggcattgattacgcacagcgttaccgtcatctgccgtatatcggcaaagtgattctgctggacgagtaa

SEQ ID NO: 24392 - DNA, 927 bp, Escherichia coli
atgaccattgcactggaacttcaacagcttaaaaaaacctatccaggcggcgttcaggcgcttcgtgggatagatttgcaggtcgaagcgggtgatttttatgcgcttctcgggccgaacggggccgggaaatcgaccactatcggtattatcagctctctggtaaataaaacctccgggcgggtcagcgtatttggttacgatctcgagaaggatgtcgtgaacgctaaacgtcagttgggactggtgccgcaggaatttaacttcaacccgtttgaaaccgtgcagcaaattgtggtgaatcaggcagggtactacggcgtggagcgcaaagaagcgtacatccgcagcgaaaagtatcttaaacaactcgatctatggggaaaacgcaacgaacgtgcgcgtatgttatctggcgggatgaagcgccgtttaatgattgcccgtgcgttaatgcatgaacctaaactactgattctcgacgaaccgaccgcaggcgtggatattgaacttcgccgctcaatgtggggctttttgaaggatttaaacgacaaaggcaccaccatcattctcaccacacactacctggaagaagcagaaatgctgtgccgcaatatcggcattattcaacacggtgagctggtggaaaatacctcgatgaaggcgctgctggcgaagctgaaatcggaaacctttattctcgatctcgcaccgaaaagcccgttaccgaagctcgatggctatcagtatcgactggtcgataccgcgacgctggaagttgaagtgctgcgtgagcaggggatcaacagcgtatttacgcagttaagtgagcagggcattcaggtattaagtatgcgtaacaaagctaaccgtctggaagagctgtttgtttcactggttaatgaaaaacaaggagatcgcgcatga

SEQ ID NO: 24393 - DNA, 1281 bp, Escherichia coli
atgagtaagtctgaaaatctttacagcgcagcgcgcgagctgatccctggcggtgtgaactcccctgttcgcgcctttactggcgtgggcggcactccactgtttatcgaaaaagcggacggcgcttatctgtacgatgttgatggcaaagcctatatcgattatgtcggttcctgggggccgatggtgctgggccataaccatccggcaatccgcaatgccgtgattgaagccgccgagcgtggtttaagctttggtgcaccaaccgaaatggaagtgaaaatggcgcaactggtgaccgaactggtcccgaccatggatatggtgcgcatggtgaactccggcactgaagcgaccatgagcgccatccgcctggcccgtggttttaccggtcgcgacaaaattattaaatttgaagggtgttaccatggtcacgctgactgcctgctggtgaaagccggttctggcgcactcacgttaggccagccaaactcgccgggcgttccggcagatttcgccaaatataccttaacctgtacttataatgatctggcttctgtacgcgccgcatttgagcaatacccgcaagagattgcctgtattatcgtcgagccggtggcaggcaatatgaactgtgttccgccgctgccagagttcctgccaggtctgcgcgcgctgtgcgacgaatttggcgcgttgctgatcatcgatgaagtgatgaccggtttccgcgtagcgctagctggcgcacaggattattacggcgtagtgccagatttaacctgcctcggcaaaatcatcggcggtggaatgccggtaggcgcattcggtggtcgtcgtgatgtaatggatgcgctggccccgacgggtccggtctatcaggcgggtacgctttccggtaacccgattgcgatggcagcgggtttcgcctgtctgaatgaagtcgcgcagccgggcgttcacgaaacgctggatgagctgacaacacgtctggcagaaggtctgctggaagcggcagaagaagccggaattccgctggtcgttaaccacgttggcggcatgttcggtattttctttaccgacgccgagtccgtgacgtgctatcaggatgtgatggcctgtgacgtggaacgctttaagcgtttcttccatatgatgctggacgaaggtgtttacctggcaccgtcagcgtttgaagcgggctttatgtccgtggcgcacagcatggaagatatcaataacaccatcgatgctgcacgtcgggtgtttgcgaagttgtga

SEQ ID NO: 24394 - DNA, 456 bp, Escherichia coli
ttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctga

SEQ ID NO: 24395 - DNA, 2142 bp, Escherichia coli
atgaacatcattgccattatgggaccgcatggcgtcttttataaagatgagcccatcaaagaactggagtcggcgctggtggcgcaaggctttcagattatctggccacaaaacagcgttgatttgctgaaatttatcgagcataaccctcgaatttgcggcgtgatttttgactgggatgagtacagtctcgatttatgtagcgatatcaatcagcttaatgaatatctcccgctttatgccttcatcaacacccactcgacgatggatgtcagcgtgcaggatatgcggatggcgctctggttttttgaatatgcgctggggcaggcggaagatatcgccattcgtatgcgtcagtacaccgacgaatatcttgataacattacaccgccgttcacgaaagccttgtttacctacgtcaaagagcggaagtacaccttttgtacgccggggcatatgggcggcaccgcatatcaaaaaagcccggttggctgtctgttttatgattttttcggcgggaatactcttaaggctgatgtctctatttcggtcaccgagcttggttcgttgctcgaccacaccgggccacacctggaagcggaagagtacatcgcgcggacttttggcgcggaacagagttatatcgttaccaacggaacatcgacgtcgaacaaaattgtgggtatgtacgccgcgccatccggcagtacgctgttgatcgaccgcaattgtcataaatcgctggcgcatctgttgatgatgaacgatgtagtgccagtctggctgaaaccgacgcgtaatgcgttggggattcttggtgggatcccgcgccgtgaatttactcgcgacagcatcgaagagaaagtcgctgctaccacgcaagcacaatggccggttcatgcggtgatcaccaactccacctatgatggcttgctctacaacaccgactggatcaaacagacgctggatgtcccgtcgattcacttcgattctgcctgggtgccgtacacccattttcatccgatctaccagggtaaaagtggtatgagcggcgagcgtgttgcgggaaaagtgatcttcgaaacgcaatcgacccacaaaatgctggcggcgttatcgcaggcttcgctgatccacattaaaggcgagtatgacgaagaggcctttaacgaagcctttatgatgcataccaccacctcgcccagttatcccattgttgcttcggttgagacggcggcggcgatgctgcgtggtaatccgggcaaacggctgattaaccgttcagtagaacgagctctgcattttcgcaaagaggtccagcggctgcgggaagagtctgacggttggtttttcgatatctggcaaccgccgcaggtggatgaagccgaatgctggcccgttgcgcctggcgaacagtggcacggctttaacgatgcggatgccgatcatatgtttctcgatccggttaaagtcactattttgacaccggggatggacgagcagggcaatatgagcgaggaggggatcccggcggcgctggtagcaaaattcctcgacgaacgtgggatcgtagtagagaaaaccggcccttataacctgctgtttctctttagtattggcatcgataaaaccaaagcaatgggattattgcgtgggttgacggaattcaaacgctcttacgatctcaacctgcggatcaaaaatatgctacccgatctctatgcagaagatcccgatttctaccgcaatatgcgtattcaggatctggcacaagggatccataagctgattcgtaaacacgatcttcccggtttgatgttgcgggcattcgatactttgccggagatgatcatgacgccacatcaggcatggcaacgacaaattaaaggcgaagtagaaaccattgcgctggaacaactggtcggtagagtatcggcaaatatgatcctgccttatccaccgggcgtaccgctgttgatgcctggagaaatgctgaccaaagagagccgcacagtactcgattttctactgatgctttgttccgtcgggcaacattaccccggttttgaaacggatattcacggcgcgaaacaggacgaagacggcgtttaccgcgtacgagtcctaaaaatggcgggataa

SEQ ID NO: 24396 - DNA, 804 bp, Escherichia coli
atggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaa

SEQ ID NO: 24397 - DNA, 756 bp, Escherichia coli
atgaatcttaacagtattcccgcctttgatgacaattacatctgggttttgaatgatgaagcaggtcgctgcctgattgtcgatcccggagacgcagagccagtattaaacgccattgccgccaataactggcaaccggaggccatatttctcacccaccatcaccacgatcacgttggcggcgtaaaagaactggtggaaaagtttccacaaattgtggtgtatggtccacaagagacacaagataagggaacaacacaggtagtcaaagatggcgaaactgccttcgttttggggcatgaatttagtgtaattgctacgccgggtcacactttaggacatatctgttacttcagtaaaccttatctattttgcggcgacacactgttttctggtgggtgtggtcggttgtttgaagggacagcatcacaaatgtatcaatcacttaaaaagttaagtgcgttacctgacgatacattggtatgttgtgctcatgaatataccttatcaaatatgaagtttgctttgagtattcttccgcacgatttgtccataaatgattattatcgtaaagttaaggagttacgggcaaaaaatcaaataacactacccgtaattctgaaaaatgagcggcaaattaatgtttttttaagaacggaagatattgatttaattaatgtaattaatgaagaaacattattgcaacaacctgaagagcgttttgcatggttaaggtcaaagaaagataggttctga

SEQ ID NO: 24398 - DNA, 459 bp, Escherichia coli
atgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaa

SEQ ID NO: 24399 - DNA, 1254 bp, Escherichia coli
atgctggaacaaatgggcattgccgcgaagcaagcctcgtataaattagcgcaactctccagccgcgaaaaaaatcgcgtgctggaaaaaatcgccgatgaactggaagcacaaagcgaaatcatcctcaacgctaacgcccaggatgttgctgacgcgcgagccaatggccttagcgaagcgatgcttgaccgtctggcactgacgcccgcacggctgaaaggcattgccgacgatgtacgtcaggtgtgcaacctcgccgatccggtggggcaggtaatcgatggcggcgtactggacagcggcctgcgtcttgagcgtcgtcgcgtaccgctgggggttattggcgtgatttatgaagcgcgcccgaacgtgacggttgatgtcgcttcgctgtgcctgaaaaccggtaatgcggtgatcctgcgcggtggcaaagaaacgtgtcgcactaacgctgcaacggtggcggtgattcaggacgccctgaaatcctgcggcttaccggcgggtgccgtgcaggcgattgataatcctgaccgtgcgctggtcagtgaaatgctgcgtatggataaatacatcgacatgctgatcccgcgtggtggcgctggtttgcataaactgtgccgtgaacagtcgacaatcccggtgatcacaggtggtataggcgtatgccatatttacgttgatgaaagtgtagagatcgctgaagcattaaaagtgatcgtcaacgcgaaaactcagcgtccgagcacatgtaatacggttgaaacgttgctggtgaataaaaacatcgccgatagcttcctgcccgcattaagcaaacaaatggcggaaagcggcgtgacattacacgcagatgcagctgcactggcgcagttgcaggcaggccctgcgaaggtggttgctgttaaagccgaagagtatgacgatgagtttctgtcattagatttgaacgtcaaaatcgtcagcgatcttgacgatgccatcgcccatattcgtgaacacggcacacaacactccgatgcgatcctgacccgcgatatgcgcaacgcccagcgttttgttaacgaagtggattcgtccgctgtttacgttaacgcctctacgcgttttaccgacggcggccagtttggtctgggtgcggaagtggcggtaagcacacaaaaactccacgcgcgtggcccaatggggctggaagcactgaccacttacaagtggatcggcattggtgattacaccattcgtgcgtaa

SEQ ID NO: 24400 - DNA, 468 bp, Escherichia coli
atgacaatactttcactaagtcggtttatgctggcgggtgtactgctcgcgagctttaatgcctctgctatcccggggttctggcagcagggttacggtcagggcaatacggaatacagcgtgaccgaagccagcggaaagacgtttaccatcaactgcacagggaacccggaccagaatggtttctatcagcattcagtctttcttacccttgccgatgacaagatggtcagttcgcacgatgacgacactactatcaccgtagtgatggatcaccagcagtacattattccgtccagcctgggctggcgtaacggcgataacgcctggtttgacttcatcagcaatatctctgaggccgggcagttcgacgtctacgtcaatgaccacaaagcagggaccttcactgcggaccggaagaacgctgagaaagttctgtccactctcggagactgcagcaacgactga

SEQ ID NO: 24401 - DNA, 1428 bp, Escherichia coli
atgtccatacgtttagaaggttatatgcaaacaacacaacaaaatgcgccactgaagcgcacaatgaaaacgcgtcacctgattatgctttccttgggcggcgtgattggcacaggattattcttcaataccgggtacatcatttccaccactggagcggcgggaacgctgctggcctatctgattggtgcgctggtggtctggctggttatgcagtgtctgggcgagctgtcggtcgcgatgccggagaccggagcgtttcacgtttatgccgcgcgctatcttggtccggctaccgggtataccgtggcctggctttactggctgacctggaccgtggcgctgggttcgagctttaccgccgctggattctgtatgcagtactggtttccacaggtgccggtatgggtctggtgcgtggtgttctgcgcgattatttttggtctgaatgttatctccacgcgcttttttgccgaaggggagttctggttctcgctggtcaaagtggtcactatcatcgcctttatcatcctcggtggggcggcgattttcggctttattccgatgcaggatggctcgcccgcgccggggctgagtaatatcacggcagaaggctggttcccgcacggtggcttaccgattttgatgactatggtggcagtgaactttgctttttcgggtaccgagcttatcggcattgccgccggtgaaacggaaaacccgcgcaaagttatcccggtagcgattcgtactaccatcgcgcgactgattattttctttatcggcaccgtgtttgtgctggcagcgctgatcccgatgcagcaggtgggcgtggagaaaagcccgtttgtgctggtatttgagaaagtagggatcccgtacgccgctgatatttttaacttcgtgatcctgacggctattctttctgcagcgaactccgggttatatgcctccgggcgcatgctgtggtcgttgtcgaatgaacgtacgctaccggcctgttttgcgcgagtaacgaaaaacggcgtgccactgacggcgctgtcggtcagtatgctcggtggtgtgctggcgctgttttccagcgtggtggccccggacacggtatttgttgcgctgtcggcaatctccgggtttgcggtggtagcggtgtggctgagtatctgcgcctcgcattttgtttttcgtcgccgtcatctgcaacaaggtaaggcattgagtgaattacattatcgcgcgccgtggtatccgctggtgccagtattaggttttgtgctgtgcctggtggcctgtgttgggctggcattcgatccagcgcagagaattgcgttgtggtgcgggttaccgtttgttgcgttgtgctatggtgcttatttccttactcaaccccgaaacgcaaaacaggagccagaacatgtcgcagaataa

SEQ ID NO: 24402 - DNA, 933 bp, Escherichia coli
atgtcgcagaataatccgttacgcgctcttcttgataaacaggatatcctgctgctggatggcgcgatggcgacggagctggaagcgcgagggtgtaacttagccgacagcctgtggtcagccaaagtgctggtagaaaacccggagcttatccgcgaagtgcatcttgattactaccgggcgggggcgcaatgcgcgatcactgccagctatcaggcgacgccggcgggcttcgccgcgcgaggtctggatgaagcgcagtcgaaagcgctgattggcaaaagcgtggagctggcgcgtaaagcccgtgaagcgtatctggcagagaacccgcaggcgggaacgcttctggtggcgggatccgtcgggccttacggcgcgtatctggcggatggctctgaataccgtggcgattatcattgtagcgttgaggcatttcaggcgtttcatcgcccgcgcgtggaagccttgctggatgccggggccgatctgctggcctgcgaaaccctgccgaatttttccgagattgaggcgttggccgagctgttgaccgcatatccgcgtgcgcgggcgtggttctcatttaccctgcgcgacagcgaacacctgagcgacggtacgccgctgcgtgacgtggttgcgttgctggcgggttatccgcaggtggtggcgctaggcattaactgtattgcgctggaaaacaccaccgctgcgttgcagcatttacacggtttaacggtgctgccgctggtggtgtatccgaactcgggcgagcattacgatgccgtgagcaaaacctggcatcatcacggtgaacattgcgcgcagctggcggattatctgccgcagtggcaggccgctggcgcacggttgattggcgggtgctgtcgcaccacgcctgcggatatcgccgcgttaaaagcgcgaagctga

SEQ ID NO: 24403 - DNA, 930 bp, Escherichia coli
atgattcagcaaggagatctcatgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctga

SEQ ID NO: 24404 - DNA, 1005 bp, Escherichia coli
atgtccgatttatacaaaaaacactttctgaaactgctcgactttacccctgcacagttcacttctctgctgacccttgccgcacagctcaaagccgataaaaaaaatggcaaggaagtacagaagcttaccggtaaaaacatcgcgctcatcttcgaaaaagactcgactcgtacccgttgctctttcgaagttgccgcatttgaccagggcgcgcgcgttacctatttagggccgagcggcagccagattgggcataaagagtcaattaaggacaccgcgcgggttctcgggcggatgtatgacggcattcagtatcgcggtcacggccaggaagtggtcgaaacgctggcgcagtatgcgggcgtgccggtgtggaacgggctgaccaacgagttccacccgacccagctgctggcggacctgatgaccatgcaggagcacctgccgggcaaggcgtttaacgagatgacgctggtctacgcgggcgatgcgcgcaacaacatgggcaactcgatgctggaagcggcggcgctgaccgggctggatctgcgcctgttggccccgaaagcctgctggccggaagagagcctggtggcggagtgcagcgcgctggcggagaagcacggcgggaaaattactctgacggaagacgtggcggcaggcgttaagggcgcggactttatctataccgacgtgtgggtgtcgatgggcgaggccaaagagaagtgggcagagcggattgcgctgctgcgcgggtatcaggtgaacgcgcagatgatggcgctgaccgacaacccgaacgtgaagttcctgcactgtctgccggcgttccatgacgaccagactacgctcggcaagcagatggcgaaggagttcgatctgcacggcgggatggaggtgacggacgaggtgtttgagtcggcggcgagcatcgtgttcgaccaggcggaaaaccggatgcatacgattaaggcggtgatgatggcaacgcttggggagtga

SEQ ID NO: 24405 - DNA, 1353 bp, Escherichia coli
atgaacgcgtttcgacaggaaatcatcatgaataaatatcaggcagtgattattggttttggcaaggctggaaaaacattagccgtcacgctggcaaaagcaggttggcgagtggctctcatcgaacaatcaaatgcaatgtatggcgggacctgtattaatatcggctgcatcccaaccaaaacattggttcatgacgcacagcagcacacagattttgtccgtgccatacagcgtaaaaatgaagtggttaattttttacgtaataagaattttcataatcttgcggatatgcccaatatcgacgtgatcgacggccaggcggagtttatcaataatcatagcctgcgtgttcatcggcctgagggaaatctggaaattcatggcgagaaaatttttattaataccggtgcacaaaccgtggttccgccaattcctggaattaccaccacgccaggagtatatgacagcaccggattacttaatctaaaagaattgcctgggcatttaggtattttgggcggcggatatattggcgttgagttcgcctctatgttcgctaattttggcagcaaggtaaccattttagaagcagcttcgctgtttttgcctcgggaagatcgggatattgctgataatatcgcgacgattttacgcgatcagggcgtcgatattatcctcaatgcccatgtggagcgaatcagtcaccatgaaaatcaagtgcaagtgcatagcgagcacgcccaactggcggtggatgcactgttaatagcttccggtcgtcaaccggctaccgcttcgttacatccagaaaatgccggtatcgcagtaaacgagcgcggggcaattgtcgttgacaagcgattacataccaccgcagacaatatttgggcgatgggagatgttaccggcgggctgcaatttacttacatatcactggatgattaccgcattgtacgtgatgagttactgggtgaaggcaaacgtagtactgatgatcggaaaaatgtgccttattccgtatttatgacaccgcccctgtccagggttggtatgacagaagaacaagccagagagagtggtgctgatattcaggtggtgacattgcctgtagctgcaattccgcgtgccagagtgatgaatgatactcgtggggtattaaaagcgattgttgataataaaacccaacgtatgttaggggcatcactgctgtgtgttgactcccacgagatgatcaatatagtgaaaatggtgatggatgccgggctgccttatagcatattacgcgatcagatatttactcatccgtcgatgagcgaatcactcaatgatctattttcattagtcaaataa

SEQ ID NO: 24406 - DNA, 1671 bp, Escherichia coli
ttgcaatttgactacatcattattggtgccggctcagccggcaacgttctcgctacccgtctgactgaagatccgaatacctccgtgctgctgcttgaagcgggcggcccggactatcgctttgacttccgcacccagatgcccgctgccctggcattcccgctacagggtaaacgctacaactgggcctatgaaacggaacctgaaccgtttatgaataaccgccgcatggagtgcggacgcggtaaaggtctgggtggatcgtcgctgatcaacggcatgtgctacatccgtggcaatgcgctggatctcgataactgggcgcaagaacccggtctggagaactggagctacctcgactgcctgccctactaccgcaaggccgagactcgcgatatgggtgaaaacgactatcacggcggtgatggcccggtgagcgtcactacctccaaacccggcgtcaatccgctgtttgaagcgatgattgaagcgggcgtgcaggcgggctacccgcgcacggacgatctcaacggttatcagcaggaaggttttggtccgatggatcgcaccgtcacgccgcagggccgtcgcgccagcaccgcgcgtggctatctcgatcaggccaaatcgcgtcctaacctgaccattcgtactcacgctatgaccgatcacatcatttttgacggcaaacgcgcggtgggcgtcgaatggctggaaggcgacagcaccatcccaacccgcgcaacggccaacaaagaagtgctgttatgtgcaggcgcgattgcctcaccgcagatcctgcaacgctccggcgtcggcaacgctgaactgctggcggagtttgatattccgctggtgcatgaattacccggcgtcggcgaaaatcttcaggatcatctggagatgtatctgcaatatgagtgcaaagaaccggtttccctctaccctgccctgcagtggtggaaccagccgaaaatcggtgcggagtggctgtttggcggcactggcgttggtgccagcaaccactttgaagcaggtggatttattcgcagccgtgaggaatttgcgtggccgaatattcagtaccatttcctgccagtagcgattaactataacggctcgaatgcagtgaaagagcacggtttccagtgccacgtcggctcaatgcgctcgccaagccgtgggcatgtgcggattaaatcccgcgacccgcaccagcatccggcgattctgtttaactacatgtcgcacgagcaggactggcaggagttccgcgacgcaattcgcatcacccgcgagatcatgcatcaacccgcgctggatcagtatcgtggccgcgaaatcagccccggtgtcgaatgccagacggatgaacagctcgatgagttcgtgcgtaaccacgccgaaaccgccttccatccgtgcggtacctgcaaaatgggttacgacgagatgtccgtggttgacggcgaaggccgcgtacacgggttagaaggcctgcgtgtggtggatgcgtcgattatgccgcagattatcaccgggaatttgaacgccacgacaattatgattggcgagaaaatagcggatatgattcgtggacaggaagcgctgccgaggagcacggcgggatattttgtggcaaatgggatgccggtgagagcgaaaaaatga

SEQ ID NO: 24407 - DNA, 1473 bp, Escherichia coli
atgtcccgaatggcagaacagcagctttatatacatggtggttatacctccgccaccagcggtcgcaccttcgagaccattaacccggccaacggtaacgtgctggcgaccgtgcaggccgccgggcgcgaggatgtcgatcgcgccgtgaaaagcgcccagcaggggcaaaaaatctgggcgtcgatgaccgccatggagcgctcgcgtattctgcgtcgggccgttgatattctgcgtgaacgcaatgacgaactcgcaaaactggaaaccctcgacaccggaaaagcatattcggaaacctcaaccgtcgatatcgttaccggtgcggacgtgctggagtactacgccgggctgatcccggcgctggaaggcagccagatcccgttgcgtgaaacgtcctttgtgtatacccgccgcgaaccgctgggcgtagtggcagggattggcgcatggaactacccgatccagattgccctgtggaaatccgccccggcgctggcggcaggcaacgcaatgattttcaaaccgagcgaagttaccccgcttaccgcgttaaagctggctgaaatttacagcgaagcgggcctgccggacggcgtatttaacgtgttgccgggcgtgggcgcggagaccgggcaatatctgaccgagcatccgggcattgccaaagtgtcatttaccggcggtgtcgccagcggcaaaaaagtgatggctaactcggcggcctcttccctgaaagaagtgaccatggaactgggcggtaaatcaccgctgatcgttttcgatgatgcggatctcgatctcgccgccgatatcgccatgatggcaaacttcttcagctccggtcaggtgtgtaccaatggcacccgcgtcttcgttccggcgaaatgcaaagccgcatttgagcagaaaattctggcgcgcgttgagcgcattcgcgcgggcgacgttttcgatccgcaaactaacttcggcccgctggtcagcttcccgcatcgcgataacgtgctgcgctatatcgccaaaggcaaagaggaaggcgcgcgcgtactgtgcggcggcgatgtactgaaaggcgatggcttcgataacggcgcatgggttgcaccgacagtgttcaccgattgcagcgacgatatgaccatcgtgcgtgaagagatcttcgggccagtgatgtccattctgacctacgagtcggaagacgaagtcattcgccgcgctaacgataccgactacggcctggcggcgggcatcgtgacagcggacctgaaccgcgcgcatcgcgtcattcatcagctggaagcgggtatttgctggatcaacacctggggcgaatccccggcagagatgcccgttggcggctacaaacactccggcattggtcgcgagaacggcgtgatgacgctccagagttacacccaggtgaagtccatccaggttgagatggctaaattccagtccatattctaa

SEQ ID NO: 24408 - DNA, 1050 bp, Escherichia coli
atgaagatcaaagctgttggtgcatattccgctaaacaaccacttgaaccgatggatatcacccggcgtgaaccgggaccgaatgatgtcaaaatcgaaatcgcttactgtggcgtttgccattccgatctccaccaggtccgttccgagtgggcggggacggtttacccctgcgtgccgggtcatgaaattgtggggcgtgtggtagccgttggtgatcaggtagaaaaatatgcgccgggcgatctggtcggtgtcggctgcattgtcgacagttgtaaacattgcgaagagtgtgaagacgggttggaaaactactgtgatcacatgaccggcacctataactcgccgacgccggacgaaccgggccatactctgggcggctactcacaacagatcgtcgttcatgagcgatatgttctgcgtattcgtcacccgcaagagcagctggcggcggtggctcctttgttgtgtgcagggatcaccacgtattcgccgctacgtcactggcaggccgggccgggtaaaaaagtgggcgtggtcggcatcggcggtctgggacatatggggattaagctggcccacgcgatgggggcacatgtggtggcatttaccacttctgaggcaaaacgcgaagcggcaaaagccctgggggccgatgaagttgttaactcacgcaatgccgatgagatggcggctcatctgaagagtttcgatttcattttgaatacagtagctgcgccacataatctcgacgattttaccaccttgctgaagcgtgatggcaccatgacgctggttggtgcgcctgcgacaccgcataaatcgccggaagttttcaacctgatcatgaaacgccgtgcgatagccggttctatgattggcggcattccagaaactcaggagatgctcgatttttgcgccgaacatggcatcgtggctgatatagagatgattcgggccgatcaaattaatgaagcctatgagcgaatgctgcgcggtgatgtgaaatatcgttttgttatcgataatcgcacactaacagactga

SEQ ID NO: 24409 - DNA, 1170 bp, Escherichia coli
atgagcgacacaacgatcctgcaaaacagtacccatgtcattaaaccgaaaaaatctgtggcactttctggcgttccggcgggcaatacggcgctctgcaccgtgggtaaaagtggcaatgacctgcattaccgcggctacgatattcttgatctggcgaaacattgcgaatttgaagaagtggcgcatctgctgatccacggcaaactgccgacccgtgacgaactcgccgcttacaaaacgaaactgaaagccctgcgcggtttaccggctaacgtgcgtaccgtgctggaagccttaccggcggcgtcgcacccgatggatgttatgcgcaccggtgtttccgcgctcggctgcacgctgccagaaaaagaggggcataccgtctctggcgcgcgggatattgccgacaaactgctggcgtcgcttagctcgattctcctttattggtatcactacagccacaacggcgaacgcatccaaccggaaaccgatgacgactccatcggcggtcacttcctgcatctgctgcacggcgaaaagccatcgcaaagctgggaaaaggcgatgcatatctcgctggtgctgtacgccgaacacgagtttaacgcctccacctttaccagtcgggtgattgcgggcaccggctctgatatgtattccgcgattattggcgcgattggcgcactgcgcgggccaaaacacggcggggcgaatgaagtgtcgctggagatccagcaacgctacgaaacgccggacgaagccgaagcagatatccgcaagcgcgtggaaaacaaagaagtggtcattggttttggtcatccggtttacaccatcgctgacccgcgccaccaggtgattaaacgtgtggcgaagcagctctcgcaggaaggcggctcgctgaagatgtacaacatcgccgatcgcctggaaacggtgatgtgggagagcaaaaagatgttccccaatctcgactggttctctgctgtttcctacaacatgatgggcgttcccaccgagatgttcacaccactgtttgttatcgcccgcgtcaccggctgggcggcgcacattatcgaacaacgtcaggacaacaaaattatccgtccttccgccaattatgttggaccggaagaccgcccgtttgtcgcgctggataagcgccagtaa

SEQ ID NO: 24410 - DNA, 1887 bp, Escherichia coli
atgtcttttagcgaattttatcagcgttcgattaacgaaccggagcagttctgggccgagcaggcccggcgtattgactggcagacgccctttacgcaaacgctcgatcacagcaatccgccgtttgcccgttggttttgtgaaggccgaaccaacttgtgccacaacgccatcgaccgctggctggagaaacagccagaggcgctggcgctgattgccgtctcttcggaaacagaagaagagcgcacctttacctttcgtcagctgcatgacgaagtgaacgcggtggcctcaatgttgcgttcattgggtgtgcagcgcggcgatcgggtgctggtgtatatgccgatgattgccgaagcgcatattactctgctggcctgcgcgcgcattggcgctattcactcggtggtgtttggtggatttgcctcgcacagcgtggcggcgcgaattgatgacgctaaaccggtgctgattgtctcggctgatgccggagcgcgcggtggcaaaatcattccctataaaaaattgctcgacgatgcgataagtcaggcgcagcaccagccacgccatgttttgctggtggatcgcgggctggcgaaaatggcgcgcgtcagcgggcgggatgtcgatttcgcgtcgttgcgccatcaacacatcggcgcgcgggtaccggtggcgtggctggaatccaacgaaacctcctgcattctctacacttccggcacgaccggcaaacctaaaggcgtgcagcgtgacgtcggcggatatgcggtggcgctggcgacctcgatggacaccatttttggcggcaaagcgggcagcgtgttcttttgcgcatcggatatcggctgggtggtggggcattcgtatatcgtttacgcgccgctgctggcggggatggcgactatcgtttacgaaggattgccgacctggccggactgcggcgtgtggtggacaatcgtcgagaaatatcaggttagccggatgttctcagcgccgaccgccattcgcgtgctgaaaaaattccctaccgctgaaattcgcaaacacgatctctcgtcgctggaagtgctctatctggctggagaaccgctggacgagccgaccgccagttgggtgagcaatacgctggatgtgccggtcatcgacaactactggcagaccgaatccggctggccgattatggcgattgctcgcggtctggacgacaggccgacgcgtctgggaagccccggtgtgccgatgtatggctataacgtgcagttgcttaatgaagtcaccggcgaaccgtgtggcgtcaacgagaaagggatgctggtggtggaagggccgctgccgccggggtgtattcagaccatctggggcgacgacggccgctttgtgaagacttactggtcgctgttttcccgcccggtgtacgccacctttgactggggcatccgtgacgctgacggttatcactttattctcgggcgcactgacgatgtaattaacgttgccgggcatcggctggggacgcgcgagattgaagagagtatctccagccatccgggcgttgccgaagtggcggtggttggggtgaaagatgcgctgaaagggcaggtggcggtggcgtttgtcattccgaaagagagcgacagtctggaagatcgtgatgtggcgcactcgcaagagaaggcgattatggcgctggtggacagccagattggcaactttggccgcccggcgcacgtctggtttgtctcgcaattgccaaaaacgcgatccggaaaaatgctgcgccgcacgatccaggcgatttgcgaaggacgcgatcctggagatctgacgaccattgatgatcctgcgtcgttggatcagatccgccaggcgatggaagagtag

SEQ ID NO: 24411 - DNA, 3075 bp, Escherichia coli
atgaccatgattacggattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgctttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataa

SEQ ID NO: 24412 - DNA, 1110 bp, Escherichia coli
atgaaatcacgtgctgccgttgcatttgctcccggtaaaccgctggaaatcgttgaaattgacgttgcaccaccgaaaaaaggtgaagtgctaattaaagtcacccataccggcgtttgccataccgacgcatttaccctctccggcgatgacccggaaggtgtattcccggtggttctcggtcacgaaggggccggcgttgtggttgaagtcggtgaaggcgtaaccagcgtcaaacctggcgaccatgtgatcccgctttacaccgcggagtgcggcgagtgtgagttctgtcgttctggcaaaactaacctctgtgttgcggttcgcgaaacccagggtaaaggcctgatgccagacggcaccacccgtttttcttacaacgggcagccgctttatcactacatggggtgctctacattcagtgaatacaccgtagtcgcggaagtgtctctggcaaaaattaatccagaagcaaaccatgaacacgtctgcctgctgggctgtggcgtgaccaccggtattggcgcggtacacaacacagctaaagtccagccaggtgattctgttgccgtgtttggtcttggcgcgattggtctggcagtggttcagggcgcgcgtcaggcgaaagcgggtcggattatcgctatcgataccaacccgaagaaattcgatctggcgcgtcgcttcggtgctaccgactgcattaacccgaatgactacgacaaaccgataaaagatgtcctgttggatatcaacaaatggggtatcgaccatacctttgaatgcatcggtaacgtcaacgtgatgcgtgcggcgctggaaagtgcgcaccgcggctggggtcagtcggtgatcatcggggtcgcggttgccggtcaggaaatctccacccgtccattccagttggtcactggtcgcgtatggaaaggttccgcgtttggcggcgtgaaaggtcgttcccagttaccgggcatggttgaagatgcgatgaaaggtgatatcgatctggaaccgtttgtcacgcataccatgagcctggatgaaattaatgacgccttcgacctgatgcatgaaggcaaatccattcgaaccgtaattcgttactga

SEQ ID NO: 24413 - DNA, 1008 bp, Escherichia coli
atgcccctcgattccacaaacatcaggcagaccatgacagacttaatccaacgccctcgtcgcctgcgcaaatctcctgcgctgcgcgctatgtttgaagagacaacacttagccttaacgacctggtgttgccgatctttgttgaagaagaaattgacgactacaaagccgttgaagccatgccaggcgtgatgcgcattccagagaaacatctggcacgcgaaattgaacgcatcgccaacgccggtattcgttccgtgatgacttttggcatctctcaccataccgatgaaaccggcagcgatgcctggcgggaagatggactggtggcgcgtatgtcgcgcatctgcaagcagaccgtgccagaaatgatcgttatgtcagacacctgcttctgtgaatacacttctcacggtcactgcggtgtgctgtgcgagcatggcgtcgacaacgacgcgactctggaaaatttaggcaagcaagccgtggttgcagctgctgcaggtgcagacttcatcgccccttccgccgcgatggacggccaggtacaggcgattcgtcaggcgctggacgctgcgggatttaaagatacggcgattatgtcgtattcgaccaagttcgcctcctccttttatggcccgttccgtgaagctgccggaagcgcattaaaaggcgaccgcaaaagctatcagatgaacccaatgaaccgtcgtgaggcgattcgtgaatcactgctggatgaagcccagggcgcagactgcctgatggttaaacctgctggagcgtacctcgacatcgtgcgtgagctgcgtgaacgtactgaattgccgattggcgcgtatcaggtgagcggtgagtatgcgatgattaagttcgccgcgctggcgggtgctatagatgaagagaaagtcgtgctcgaaagcttaggttcgattaagcgtgcgggtgcggatctgattttcagctactttgcgctggatttggctgagaagaagattctgcgttaa

SEQ ID NO: 24414 - DNA, 810 bp, Escherichia coli
atggaaaagaaaatcggttttattggctgcggcaatatgggaaaagccattctcggcggtctgattgccagcggtcaggtgcttccagggcaaatctgggtatacaccccctccccggataaagtcgccgccctgcatgaccagttcggcatcaacgccgcagaatcggcgcaagaagtggcgcaaatcgccgacatcatttttgctgccgttaaacctggcatcatgattaaagtgcttagcgaaatcacctccagcctgaataaagactctctggtcgtttctattgctgcaggtgtcacgctcgaccagcttgcccgcgcgctgggccatgaccggaaaattatccgcgccatgccgaacactcccgcactggttaatgccgggatgacctccgtaacgccaaacgcgctggtaaccccagaagataccgctgatgtgctgaatattttccgctgctttggcgaagcggaagtaattgctgagccgatgatccacccggtggtcggtgtgagcggttcttcgccagcctacgtatttatgtttatcgaagcgatggccgacgccgccgtgctgggcgggatgccacgcgcccaggcgtataaatttgccgctcaggcggtaatgggttccgcaaaaatggtgctggaaacgggagaacatccgggggcactgaaagatatggtctgctcaccgggaggcaccaccattgaagcggtacgcgtactggaagagaaaggcttccgtgctgcagtgatcgaagcgatgacgaagtgtatggaaaaatcagaaaaactcagcaaatcctga

SEQ ID NO: 24415 - DNA, 525 bp, Escherichia coli
atgacacaacctctttttctgatcgggcctcggggctgtggtaaaacaacggtcggaatggcccttgccgattcgcttaaccgtcggtttgtcgataccgatcagtggttgcaatcacagctcaatatgacggtcgcggagatcgtcgaaagggaagagtgggcgggatttcgcgccagagaaacggcggcgctggaagcggtaactgcgccatccaccgttatcgctacaggcggcggcattattctgacggaatttaatcgtcacttcatgcaaaataacgggatcgtggtttatttgtgtgcgccagtatcagtcctggttaaccgactgcaagctgcaccggaagaagatttacggccaaccttaacgggaaaaccgctgagcgaagaagttcaggaagtgctggaagaacgcgatgcgctatatcgcgaagttgcgcatattatcatcgacgcaacaaacgaacccagccaggtgatttctgaaattcgcagcgccctggcacagacgatcaattgttga

SEQ ID NO: 24416 - DNA, 1374 bp, Escherichia coli
atggaaagtaagaacaagctaaagcgtgggctaagtacccgccacatacgctttatggcactgggttcagcaattggcaccgggctgttttacggttcggcagacgccatcaaaatggccggtccgagcgtgttgttggcctatattatcggtggtatcgcggcgtatatcattatgcgtgcgctgggggaaatgtcggtacataacccggccgccagctctttctcgcgttatgcgcaggaaaacctcggcccgctggcaggttacattaccggctggacctactgctttgaaatccttattgtcgccatcgccgatgtgaccgcttttggtatctatatgggtgtctggttcccgacggtgccgcactggatttgggtactgagcgtggtgctgatcatttgcgccgtaaacctgatgagcgtgaaggtattcggtgagctggaattctggttctcgttctttaaagtcgccaccatcatcatcatgattgtcgccggtttcggcatcatcatctgggggattggcaacggcgggcaaccgaccggtattcataacctgtggagcaacggcggcttcttcagtaacggctggcttggcatggtaatgtcgttgcaaatggtgatgtttgcttacggtgggatcgaaattatcgggattaccgccggtgaagcgaaagatcctgagaaatcgataccgcgtgcgattaactccgtgccgatgcgtattctggtgttctacgtcggtacgctgttcgtcattatgtctatctacccgtggaatcaggttggcactgccggtagcccgttcgtgctgacgttccagcatatgggcattacctttgccgccagcattcttaactttgttgtgctgactgcttcgctgtcggcaattaacagtgatgtatttggcgtaggccgtatgctccacggtatggcagagcagggcagcgcgccgaaaattttcagcaaaacgtcgcgtcgcggtattccgtgggttacggtgctggtgatgactaccgcgctgctgtttgcggtgtatctgaactacatcatgccggaaaacgtcttcctggtgatcgcttcgctggcaaccttcgccacggtgtgggtgtggattatgatcctgctgtcgcaaattgccttccgtcgccgtttgccgccagaagaagttaaggcgctgaaatttaaagtgccgggtggggtagcaacgaccatcggcgggctgattttcctgctctttattatcgggttgattggttatcacccggatacgcgtatctcgctgtatgtcggtttcgcgtggattgttgtgctgttgattggctggatgtttaaacgccgccacgatcgtcagctggctgaaaaccagtaa

SEQ ID NO: 24417 - DNA, 1818 bp, Escherichia coli
atgatgttaaatgcatggcacctgccggtgcccccatttgttaaacaaagcaaagatcaactgctcattacactgtggctgacgggcgaagacccaccgcagcgcattatgctgcgtacagaacacgataacgaagaaatgtcagtaccgatgcataagcagcgcagtcagccgcagcctggcgtcaccgcatggcgtgcggcgattgatctctccagcggacaaccccggcggcgttacagtttcaaactgctgtggcacgatcgccagcgttggtttacaccgcagggcttcagccgaatgccgccggcacgactggagcagtttgccgtcgatgtaccggatatcggcccacaatgggctgcggatcagattttttatcagatcttccctgatcgttttgcgcgtagtcttcctcgtgaagctgaacaggatcatgtctattaccatcatgcagccggacaagagatcatcttgcgtgactgggatgaaccggtcacggcgcaggcgggcggatcaacgttctatggcggcgatctggacgggataagcgaaaaactgccgtatctgaaaaagcttggcgtgacagcgctgtatctcaatccggtgtttaaagctcccagcgtacataaatacgataccgaggattatcgccatgtcgatccgcagtttggcggtgatggggcgttgctgcgtttgcgacacaatacgcagcagctgggaatgcggctggtgctggacggcgtgtttaaccacagtggcgattcccatgcctggtttgacaggcataatcgtggcacgggtggtgcttgtcacaaccccgaatcgccctggcgcgactggtactcgtttagtgatgatggcacggcgctcgactggcttggctatgccagcttgccgaagctggattatcagtcggaaagtctggtgaatgaaatttatcgcggggaagacagtattgtccgccactggctgaaagcgccgtggaatatggacggctggcggctggatgtggtgcatatgctgggggaggcgggtggggcgcgcaataatatgcagcacgttgccgggatcaccgaagcggcgaaagaaacccagccggaagcgtatattgtcggcgaacattttggcgatgcacggcaatggttacaggccgatgtggaagatgccgccatgaactatcgtggcttcacattcccgttgtggggatttcttgccaataccgatatctcttacgatccgcagcaaattgatgcccaaacctgtatggcctggatggataattaccgcgcagggctttctcatcaacaacaattacgtatgtttaatcagctcgacagccacgatactgcgcgatttaaaacgctgctcggtcgggatattgcgcgcctgccgctggcggtggtctggctgttcacctggcctggtgtaccgtgcatttattacggtgatgaagtaggactggatggcaaaaacgatccgttttgccgtaaaccgttcccctggcaggtggaaaagcaggatacggcgttattcgcgctgtaccagcgaatgattgcgctgcgtaagaaaagtcaggcgctacgtcatggcggctgtcaggtgctgtatgcggaagataacgtggtggtatttgtccgcgtgctgaatcagcaacgtgtactggtggcaatcaaccgtggcgaggcctgtgaagtggtgctacccgcgtcaccgtttctcaatgccgtgcaatggcaatgcaaagaagggcatgggcaactgactgacgggattctggctttgcctgccatttcggctacggtatggatgaactaa

SEQ ID NO: 24418 - DNA, 1863 bp, Escherichia coli
atgagttttgatattgccaaatacccgaccctggcactggtcgactccacccaggagttacgactgttgccgaaagagagtttaccgaaactctgcgacgaactgcgccgctatttactcgacagcgtgagccgttccagcgggcacttcgcctccgggctgggcacggtcgaactgaccgtggcgctgcactatgtctacaacaccccgtttgaccaattgatttgggatgtggggcatcaggcttatccgcataaaattttgaccggacgccgcgacaaaatcggcaccatccgtcagaaaggcggtctgcacccgttcccgtggcgcggcgaaagcgaatatgacgtattaagcgtcgggcattcatcaacctccatcagtgccggaattggtattgcggttgctgccgaaaaagaaggcaaaaatcgccgcaccgtctgtgtcattggcgatggcgcgattaccgcaggcatggcgtttgaagcgatgaatcacgcgggcgatatccgtcctgatatgctggtgattctcaacgacaatgaaatgtcgatttccgaaaatgtcggcgcgctcaacaaccatctggcacagctgctttccggtaagctttactcttcactgcgcgaaggcgggaaaaaagttttctctggcgtgccgccaattaaagagctgctcaaacgcaccgaagaacatattaaaggcatggtagtgcctggcacgttgtttgaagagctgggctttaactacatcggcccggtggacggtcacgatgtgctggggcttatcaccacgctaaagaacatgcgcgacctgaaaggcccgcagttcctgcatatcatgaccaaaaaaggtcgtggttatgaaccggcagaaaaagacccgatcactttccacgccgtgcctaaatttgatccctccagcggttgtttgccgaaaagtagcggcggtttgccgagctattcaaaaatctttggcgactggttgtgcgaaacggcagcgaaagacaacaagctgatggcgattactccggcgatgcgtgaaggttccggcatggtcgagttttcacgtaaattcccggatcgctacttcgacgtggcaattgccgagcaacacgcggtgacctttgctgcgggtctggcgattggtgggtacaaacccattgtcgcgatttactccactttcctgcaacgcgcctatgatcaggtgctgcatgacgtggcgattcaaaagcttccggtcctgttcgccatcgaccgcgcgggcattgttggtgctgacggtcaaacccatcagggtgcttttgatctctcttacctgcgctgcataccggaaatggtcattatgaccccgagcgatgaaaacgaatgtcgccagatgctctataccggctatcactataacgatggcccgtcagcggtgcgctacccgcgtggcaacgcggtcggcgtggaactgacgccgctggaaaaactaccaattggcaaaggcattgtgaagcgtcgtggcgagaaactggcgatccttaactttggtacgctgatgccagaagcggcgaaagtcgccgaatcgctgaacgccacgctggtcgatatgcgttttgtgaaaccgcttgatgaagcgttaattctggaaatggccgccagccatgaagcgctggtcaccgtagaagaaaacgccattatgggcggcgcaggcagcggcgtgaacgaagtgctgatggcccatcgtaaaccagtacccgtgctgaacattggcctgccggacttctttattccgcaaggaactcaggaagaaatgcgcgccgaactcggcctcgatgccgctggtatggaagccaaaatcaaggcctggctggcataa

SEQ ID NO: 24419 - DNA, 900 bp, Escherichia coli
atggactttccgcagcaactcgaagcctgcgttaagcaggccaaccaggcgctgagccgttttatcgccccactgccctttcagaacactcccgtggtcgaaaccatgcagtatggcgcattattaggtggtaagcgcctgcgacctttcctggtttatgccaccggtcatatgttcggcgttagcacaaacacgctggacgcacccgctgccgccgttgagtgtatccacgcttactcattaattcatgatgatttaccggcaatggatgatgacgatctgcgtcgcggtttgccaacctgccatgtgaagtttggcgaagcaaacgcgattctcgctggcgacgctttacaaacgctggcgttctcgattttaagcgatgccgatatgccggaagtgtcggaccgcgacagaatttcgatgatttctgaactggcgagcgccagtggtattgccggaatgtgcggtggtcaggcattagatttagacgcggaaggcaaacacgtacctctggacgcgcttgagcgtattcatcgtcataaaaccggcgcattgattcgcgccgccgttcgccttggtgcattaagcgccggagataaaggacgtcgtgctctgccggtactcgacaagtatgcagagagcatcggccttgccttccaggttcaggatgacatcctggatgtggtgggagatactgcaacgttgggaaaacgccagggtgccgaccagcaacttggtaaaagtacctaccctgcacttctgggtcttgagcaagcccggaagaaagcccgggatctgatcgacgatgcccgtcagtcgctgaaacaactggctgaacagtcactcgatacctcggcactggaagcgctagcggactacatcatccagcgtaataaataa

SEQ ID NO: 24420 - DNA, 1275 bp, Escherichia coli
atgacagataaacgcaaagatggctcaggcaaattgctgtattgctctttttgcggcaaaagccagcatgaagtgcgcaagctgattgccggtccatccgtgtatatctgcgacgaatgtgttgatttatgtaacgacatcattcgcgaagagattaaagaagttgcaccgcatcgtgaacgcagtgcgctaccgacgccgcatgaaattcgcaaccacctggacgattacgttatcggccaggaacaggcgaaaaaagtgctggcggtcgcggtatacaaccattacaaacgtctgcgcaacggcgataccagcaatggcgtcgagttgggcaaaagtaacattctgctgatcggtccgaccggttccggtaaaacgctgctggctgaaacgctggcgcgcctgctggatgttccgttcaccatggccgacgcgactacactgaccgaagccggttatgtgggtgaagacgttgaaaacatcattcagaagctgttgcagaaatgcgactacgatgtccagaaagcacagcgtggtattgtctacatcgatgaaatcgacaagatttctcgtaagtcagacaacccgtccattacccgagacgtttccggtgaaggcgtacagcaggcactgttgaaactgatcgaaggtacggtagctgctgttccaccgcaaggtgggcgtaaacatccgcagcaggaattcttgcaggttgatacctctaagatcctgtttatttgtggcggtgcgtttgccggtctggataaagtgatttcccaccgtgtagaaaccggctccggcattggttttggcgcgacggtaaaagcgaagtccgacaaagcaagcgaaggcgagctgctggcgcaggttgaaccggaagatctgatcaagtttggtcttatccctgagtttattggtcgtctgccggttgtcgcaacgttgaatgaactgagcgaagaagctctgattcagatcctcaaagagccgaaaaacgccctgaccaagcagtatcaggcgctgtttaatctggaaggcgtggatctggaattccgtgacgaggcgctggatgctatcgctaagaaagcgatggcgcgtaaaaccggtgcccgtggcctgcgttccatcgtagaagccgcactgctcgataccatgtacgatctgccgtccatggaagacgtcgaaaaagtggttatcgacgagtcggtaattgatggtcaaagcaaaccgttgctgatttatggcaagccggaagcgcaacaggcatctggtgaataa

SEQ ID NO: 24421 - DNA, 2355 bp, Escherichia coli
atgaatcctgagcgttctgaacgcattgaaatccccgtattgccgctgcgcgatgtggtggtttatccgcacatggtcatccccttatttgtcgggcgggaaaaatctatccgttgtctggaagcggcgatggaccatgataaaaaaattatgctggtcgcgcagaaagaagcttcaacggatgagccgggtgtaaacgatcttttcaccgtcgggaccgtggcctctatattgcagatgctgaaactgcctgacggcaccgtcaaagtgctggtcgaggggttacagcgcgcgcgtatttctgcgctctctgacaatggcgaacacttttctgcgaaggcggagtatctggagtcgccgaccattgatgagcgggaacaggaagtgctggtgcgtactgcaatcagccagttcgaaggctacatcaagctgaacaaaaaaatcccaccagaagtgctgacgtcgctgaatagcatcgacgatccggcgcgtctggcggataccattgctgcacatatgccgctgaaactggctgacaaacagtctgttctggagatgtccgacgttaacgaacgtctggaatatctgatggcaatgatggaatcggaaatcgatctgctgcaggttgagaaacgcattcgcaaccgcgttaaaaagcagatggagaaatcccagcgtgagtactatctgaacgagcaaatgaaagctattcagaaagaactcggtgaaatggacgacgcgccggacgaaaacgaagccctgaagcgcaaaatcgacgcggcgaagatgccgaaagaggcaaaagagaaagcggaagcagagttgcagaagctgaaaatgatgtctccgatgtcggcagaagcgaccgtagtgcgtggttatatcgactggatggtacaggtgccgtggaatgcgcgtagcaaggtcaaaaaagacctgcgtcaggcgcaggaaatccttgataccgaccattatggtctggagcgcgtgaaagatcgaatccttgagtatcttgcggttcaaagccgtgtcaacaaaatcaagggaccgatcctctgcctggtagggccgccgggggtaggtaaaacctctcttggtcagtccattgccaaagccaccgggcgtaaatatgtccgtatggcgctgggcggcgtgcgtgatgaagcggaaatccgtggtcaccgccgtacttacatcggttctatgccgggtaaactgatccagaaaatggcgaaagtgggcgtgaaaaacccgctgttcctgctcgatgagatcgacaaaatgtcttctgacatgcgtggcgatccggcctctgcactgcttgaagtgctggatccagagcagaacgtagcgttcagcgaccactacctggaagtggattacgatctcagcgacgtgatgtttgtcgcgacgtcgaactccatgaacattccggcaccgctgctggatcgtatggaagtgattcgcctctccggttataccgaagatgaaaaactgaacatcgccaaacgtcacctgctgccgaagcagattgaacgtaatgcactgaaaaaaggtgagctgaccgtcgacgatagcgccattatcggcattattcgttactacacccgtgaggcgggcgtgcgtggtctggagcgtgaaatctccaaactgtgtcgcaaagcggttaagcagttactgctcgataagtcattaaaacatatcgaaattaacggcgataacctgcatgactatctcggtgttcagcgtttcgactatggtcgcgcggataacgaaaaccgtgtcggtcaggtaaccggtctggcgtggacggaagtgggcggtgacttgctgaccattgaaaccgcatgtgttccgggtaaaggcaaactgacctataccggttcgctcggcgaagtgatgcaggagtccattcaggcggcgttaacggtggttcgtgcgcgtgcggaaaaactggggatcaaccctgatttttacgaaaaacgtgacatccacgtccacgtaccggaaggtgcgacgccgaaagatggtccgagtgccggtattgctatgtgcaccgcgctggtttcttgcctgaccggtaacccggttcgtgccgatgtggcaatgaccggtgagatcactctgcgtggtcaggtactgccgatcggtggtttgaaagaaaaactcctggcagcgcatcgcggcgggattaaaacagtgctaattccgttcgaaaataaacgcgatctggaagagattcctgacaacgtaattgccgatctggacattcatcctgtgaagcgcattgaggaagttctgactctggcgctgcaaaatgaaccgtctggtatgcaggttgtgactgcaaaatag

SEQ ID NO: 24422 - DNA, 1773 bp, Escherichia coli
gtgcgattatttgctcaattaagctggtatttccgtcgggaatggcgtcgctatctcggggctgtcgccttgcttgtcattatcgcgatgctgcaactggttccgccaaaagtggttggtattgttgtcgatggcgtgacagaacaacactttactaccgggcagatcctgatgtggatcgccaccatggtgctgattgccgttgtggtttatctcctgcgttacgtctggcgggtattgctgtttggtgcgtcttatcaactggctgttgaactgcgtgaagattattaccgtcagctaagccggcagcatcctgagttttacctgcgtcatcgcaccggtgacctcatggctcgtgcgaccaatgacgtcgatcgcgtcgtgtttgccgccggagaaggggtgctgacgctggtggattcactggtgatgggctgcgctgtgttgattatgatgtctacgcaaattagctggcagttgaccttattttccctgttgccgatgccagtgatggcgatcatgattaagcgcaacggcgatgctttgcatgaacgctttaagctggcacaggcggcgttttccagtcttaatgaccgcacccaggaaagcctcaccagtatccgcatgatcaaagcctttggtctggaagatcgccagtcggcgttatttgccgcggatgccgaagataccggcaaaaaaaacatgcgggtggcgcgtattgatgctcgtttcgacccgaccatctatatcgcgattggtatggcgaacttgctggcgattggcggcggtagttggatggtggtgcagggcagtttaacgctgggccagctcaccagttttatgatgtatttaggtctgatgatttggccaatgctggcgctggcatggatgtttaacattgtggaacgtggtagtgctgcgtacagccgtattcgcgcgatgctggcggaagcgccggtggtgaacgatggtagcgaacccgtgccggaagggcgtggcgaactggatgtaaatattcaccagttcacgtatccgcagactgaccatcctgcgctggaaaacgtcaatttcgccctgaaacccggtcagatgctgggtatctgcgggccgactggttccggcaaaagtaccctgttgtcgctcattcagcgtcatttcgacgtcagcgagggggatattcgctttcatgatattcctctgacgaagttacaactcgatagctggcgtagccgcctggcggtagttagccagacgccattccttttttctgacactgtggcgaataacatcgcgctgggttgcccgaatgccacccagcaagagattgagcatgtcgcgcggttagccagcgtacatgacgatattttgcgtctaccgcaaggttacgatacagaggtgggcgagcgcggtgtgatgctttccggcgggcaaaaacagcgtatctccattgctcgtgcgttattagtcaacgcggaaatcctcatccttgatgatgcgctttcggcggtggacggacgcactgagcaccagatcctgcataacctgcgtcagtgggggcagggaagaacggtaatcatcagtgcccatcgcctttctgcactgacggaagccagtgaaattattgtgatgcagcacggacatatcgcccagcgtggcaatcatgatgtgctggcacaacaaagcggctggtatcgcgatatgtatcgctatcaacaactggaggcggcgctcgacgacgctccggaaaatcgcgaggaggccgtcgatgcgtag

SEQ ID NO: 24423 - DNA, 1782 bp, Escherichia coli
atgcgtagttttagccaactgtggccgactctcaagcgcctgttagcgtacggttcgccgtggcgtaaaccgctggggattgcggtcctgatgatgtgggttgcggcggcggcagaagtcagtgggccgctgcttatcagctattttatcgacaatatggtagcgaaaaataacctgccgttgaaagtggttgcagggctggctgcggcgtatgttgggctgcaactgtttgccgccgggctacattacgcgcagtcgctgctgtttaatcgggcggcagtaggcgtagtgcaacagttgcgtaccgacgtgatggatgctgcgttacgccagccattaagcgagtttgatacccaacccgtcgggcaggtgatttcccgcgtcactaatgacactgaagtgatccgcgatctctacgttaccgtagtggcaactgtcctgcgcagtgccgcgctggtgggcgcgatgctggtggcgatgttcagcctcgactggcgaatggcactggtggcgataatgattttcccggtggtgctggtggtaatggtgatataccagcgttacagcacgccgattgtccgtcgtgtgcgcgcctatttggcggatatcaacgacggctttaacgaaatcatcaatggcatgagcgttatccagcagtttcgtcagcaggcgcgatttggcgaacgtatgggggaggccagtcgttcacactatatggcgaggatgcaaaccctgcgcctcgacggttttctgctgcgtccgctgctgagtctgttttcatcgctcattctttgtggcttgttgatgctgtttggcttctccgccagcggcaccattgaagtgggcgtgctgtatgcgtttatcagctatcttgggcgacttaacgaaccattaatcgaactgaccacgcaacaggcgatgctgcaacaggctgttgttgctggtgagcgcgtgtttgaactgatggacggaccgcgccagcaatatggcaatgatgatcgcccgttacagagtggcaccatcgaagtcgataacgtgtcatttgcttatcgcgatgacaatctggtgctaaagaacattaatctctctgtgccttcgcgcaattttgtggcgctggtcgggcataccggcagtggcaaaagcaccctcgccagtttattgatgggctattacccgctaacggaaggtgagattcgccttgatggtcgtccattaagttcgctaagtcacagcgcgctgcgccagggcgtggcaatggtgcagcaagatccggtggtgctggcggataccttcctcgccaacgtgacgctggggcgggatatctccgaagaacgcgtctggcaggcgctggaaaccgtgcaactggcggagctggcgcgtagcatgagcgacggtatttacacgccgctgggcgagcaggggaataatctctcagttgggcaaaagcaactgctggcactggcgcgcgtgctggtcgagacgccgcaaatcctgatccttgatgaggcaaccgccagcattgactccggtactgaacaggcgattcaacatgctctggcggcggtgcgtgaacataccacgctggtagtgattgctcaccgcttatcgaccattgttgatgccgacaccattctggtgcttcatcgtgggcaagccgtggagcagggcactcaccagcaactgctggcggcccagggacgctactggcagatgtatcaactgcaacttgcgggcgaagagctggcagccagcgtgcgtgaagaggaatcattgagcgcctga

SEQ ID NO: 24424 - DNA, 552 bp, Escherichia coli
atgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggagatccacgttgatgccatcaaaccgggcgacaaagttctggtggtggacgacctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaa

SEQ ID NO: 24425 - DNA, 1875 bp, Escherichia coli
atgaaaggacaagaaactcgtggttttcagtcagaagtgaaacagcttctgcacctgatgatccattctctctattccaataaagaaatcttcctgcgtgagcttatctctaacgcctccgatgcggcggacaagctgcgtttccgtgcgctctctaacccggacctgtacgaaggtgatggcgaactacgcgttcgtgtctctttcgataaagacaagcgtacgctgaccatctccgataacggcgtggggatgacccgcgacgaagtgattgaccatctggggactatcgctaaatccggtaccaaatcattcctcgaatccctgggttctgaccaggcgaaagacagccagctgatcggtcagtttggtgttggtttctactctgcgtttatcgtggccgacaaagtgaccgtgcgtactcgcgcggcaggcgaaaaaccagaaaatggcgtcttctgggaatcggctggcgaaggtgaatacaccgttgccgacatcaccaaagaagatcgtggtactgaaatcaccctgcatctgcgtgaaggcgaagacgagttcctcgatgactggcgcgtgcgttccatcatcagcaaatactccgaccatatcgcgctgccggtagagatcgaaaaacgcgaagagaaagacggcgaaaccgttatctcctgggagaaaatcaacaaagcgcaggcgctgtggactcgtaacaagtcggaaatcaccgatgaagagtacaaagagttctacaaacacatcgcccacgactttaatgatccgctgacctggagccacaaccgtgttgaaggtaagcaggagtacaccagcctgctgtacatcccgtcccaggctccgtgggatatgtggaaccgcgatcataaacacggcctgaaactgtatgttcagcgtgtgttcatcatggacgacgcagaacagttcatgccgaactatctgcgcttcgtgcgtggtctgattgactccagcgatctgccgctgaacgtttcccgtgaaatcctccaggacagcacggtaacgcgtaacctgcgcaatgcgctgaccaagcgtgtgctgcaaatgctggaaaaactggcgaaagacgacgcggaaaaataccagaccttctggcaacagtttggcctggtactgaaagaaggtccggcggaagatttcgctaaccaggaagcgatcgccaaactgctgcgttttgcttctacccataccgattcttctgcgcagaccgtatctctggaagactacgtttcccgcatgaaagaagggcaggagaaaatctactacatcaccgcagacagctatgcggcagcgaagagcagcccgcacctggaactgctgcgtaagaaaggcatcgaagttctgctgctttccgaccgcatcgatgagtggatgatgaactatctgactgagttcgacggtaaaccgttccagtcggtgtctaaagttgacgagtcgcttgaaaaactggctgacgaagttgatgagagcgcgaaagaagcggagaaagcactgactccgttcatcgaccgtgtgaaagccctgctcggcgagcgcgtgaaagatgtccgtctgactcaccgtctgaccgatacgccagcgatcgtttcgaccgacgcggacgaaatgagcactcagatggcgaaactgttcgctgcggcgggccagaaagtgccagaagtgaaatacatcttcgaactgaacccggatcacgtactggtgaaacgtgcggcagatactgaagatgaagcgaagttcagcgagtgggtagaactgctgctggatcaggcgctgctggcagaacgcggcacgctggaagatccgaacctgtttattcgtcgtatgaaccagctgctggtttcctga

SEQ ID NO: 24426 - DNA, 963 bp, Escherichia coli
atgcgtcagactaaaaccggtatcctgctggcaaacctgggtacgcccgatgcccccacacctgaagcggtaaaacgctatctgaaacaatttttaagcgacagacgcgtggttgatacctcacggttgttatggtggccattgctgcgcggcgtgattttgccgctgcgctcgccgcgtgtggcgaagctgtatgcctctgtctggatggaaggtggctcgccgctgatggtttacagccgccagcaacagcaggcgctggcacaacgtttaccggagatgcccgtagcgctgggaatgagctacggctcgccatcactggaaagcgccgtagatgaactcctggcagagcatgtagatcatattgtggtgctgccgctttatccgcaattctcctgttctacggtcggtgcggtatgggatgaactggcacgcattctggcgcgcaaacgtagcattccggggatatcgtttatacgtgattacgccgataaccacgattacattaatgcactggcgaacagcgtacgcgcttcttttgccaaacatggcgaaccggatctgctactgctctcttatcatggcattccccagcgttatgcagatgaaggcgatgattacccgcaacgttgccgcacaacgactcgtgaactggcttccgcattggggatggcaccggaaaaagtgatgatgacctttcagtcgcgctttggtcgggaaccctggctgatgccttataccgacgaaacgctgaaaatgctcggagaaaaaggcgtaggtcatattcaggtgatgtgcccgggctttgctgcggattgtctggagacgctggaagagattgccgagcaaaaccgtgaggtcttcctcggtgccggcgggaaaaaatatgaatatattccggcgcttaatgccacgccggaacatatcgaaatgatggctaatcttgttgccgcgtatcgctaa

SEQ ID NO: 24427 - DNA, 1653 bp, Escherichia coli
atgaaattattgcagcggggcgtggcgttagcgctgttaaccacatttacactggcgagtgaaactgctctggcgtatgagcaggataaaacctacaaaattacagttctgcataccaatgatcatcatgggcatttttggcgcaatgaatatggcgaatatggtctggcggcgcaaaaaacgctggtggatggtatccgcaaagaggttgcggctgaaggcggtagcgtgctgctactttccggtggcgacattaacactggcgtgcccgagtctgacttacaggatgccgaacctgattttcgcggtatgaatctggtgggctatgacgcgatggcgatcggtaatcatgaatttgataatccgctcaccgtattacgccagcaggaaaagtgggccaagttcccgttgctttccgcgaatatctaccagaaaagtactggcgagcgcctgtttaaaccgtgggcgctgtttaagcgtcaggatctgaaaattgccgttattgggctgacaaccgatgacacagcaaaaattggtaacccggaatacttcactgatatcgaatttcgtaagcccgccgatgaagcgaagctggtgattcaggagctgcaacagacagaaaagccagacattattatcgcggcgacccatatggggcattacgataatggtgagcacggctctaacgcaccgggcgatgtggagatggcacgcgcgctgcctgccggatcgctggcgatgatcgtcggtggtcactcgcaagatccggtctgcatggcggcagaaaacaaaaaacaggtcgattacgtgccgggtacgccatgcaaaccagatcaacaaaacggcatctggattgtgcaggcgcatgagtggggcaaatacgtgggacgggctgattttgagtttcgtaatggcgaaatgaaaatggttaactaccagctgattccggtgaacctgaagaagaaagtgacctgggaagacgggaaaagcgagcgcgtgctttacactcctgaaatcgctgaaaaccagcaaatgatctcgctgttatcaccgttccagaacaaaggcaaagcgcagctggaagtgaaaataggcgaaaccaatggtcgtctggaaggcgatcgtgacaaagtgcgttttgtacagaccaatatggggcggttgattctggcagcccaaatggatcgcactggtgccgactttgcggtgatgagcggaggcggaattcgtgattctatcgaagcaggcgatatcagctataaaaacgtgctgaaagtgcagccattcggcaatgtggtggtgtatgccgacatgaccggtaaagaggtgattgattacctgaccgccgtcgcgcagatgaagccagattcaggtgcctacccgcaatttgccaacgttagctttgtggcgaaagacggcaaactgaacgaccttaaaatcaaaggcgaaccggtcgatccggcgaaaacttaccgtatggcgacattaaacttcaatgccaccggcggtgatggatatccgcgccttgataacaaaccgggctatgtgaataccggctttattgatgccgaagtgctgaaagcgtatatccagaaaagctcgccgctggatgtgagtgtttatgaaccgaaaggtgaggtgagctggcagtaa

SEQ ID NO: 24428 - DNA, 2505 bp, Escherichia coli
atgtcacaaactatcgacctgaccctggacggcctgtcctgcggtcactgcgttaaacgcgtgaaagaaagtcttgaacagcgtccggatgttgagcaggcggatgtgtctatcactgaagcgcacgttaccgggactgccagtgcagaacagctgatcgaaaccatcaaacaagcgggttatgacgcatctgtaagccacccaaaggctaaaccgctggcggagtcatcaatcccgtcggaagcactgacagcggtttctgaggcgcttccggcagcgaccgccgatgacgatgacagccagcagttgctgctgagcggcatgagctgcgccagctgtgtcacccgcgtacaaaatgcgctgcaaagcgtaccgggcgtcactcaggcacgggtaaacctggcggagcgtactgcgctggtgatgggcagtgcctccccacaagatttagtgcaggcggtggaaaaagcgggctacggcgcggaagcgattgaagatgacgctaaacgccgcgagcgccagcaagaaaccgccgtcgctacgatgaagcgcttccgctggcaggcaattgtcgcactggcggtgggtatcccggtgatggtctgggggatgatcggcgataacatgatggtcaccgctgacaaccgcagcctgtggttggttatcggcctgataaccctggcagtgatggttttcgccggcggccatttttaccgcagtgcatggaaaagcctgctgaacggtgcggcgacgatggatacgctggtggcgctgggtactggcgtggcgtggctctattcgatgagcgtcaacctgtggccgcagtggttcccgatggaagcgcgacatctttattacgaagccagcgcgatgattatcggtctgatcaatctcggccatatgctggaagcgcgcgcacgccagcgttcttctaaggcgctggaaaagttactcgatttaaccccgccgacggcacgcctggttactgacgaaggtgaaaaaagcgtgcctctggcagaagtgcagccaggtatgttgctgcgcctgacgaccggcgatcgcgtgccggtagatggcgagattacccagggcgaagcatggctggatgaagcgatgctgacgggcgaaccaatcccgcagcaaaaaggcgaaggcgatagcgtccatgccgggacagtggtacaggacggcagtgtgctgtttcgtgccagtgcggttggcagccatactacgctgtcacgaatcattcgcatggtgcgccaggcccagagcagcaagccagaaatcggtcagctggcggataaaatctcagccgtatttgtgccggtagtggtggttattgcgcttgtcagtgcggcaatctggtatttctttggtccggcaccgcagattgtctataccctggtgattgccaccacggtactgattattgcctgtccgtgtgcgctggggctggcgacgccgatgtcgattatttccggcgtcgggcgggcggctgagtttggcgtgctggtgcgggacgctgacgcgctgcaacgcgccagtacactcgacactgtagtgttcgataaaaccgggacgctgactgaagggaagccgcaggttgtcgcagtgaaaacatttgctgatgttgatgaagcgcaggcattgcgtctggcggcggcactggagcaaggttccagccatccgctggcacgagcgatcctcgataaagcaggtgatatgcagctaccgcaggtcaacggtttccgcacattgcgcgggctgggcgtgagcggtgaagctgaaggtcatgcgttattgctgggcaatcaggcgctgttaaatgagcaacaggttggtaccaaagctatcgaagcggagattactgctcaggcatcgcaaggggcaacgcctgtgctgctggcggttgacgggaaagcggtagccctgctggcagtacgcgatccgttgcgtagtgatagcgtggcggcgctgcaacgcctgcataaagcgggatatcgtctggtgatgttgaccggggataacccaaccaccgccaatgcgatcgccaaagaagcagggattgatgaggtgatcgccggggtgctgccggacggtaaagccgaagcgatcaaacatctgcaaagtgaaggacgtcaggtggcaatggtgggcgacggcattaacgacgcgccagcgctggctcaggcggatgtcggcattgcgatgggtggcggcagtgatgttgccattgaaaccgcggcgattaccctgatgcgccatagcctgatgggcgttgcggatgcgctcgctatttcccgcgcaacgctgcacaacatgaagcagaacctgctcggtgcgtttatctacaacagtatcggtattccggtcgccgccggtattttgtggccgttcactggaacactgcttaacccggtagttgccggagcggcaatggcgctctcgtcgattaccgtagtgagtaacgccaaccggttgctgcggtttaaaccgaaggaataa

SEQ ID NO: 24429 - DNA, 1293 bp, Escherichia coli
atgatgaacacggaaggtaataacggtaacaaacctctcggtctatggaacgtcgtttccatcggcattggggcaatggtgggggcggggatcttcgcgctgctggggcaggctgcattgctaatggaagcctcgacctgggtcgcctttgcttttggcggtattgtggcgatgttttccggttatgcctatgcgcgtctgggggcgagctatcccagcaatggcggcattatcgacttctttcgtcgcggattaggcaacggcgtcttttcgctggcgctctcgttactgtacctgttgacgctggcggtgagcatcgccatggtcgcccgtgcttttggcgcttatgccgtgcagtttttgcatgaaggcagccaggaggagcaccttattttgctctacgcgttggggatcattgcggtgatgacgcttttcaactccttaagcaaccatgcggtagggcggctggaagtgatcctcgtcggcattaaaatgatgatcctgttattgctgattattgccggtgtctggtcgctgcaaccggcgcatatttccgtctctgcgccccccagctccggtgcgttcttctcctgtattgggataactttccttgcctatgcgggctttggcatgatggcgaacgcggcggataaagtgaaagatccgcaggtcattatgccacgggcgtttctggtggcgattggcgttaccacgttgctttatatctcgctggcactggttttgcttagcgatgtatcggcattagagttagaaaaatatgccgataccgccgtagcgcaggctgcttctccgctgctcgggcatgtgggttatgtgatcgtcgtcatcggcgctttactggcgacggcttcagccattaacgcgaacctgttcgccgtgtttaacatcatggacaacatgggcagcgaacgcgaactgccgaagctaatgaataaatccctgtggcggcagagtacctggggcaacattattgtcgtggtgttgattatgctgatgacggcggcactgaatttaggctcactcgccagcgttgccagcgccacctttttgatttgctacctggcggtgtttgtggtggcgatccgcctgcgtcatgatattcacgcctcgttgccgattcttatcgttggtacgttggtgatgttgttggtgatcgttggctttatctacagtctgtggtcccagggtagccgtgcgttgatatggattattggctcactcttactcagccttattgtggcaatggtcatgaagcgcaataaaaccgtataa

SEQ ID NO: 24430 - DNA, 1050 bp, Escherichia coli
atgaaaatcagtcgggaaacactccaccagctaattgagaataaactctgccaggctgggttaaaacgtgagcacgctgcaaccgtggctgaagtattggtttacgccgatgccagagggatccactctcatggcgcggtgcgcgtggaatactacgcggaacgcatttcaaaaggcggcaccaaccgcgaaccggagtttcgtcttgaggaaaccgggccgtgctcggcaattttacatgccgacaatgccgccggacaggtcgcggcgaaaatgggtatggaacatgccatcaaaaccgcccagcaaaatggcgttgcggtggtcggtatcagccggatgggtcacagcggcgcaatctcttattttgtgcagcaggcagcccgcgccggattcattggcatttcgatgtgccagtccgatccaatggtggtgccgtttggcggcgcggaaatttactacggtactaaccccctggcctttgccgcgccgggagaaggcgacgagatccttacctttgatatggcgactaccgtacaggcatggggaaaagtgctcgacgcccgctcgcgtaatatgtctatcccggatacctgggcggtcgataaaaacggtgtaccaacaaccgatccgttcgcggtacatgctctgctccccgccgccgggccaaaagggtatggcctgatgatgatgattgacgtcctctcaggcgtcttactcggcttaccgttcgggcgacaggttagttcgatgtatgacgatttacacgcagggcgtaatttggggcaattacatatagttattaatccgaactttttctcctccagcgaattattccgtcaacatcttagccagaccatgcgcgaattaaatgccattacccccgcgcccggttttaatcaggtttattatcccggacaggatcaggatattaaacaacgcaaagccgccgtcgaaggcatcgaaattgttgatgatatttaccagtatttaatttccgacgcgctttataacacgtcatacgaaacgaaaaatccctttgcgcaataa

SEQ ID NO: 24431 - DNA, 867 bp, Escherichia coli
atggcagcaaagattattgacggtaaaacgattgcgcagcaggtgcgctctgaagttgctcaaaaagttcaggcgcgtattgcagccggactgcgggcaccaggactggccgttgtgctggtgggtagtaaccctgcatcgcaaatttatgtcgcaagcaaacgcaaggcttgtgaagaagtcgggttcgtctcccgctcttatgacctcccggaaaccaccagcgaagcggagctgctggagcttatcgatacgctgaatgccgacaacaccatcgatggcattctggttcaactgccgttaccggcgggtattgataacgtcaaagtgctggaacgtattcatccggacaaagacgtggacggtttccatccttacaacgtcggtcgtctgtgccagcgcgcgccgcgtctgcgtccctgcaccccgcgcggtatcgtcacgctgcttgagcgttacaacattgataccttcggcctcaacgccgtggtgattggcgcatcgaatatcgttggccgcccgatgagcatggaactgctgctggcaggttgcaccactacagtgactcaccgcttcactaaaaatctgcgtcatcacgtagaaaatgccgatctattgatcgttgccgttggcaagccaggctttattcccggtgactggatcaaagaaggcgcaattgtgattgatgtcggcatcaaccgtctggaaaatggcaaagttgtgggcgacgtcgtgtttgaagacgcggctaaacgcgcctcatacattacgcctgttcccggcggcgttggcccgatgacggttgccacgctgattgaaaacacgctacaggcgtgcgttgaatatcatgatccacaggatgagtaa

SEQ ID NO: 24432 - DNA, 1377 bp, Escherichia coli
gtgaaaaacgcgtcaaccgtatcggaagatactgcgtcgaatcaagagccgacgcttcatcgcggattacataaccgtcatattcaactgattgcgttgggtggcgcaattggtactggtctgtttcttggcattggcccggcgattcagatggcgggtccggctgtattgctgggctacggcgtcgccgggatcatcgctttcctgattatgcgccagcttggcgaaatggtggttgaggagccggtatccggttcatttgcccactttgcctataaatactggggaccgtttgcgggcttcctctctggctggaactactgggtaatgttcgtgctggtgggaatggcagagctgaccgctgcgggcatctatatgcagtactggttcccggatgttccaacgtggatttgggctgccgccttctttattatcatcaacgccgttaacctggtgaacgtgcgcttatatggcgaaaccgagttctggtttgcgttgattaaagtgctggcaatcatcggtatgatcggctttggcctgtggctgctgttttctggtcacggcggcgagaaagccagtatcgacaacctctggcgctacggtggtttcttcgccaccggctggaatgggctgattttgtcgctggcggtaattatgttctccttcggcggtctggagctgattgggattactgccgctgaagcgcgcgatccggaaaaaagcattccaaaagcggtaaatcaggtggtgtatcgcatcctgctgttttacatcggttcactggtggttttactggcgctctatccgtgggtggaagtgaaatccaacagtagcccgtttgtgatgattttccataatctcgacagcaacgtggtagcttctgcgctgaacttcgtcattctggtagcatcgctgtcagtgtataacagcggggtttactctaacagccgcatgctgtttggcctttctgtgcagggtaatgcgccgaagtttttgactcgcgtcagccgtcgcggtgtgccgattaactcgctgatgctttccggagcgatcacttcgctggtggtgttaatcaactatctgctgccgcaaaaagcgtttggtctgctgatggcgctggtggtagcaacgctgctgttgaactggattatgatctgtctggcgcatctgcgttttcgtgcagcgatgcgacgtcaggggcgtgaaacacagtttaaggcgctgctctatccgttcggcaactatctctgcattgccttcctcggcatgattttgctgctgatgtgcacgatggatgatatgcgcttgtcagcgatcctgctgccggtgtggattgtattcctgtttatggcatttaaaacgctgcgtcggaaataa

SEQ ID NO: 24433 - DNA, 1611 bp, Escherichia coli
atgagcattccattcacccgctggccggaagagtttgcccgtcgctatcgggaaaaaggctactggcaggatttgccgctgaccgacattctgacgcgacatgctgcgagtgacagcatcgcggttatcgacggcgagcgacagttgagttatcgggagctgaatcaggcggcggataacctcgcgtgtagtttacgccgtcagggcattaaacctggtgaaaccgcgctggtacaactgggtaacgtcgctgaattgtatattacctttttcgcgctgctgaaactgggcgttgcgccggtgctggcgttgttcagccatcagcgtagtgaactgaacgcctatgccagccagattgaacccgcattgctgattgccgatcgccaacatgcgctgtttagcggggatgatttcctcaatactttcgtcacagaacattcctccattcgcgtggtgcaactgctcaacgacagcggtgagcataacttgcaggatgcgattaaccatccggctgaggattttactgccacgccatcacctgctgatgaagtggcctatttccagctttccggtggcaccaccggcacaccgaaactgatcccgcgcactcataacgactactactacagcgtgcgtcgtagcgtcgagatttgtcagttcacacaacagacacgctacctgtgcgcgatcccggcggctcataactacgccatgagttcgccaggatcgctgggcgtctttcttgccggaggaacggttgttctggcggccgatcccagcgccacgctctgtttcccattgattgaaaaacatcaggttaacgttaccgcgctggtgccacccgcagtcagcctgtggttgcaggcgctgatcgaaggcgaaagccgggcgcagcttgcctcgctgaaactgttacaggtcggcggcgcacgtctttctgccacccttgcggcgcgtattcccgctgagattggctgtcagttgcagcaggtgtttggcatggcggaagggctggtgaactacacccgacttgatgatagcgcggagaaaattatccatacccagggttacccaatgtgtccggatgacgaagtatgggttgccgatgccgaaggaaatccactgccgcaaggggaagtcggacgcctgatgacgcgcgggccgtacaccttccgcggctattacaaaagtccacagcacaatgccagcgcctttgatgccaacggtttttactgttccggcgatctgatctctattgatccagagggttacatcaccgtgcaggggcgcgagaaagatcagattaaccgtggcggcgagaagatcgctgccgaagagatcgaaaacctgctgctgcgccacccggcggtgatctacgccgcactggtgagcatggaagatgagctgatgggcgaaaaaagctgcgcttatctggtggtaaaagagccgctgcgcgcggtgcaggtgcgtcgtttcctgcgtgaacagggtattgccgaatttaaattaccggatcgcgtggagtgtgtggattcacttccgctgacggcggtcgggaaagtcgataaaaaacaattacgtcagtggctggcgtcacgcgcatcagcctga

SEQ ID NO: 24434 - DNA, 747 bp, Escherichia coli
atggatttcagcggtaaaaatgtctgggtaaccggcgcaggtaaaggtatcggctacgccacggcgctggcgtttgttgaggcgggagcgaaagttacaggttttgatcaagcgttcactcaggagcaatatccctttgcgaccgaagtgatggatgttgccgacgctgcgcaggtcgcgcaagtgtgtcagcgactgttagctgaaacggagcgactggacgcgctggtcaatgcggcgggaattttacgcatgggcgcgaccgatcagctcagtaaagaggactggcagcagacttttgcggttaacgtcggcggtgcgtttaacctgttccagcaaaccatgaaccagtttcgccgtcagcggggcggggcgattgtcactgtggcgtccgacgccgcgcacacgccgcgtattggcatgagtgcttatggcgcatcgaaagcggcgctgaaaagcctggcgttgagcgtcgggctggaactggcgggtagcggcgtgcgctgtaatgtggtttcgcctggctccaccgacaccgatatgcaacgcacgctgtgggtgagcgatgacgccgaagaacagcgtattcgcggctttggcgagcagtttaaactcggcattccgctggggaaaatcgcccgtccacaagagatcgccaacacgattttgttcctcgcctctgacctcgccagccatattaccctacaggatattgtggtcgatggcggctcaacgctgggggcataa

SEQ ID NO: 24435 - DNA, 1089 bp, Escherichia coli
atgcctcacaatcctatccgcgtggtcgtcggcccggctaactacttttcacatccaggaagtttcaatcacctgcacgattttttcactgatgaacaactttctcgcgcggtgtggatctacggcaaacgcgccattgctgcggcgcaaaccaaacttccgccagcgtttggactgccaggggcaaagcatattttgtttcgcggtcattgcagcgaaagcgatgtacaacaactggcggctgagtccggtgacgaccgcagcgtggtgattggcgtcggtggcggtgcactgctcgacaccgcgaaagccctcgcccgccgtctcggtctgccgtttgttgccgttccgacgatcgccgccacctgcgccgcctggacaccgctctccgtctggtataatgatgccggacaggcgctgcattatgagattttcgacgacgccaattttatggtgctggtggaaccggagattatcctcaatgcaccgcaacaatatctgctggcggggatcggtgacacgctggcgaaatggtatgaagcggtggtgctggctccgcaaccagaaacgttgccgctaaccgtgcgactggggatcaataatgcgcaagccattcgcgacgtcttgttaaacagtagcgaacaggcgctgagcgatcagcaaaatcaacagttaacgcaatcattttgcgatgtggtggatgctattattgctggtggtgggatggttggtggtctgggcgatcgttttacgcgtgtggcggcagctcatgccgtgcataacggtctgaccgtgctgccgcaaaccgagaagtttctccacggcaccaaagtcgcctacggaattctggtgcaaagcgccttgctgggtcaggatgatgtgctggcgcaattaactggagcgtatcagcgttttcatctgccgactacactggcggagctggaagtggatatcaataatcaggcggagatcgacaaagtgattgcccacaccctgcgtccggtggagtccattcattacctgccagtcacgctgacaccagatacgttgcgtgcagcgttcaaaaaagtggaatcgtttaaagcctga

SEQ ID NO: 24436 - DNA, 1464 bp, Escherichia coli
atgtctttagcaaaagataatatatggaaactattggccccactggtggtgatgggtgtcatgtttcttatccctgtccccgacggtatgccgccgcaggcatggcattacttcgctgtgtttgtggcaatgattgtcggcatgatcctcgagccaattccggcaacagcgatcagttttattgcggttactatttgcgttattggcagtaattacctgctctttgatgccaaagaattagctgacccagcgtttaatgcgcaaaaacaggcgctgaaatggggcctggctggtttttccagcaccacggtatggctggtatttggcgcatttatttttgcattagggtatgaagtttccgggttaggtcgtcgcattgcccttttcctggtgaaattcatgggcaaacgcacgctgacgttgggttatgcgattgtcattatcgacattctgctggcaccgtttacaccttccaacaccgcgcgtaccgggggtacggtttttccggtcattaaaaacctgccgccgttgtttaaatcattcccgaacgatccgtccgcgcgtcgtattggcggctatttgatgtggatgatggtcattagtaccagtctgagttcgtccatgtttgtcaccggtgcggcaccaaacgtgctgggtctggagttcgtcagcaaaattgccggtatccagattagctggttgcagtggttcctctgcttcctgccggttggggttatcttgcttatcattgcgccgtggctttcctacgtgctgtacaaaccggaaatcacacacagtgaagaagtggcaacctgggcgggtgatgaactgaaaaccatgggtgcgctgacacgcagagagtggacactgattggccttgtattgctcagcttaggtttgtgggtatttggcagtgaagtcattaatgctactgcggttggtctgctggcagtttcgctaatgctggccctgcacgttgtgccttggaaagacattacccgctataacagcgcatggaacacactggtcaacctggcaactctggttgtgatggctaacggcctgactcgttctggttttattgactggttcgccggtaccatgagtacgcacctggaaggattctcaccaaacgcaacggtgattgtactggttctggtgttctactttgcacactacctgtttgccagcctgtctgcgcacaccgcaaccatgctgccggttattctggccgtcggtaaaggtattccgggcgtaccaatggaacaactgtgtatcctgctggtgctgtctatcggtatcatgggctgtctgacgccgtatgcaaccggtcctggggtgattatttacggctgtggctatgtgaaatcaaaagattactggcgtcttggcgcaatcttcggggtgatttacatctctatgttgctgttggttggctggccgattctcgccatgtggaactaa

SEQ ID NO: 24437 - DNA, 1671 bp, Escherichia coli
atggataatgcagaactcgccattggtatcgatctcggtactaccaatagtttaattgccgtctggaaagacggtgccgcgcaattaattccaaataagttcggtgaatatttaacaccatccataattagcatggatgaaaataatcatattttagtcggaaaaccggctgtatcacggcgtacttcgcatccggataaaacggcagcgttatttaaacgtgcaatgggcagtaataccaactggcggttaggcagcgacacatttaacgcgccagaactgtcctctttggtattacgctcattaaaagaagatgccgaagaatttctgcaacgtccgattaaagatgtggtgatctccgttccggcttatttcagcgatgaacaacgcaagcatacccgtttagcagcggagttagccgggttaaatgcggtacgcttaattaatgaacccacagcagctgcgatggcgtatggcctgcatacccaacaaaatacccgttcgctggtgtttgatctcggtggcggcacgtttgacgttacggtgcttgagtacgccacgccggtgattgaagttcacgcctccgctggcgacaactttcttggtggcgaagattttacccatatgctggtcgatgaggttttaaaacgcgcggatgtcgccaggaccacgcttaacgagagtgaactggcagccttgtacgcctgtgtggaagcggcaaaatgtagcaatcaatcgccattgcacattcgctggcagtatcaggaagaaacgcgggaatgcgaattttacgagaacgaactggaagatttgtggttgccgctgctcaatcgcttgcgagtgccgattgaacaggcgttgcgcgatgcgcgtctgaagccgagtcaaatcgacagtctggtgctggttggcggcgcgtcacaaatgccgctggtgcagcgaatcgccgtgcgtctgtttggcaaattaccgtatcaaagttacgatccgagcaccattgtcgcgctgggcgcagcaatccaggccgcctgccgcttacgcagtgaagatattgaagaggtaatcctcactgatatttgcccttactcgttgggcgttgaagttaaccgccagggcgtttccggcattttctcgccgattattgaacgaaacaccactgtgcccgtgtcgcgtgtagaaacttattcaaccatgcacccggaacaggattcaattacggttaacgtctatcagggagaaaaccacaaagttaaaaacaacattctggtggaatccttcgatgtgccgttgaagaaaaccggggcttatcagtcgattgatattcgctttagttatgatatcaacgggttgcttgaagttgacgtgcttctggaagacggcagcgttaagtccagagtgattaaccacagcccggtaacattgagcgcgcagcagattgaagagagtcggacgcggttatccgcattgaaaatttatccgcgcgatatgctcatcaatcgcacctttaaagccaaactggaagagttgtgggcgcgggcgctgggtgacgagcgagaagagatcggccgggtgatcaccgattttgatgcggcgttgcagtcaaacgatatggcccgcgtggatgaagttcggcggcgggcgagcgattatttagccattgagatcccataa

SEQ ID NO: 24438 - DNA, 1665 bp, Escherichia coli
atgagtgaggcagaagcccgcccgactaactttatccgtcagatcatcgatgaagatctggccagtggtaagcacaccacagtacacacccgtttcccgccggagccgaatggctatctgcatattggccatgcgaaatctatctgcctgaacttcgggatcgcccaggactataaaggccagtgcaacctgcgtttcgacgacactaacccggtaaaagaagatatcgagtatgttgagtcgatcaaaaacgacgtagagtggttaggttttcactggtctggtaacgtccgttactcctccgattattttgatcagctccacgcctatgcgatcgaactgatcaataaaggcctggcgtacgttgatgaactgacgccggaacagatccgcgaataccgcggcaccctgacgcaaccgggtaaaaacagcccgtaccgcgaccgcagcgttgaagagaacctggcgctgttcgaaaaaatgcgtgccggtggttttgaagaaggtaaagcctgcctgcgtgcgaaaatcgacatggcttcaccgtttatcgtgatgcgcgatccggtgctgtaccgtattaaatttgctgaacaccaccagactggcaacaagtggtgcatctacccgatgtacgacttcacccactgcatcagcgatgccctggaaggtattacgcactctctgtgtacgcttgagttccaggacaaccgtcgtctgtacgactgggtactggacaacatcacgattcctgttcacccgcgccagtatgagttctcgcgcctgaatctggaatacaccgtgatgtccaagcgtaagttgaacctgctggtgaccgacaagcacgttgaaggctgggatgacccgcgtatgccgaccatttccggtctgcgtcgtcgtggttacactgcggcttctattcgtgagttctgcaaacgcatcggcgtgaccaagcaggacaacaccattgagatggcgtcgctggaatcctgcatccgtgaagatctcaacgaaaatgcgccgcgcgcaatggcggttatcgatccggtgaaactggttatcgaaaactatcagggcgaaggcgaaatggttaccatgccgaaccatccgaacaaaccggaaatgggcagccgtcaggtgccgtttagcggtgagatttggattgatcgcgccgatttccgcgaagaagctaacaagcagtacaaacgtctggtgctgggtaaagaagtgcgtctgcgtaatgcttatgtgattaaggcagaacgcgtcgagaaagatgccgaaggtaatatcaccaccatcttctgtacttatgacgccgataccttaagcaaagatccggcagatggtcgtaaagtcaaaggtgttattcactgggtgagcgcggcacatgcgctgccggttgaaatccgtttgtatgaccgtctgttcagcgtgcctaacccaggtgctgcggatgatttcctgtcggtgattaacccggaatcgctggtgatcaaacagggctttgctgaaccgtcgctgaaagatgcggttgcgggtaaagcattccagtttgagcgtgaaggttacttctgcctcgatagccgccattctacggcggaaaaaccggtatttaaccgcaccgttgggctgcgtgatacctgggcgaaagtaggcgagtaa

SEQ ID NO: 24439 - DNA, 1641 bp, Escherichia coli
atggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaa

SEQ ID NO: 24440 - DNA, 1320 bp, Escherichia coli
atgagtcaggctaaatcgaacaaaatgggcgtcgttcagttaaccatactgacgatggtcaacatgatgggctccggtatcatcatgctgccgacaaagcttgccgaagtcgggacaatctcaattatctcctggctggtgacagccgtaggctcaatggcactggcatgggcattcgcaaaatgcggtatgttcagccgtaaatcaggcggtatgggcggttatgccgagtatgctttcggtaaatccggtaactttatggcgaactatacctacggcgtctcactgctgattgctaacgtcgcgattgctatttcggcggttggttacggcaccgaactgctcggcgcgagtttgtcgccagtgcagattggtcttgcgaccatcggggtgctgtggatttgtaccgtggctaactttggtggtgcgcgcattaccgggcaaatcagtagcattaccgtgtggggggtcattattccggtcgtcggtctgtgcattattggctggttctggtttagcccgacgctgtacgttgattcctggaatccgcatcatgcaccgttcttcagtgcggtaggttcttccatcgctatgacgctgtgggcttttcttggtctggagtctgcgtgtgcgaatactgatgtagtggaaaacccggaacgtaatgtgccaatcgcggtactcggcggtacgttaggtgcggcggtgatttatatcgtctccaccaacgtgattgccgggattgtgccaaatatggagctggcaaattcaacggcaccatttggtctggccttcgcgcagatgttcacgccggaagtgggtaaagtcattatggcgctgatggtgatgtcctgctgcggttcgctacttggctggcagttcaccattgcccaggtgtttaaatcttcatctgatgaaggctacttccctaaaattttctcccgtgtaaccaaagtggatgcaccggtgcagggaatgttgaccattgtgattattcagagtggattggcactgatgaccattagcccgtcgctaaacagtcagttcaacgtgctggttaacctggccgtggtgaccaatatcattccgtatattctgtcaatggcggcattagtcattattcagaaggtcgctaatgtgcccccctcaaaagcgaaagttgcaaactttgttgcttttgttggcgcgatgtatagcttttatgcgctgtactcatccggggaagaagccatgctgtacggttccatcgtgaccttccttggttggacactgtatggtctggtatcaccacgctttgaactgaaaaataaacacggttaa

SEQ ID NO: 24441 - DNA, 2199 bp, Escherichia coli
atgtcaaaattaaaaattgcggttagtgattcttgcccggactgttttaccacgcagcgagaatgtatctacattaatgaaagtcgtaatatcgatgtggcggcaatagttttatcgctcaacgatgttacatgcggaaaactcgatgaaatcgatgccacgggttatggcatcccggtatttattgctactgaaaatcaagaacgtgtacccgcagagtatttgccccgtatttcgggtgtctttgagaattgcgaatcgcgacgagaattttatggtcgccagttagaaaccgctgccagccattatgaaactcaactgcgcccacctttcttccgcgcactggtcgattatgtcaatcaaggtaacagcgcgtttgattgccctggtcatcagggcggcgaatttttccgtcgccatccggcggggaatcagtttgtggaatactttggtgaggcgctgttccgtgccgacttgtgcaacgccgacgtagcgatgggcgatctgctgattcacgaaggcgcgccatgcattgcacagcaacatgcggcaaaagtgtttaatgccgataaaacctacttcgttttaaatggcacttcatcttctaacaaagtggttttaaacgccctgctaacaccgggtgatctggtgctgtttgatcgcaataaccacaaatctaaccaccacggagcgttgctacaggctggtgcaacaccggtttatctggaaacggcacgtaacccgtatggctttatcggtggcattgatgcgcactgttttgaagaaagttacctgcgtgagctgatcgcggaagtcgcaccgcagcgggcaaaagaggctcgtcctttccgcctcgctgtgattcagttaggcacctacgacggtacgatttataacgcccgccaagtggtggataaaattggtcatctgtgtgactacatcctgtttgactcagcatgggtcggctatgaacagtttattccgatgatggcggactgttcgccgctgttgctggatcttaatgagaacgatccgggtattctggttacgcaatctgtgcataaacaacaggctggtttttctcagacttcacaaattcataaaaaagacagccacatcaaagggcaacagcgttatgtaccgcacaaacgcatgaacaacgcctttatgatgcacgcctccaccagcccgttctatccgctgtttgccgcactgaatatcaacgccaaaatgcatgaaggtgtcagcggtcgtaatatgtggatggattgtgtggtaaatggcattaatgcccgcaaactgatcctcgataactgtcagcatattcgtccgttcgtacctgaactggtggatggtaaaccctggcagtcgtatgaaacagcgcaaattgcggttgatctgcgcttcttccagtttgtaccaggggaacactggcattcttttgaaggctatgcagagaatcaatactttgtcgatccatgcaaactgttgctgacaaccccaggtattgatgcacgtaacggcgaatatgaagcgttcggtgtacccgcgacgattcttgctaacttcctgcgcgaaaatggcgtagtgccggaaaaatgcgatcttaactccatcctcttcctgctgactccggcagaagatatggccaaacttcagcaacttgttgccctgctggtacgcttcgaaaaactgcttgagtccgacgcgccattagcagaagtgctaccttccatctacaaacagcatgaagagcgctacgccggttataccctgcgtcagttgtgtcaggaaatgcatgatttgtatgcccgccacaacgtgaaacaactgcaaaaagagatgttccgtaaggagcacttcccacgcgtcagcatgaatccgcaagaagccaactacgcctatttacgcggtgaagtggaactggttcgtctgccggatgcagaaggccgtatcgctgccgaaggtgcgcttccttatcctccgggtgtgctgtgtgttgttccgggtgaaatctggggtggtgctgttctgcgttacttcagcgctctggaagaagggatcaacctgctgccaggttttgcaccggagctgcagggtgtctatatcgaagaacatgatggtcgtaagcaagtttggtgctatgtcatcaagcctcgtgatgcgcaaagcaccctgttgaaaggggaaaaattatga

SEQ ID NO: 24442 - DNA, 1284 bp, Escherichia coli
atggctgatacaaaagcaaaactcaccctcaacggggatacagctgttgaactggatgtgctgaaaggcacgctgggtcaagatgttattgatatccgtactctcggttcaaaaggtgtgttcacctttgacccaggcttcacttcaaccgcatcctgcgaatctaaaattacttttattgatggtgatgaaggtattttgctgcaccgcggtttcccgatcgatcagctggcgaccgattctaactacctggaagtttgttacatcctgctgaatggtgaaaaaccgactcaggaacagtatgacgaatttaaaactacggtgacccgtcataccatgatccacgagcagattacccgtctgttccatgctttccgtcgcgactcgcatccaatggcagtcatgtgtggtattaccggcgcgctggcggcgttctatcacgactcgctggatgttaacaatcctcgtcaccgtgaaattgccgcgttccgcctgctgtcgaaaatgccgaccatggccgcgatgtgttacaagtattccattggtcagccatttgtttacccgcgcaacgatctctcctacgccggtaacttcctgaatatgatgttctccacgccgtgcgaaccgtatgaagttaatccgattctggaacgtgctatggaccgtattctgatcctgcacgctgaccatgaacagaacgcctctacctccaccgtgcgtaccgctggctcttcgggtgcgaacccgtttgcctgtatcgcagcaggtattgcttcactgtggggacctgcgcacggcggtgctaacgaagcggcgctgaaaatgctggaagaaatcagctccgttaaacacattccggaatttgttcgtcgtgcgaaagacaaaaatgattctttccgcctgatgggcttcggtcaccgcgtgtacaaaaattacgacccgcgcgccaccgtaatgcgtgaaacctgccatgaagtgctgaaagagctgggcacgaaggatgacctgctggaagtggctatggagctggaaaacatcgcgctgaacgacccgtactttatcgagaagaaactgtacccgaacgtcgatttctactctggtatcatcctgaaagcgatgggtattccgtcttccatgttcaccgtcattttcgcaatggcacgtaccgttggctggatcgcccactggagcgaaatgcacagtgacggtatgaagattgcccgtccgcgtcagctgtatacaggatatgaaaaacgcgactttaaaagcgatatcaagcgttaa

SEQ ID NO: 24443 - DNA, 1767 bp, Escherichia coli
atgaaattgccagtcagagaatttgatgcagttgtgattggtgccggtggcgcaggtatgcgcgcggcgctgcaaatttcccagagcggccagacctgtgcgctgctctctaaagtcttcccgacccgttcccataccgtttctgcgcaaggcggcattaccgttgcgctgggtaatacccatgaagataactgggaatggcatatgtacgacaccgtgaaagggtcggactatatcggtgaccaggacgcgattgaatatatgtgtaaaaccgggccggaagcgattctggaactcgaacacatgggcctgccgttctcgcgtctcgatgatggtcgtatctatcaacgtccgtttggcggtcagtcgaaaaacttcggcggcgagcaggcggcacgcactgcggcagcagctgaccgtaccggtcacgcactgttgcacacgctttatcagcagaacctgaaaaaccacaccaccattttctccgagtggtatgcgctggatctggtgaaaaaccaggatggcgcggtggtgggttgtaccgcactgtgcatcgaaaccggtgaagtggtttatttcaaagcccgcgctaccgtgctggcgactggcggagcagggcgtatttatcagtccaccaccaacgcccacattaacaccggcgacggtgtcggcatggctatccgtgccggcgtaccggtgcaggatatggaaatgtggcagttccacccgaccggcattgccggtgcgggcgtactggtcaccgaaggttgccgtggtgaaggcggttatctgctgaacaaacatggcgaacgttttatggagcgttatgcgccgaacgccaaagacctggcgggccgtgacgtggttgcgcgttccatcatgatcgaaatccgtgaaggtcgcggctgtgatggtccgtgggggccacacgcgaaactgaaactcgatcacctgggtaaagaagttctcgaatcccgtctgccgggtatcctggagctttcccgtaccttcgctcacgtcgatccggtgaaagagccgattccggttatcccaacctgtcactacatgatgggcggtattccgaccaaagttaccggtcaggcactgactgtgaatgagaaaggcgaagatgtggttgttccgggactgtttgccgttggtgaaatcgcttgtgtatcggtacacggcgctaaccgtctgggcggcaactcgctgctggacctggtggtctttggtcgcgcggcaggtctgcatctgcaagagtctatcgccgagcagggcgcactgcgcgatgccagcgagtctgatgttgaagcgtctctggatcgcctgaaccgctggaacaataatcgtaacggtgaagatccggtggcgatccgtaaagcgctgcaagaatgtatgcagcataacttctcggtcttccgtgaaggtgatgcgatggcgaaagggcttgagcagttgaaagtgatccgcgagcgtctgaaaaatgcccgtctggatgacacttccagcgagttcaacacccagcgcgttgagtgcctggaactggataacctgatggaaacggcgtatgcaacggctgtttctgccaacttccgtaccgaaagccgtggcgcgcatagccgcttcgacttcccggatcgtgatgatgaaaactggctgtgccactccctgtatctgccagagtcggaatccatgacgcgccgaagcgtcaacatggaaccgaaactgcgcccggcattcccgccgaagattcgtacttactaa

SEQ ID NO: 24444 - DNA, 717 bp, Escherichia coli
atgagactcgagttttcaatttatcgctataacccggatgttgatgatgctccgcgtatgcaggattacaccctggaagcggatgaaggtcgcgacatgatgctgctggatgcgcttatccagctaaaagagaaagatcccagcctgtcgttccgccgctcctgccgtgaaggtgtgtgcggttccgacggtctgaacatgaacggcaagaatggtctggcctgtattaccccgatttcggcactcaaccagccgggcaagaagattgtgattcgcccgctgccaggtttaccggtgatccgcgatttggtggtagacatgggacaattctatgcgcaatatgagaaaattaagccttacctgttgaataatggacaaaatccgccagctcgcgagcatttacagatgccagagcagcgcgaaaaactcgacgggctgtatgaatgtattctctgcgcatgttgttcaacctcttgtccgtctttctggtggaatcccgataagtttatcggcccggcaggcttgttagcggcatatcgtttcctgattgatagccgtgataccgagactgacagccgcctcgacggtttgagtgatgcattcagcgtattccgctgtcacagcatcatgaactgcgtcagtgtatgtccgaaggggctgaacccgacgcgcgccatcggccatatcaagtcgatgttgttgcaacgtaatgcgtaa

SEQ ID NO: 24445 - DNA, 2802 bp, Escherichia coli
atgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataa

SEQ ID NO: 24446 - DNA, 1218 bp, Escherichia coli
atgagtagcgtagatattctggtccctgacctgcctgaatccgtagccgatgccaccgtcgcaacctggcataaaaaacccggcgacgcagtcgtacgtgatgaagtgctggtagaaatcgaaactgacaaagtggtactggaagtaccggcatcagcagacggcattctggatgcggttctggaagatgaaggtacaacggtaacgtctcgtcagatccttggtcgcctgcgtgaaggcaacagcgccggtaaagaaaccagcgccaaatctgaagagaaagcgtccactccggcgcaacgccagcaggcgtctctggaagagcaaaacaacgatgcgttaagcccggcgatccgtcgcctgctggctgaacacaatctcgacgccagcgccattaaaggcaccggtgtgggtggtcgtctgactcgtgaagatgtggaaaaacatctggcgaaagccccggcgaaagagtctgctccggcagcggctgctccggcggcgcaaccggctctggctgcacgtagtgaaaaacgtgtcccgatgactcgcctgcgtaagcgtgtggcagagcgtctgctggaagcgaaaaactccaccgccatgctgaccacgttcaacgaagtcaacatgaagccgattatggatctgcgtaagcagtacggtgaagcgtttgaaaaacgccacggcatccgtctgggctttatgtccttctacgtgaaagcggtggttgaagccctgaaacgttacccggaagtgaacgcttctatcgacggcgatgacgtggtttaccacaactatttcgacgtcagcatggcggtttctacgccgcgcggcctggtgacgccggttctgcgtgatgtcgataccctcggcatggcagacatcgagaagaaaatcaaagagctggcagtcaaaggccgtgacggcaagctgaccgttgaagatctgaccggtggtaacttcaccatcaccaacggtggtgtgttcggttccctgatgtctacgccgatcatcaacccgccgcagagcgcaattctgggtatgcacgctatcaaagatcgtccgatggcggtgaatggtcaggttgagatcctgccgatgatgtacctggcgctgtcctacgatcaccgtctgatcgatggtcgcgaatccgtgggcttcctggtaacgatcaaagagttgctggaagatccgacgcgtctgctgctggacgtgtag

SEQ ID NO: 24447 - DNA, 1167 bp, Escherichia coli
atgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataa

SEQ ID NO: 24448 - DNA, 870 bp, Escherichia coli
atgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataa

SEQ ID NO: 24449 - DNA, 1053 bp, Escherichia coli
atgaattatcagaacgacgatttacgcatcaaagaaatcaaagagttacttcctcctgtcgcattgctggaaaaattccccgctactgaaaatgccgcgaatacggttgcccatgcccgaaaagcgatccataagatcctgaaaggtaatgatgatcgcctgttggttgtgattggcccatgctcaattcatgatcctgtcgcggcaaaagagtatgccactcgcttgctggcgctgcgtgaagagctgaaagatgagctggaaatcgtaatgcgcgtctattttgaaaagccgcgtaccacggtgggctggaaagggctgattaacgatccgcatatggataatagcttccagatcaacgacggtctgcgtatagcccgtaaattgctgcttgatattaacgacagcggtctgccagcggcaggtgagtttctcgatatgatcaccccacaatatctcgctgacctgatgagctggggcgcaattggcgcacgtaccaccgaatcgcaggtgcaccgcgaactggcatcagggctttcttgtccggtcggcttcaaaaatggcaccgacggtacgattaaagtggctatcgatgccattaatgccgccggtgcgccgcactgcttcctgtccgtaacgaaatgggggcattcggcgattgtgaataccagcggtaacggcgattgccatatcattctgcgcggcggtaaagagcctaactacagcgcgaagcacgttgctgaagtgaaagaagggctgaacaaagcaggcctgccagcacaggtgatgatcgatttcagccatgctaactcgtccaaacaattcaaaaagcagatggatgtttgtgctgacgtttgccagcagattgccggtggcgaaaaggccattattggcgtgatggtggaaagccatctggtggaaggcaatcagagcctcgagagcggggagccgctggcctacggtaagagcatcaccgatgcctgcatcggctgggaagataccgatgctctgttacgtcaactggcgaatgcagtaaaagcgcgtcgcgggtaa

SEQ ID NO: 24450 - DNA, 753 bp, Escherichia coli
atggctgtaactaagctggttctggttcgtcatggcgaaagtcagtggaacaaagaaaaccgtttcaccggttggtacgacgtggatctgtctgagaaaggcgtaagcgaagcaaaagcagcaggtaagctgctgaaagaggaaggttacagctttgactttgcttacacttctgtgctgaaacgcgctatccataccctgtggaatgtgctggacgaactggatcaggcatggctgcccgttgagaaatcctggaaactgaacgaacgtcactacggtgcgttgcagggtctgaacaaagcggaaactgctgaaaagtatggcgacgagcaggtgaaacagtggcgtcgtggttttgcagtgactccgccggaactgactaaagatgatgagcgttatccgggtcacgatccgcgttacgcgaaactgagcgagaaagaactgccgctgacggaaagcctggcgctgaccattgaccgcgtgatcccttactggaatgaaactattctgccgcgtatgaagagcggtgagcgcgtgatcatcgctgcacacggtaactctttacgtgcgctggtgaaatatcttgataacatgagcgaagaagagattcttgagcttaatatcccgactggcgtgccgctggtgtatgagttcgacgagaatttcaaaccgctgaaacgctattatctgggtaatgctgacgagatcgcagcgaaagcagcggcggttgcaaaccagggtaaagcgaagtaa

SEQ ID NO: 24451 - DNA, 1149 bp, Escherichia coli
atgagtctgaaagaaaaaacacaatctctgtttgccaacgcatttggctaccctgccactcacaccattcaggcgcctggccgcgtgaatttgattggtgaacacaccgactacaacgacggtttcgttctgccctgcgcgattgattatcaaaccgtgatcagttgtgcaccacgcgatgaccgtaaagttcgcgtgatggcagccgattatgaaaatcagctcgacgagttttccctcgatgcgcccattgtcgcacatgaaaactatcaatgggctaactacgttcgtggcgtggtgaaacatctgcaactgcgtaacaacagcttcggcggcgtggacatggtgatcagcggcaatgtgccgcagggtgccgggttaagttcttccgcttcactggaagtcgcggtcggaaccgtattgcagcagctttatcatctgccgctggacggcgcacaaatcgcgcttaacggtcaggaagcagaaaaccagtttgtaggctgtaactgcgggatcatggatcagctaatttccgcgctcggcaagaaagatcatgccttgctgatcgattgccgctcactggggaccaaagcagtttccatgcccaaaggtgtggctgtcgtcatcatcaacagtaacttcaaacgtaccctggttggcagcgaatacaacacccgtcgtgaacagtgcgaaaccggtgcgcgtttcttccagcagccagccctgcgtgatgtcaccattgaagagttcaacgctgttgcgcatgaactggacccgatcgtggcaaaacgcgtgcgtcatatactgactgaaaacgcccgcaccgttgaagctgccagcgcgctggagcaaggcgacctgaaacgtatgggcgagttgatggcggagtctcatgcctctatgcgcgatgatttcgaaatcaccgtgccgcaaattgacactctggtagaaatcgtcaaagctgtgattggcgacaaaggtggcgtacgcatgaccggcggcggatttggcggctgtatcgtcgcgctgatcccggaagagctggtgcctgccgtacagcaagctgtcgctgaacaatatgaagcaaaaacaggtattaaagagactttttacgtttgtaaaccatcacaaggagcaggacagtgctga

SEQ ID NO: 24452 - DNA, 1047 bp, Escherichia coli
atgacgcaatttaatcccgttgatcatccacatcgccgctacaacccgctcaccgggcaatggattctggtttcaccgcaccgcgctaagcgcccctggcagggggcgcaggaaacgccagccaaacaggtgttacctgcgcacgatccagattgcttcctctgcgcaggtaatgtgcgggtgacaggcgataaaaaccccgattacaccgggacttacgttttcactaatgactttgcggctttgatgtctgacacgccagatgcgccagaaagtcacgatccgctgatgcgttgccagagcgcgcgcggcaccagccgggtgatctgcttttcaccggatcacagtaaaacgctgccagagctcagcgttgcagcattgacggaaatcgtcaaaacctggcaggagcaaaccgcagaactggggaaaacgtacccatgggtgcaggtttttgaaaacaaaggcgcggcgatgggctgctctaacccgcatccgcacggtcagatttgggcaaatagcttcctgcctaacgaagctgagcgcgaagaccgcctgcaaaaagaatattttgccgaacagaaatcaccaatgctggtggattatgttcagcgcgagctggcagacggtagccgtaccgttgtcgaaaccgaacactggttagccgtcgtgccttactgggctgcctggccgttcgaaacgctactgctgcccaaagcccacgttttacggatcaccgatttgaccgacgcccagcgcagcgatctggcgctggcgttgaaaaagctgaccagtcgttatgacaacctcttccagtgctccttcccctactctatgggctggcacggcgcgccatttaatggcgaagagaatcaacactggcagctgcacgcgcacttttatccgcctctgctgcgctccgccaccgtacgtaaatttatggttggttatgaaatgctggcagagacccagcgagacctgaccgcagaacaggcagcagagcgtttgcgcgcagtcagcgatatccattttcgcgaatccggagtgtaa

SEQ ID NO: 24453 - DNA, 1473 bp, Escherichia coli
atgtcatcgttgcaaattttgcaaggcacgtttcgtcttagcgacacaaaaacgctgcaattgcctcagctaacgttaaacgcgggtgatagttgggcgtttgtcggttcgaatggaagcgggaaatcggccctggcccgcgcgctggcgggggaacttccgcttttgaaaggtgaacggcaaagccagttttcccacatcactcgtctctccttcgagcaattgcaaaaactcgtcagcgacgaatggcagcggaataacaccgatatgctcggccctggcgaagatgacaccggacgcactacggctgagatcattcaggatgaagtaaaggatgcaccgcgttgcatgcaactggcgcagcagttcggtattaccgccctcctcgaccgacgctttaaatacctttccactggcgagacgcgaaaaaccctgctgtgtcaggcgctgatgtcggagcctgacttgttgattcttgatgagccgttcgatggcctggatgttgcctcacgtcagcagctggctgagcgactcgcctcgttacatcagtccggtattactctggtactggtgctcaatcgcttcgatgagatcccggagtttgtccagtttgctggcgtgctggcggattgcacgttagcggaaactggcgctaaagaggaactgctccaacaagcactcgtcgcgcaactggcgcatagtgaacagcttgaaggtgtgcaactgccggagccggatgaaccttcagcacgtcacgccttacccgccaacgaaccgcgcattgtgctgaacaatggcgtggtttcttataacgatcgccccattcttaataaccttagctggcaggtgaatccaggcgaacactggcaaattgtcgggccaaatggtgcaggaaaatcgacgttattaagcctggttactggcgatcatccgcaaggttacagcaacgatttgacgcttttcggacgacgtcgcggcagcggcgaaaccatctgggatatcaaaaagcatatcggttacgtcagcagtagtttgcatctggattaccgggtcagcactaccgtgcgtaatgtgattctttctggctattttgattcgattggcatttatcaggccgtttcggatcgccagcaaaaactggtgcagcagtggctggatattctcggcattgataaacgcacggctgacgctccgttccatagtctttcctggggacagcagcgtctggcgctgattgtccgcgcactggtgaaacatccgacgttgcttattctcgatgaaccactacaggggcttgatccgctgaatcgccagcttatccgccgttttgttgatgtgctgattagcgaaggtgaaacgcaattgttgtttgtttcgcaccacgctgaagatgcgcctgcctgtattacccatcgtcttgagttcgtgccggacggtggactctatcgctatgtgctgacaaaaatatattga

SEQ ID NO: 24454 - DNA, 1434 bp, Escherichia coli
atgaataagaaatcgttatggaagctaattctgatattagcgatcccatgtattattggttttatgccagctccggcaggattaagcgaactggcgtgggtgctttttggtatttacctggcggccattgtggggctggttatcaagcctttcccggaacctgtcgtactgttaattgccgttgctgcctcaatggtggtggtcggtaacttatccgacggtgcgtttaaaaccaccgccgtattaagcggttactcttcaggtaccacctggctggtgttctcggcgtttaccttaagcgccgcatttgtgaccaccggtttaggtaaacgtattgcctatctgctgattggtaaaatcggtaacaccacgctgggtctgggttacgttacggtattcctcgatctggtactggctccggcaacaccgtctaacaccgcgcgtgcgggcggcattgtgttaccgatcatcaacagcgtggcggtggctttggggtccgaaccggaaaaaagtccgcgtcgtgtcggacattacctgatgatgtccatttacatggtcaccaaaaccaccagctatatgttctttaccgcaatggcggggaacattctggcgctgaaaatgatcaacgacattctgcacctgcaaattagctggggtggatgggcgctggcagccggattgccgggcatcattatgctgctggtcaccccgctggtgatttacaccatgtatccaccagaaattaagaaggtggataacaaaaccatcgctaaagcgggccttgccgaactaggaccgatgaaaatccgcgaaaaaatgctgctcggtgtctttgtgctggcgctgctgggctggattttcagtaagtctctgggggttgatgaatccaccgtggcaatcgttgttatggcaaccatgctgctgctgggtatcgttacctgggaagacgtggttaaaaataaaggcggctggaataccttaatctggtacggcggtattatcggcttaagctccttattatcgaaagttaaattcttcgaatggttagctgaagtctttaaaaataacctggcatttgatggtcacggtaacgttgctttcttcgttattattttcctcagcattatcgtgcgttatttcttcgcttccggtagtgcctatatcgttgctatgttaccggtatttgccatgctggcgaacgtctccggcgcaccgttaatgttaaccgcgctggcactgttgttctccaactcctatggcggcatggttactcactatggcggcgcggcaggtccggtcatctttggcgtgggttataacgatattaaatcctggtggttggtcggtgcggtactgacgatattaaccttcctggtgcatatcaccctcggcgtgtggtggtggaatatgctgatcggctggaacatgctgtaa

SEQ ID NO: 24455 - DNA, 2286 bp, Escherichia coli
gtgcgcagatatctggagcatttgatgatcaagttatctgaaaaaggcgtgtttctcgccagtaataacgaaataattgccgaagaacatttcaccggcgaaattaaaaaagaagaagccaaaaaaggcactattgcctggtctattctctcttcgcataatacgtccggaaatatggataaacttaaaattaagtttgattcattagcctctcacgatattacctttgttggtattgtacagaccgctaaagcgtccggtatggaacgtttcccgctgccgtatgtgctgaccaactgccataactcactctgcgccgtcggcggcactattaacggtgatgaccatgtttttggtttatcggcggcccagcgttatggcggtatttttgtgcctccgcatattgcggtcatccatcaatatatgcgtgagatgatggcaggcggcggcaaaatgatcctcgggtcagacagccacacccgttacggtgcattagggacaatggcagtcggtgagggcggcggtgagttggtaaaacagctgcttaatgacacctgggatatcgactatccgggcgtggttgcggtgcatctgaccggaaaacctgcgccgtatgtggggccacaggatgtggcgctggctatcattggcgcggtgttcaaaaacggttacgtcaaaaacaaagtcatggagttcgttggaccgggcgttagcgcgctctctaccgatttccgtaacagcgttgacgtgatgaccactgaaacgacctgtttaagttctgtctggcaaaccgatgaagaagtccataactggctggcgctgcacggtcgcggccaggattactgccagcttaaccctcaaccgatggcgtactacgatggctgcatcagcgttgatttaagcgccatcaaaccaatgattgcgctgccgttccacccgagcaacgtgtatgaaatcgacacactgaaccagaacctgaccgacattctgcgtgagattgaaattgagtccgaacgcgtggcgcacggtaaagccaaactctcgctgctggataaagtggaaaatggtcgcctgaaagtgcagcaggggattatcgcgggctgttctggcggtaactacgaaaacgtcatcgcggcggcgaatgcactgcgcggtcaatcctgtggcaatgacaccttctcgctggcagtttacccgtcatcacagccggtgtttatggatctcgccaaaaaaggtgtggtagcagatttgattggcgcaggcgcaatcatcagaaccgcgttctgcggcccatgctttggcgcgggcgatacgccaatcaacaacggtttgagtattcgccacaccacgcgtaacttcccgaaccgcgaaggctctaagccagctaatgggcagatgtcagcggtggcgttgatggacgctcgttctatcgctgcgactgcggcaaacggtggctatttaacctctgccagcgaacttgattgctgggacaacgtgccggagtacgccttcgatgtaacgccgtataaaaaccgtgtttatcagggctttgtgaaaggggcaactcagcaaccgctgatttacgggccgaacattaaagactggccggaattgggtgcgctgactgacaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacggaaattacgctctatatggaaagtctgactgctgaagagcgcgagattatcaaggcgggtagtttgattaacttcaataaaaaccgtcagatgtaa

SEQ ID NO: 24456 - DNA, 1284 bp, Escherichia coli
gtgaacacattttcagtttcccgtctggcgctggcattggcttttggcgtgacgctgaccgcctgtagctcaaccccgcccgatcaacgtccttctgatcaaaccgcgcctggtacctcttctcgcccgattctgtcggcaaaagaagcgcagaatttcgatgctcaacactattttgcatccctgacaccaggtgctgcagcgtggaatccttccccgattaccctgcctgcgcaacctgactttgttgtcggcccggcgggcactcaaggtgtaacgcataccacgattcaggcggcggtagatgcggcaattatcaagcgtaccaacaagcgccagtatattgccgtgatgcctggtgagtatcagggaacggtatatgtccctgccgctccgggtggaattactctgtacggtacaggtgaaaaaccgattgatgtgaagattgggctttcccttgatggtggcatgagccctgccgactggcgtcacgacgtcaacccgcgcggcaaatatatgccaggtaaaccagcgtggtatatgtacgatagctgccagagcaaacgcagcgacagtatcggtgttctctgctctgcggtcttctggtcacaaaacaatggcctgcaactgcaaaatctgaccatcgaaaacacgctgggcgatagcgtagatgcaggtaaccatccggcggtggcactgcgtactgatggtgaccaggtacagattaacaacgttaacattctcggtcgtcagaacaccttctttgtcaccaacagcggtgtgcagaaccgtctggaaacgaatcgtcagccgcgtacgctggtgaccaacagctacattgaaggggatgtggatatcgtttctggtcgcggcgcagtggtgttcgataacaccgaattccgcgtggtgaactcacgtactcagcaagaagcgtatgtgtttgcaccggctacgctgtccaacatttactacggtttcctcgccgtaaacagccgtttcaatgctttcggtgatggtgtggcgcaactgggccgctcgctggatgttgatgccaataccaacggtcaggtggtgatccgtgatagcgccatcaacgaaggttttaacacggctaaaccgtgggccgatgcggtgatctctaatcgtccgtttgcgggtaataccggcagcgtagatgataacgacgaaatacagcgcaatctgaatgacactaactacaaccgcatgtgggaatacaataaccgcggcgtgggtagtaaagtggttgcagaggcgaagaagtaa

SEQ ID NO: 24457 - DNA, 1290 bp, Escherichia coli
atgacaacggacgatcttgcctttgaccaacgccatatctggcacccatacacatccatgacctcccctctgccggtttatccggtggtgagcgccgaaggttgcgagctgattttgtctgacggcagacgcctggttgacggtatgtcgtcctggtgggcggcgatccacggctacaatcacccgcagcttaatgcggcgatgaagtcgcaaattgatgccatgtcgcatgtgatgtttggcggtatcacccatgcgccagccattgagctgtgccgcaaactggtggcgatgacgccgcaaccgctggagtgcgtttttctcgcggactccggttccgtagcggtggaagtggcgatgaaaatggcgttgcagtactggcaagccaaaggcgaagcgcgccagcgttttctgaccttccgcaatggttatcatggcgatacctttggcgcgatgtcggtgtgcgatccggataactcaatgcacagtctgtggaaaggctacctgccagaaaacctgtttgctcccgccccgcaaagccgcatggatggcgaatgggatgagcgcgatatggtgggctttgcccgcctgatggcggcgcatcgtcatgaaatcgcggcggtgatcattgagccgattgtccagggcgcaggcgggatgcgcatgtaccatccggaatggttaaaacgaatccgcaaaatatgcgatcgcgaaggtatcttgctgattgccgacgagatcgccactggatttggtcgtaccgggaaactgtttgcctgtgaacatgcagaaatcgcgccggacattttgtgcctcggtaaagccttaaccggcggcacaatgaccctttccgccacactcaccacgcgcgaggttgcagaaaccatcagtaacggtgaagccggttgctttatgcatgggccaacttttatgggcaatccgctggcctgcgcggcagcaaacgccagcctggcgattctcgaatctggcgactggcagcaacaggtggcggatattgaagtacagctgcgcgagcaacttgcccccgcccgtgatgccgaaatggttgccgatgtgcgcgtactgggggccattggcgtggtcgaaaccactcatccggtgaatatggcggcgctgcaaaaattctttgtcgaacagggtgtctggatccggccttttggcaaactgatttacctgatgccgccctatattattctcccgcaacagttgcagcgtctgaccgcagcggttaaccgcgcggtacaggatgaaacatttttttgccaataa

SEQ ID NO: 24458 - DNA, 1155 bp, Escherichia coli
atgagctggcaggagaaaatcaacgcggcgctcgatgcgcggcgtgctgccgatgccctgcgtcgccgttatccggtggcgcaaggagccggacgctggctggtggcggatgatcgccagtatctgaacttttccagtaacgattatttaggtttaagccatcatccgcaaattatccgtgcctggcagcagggggcggagcaatttggcatcggtagcggcggctccggtcacgtcagcggttatagcgtggtgcatcaggcactggaagaagagctggccgagtggcttggctattcgcgggcactgctgtttatctctggtttcgccgctaatcaggcagttattgccgcgatgatggcgaaagaggaccgtattgctgccgaccggcttagccatgcctcattgctggaagctgccagtttaagcccgtcgcagcttcgccgttttgctcataacgatgtcactcatttggcgcgattgcttgcttccccctgtccggggcagcaaatggtggtgacagaaggcgtgttcagcatggacggcgatagtgcgccactggcggaaatccagcaggtaacgcaacagcacaatggctggttgatggtcgatgatgcccacggcacgggcgttatcggggagcaggggcgcggcagctgctggctgcaaaaggtaaaaccagaattgctggtagtgacttttggcaaaggatttggcgtcagcggggcagcggtgctttgctccagtacggtggcggattatctgctgcaattcgcccgccaccttatctacagcaccagtatgccgcccgctcaggcgcaggcattacgtgcgtcgctggcggtcattcgcagtgatgagggtgatgcacggcgcgaaaaactggcggcactcattacgcgttttcgtgccggagtacaggatttgccgtttacgcttgctgattcatgcagcgccatccagccattgattgtcggtgataacagccgtgcgttacaactggcagaaaaactgcgtcagcaaggctgctgggtcacggcgattcgcccgccaaccgtacccgctggtactgcgcgactgcgcttaacgctaaccgctgcgcatgaaatgcaggatatcgaccgtctgctggaggtgctgcatggcaacggttaa

SEQ ID NO: 24459 - DNA, 1752 bp, Escherichia coli
gtgacgaggcaggacatgaatgatgccgttatcacgctgaacggcctggaaaaacgctttccgggcatggacaagcccgccgtcgcgccgctcgattgtaccattcacgccggttatgtgacggggttggtggggccggacggtgcaggtaaaaccacgctgatgcggatgttggcgggattactgaaacccgacagcggcagtgccacggtgattggctttgatccgatcaaaaacgacggcgcgctgcacgccgtgctcggttatatgccgcagaaatttggtctgtatgaagatctcacggtgatggagaacctcaatctgtacgcggatttgcgcagcgtcaccggcgaggcacgtaagcaaacttttgctcgcctgctggagtttacgtctcttgggccgtttaccggacgcctggcgggcaagctctccggtgggatgaaacaaaaactcggtctggcctgtaccctggtgggcgaaccgaaagtgttgctgctcgatgaacccggcgtcggcgttgaccctatctcacggcgcgaactgtggcagatggtgcatgagctggcgggcgaagggatgttaatcctctggagtacctcgtatctcgacgaagccgagcagtgccgtgacgtgttactgatgaacgaaggcgagttgctgtatcagggagaaccaaaagccctgacacaaaccatggccggacgcagctttctgatgaccagtccacacgagggcaaccgcaaactgttgcaacgcgccttgaaactgccgcaggtcagcgacggcatgattcaggggaaatcggtacgtctgatcctcaaaaaagaggccacaccagacgatattcgccatgccgacgggatgccggaaatcaacatcaacgaaactacgccgcgttttgaagatgcgtttattgatttgctgggcggtgccggaacctcggaatcgccgctgggcgcaatattacatacggtagaaggcacacccggcgagacggtgatcgaagcgaaagaactgaccaagaaatttggggattttgccgccaccgatcacgtcaactttgccgttaaacgtggggagatttttggtttgctggggccaaacggcgcgggtaaatcgaccacctttaagatgatgtgcggtttgctggtgccgacttccggccaggcgctggtgctggggatggatctgaaagagagttccggtaaagcgcgccagcatctcggctatatggcgcaaaaattttcgctctacggtaacctgacggtcgaacagaatttacgctttttctctggtgtgtatggcttacgcggtcgggcgcagaacgaaaaaatctcccgcatgagcgaggcgttcggcctgaaaagtatcgcctcccacgccaccgatgaactgccattaggttttaaacagcggctggcgctggcctgttcgctgatgcatgaaccggacattctgtttctcgacgaaccgacttccggcgttgaccccctcacccgccgtgaattttggctgcacatcaacagcatggtagagaaaggcgtcacggtgatggtcaccacccactttatggatgaagcggaatattgcgaccgcatcggcctggtgtaccgcgggaaattaatcgccagcggcacgccggacgatttgaaagcacagtcggctaacgatgagcaacccgatcccaccatggagcaagcctttattcagttgatccacgactgggataaggagcatagcaatgagtaa

SEQ ID NO: 24460 - DNA, 1365 bp, Escherichia coli
atgtctttcgattctttgggtttaagccctgatatcctgcgcgccgttgccgagcagggttaccgtgaacccacccctattcagcagcaggcgatccctgcggtgctggaaggccgcgacctgatggctagcgcccagaccggcaccggcaaaacagcgggctttacgctgccgctgttgcaacacctgatcactcgccagccgcacgccaaagggcgtcgtccggtacgtgcgctcattcttaccccgacccgtgaactggcggcgcagattggcgaaaacgtccgtgattacagcaaatacctgaacattcgttcgctggtggtgtttggtggtgtgagtattaacccgcagatgatgaaactgcgtggcggcgttgatgtgctggtggcaaccccgggacgtttgctggacctggaacatcagaatgcagtgaagctggatcaggttgaaatcctcgtcctcgatgaagctgaccgcatgctcgacatgggctttatccacgatatccgtcgcgtgttaacaaaactacctgcgaagcgccagaacctgttattctccgcgaccttctctgacgatattaaagccctggcggaaaaactgttgcacaacccgctggaaatcgaagtggcacgccgcaataccgcgtctgatcaggtgacccagcacgttcactttgtcgataagaaacgcaaacgcgaattgctgtcgcacatgattgggaaagggaactggcagcaggtgctggtgtttacccgtaccaaacacggcgctaaccatctggctgaacagctcaataaagatggcatccgtagtgcggcgatccacggcaataaatcgcaaggtgcgcgtactcgtgcgctggctgattttaaatcgggcgatattcgtgtactggtggcaactgacatcgctgcgcgcggcctggatattgaagagctgccgcacgtcgtcaactatgaactgccaaacgtacctgaagattatgtccaccgtatcgggcgtaccggtcgtgcggctgctaccggtgaagcgttgtcgctggtgtgtgttgatgaacacaaactgctgcgtgatatcgaaaaactgctgaaaaaagagatcccgcgcattgcgattccgggctatgagccggacccgtcaatcaaagccgaaccgatccagaacggtcgccagcaacgtggcggcggcggtcgtgggcaaggtggtggtcgcggtcaacagcaaccacgccgtggggaaggtggcgcaaaatctgcaagcgcgaaacctgcagaaaaaccgtctcgccgcctcggcgatgccaaaccggcaggcgaacaacaacgtcgccgccgtccgcgtaaacctgccgctgcgcagtaa

SEQ ID NO: 24461 - DNA, 2151 bp, Escherichia coli
atggcattaaccgccgcgcttaaagcgcaaattgccgcctggtataaggcgcttcaggaacagatccccgactttattccccgtgcgccgcagcggcagatgattgcggacgtcgccaaaacgctggccggagaagaagggcgacatctggcgattgaagcccccaccggcgttgggaaaacgctctcttatttgattcccggcatcgccattgcccgcgaagagcaaaaaacgctggtggtgagtaccgccaacgtggcattgcaggatcagatttacagcaaagatttaccgctgctgaaaaagatcattcccgatcttaaattcactgccgcttttgggcgtgggcgctacgtttgtccgcgtaatctgacggcgctcgccagtactgaacccacgcaacaggatctgctggcgtttcttgacgacgaactgacgccgaacaatcaggaagagcaaaaacgttgtgcgaagctgaagggcgatctcgatacttataaatgggatggtctgcgcgatcatactgatatcgctatagatgacgatctctggcgtcgtttaagtaccgacaaagccagctgcctcaaccgcaattgttactactatcgtgaatgcccgttttttgtcgctcgtcgggagattcaggaagcggaagtggtggtggcaaaccatgcgctggtgatggcggcgatggaaagcgaagcggtattgcctgacccgaaaaatttactgctggtgctggacgaaggccatcacctgccggatgtggcgcgggatgcgcttgagatgagcgccgaaatcaccgcgccgtggtatcggctacagctggacttgttcacgaaactggtcgctacctgcatggagcagtttcgcccgaagaccatcccaccgctggcgatccctgaacgtttgaatgcgcattgtgaagagttgtatgagcttatcgcctcgttaaacaacattctcaatctctacatgcctgccgggcaggaggcagagcaccgttttgcgatgggcgaactgccagatgaagtgctggagatctgccagcggctggcaaaactcaccgagatgctgcgtggcctggcggagttatttcttaacgatttaagtgagaaaaccggcagccatgacattgtacgtctgcatcggttgattttgcagatgaaccgcgcgttggggatgttcgaggcgcaaagcaaactctggcggctggcttcgctggcgcaatcttccggtgcaccggtgaccaaatgggcgacgcgggaagagcgcgaagggcagctacacctctggtttcactgcgtgggaatacgtgtcagcgatcagctggaaaggctgctgtggcgcagtattccgcacattattgtcacctccgcaaccttgcgttcgctgaacagtttttcgcgtttgcaggagatgagtggtctgaaagagaaagcgggcgaccgttttgtggcgctggattccccctttaaccactgcgaacagggcaaaattgttattccccggatgcgcgttgagccttccatcgacaacgaagagcagcatattgccgaaatggcggcctttttccgtaagcaggtggagagcaaaaaacatctcggtatgttggtactgtttgccagcggacgggcgatgcagcgctttctcgactatgtgacggatttacgtctgatgttgctggttcagggcgatcagccgcgttaccgtttagttgaactgcaccgcaaacgcgtcgccaacggtgagcgcagcgtgctggtgggcttacagtcatttgccgaagggcttgatttgaaaggtgatctgctcagccaggtgcatatccacaaaatcgcttttccgcccatcgacagcccggtggtgatcaccgaaggggaatggctgaaaagcctcaaccgctatccgtttgaggtgcaaagcctgccgagcgcctcgtttaacctgattcagcaggttgggcgactgattcgaagccacggttgctggggcgaagtggttatctacgacaaacgcttgctgaccaaaaattatggcaagcgactactggatgcattaccggtatttccgatagagcaaccggaagtccctgaaggtatagttaaaaagaaagaaaaaacgaaatccccacgccgtcggcggcgttaa

SEQ ID NO: 24462 - DNA, 1086 bp, Escherichia coli
atggaaagtggtcatcgctttgatgctcagacgctgcacagttttattcaggctgtatttcgtcagatgggtagcgaggaacaagaagcgaaattagttgccgatcatttaatcgcggcaaacctggcagggcatgattcacatggtattggcatgatcccaagctatgtacgctcctggagtcaggggcacctgcaaattaaccatcatgccaaaaccgttaaagaggcgggggcggcggtcacgctcgatggcgatcgcgcatttggtcaggtcgcggcacatgaagcgatggcgctggggattgagaaagcgcatcagcacggtattgccgccgtggcgctacataactcgcatcatatcggccgtatcggttactgggcggagcagtgtgcagcggcggggtttgtctctatccactttgttagcgtggtcggtattccaatggtcgcgccgttccacggtcgcgacagccgctttggcaccaatccgttctgtgtggttttccctcgtaaagataatttcccgctgttgcttgattacgccaccagcgccattgcatttggcaaaacccgcgtcgcctggcataaaggcgtccccgtgccgccaggttgcctgattgacgttaacggcgtgccgacgaccaatccggcggtaatgcaggagtcgccgttgggttcgctgttgacctttgccgaacataaaggctacgcccttgcagcgatgtgtgaaattcttggcggggcgctttccggcggtaaaacgacgcatcaggaaacgttacaaaccagtcccgatgccattcttaactgcatgaccactatcatcatcaacccggaactcttcggcgcgccggattgtaacgcgcagaccgaagcctttgccgagtgggtgaaagcctcgccgcatgatgatgataagccgattttgctaccgggcgagtgggaagtgaacacgcgtcgcgaacggcagaagcaggggattccactggatgcgggaagctggcaggccatttgtgatgcagcgcggcagattggtatgccggaagagacgttgcaggctttctgtcagcagttagccagctaa

SEQ ID NO: 24463 - DNA, 1050 bp, Escherichia coli
atgcgcacgttattttctcaacaacagtggattgatatgaaggtactggttaccggcgccaccagcggcttaggtcgaaacgcggtagagtttttatgccagaaaggcatcagcgtgcgagcgaccggtcgcaacgaggcaatgggcaaattgctggaaaaaatgggcgcagagtttgttccggcggatctgaccgagctggtttcatcacaagctaaagtgatgctcgcgggcattgatacgctgtggcactgctccagctttacctcaccctgggggacacaacaggctttcgatctggctaacgttcgcgccactcgccgcctgggtgaatgggctgtcgcctggggtgtgcgtaactttattcatatctcttccccctccctgtacttcgattatcaccaccatcgcgatattaaagaagattttcgccctcaccgcttcgccaacgagtttgcccgcagcaaagcagccagcgaagaagtgatcaatatgctttcgcaggcgaatccacaaacgcgctttactattctgcgcccacaaagtctgttcggaccgcacgataaagtctttattccccgtctggcgcatatgatgcaccactacggcagtattctgttaccgcatggcggcagtgcgctggtcgatatgacctactatgaaaatgccgtgcacgcaatgtggctggcaagccaggaagcctgcgataagctaccttccgggcgtgtgtacaacatcaccaacggcgagcatcgcacactgcgcagcatcgtgcagaagctgatcgacgagttgaatattgactgtcgtattcgttccgtcccctacccgatgctggatatgatcgcccgcagcatggagcgtttaggccgcaagtcagcaaaagagccgccgctgacccactacggcgtctccaagttgaattttgactttacgctggatattacgcgtgcgcaggaagagttaggttatcagccggtcatcaccctggatgaaggtatcgagaaaactgccgcctggctacgcgaccacggaaaactgccgcgctaa

SEQ ID NO: 24464 - DNA, 2277 bp, Escherichia coli
atgctcaatcaagaactggaactcagtttaaatatggctttcgccagagcgcgcgagcaccgtcatgagtttatgaccgtcgagcacttgttactggcgctgctcagtaacccatctgcccgggaggcgctggaagcgtgttctgtggatttggttgcgctccgtcaggaactggaagcctttattgaacaaaccacacccgttctgcctgccagtgaagaggagcgcgacacacagccgacgctgagttttcagcgtgtactgcaacgtgcggtcttccatgtccagtcctccggtcgcaatgaggttaccggtgcaaacgttctggtcgctatctttagcgaacaggagtcgcaggcggcatatctgttgcgtaaacatgaagtcagccgtctcgatgtggtgaactttatctctcatggcacgcgtaaagacgagccgacacagtcttctgatcctggcagccagccaaacagcgaagaacaagctggtggggaggaacgtatggagaatttcacgacgaacctgaatcagcttgcgcgcgtgggcggaatcgacccactgattggtcgtgagaaggagctggagcgtgctattcaggttctctgccgtcgccgtaaaaacaacccgctgctggtgggggaatctggtgtcggtaaaaccgcgattgcggaaggtcttgcctggcgaattgttcagggcgatgtgccggaagtgatggctgactgtacgatttactctctcgatatcggttctctgttagcgggcacaaaatatcgcggcgactttgaaaaacgttttaaagcgttgctcaagcagctggagcaggacactaacagcatcctgtttattgatgagatccacaccattatcggtgcgggtgcagcgtctggtggtcaggtcgatgcggctaacctaatcaaaccgttgctctccagcggtaaaattcgtgtaattggttcgacaacctatcaggagttcagcaacattttcgagaaagaccgtgctctggcgcgtcgcttccagaaaattgatattactgaaccgtcgatcgaagaaactgttcaaatcatcaatggcctgaaaccgaagtatgaagcgcaccacgacgtgcgttataccgcaaaagcggtgcgtgcggcggtagagctggcggtgaaatacattaacgatcgtcatctgccggataaagccattgatgttatcgacgaagcgggcgctcgcgcacgcctgatgccggtaagcaaacgcaagaaaaccgttaatgtggcggatattgagtccgtggtggcccgtattgcacgcattccagagaagagtgtttctcagagtgatcgtgataccctgaaaaacctcggcgatcgcttgaaaatgctggtcttcggtcaggataaagccattgaggcgctgactgaagccattaagatggcgcgtgcaggtttaggtcacgaacataaaccggttggttcgttcctgtttgccggccctaccggggtcgggaaaacagaggtgacggtacagctttcgaaagctttgggcattgagcttctgcgctttgatatgtccgagtatatggaacgccataccgtcagccgtcttattggtgcgcctccgggatacgttggttttgatcagggcggtttgctgactgatgcggtcatcaagcatccacatgcggtgctgctgctggacgaaatcgagaaagcgcacccggacgtgttcaatattctgttgcaggtgatggataacggtacgctgaccgataacaacggacgcaaagcagacttccgtaacgtggtgctggtgatgaccaccaacgccggggtacgggaaactgagcgcaaatccattggtcttatccaccaggataacagcaccgatgcgatggaagagatcaagaagatctttacaccggaattccgtaaccgtctcgacaacattatctggtttgatcatctgtcaaccgacgtgatccatcaggtggtggataaattcatcgtcgagttgcaggttcagctggatcagaaaggtgtttctctggaagtgagccaggaagcgcgtaactggctggccgagaaaggttacgaccgggcaatgggcgctcgtccgatggcgcgtgtcatccaggacaacctgaaaaaaccgctcgccaacgaactgctgtttggttcgctggtggacggcggtcaggtcaccgtcgcgctggataaagagaaaaatgagctgacttacggattccagagtgcacaaaagcacaaggcggaagcagcgcattaa

SEQ ID NO: 24465 - DNA, 1722 bp, Escherichia coli
atgcgcgctttgctaccctatctggcactgtataaacgtcataaatggatgttaagtcttggtattgtgctggcaattgtgacgctgctcgccagtatcggtctgttgacactttccggctggttcctctcggcctcagcggttgcgggggttgccggactgtacagcttcaactatatgctacccgctgcgggcgtgcgtggcgcagcaatcacccgtactgccgggcgctattttgaacgtctggtaagtcacgacgcgactttccgcgtgttgcagcatctgcgcatttacaccttcagcaaattgctgcccctctcccctgccggactggcgcgctatcgtcagggcgaattgctcaatcgcgtggtggcggatgttgatacgctcgatcatctttacctgcgcgttatctcgccgctggtgggcgcttttgtggtgattatggtggtgacaatcgggttaagtttccttgatttcaccctcgcctttacgctgggcggcattatgttactgacgcttttcctgatgccaccgctgttttatcgtgcgggaaaaagcaccgggcaaaatctgactcatcttcgcggacagtatcgccaacaactgacggcctggctgcaagggcaagctgagctgaccatttttggtgccagcgatcgttatcgcacgcaactagagaatacagaaattcaatggctggaagcgcaacgccgtcaatctgaactgaccgcattgtcgcaagcgataatgctgctcattggcgcgttagcggtgatcctgatgctgtggatggcgtctggcggcgttggcggcaatgctcaacccggcgcgttaattgccctgtttgtcttctgcgcgttagccgcgtttgaagcactggcaccagtaacgggtgcatttcagcatctggggcaagtcattgcctctgccgtacgtatctctgacttaacggatcaaaaaccggaggtcacctttcctgatacccaaactcgtgttgccgatcgcgtttcgctgacgttacgggatgttcagttcacttatccggagcaatctcaacaggcacttaaagggatttctcttcaggtaaacgccggggaacatatagcgattctcgggcgaaccggatgcggcaaatcaacactgttacaacagctgacccgcgcatgggacccgcaacagggcgagattttgcttaacgatagccccatagccagcctgaatgaagcggctctacgacagaccatcagcgttgttcctcagcgagtgcatctgtttagcgccacgctgcgtgataatcttttactcgcctcgcctggcagtagtgatgaggctctgtcggagatcttgcgtcgcgttggcctggaaaagctgctcgaggatgcaggtctcaacagttggttaggtgaaggcggacgccagctctccggtggtgaactgcgccgtctggctatcgcccgtgcgctgttacatgatgcgccactggtgttgctggatgaacctaccgaaggcttagatgccacaaccgaaagccagatccttgaattgcttgcagaaatgatgcgtgagaaaacggtgttaatggtcacccatcgacttcgcggactctctcgtttccaacaaataatagtgatggacaacgggcaaattattgagcaaggtactcacgcagaactgcttgccagacaggggcgttattaccagttcaagcagggtttgtaa

SEQ ID NO: 24466 - DNA, 1767 bp, Escherichia coli
atgaataaatctcgtcaaaaagagttaacccgctggttaaaacagcaaagcgtcatctcccaacgttggctgaatatttctcgtctgctgggctttgtgagcggcatattgatcattgcccaggcctggttcatggcgcgaattctgcaacatatgattatggagaatattccccgtgaagccctgctgcttccctttacgttactggttctgacctttgtactgcgcgcatgggtggtctggttacgcgaacgggtgggttatcacgccgggcagcatatccgctttgccatccgccgtcaggttctcgaccgtctgcaacaagcagggccagcgtggattcagggtaaacctgcggggagctgggcgacgctggtactcgagcaaattgacgatatgcatgattactatgcacgctatctgccgcaaatggcgctggcagtgtcggtgccgttgctgattgtggtggcaatcttcccctctaactgggctgcggcgctcattctgctgggcactgcaccgttaattccgttgtttatggcgctggttggaatgggggctgccgatgctaaccgacgtaactttctcgctcttgctcgcttaagtgggcatttcctcgatcgcctgcgcggcatggaaacattgcgtatttttggtcgtggtgaagctgaaattgaaagtattcgttctgcttcggaagatttccgccaacggacaatggaagtgctacggctggcgtttttatcctccggcattctcgaattttttacctcgctgtcaattgctctggtggcggtctactttggtttttcctatctcggcgagctggattttggtcactacgataccggtgtgacgctggctgcgggttttctggccctgatccttgcgccagagtttttccagccattacgcgatctcggtacgttttatcatgctaaagcccaggctgttggcgcagctgacagtctgaaaacgtttatggaaaccccgctcgcccatccgcaacgtggtgaggcggaattagcatcgaccgatccggtgaccattgaggccgaggagctgtttatcacgtcgccggaaggtaaaacgctggccggaccgctgaactttactttgccagcaggccaacgtgcggtgttggttggtcgcagcggttcaggtaaaagctcactgctgaacgcgctttctggttttctctcatatcagggatcgctacgaatcaacgggatagaattacgcgatttatcaccagaatcatggcgtaaacatctctcctgggttgggcaaaacccacaattaccggcagcaacattgcgggataacgtactactggcgcgacctgatgccagcgaacaagaattacaagcagcgctggataacgcctgggtcagcgagtttctaccgctcctcccacaaggcgttgatacgcctgttggcgaccaggctgcccgcctttccgtggggcaggcgcagcgcgtggcggtggcccgtgcgttactaaatccctgttcgctattactgttggatgaacccgctgccagccttgatgctcacagtgaacagcgcgtaatggaggcgctgaatgccgcctctctgcgccagacaacgttaatggtcacccaccagttagaagatcttgctgactgggatgtcatttgggttatgcaggatggccggattattgagcaaggacgttacgcggaattaagtgtggctggtggcccattcgccacattactggcccatcgtcaggaggagatttaa

SEQ ID NO: 24467 - DNA, 2358 bp, Escherichia coli
atggccagcagcgcattaacattaccttttagtcggattgcgcacgctgtcgatagcgccattccaacaaaatcagacgaaaaggttatctggagcgcctgtacagttaactgtggtagtcgctgcccgctacgtatgcacgtcgtggacggtgaaatcaaatatgtcgaaacggacaataccggcgatgacaattacgacggcctgcaccaggttcgcgcctgcctgcgtgggcgttccatgcgtcgccgtgtctacaatccggaccgcctgaaatatccgatgaaacgagtcggggcgcgcggtgaaggcaaattcgagcgcattagctgggaagaagcctacgacatcatcgcgaccaatatgcagcgcctgatcaaagagtacggcaacgagtctatctatctgaactatggcaccggtacgctgggcggcaccatgacccgctcctggccgccgggaaataccctggtcgcgcggctgatgaactgctgcggcggctatctgaaccattacggcgactactcctccgcgcaaattgcggaaggtttgaactatacctacggcggctgggcagatggcaacagcccgtcggatatcgaaaacagtaagctggtagtgctgtttggtaataaccctggcgaaacgcgaatgagtggcggtggggtgacttactatcttgaacaggcacgccagaaatctaatgcccgcatgatcatcatcgatccgcgctataccgacaccggtgccgggcgcgaagatgagtggatccctattcgtccgggaacagatgccgcactggttaacggtctggcgtacgtcatgatcactgaaaacctggtggatcaggcattcctcgataaatattgcgttggctacgatgagaaaaccctgccagccagtgcgccgaaaaatggccactataaagcttatattctgggtgaagggccagatggcgtggctaaaacgccggaatgggcctcgcaaatcactggtgttccggcagacaaaatcatcaaattggctcgtgaaatcggtagtaccaaaccggcgtttatcagccagggatggggcccgcagcgtcacgctaacggtgaaatcgcaacccgtgctatctcgatgctggcgattctgaccggtaacgttggtattaacggaggcaacagcggcgcgcgtgaaggttcatacagcttaccgtttgtccgtatgccgaccttggaaaacccgatccagaccagcatttcgatgtttatgtggaccgatgccattgaacgtggcccggaaatgacggcgctgcgtgatggtgtacgcgggaaagataagctggatgtgccgatcaaaatgatctggaactatgccggtaactgcctgattaaccagcattctgaaatcaaccgtacccatgaaatccttcaggatgataagaagtgcgagctgattgtggttatcgactgccacatgacctcatcggcgaaatatgctgacatcctgctgcctgactgcaccgcttccgaacagatggactttgcgctggatgcatcctgcgggaatatgtcttacgtgattttcaacgatcaggtgattaaaccgcgctttgaatgtaagaccatctatgaaatgaccagcgaactggcaaaacgtcttggcgttgagcaacagtttactgaaggccgtacccaggaagagtggatgcggcatctgtatgcccagtcgcgggaagcgattcctgaactgccaacgtttgaagagttccgcaagcaggggatctttaaaaagcgcgacccacaagggcatcacgttgcttataaagccttccgtgaagatccgcaggcaaacccactgactacgccatcgggcaaaattgagatttattcgcaggcgctggctgacattgccgctacctgggaattgcctgaaggcgatgtgatcgatccactgccgatctacacgccgggctttgaaagttatcaggatccgctgaacaaacagtatccgctgcagcttacaggtttccactataaatctcgcgttcactcaacttacggcaacgttgatgtgctgaaagcggcttgccgtcaggaaatgtggatcaacccgcttgatgcccaaaaacgcggtatccacaacggcgataaagtcaggatctttaacgatcgtggtgaggttcatattgaggcgaaagtgacgccacgaatgatgccgggtgtggtcgcactgggtgaaggtgcctggtatgacccggatgcaaaacgtgtcgataagggtggttgtattaacgtactgaccactcaacgtccgtctcctctcgctaaggggaatccgtcacatacaaaccttgttcaggttgaaaaggtgtaa

SEQ ID NO: 24468 - DNA, 1623 bp, Escherichia coli
gtgaacttactgtttcacactctgcttttttgtttcttctatctgacttgctttattccaaattttattcgtttaaaaataaaatgtgcagcaggttataattttgcatttcgctatttccgcacttcttatttgccgcgcataatccctcgttttaccgatgcccctttaattttggcgaaggatttgtctatggctgggaatgttcaggaaaaacagttgcgatggtacaacattgcgctgatgtcttttatcactgtctggggttttggcaacgttgttaataactatgccaaccaggggctggtggttgttttttcatgggtgtttatctttgcactctatttcacaccttatgcgctaattgttggtcagttaggctcgaccttcaaagatgggaagggcggggtcagtacctggattaaacacacgatgggacccggactggcttatctcgccgcgtggacctactgggtggtgcatattccctatctggcacaaaaaccccaggcaattctgattgcgctcggttgggcgatgaaaggcgacggttcgctaatcaaagaatattcagtcgtagcgttacaggggttaacgctggtgctgtttatcttctttatgtgggttgcttcacgcggtatgaaatcgctgaaaatcgtcggttctgtggcagggattgctatgtttgttatgtcactcctgtatgtggcgatggcggtaaccgcgcctgcaattactgaagtgcatattgcgaccacaaacattacctgggaaacgttcattcctcatatcgactttacctacattaccactatttcaatgctggttttcgcggttggcggagcagagaagatttctccttacgttaatcaaacgcgcaacccaggaaaagaatttccaaaagggatgttatgcctggcggtgatggttgcggtttgtgccattctgggctcgctggcgatggggatgatgtttgattcgcgtaatatcccggatgacttaatgaccaacggtcagtattacgcctttcagaagctgggcgagtattacaacatgggtaatactttaatggtgatttacgccattgcgaataccctgggacaagtagcggcgctggtattctcgattgatgccccgcttaaagtgctattaggtgatgctgacagcaaatatattccagccagtttatgtcgtaccaacgcttctggtacgcccgttaatggctattttctgaccctggtactggtggcgattctgattatgctgccgactctcggcattggtgatatgaacaatctctataaatggctgttgaaccttaattcggtagtgatgccgctgcgttatttatgggtatttgttgcatttattgcagtcgttcgcttggcgcagaaatataaaccagaatatgtctttattcgtaataagcctctggcaatgaccgtcgggatttggtgttttgcctttaccgcctttgcctgtttgacggggatcttcccgaaaatggaagccttcactgcagagtggaccttccagttggcgctgaatgttgcaacgccgtttgtgctggtaggattaggactgatattcccgctgctggcgcgtaaagcgaatagtaaataa

SEQ ID NO: 24469 - DNA, 1089 bp, Escherichia coli
atggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaa

SEQ ID NO: 24470 - DNA, 1284 bp, Escherichia coli
atggaatccctgacgttacaacccatcgctcgtgtcgatggcactattaatctgcccggttccaagagcgtttctaaccgcgctttattgctggcggcattagcacacggcaaaacagtattaaccaatctgctggatagcgatgacgtgcgccatatgctgaatgcattaacagcgttaggggtaagctatacgctttcagccgatcgtacgcgttgcgaaattatcggtaacggcggtccattacacgcagaaggtgccctggagttgttcctcggtaacgccggaacggcaatgcgtccgctggcggcagctctttgtctgggtagcaatgatattgtgctgaccggtgagccgcgtatgaaagaacgcccgattggtcatctggtggatgcgctgcgcctgggcggggcgaagatcacttacctggaacaagaaaattatccgccgttgcgtttacagggcggctttactggcggcaacgttgacgttgatggctccgtttccagccaattcctcaccgcactgttaatgactgcgcctcttgcgccggaagatacggtgattcgtattaaaggcgatctggtttctaaaccttatatcgacatcacactcaatctgatgaagacgtttggtgttgaaattgaaaatcagcactatcaacaatttgtcgtaaaaggcgggcagtcttatcagtctccgggtacttatttggtcgaaggcgatgcatcttcggcttcttactttctggcagcagcagcaatcaaaggcggcactgtaaaagtgaccggtattggacgtaacagtatgcagggtgatattcgctttgctgatgtgctggaaaaaatgggcgcgaccatttgctggggcgatgattatatttcctgcacgcgtggtgaactgaacgctattgatatggatatgaaccatattcctgatgcggcgatgaccattgccacggcggcgttatttgcaaaaggcaccaccacgctgcgcaatatctataactggcgtgttaaagagaccgatcgcctgtttgcgatggcaacagaactgcgtaaagtcggcgcggaagtggaagaggggcacgattacattcgtatcactcctccggaaaaactgaactttgccgagatcgcgacatacaatgatcaccggatggcgatgtgtttctcgctggtggcgttgtcagatacaccagtgacgattcttgatcccaaatgcacggccaaaacatttccggattatttcgagcagctggcgcggattagccaggcagcctga

SEQ ID NO: 24471 - DNA, 1749 bp, Escherichia coli
atgcataacgacaaagatctctctacgtggcagacattccgccgactgtggccaaccattgcgcctttcaaagcgggtctgatcgtggcgggcgtagcgttaatcctcaacgcagccagcgataccttcatgttatcgctccttaagccacttcttgatgatggctttggtaaaacagatcgctccgtgctggtgtggatgccgctggtggtgatcgggctgatgattttacgtggtatcaccagctatgtctccagctactgtatctcctgggtatcaggaaaggtggtaatgaccatgcgtcgccgcctgtttggtcacatgatgggaatgccagtttcattctttgacaaacagtcaacgggtacgctgttgtcacgtattacctacgattccgaacaggttgcttcttcttcttccggcgcactgattactgttgtgcgtgaaggtgcgtcgatcatcggcctgttcatcatgatgttctattacagttggcaactgtcgatcattttgattgtgctggcaccgattgtttcgattgcgattcgcgttgtatcgaagcgttttcgcaacatcagtaaaaacatgcagaacaccatggggcaggtgaccaccagcgcagaacaaatgctgaagggccacaaagaagtattgattttcggtggtcaggaagtggaaacgaaacgctttgataaagtcagcaaccgaatgcgtcttcaggggatgaaaatggtttcagcctcttccatctctgatccgatcattcagctgatcgcctctttggcgctggcgtttgttctgtatgcggcgagcttcccaagtgtcatggatagcctgactgccggtacgattaccgttgttttctcttcaatgattgcactgatgcgtccgctgaaatcgctgaccaacgttaacgcccagttccagcgcggtatggcggcttgtcagacgctgtttaccattctggacagtgagcaggagaaagatgaaggtaagcgcgtgatcgagcgtgcgactggcgacgtggaattccgcaatgtcacctttacttatccgggacgtgacgtacctgcattgcgtaacatcaacctgaaaattccggcagggaagacggttgctctggttggacgctctggttcgggtaaatcaaccatcgccagcctgatcacgcgtttttacgatattgatgaaggcgaaatcctgatggatggtcacgatctgcgcgagtataccctggcgtcgttacgtaaccaggttgctctggtgtcgcagaatgtccatctgtttaacgatacggttgctaacaacattgcttacgcacggactgaacagtacagccgtgagcaaattgaagaagcggcgcgtatggcctacgccatggacttcatcaataagatggataacggtctcgatacagtgattggtgaaaacggcgtgctgctctctggcggtcagcgtcagcgtattgctatcgctcgagccttgttgcgtgatagcccgattctgattctggacgaagctacctcggctctggataccgaatccgaacgtgcgattcaggcggcactggatgagttgcagaaaaaccgtacctctctggtgattgcccaccgcttgtctaccattgaaaaggcagacgaaatcgtggtcgtcgaggatggtgtcattgtggaacgcggtacgcataacgatttgcttgagcaccgcggcgtttacgcgcaacttcacaaaatgcagtttggccaatga

SEQ ID NO: 24472 - DNA, 1191 bp, Escherichia coli
atgtttgagaacattaccgccgctcctgccgacccgattctgggcctggccgatctgtttcgtgccgatgaacgtcccggcaaaattaacctcgggattggtgtctataaagatgagacgggcaaaaccccggtactgaccagcgtgaaaaaggctgaacagtatctgctcgaaaatgaaaccaccaaaaattacctcggcattgacggcatccctgaatttggtcgctgcactcaggaactgctgtttggtaaaggtagcgccctgatcaatgacaaacgtgctcgcacggcacagactccggggggcactggcgcactacgcgtggctgccgatttcctggcaaaaaataccagcgttaagcgtgtgtgggtgagcaacccaagctggccgaaccataagagcgtctttaactctgcaggtctggaagttcgtgaatacgcttattatgatgcggaaaatcacactcttgacttcgatgcactgattaacagcctgaatgaagctcaggctggcgacgtagtgctgttccatggctgctgccataacccaaccggtatcgaccctacgctggaacaatggcaaacactggcacaactctccgttgagaaaggctggttaccgctgtttgacttcgcttaccagggttttgcccgtggtctggaagaagatgctgaaggactgcgcgctttcgcggctatgcataaagagctgattgttgccagttcctactctaaaaactttggcctgtacaacgagcgtgttggcgcttgtactctggttgctgccgacagtgaaaccgttgatcgcgcattcagccaaatgaaagcggcgattcgcgctaactactctaacccaccagcacacggcgcttctgttgttgccaccatcctgagcaacgatgcgttacgtgcgatttgggaacaagagctgactgatatgcgccagcgtattcagcgtatgcgtcagttgttcgtcaatacgctgcaggaaaaaggcgcaaaccgcgacttcagctttatcatcaaacagaacggcatgttctccttcagtggcctgacaaaagaacaagtgctgcgtctgcgcgaagagtttggcgtatatgcggttgcttctggtcgcgtaaatgtggccgggatgacaccagataacatggctccgctgtgcgaagcgattgtggcagtgctgtaa

SEQ ID NO: 24473 - DNA, 1089 bp, Escherichia coli
atgatgaagcgcaatattctggcagtgatcgtccctgctctgttagtagcaggtactgcaaacgctgcagaaatctataacaaagatggcaacaaagtagatctgtacggtaaagctgttggtctgcattatttttccaagggtaacggtgaaaacagttacggtggcaatggcgacatgacctatgcccgtcttggttttaaaggggaaactcaaatcaattccgatctgaccggttatggtcagtgggaatataacttccagggtaacaactctgaaggcgctgacgctcaaactggtaacaaaacgcgtctggcattcgcgggtcttaaatacgctgacgttggttctttcgattacggccgtaactacggtgtggtttatgatgcactgggttacaccgatatgctgccagaatttggtggtgatactgcatacagcgatgacttcttcgttggtcgtgttggcggcgttgctacctatcgtaactccaacttctttggtctggttgatggcctgaacttcgctgttcagtacctgggtaaaaacgagcgtgacactgcacgccgttctaacggcgacggtgttggcggttctatcagctacgaatacgaaggctttggtatcgttggtgcttatggtgcagctgaccgtaccaacctgcaagaagctcaacctcttggcaacggtaaaaaagctgaacagtgggctactggtctgaagtacgacgcgaacaacatctacctggcagcgaactacggtgaaacccgtaacgctacgccgatcactaataaatttacaaacaccagcggcttcgccaacaaaacgcaagacgttctgttagttgcgcaataccagttcgatttcggtctgcgtccgtccatcgcttacaccaaatctaaagcgaaagacgtagaaggtatcggtgatgttgatctggtgaactactttgaagtgggcgcaacctactacttcaacaaaaacatgtccacctatgttgactacatcatcaaccagatcgattctgacaacaaactgggcgtaggttcagacgacaccgttgctgtgggtatcgtttaccagttctaa

SEQ ID NO: 24474 - DNA, 1011 bp, Escherichia coli
atgtactaccccttcgttcgtaaagcccttttccagctcgatccagagcgcgctcatgagtttacttttcagcaattacgccgtattacaggaacgccgtttgaagcactggtgcggcagaaagtgcctgcgaaacctgttaactgcatgggcctgacgtttaaaaatccgcttggtctggcagccggtcttgataaagacggggagtgcattgacgcgttaggcgcgatgggatttggatcgatcgagatcggtaccgtcacgccacgtccacagccaggtaatgacaagccgcgtctctttcgtctggtagatgccgaaggtttgatcaaccgtatgggctttaataatcttggcgttgataacctcgtagagaacgtaaaaaaggcccattatgacggcgtcctgggtattaacatcggcaaaaataaagatacgccagtggagcagggcaaagatgactatctgatttgtatggaaaaaatctatgcctatgcgggatatatcgccatcaatatttcatcgccgaataccccaggattacgcacgctgcaatatggtgaagcgctggatgatctcttaaccgcgattaaaaataagcaaaatgatttgcaagcgatgcaccataaatatgtgccgatcgcagtgaagatcgcgccggatctttctgaagaagaattgatccaggttgccgatagtttagttcgccataatattgatggcgttattgcaaccaataccacactcgatcgttctcttgttcagggaatgaaaaattgcgatcaaaccggtggcttaagtggtcgtccgcttcagttaaaaagcaccgaaattattcgccgcttgtcactggaattaaacggtcgcttaccgatcatcggtgttggcggcatcgactcggttatcgctgcgcgtgaaaagattgctgcgggtgcctcactggtgcaaatttattctggttttatttttaaaggtccgccgctgattaaagaaatcgttacccatatctaa

SEQ ID NO: 24475 - DNA, 279 bp, Escherichia coli
atgtcgaaagtctgcataattgcctgggtttacgggcgagttcagggcgtaggatttcgctacaccacacagtacgaagcgaaaagactgggtttaaccgggtacgccaaaaatcttgacgatggcagcgtggaagtggttgcttgcggtgaagaagggcaggtggaaaaattaatgcagtggttaaagagtggcggcccgcgttctgcgcgtgtagaacgggtgctcagcgagccgcatcatccctcgggggaattaaccgattttcgtatccgttaa

SEQ ID NO: 24476 - DNA, 2547 bp, Escherichia coli
atgaacaataacgatctctttcaggcatcacgtcggcgttttctggcacaactcggcggcttaaccgtcgccgggatgctggggccgtcattgttaacgccgcgacgtgcgactgcggcgcaagcggcgactgacgctgtcatctcgaaagagggcattcttaccgggtcgcactggggggctatccgcgcgacggtgaaggatggtcgctttgtggcggcaaaaccgttcgaactggataaatatccgtcgaaaatgattgccggattgccggatcacgtacacaacgcggcgcgtattcgttatccgatggtacgcgtggactggctgcgtaagcgccatctcagcgatacctcccagcgcggtgataaccgttttgtgcgcgtgagctgggatgaagccctcgacatgttctatgaagaactggaacgcgtgcagaaaactcacgggccgagtgccttgctgaccgccagtggttggcaatcgacggggatgttccataacgcttcggggatgctggcgaaagctattgccttgcatggtaatagcgttggtacgggcggagattactctaccggtgctgcgcaggtgatcctgccgcgcgtagtcggttcgatggaagtgtatgaacagcaaacctcctggccgctggtattgcagaacagcaaaaccattgtgctgtggggctccgatttgctgaaaaaccagcaagcgaactggtggtgcccggatcacgatgtttatgaatattacgcgcagctaaaagcgaaagtcgccgccggtgaaattgaggtcatcagcatcgatccggttgtcacatccacccatgagtatctggggcgcgagcatgtgaagcacattgcggttaacccgcaaactgacgtgccgctgcaactggcgctggcacatacgctgtacagtgaaaacctgtacgacaaaaacttccttgctaactactgtgtgggttttgagcagttcctgccgtatctgctgggtgagaaagacggtcagccgaaagatgccgcatgggctgaaaaactgaccggcattgatgccgaaaccattcgtgggctggcgcggcagatggcggcgaacagaacgcaaattattgctggctggtgcgtgcagcgtatgcagcacggtgaacagtgggcgtggatgattgtggttctggcggcgatgctggggcaaattggcctgccaggtggtggttttggttttggctggcactacaacggcgcaggcacgccggggcgtaaaggcgttattctgagtggtttctccggctctacgtcgattccgcctgttcacgacaacagtgactacaaaggctacagcagcactattccgattgcccgttttatcgatgcgatcctcgaaccggggaaagtgatcaactggaacggtaaatcggtaaaactgccgccgctgaaaatgtgtatttttgccggaactaacccattccatcgccatcagcagatcaaccgcattattgaaggcttgcgcaagctggaaacggttatcgccatagataaccagtggacctcaacctgccgctttgccgatatcgtactgcctgcgaccacgcagtttgagcgtaacgatctcgaccagtacggcaatcactccaaccgtggcattatcgccatgaaacaggtggtgccgccgcagttcgaggcgcgcaacgacttcgatattttccgcgagctgtgccgtcgctttaatcgcgaagaagcctttaccgaagggctggacgaaatgggctggctgaaacgcatctggcaggaaggtgtacagcaaggcaaaggacgcggcgttcatctgccagcgtttgatgacttctggaataacaaagagtacgtcgagtttgaccatccgcagatgtttgttcgccaccaggcattccgcgaagatccggatctcgaaccgctgggcacgccgagtggcctgattgagatctactcgaaaactatcgccgatatgaactacgacgattgtcaggggcatccgatgtggtttgagaaaatcgaacgctcccacggtgggcctggctcgcaaaagtatccgttgcatctgcaatctgtgcatccggatttccgacttcactcgcagttatgtgagtcggaaacgctgcgtcagcaatatacggtagcgggtaaagagccagtattcattaacccgcaggatgccagcgcgcgcggtattcgtaacggtgatgtggtacgcgtctttaacgctcgcggtcaggtgttggcaggggcagtggtttctgaccgctatgcacccggcgtggcacgaattcacgaaggggcatggtacgatccagataaaggcggcgagcctggtgcgctgtgcaaatacggtaaccccaacgtgttgaccatcgacatcggtacatcgcagctggcgcaggcgaccagtgcgcacactacgctggtggaaattgagaagtacaacggaacagtggagcaggtgacggcgtttaacggccccgtggagatggtggcgcagtgcgaatatgttcccgcgtcgcaggtgaaatcatga

SEQ ID NO: 24477 - DNA, 921 bp, Escherichia coli
atggaattaaaggattattacgccatcatgggcgtgaaaccgacggacgatctcaagacaatcaagaccgcctatcgtcgacttgcccgcaaataccatcctgatgtcagcaaagaaccggatgccgaagcccgcttcaaagaggtcgctgaagcctgggaagtgttaagtgatgaacaacgtcgcgctgagtatgatcagatgtggcaacatcgcaacgatccgcaatttaaccgtcagttccaccatggcgacggtcagagttttaacgccgaagattttgacgatatcttctcgtcaattttcggtcagcatgcccgccagagccgtcaacgccccgccacacgcggccacgatattgaaatcgaagtggcggtattcctcgaagaaacgcttactgagcataagcgtaccatcagctataacctgccggtttataacgcctttggcatgatcgaacaggaaattccgaaaacgctgaatgtgaagatcccggcgggcgtcggcaatggtcaacgcatccgtctgaaaggccaggggacgccgggcgaaaacggcggtccaaatggcgatttgtggctggtgattcatattgcgccacatccgctgtttgatattgtcggccaggatctggaaattgtggtgccggttagcccgtgggaagcggcgctgggtgctaaagtcaccgttccaacactgaaagaaagcattttgctgactatcccgccaggcagccaggccgggcaacgattgcgcgttaaaggcaaaggtctggtgagcaaaaaacagaccggcgatctgtatgcggtactgaaaatcgtgatgccgccgaaaccggatgaaaacactgccgcgctgtggcagcaactggcagacgcccagtcgtcttttgatccacgtaaagattgggggaaagcataa

SEQ ID NO: 24478 - DNA, 3963 bp, Escherichia coli
atgggaaccaccaccatgggggttaagctggacgacgcgacgcgtgagcgtattaagtctgccgcgacacgtatcgatcgcacaccacactggttaattaagcaggcgattttttcttatctcgaacaactggaaaacagcgatactctgccggagctacctgcgctgctttctggcgcggccaatgagagcgatgaagcaccgactccggcagaggaaccacaccagccattcctcgactttgccgagcaaatattgccccagtcggtttcccgcgccgcgatcaccgcggcctatcgccgcccggaaaccgaagcggtttctatgctgctggaacaagcccgcctgccgcagccagttgctgaacaggcgcacaaactggcgtatcagctggccgataaactgcgtaatcaaaaaaatgccagtggtcgcgcaggtatggtccaggggttattgcaggagttttcgctgtcatcgcaggaaggcgtggcgctgatgtgtctggcggaagcgttgttgcgtattcccgacaaagccacccgcgacgcgttaattcgcgacaaaatcagcaacggtaactggcagtcacacattggtcgtagcccgtcactgtttgttaatgccgccacctgggggctgctgtttactggcaaactggtttccacccataacgaagccagcctctcccgctcgctgaaccgcattatcggtaaaagcggtgaaccgctgatccgcaaaggtgtggatatggcgatgcgcctgatgggtgagcagttcgtcactggcgaaaccatcgcggaagcgttagccaatgcccgcaagctggaagagaaaggtttccgttactcttacgatatgctgggcgaagccgcgctgaccgccgcagatgcacaggcgtatatggtttcctatcagcaggcgattcacgccatcggtaaagcgtctaacggtcgtggcatctatgaagggccgggcatttcaatcaaactgtcggcgctgcatccgcgttatagccgcgcccagtatgaccgggtaatggaagagctttacccgcgtctgaaatcactcaccctgctggcgcgtcagtacgatattggtatcaacattgacgccgaagagtccgatcgcctggagatctccctcgatctgctggaaaaactctgtttcgagccggaactggcaggctggaacggcatcggttttgttattcaggcttatcaaaaacgctgcccgttggtgatcgattacctgattgatctcgccacccgcagccgtcgccgtctgatgattcgcctggtgaaaggcgcgtactgggatagtgaaattaagcgtgcgcagatggacggccttgaaggttatccggtttatacccgcaaggtgtataccgacgtttcttatctcgcctgtgcgaaaaagctgctggcggtgccgaatctaatctacccgcagttcgcgacgcacaacgcccatacgctggcggcgatttatcaactggcggggcagaactactacccgggtcagtacgagttccagtgcctgcatggtatgggcgagccactgtatgagcaggtcaccgggaaagttgccgacggcaaacttaaccgtccgtgtcgtatttatgctccggttggcacacatgaaacgctgttggcgtatctggtgcgtcgcctgctggaaaacggtgctaacacctcgtttgttaaccgtattgccgacacctctttgccactggatgaactggtcgccgatccggtcactgctgtagaaaaactggcgcaacaggaagggcaaactggattaccgcatccgaaaattcccctgccgcgcgatctttacggtcacgggcgcgacaactcggcagggctggatctcgctaacgaacaccgcctggcctcgctctcctctgccctgctcaatagtgcactgcaaaaatggcaggccttgccaatgctggaacaaccggtagcggcaggtgagatgtcgcccgttattaaccctgcggaaccgaaagatattgtgggctatgtgcgtgaagccacgccgcgtgaagtagaacaggcgctggaaagtgcggttaataacgcgccaatctggtttgccacgcctccggctgaacgcgcagcgattttgcaccgcgctgccgtgctgatggaaagccagatgcagcaactgattggtattctggtgcgtgaggccggaaaaaccttcagtaacgccattgccgaagtgcgcgaagcggtcgattttctccactactacgccggacaggtgcgggatgatttcgctaacgaaacccaccgtccattagggcctgtggtgtgtatcagtccgtggaacttcccgctggctattttcaccgggcagatcgccgccgcactggcggcaggtaacagcgtgctggcaaaaccggcagaacaaacgccgctgattgccgcgcaagggatcgccattttgctggaagcgggtgtaccgccaggcgtggtgcaattgctgccaggtcggggtgaaaccgtgggcgcgcaactgacgggtgatgatcgcgtgcgcggggtgatgtttaccggttcaaccgaagtcgctacgttactgcagcgcaatatcgccagccgcctggacgctcagggtcgccctattccgctcatcgctgaaaccggcggcatgaacgcgatgattgtcgattcttcagcactgaccgaacaggtcgtcgtggatgtactggcctcggcgttcgacagtgcgggtcagcgttgttcggcgctgcgcgtgctgtgcctgcaagatgagattgccgaccacacgttgaaaatgctgcgcggcgcaatggccgaatgccggatgggtaatccgggtcgcctgaccaccgatatcggtccagtgattgatagcgaagcgaaagccaatattgagcgccatattcagaccatgcgtagcaaaggccgtccggtgttccaggcggtgcgggaaaacagcgaagatgcccgtgaatggcaaagcggcacctttgtcgccccgacgctgatcgaactggatgactttgccgaattgcaaaaagaggtctttggtccggtgctgcatgtggtgcgttacaaccgtaaccagctaccagagctgatcgagcagattaacgcttccggttatggtctgacgcttggcgtccatacgcgcattgatgaaaccatcgcccaggtcactggctcggcccatgttggtaacctgtatgttaaccgtaatatggtgggcgcagtggttggtgtgcagccgttcggcggcgaagggttgtccggtaccgggccgaaagcaggcggtccgctctatctctaccgtctgctggcgaatcgcccggaaagtgcgctggcagtgacgctcgcgcgtcaggatgcaaagtatccggtcgatgcgcagttgaaagccgcattgactcagccgctaaatgcactgcgggaatgggcagcaaatcgtccagaattgcaggcgttatgtacgcaatatggcgagctggcgcaggcaggaacacaacgattgctgccggggccgacgggtgaacgcaacacctggacgctgctgccgcgtgagcgcgtgttgtgtattgccgatgatgagcaggatgcgctgactcagctcgccgccgtgctggcggtgggcagccaggtactgtggccggatgacgcgctgcatcgtcagttagtgaaggcattgccatcggcagtcagcgaacgtattcaactggcgaaagcggaaaatataaccgctcaaccgtttgatgcggtgatcttccacggtgattcggatcagcttcgcgcattgtgtgaagcagttgccgcgcgggatggcacaattgtttcggtgcagggttttgcccgtggcgaaagcaatatccttctggaacggctgtatatcgagcgttcgctgagtgtgaataccgctgccgctggcggtaacgccagcttaatgactataggttaa

SEQ ID NO: 24479 - DNA, 954 bp, Escherichia coli
atgtatacgaagattattggtactggcagctatctgcccgaacaagtgcggacaaacgccgatttggaaaaaatggtggacacctctgacgagtggattgtcactcgtaccggtatccgcgaacgccacattgccgcgccaaacgaaaccgtttcaaccatgggctttgaagcggcgacacgcgcaattgagatggcgggcattgagaaagaccagattggcctgatcgttgtggcaacgacttctgctacgcacgctttcccgagcgcagcttgtcagattcaaagcatgttgggcattaaaggttgcccggcatttgacgttgcagcagcctgcgcaggtttcacctatgcattaagcgtagccgatcaatacgtgaaatctggggcggtgaagtatgctctggtcgtcggttccgatgtactggcgcgcacctgcgatccaaccgatcgtgggactattattatttttggcgatggcgcgggcgctgcggtgctggctgcctctgaagagccgggaatcatttccacccatctgcatgccgacggtagttatggtgaattgctgacgctgccaaacgccgaccgcgtgaatccagagaattcaattcatctgacgatggcgggcaacgaagtcttcaaggttgcggtaacggaactggcgcacatcgttgatgagacgctggcggcgaataatcttgaccgttctcaactggactggctggttccgcatcaggctaacctgcgtattatcagtgcaacggcgaaaaaactcggtatgtctatggataatgtcgtggtgacgctggatcgccacggtaatacctctgcggcctctgtcccgtgcgcgctggatgaagctgtacgcgacgggcgcattaagccggggcagttggttctgcttgaagcctttggcggtggattcacctggggctccgcgctggttcgtttctag

SEQ ID NO: 24480 - DNA, 930 bp, Escherichia coli
atgacgcaatttgcatttgtgttccctggacagggttctcaaaccgttggaatgctggctgatatggcggcgagctatccaattgtcgaagaaacgtttgctgaagcttctgcggcgctgggctacgacctgtgggcgctgacccagcaggggccagctgaagaactgaataaaacctggcaaactcagcctgcgctgttgactgcatctgttgcgctgtatcgcgtatggcagcagcagggcggtaaagcaccggcaatgatggccggtcacagcctgggggaatactccgcgctggtttgcgctggtgtgattgatttcgctgatgcggtgcgtctggttgagatgcgcggcaagttcatgcaagaagccgtaccggaaggcacgggcgctatggcggcaatcatcggtctggatgatgcgtctattgcgaaagcgtgtgaagaagctgcagaaggtcaggtcgtttctccggtaaactttaactctccgggacaggtggttattgccggtcataaagaagcggttgagcgtgctggcgctgcctgtaaagcggcgggcgcaaaacgcgcgctgccgttaccagtgagcgtaccgtctcactgtgcgctgatgaaaccagcagccgacaaactggcagtagaattagcgaaaatcacctttaacgcaccaacagttcctgttgtgaataacgttgatgtgaaatgcgaaaccaatggtgatgccatccgtgacgcactggtacgtcagttgtataacccggttcagtggacgaagtctgttgagtacatggcagcgcaaggcgtagaacatctctatgaagtcggcccgggcaaagtgcttactggcctgacgaaacgcattgtcgacaccctgaccgcctcggcgctgaacgaaccttcagcgatggcagcggcgctcgagctttaa

SEQ ID NO: 24481 - DNA, 735 bp, Escherichia coli
atgaattttgaaggaaaaatcgcactggtaaccggtgcaagccgcggaattggccgcgcaattgctgaaacgctcgcagcccgtggcgcgaaagttattggcactgcgaccagtgaaaatggcgctcaggcgatcagtgattatttaggtgccaacggcaaaggtctgatgttgaatgtgaccgacccggcatctatcgaatctgttctggaaaaaattcgcgcagaatttggtgaagtggatatcctggtcaataatgccggtatcactcgtgataacctgttaatgcgaatgaaagatgaagagtggaacgatattatcgaaaccaacctttcatctgttttccgtctgtcaaaagcggtaatgcgcgctatgatgaaaaagcgtcatggtcgtattatcactatcggttctgtggttggtaccatgggaaatggcggtcaggccaactacgctgcggcgaaagcgggcttgatcggcttcagtaaatcactggcgcgcgaagttgcgtcacgcggtattactgtaaacgttgttgctccgggctttattgaaacggacatgacacgtgcgctgagcgatgaccagcgtgcgggtatcctggcgcaggttcctgcgggtcgcctcggcggcgcacaggaaatcgccaacgcggttgcattcctggcatccgacgaagcagcttacatcacgggtgaaactttgcatgtgaacggcgggatgtacatggtctga

SEQ ID NO: 24482 - DNA, 237 bp, Escherichia coli
atgagcactatcgaagaacgcgttaagaaaattatcggcgaacagctgggcgttaagcaggaagaagttaccaacaatgcttctttcgttgaagacctgggcgcggattctcttgacaccgttgagctggtaatggctctggaagaagagtttgatactgagattccggacgaagaagctgagaaaatcaccaccgttcaggctgccattgattacatcaacggccaccaggcgtaa

SEQ ID NO: 24483 - DNA, 1242 bp, Escherichia coli
gtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaa

SEQ ID NO: 24484 - DNA, 642 bp, Escherichia coli
atgcgcagtaagtatatcgtcattgaggggctggaaggcgcaggcaaaactaccgcgcgtaatgtggtggttgagacgctcgagcaactgggtatccgcgacatggttttcactcgggaacctggcggtacgcaacttgccgaaaagttaagaagcctggtgctggatatcaaatcggtaggcgatgaagtcattaccgataaagccgaagttctgatgttttatgccgcgcgcgttcaactggtagaaacggtcatcaaaccagctctggctaacggcacctgggtgattggcgatcgccacgatctctccactcaggcgtatcagggcggcggacgtggtattgaccaacatatgctggcaacactgcgtgatgctgttctcggggattttcgccccgacttaacgctctatctcgatgttaccccggaagttggcttaaaacgcgcgcgtgcgcgcggcgagctggatcgtattgagcaagaatctttcgatttctttaatcgcacccgcgcccgctatctggaactggcagcacaagataaaagcattcataccattgatgccacccagccgctggaggccgtgatggatgcaatccgcactaccgtgacccactgggtgaaggagttggacgcatga

SEQ ID NO: 24485 - DNA, 1251 bp, Escherichia coli
atggaaagtaaagtagttgttccggcacaaggcaagaagatcaccctgcaaaacggcaaactcaacgttcctgaaaatccgattatcccttacattgaaggtgatggaatcggtgtagatgtaaccccagccatgctgaaagtggtcgacgctgcagtcgagaaagcctataaaggcgagcgtaaaatctcctggatggaaatttacaccggtgaaaaatccacacaggtttatggtcaggacgtctggctgcctgctgaaactcttgatctgattcgtgaatatcgcgttgccattaaaggtccgctgaccactccggttggtggcggtattcgctctctgaacgttgccctgcgccaggaactggatctctacatctgcctgcgtccggtacgttactatcagggcactccaagcccggttaaacaccctgaactgaccgatatggttatcttccgtgaaaactcggaagacatttatgcgggtatcgaatggaaagcagactctgccgacgccgagaaagtgattaaattcctgcgtgaagagatgggggtgaagaaaattcgcttcccggaacattgtggtatcggtattaagccgtgttcggaagaaggcaccaaacgtctggttcgtgcagcgatcgaatacgcaattgctaacgatcgtgactctgtgactctggtgcacaaaggcaacatcatgaagttcaccgaaggagcgtttaaagactggggctaccagctggcgcgtgaagagtttggcggtgaactgatcgacggtggcccgtggctgaaagttaaaaacccgaacactggcaaagagatcgtcattaaagacgtgattgctgatgcattcctgcaacagatcctgctgcgtccggctgaatatgatgttatcgcctgtatgaacctgaacggtgactacatttctgacgccctggcagcgcaggttggcggtatcggtatcgcccctggtgcaaacatcggtgacgaatgcgccctgtttgaagccacccacggtactgcgccgaaatatgccggtcaggacaaagtaaatcctggctctattattctctccgctgagatgatgctgcgccacatgggttggaccgaagcggctgacttaattgttaaaggtatggaaggcgcaatcaacgcgaaaaccgtaacctatgacttcgagcgtctgatggatggcgctaaactgctgaaatgttcagagtttggtgacgcgatcatcgaaaacatgtaa

SEQ ID NO: 24486 - DNA, 1698 bp, Escherichia coli
atgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgctttcgcgaggtatattactgggacagttacttcaccatgttaggacttgccgaaagcggtcactgggataaagtcgcggatatggtggccaattttgctcatgaaatagacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtcaaacttcaggatggtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgccggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcgtccgaccgttaagtcagcaacgacgcaaccctcaaccaaagaggcacaacccacaccttaa

SEQ ID NO: 24487 - DNA, 1101 bp, Escherichia coli
atgccctaccgtaattgctggagcaaaataatgaaaaaattgatcaatgatgtgcaagacgtactggacgaacaactggcaggactggcgaaagcgcatccatcgctgacactgcatcaggatccggtgtatgtcacccgagctgatgcccctgttgcaggaaaagtcgccctgctgtcgggtggcggcagcggacacgagccgatgcactgtggttatatcggtcaggggatgctttcgggggcctgtccgggcgaaattttcacctcaccgacgcccgataaaatctttgaatgcgccatgcaagttgatggcggcgaaggtgtactgttgattatcaaaaattacaccggcgatattcttaactttgaaacagcgaccgagttactgcacgatagcggcgtaaaagtgaccactgtggtcattgatgacgacgttgcggtaaaagacagtctttatactgccgggcgacgcggcgttgccaacaccgtattaattgaaaaactcgtaggcgcagcggcggagcgtggcgactcactggacgcctgtgcggaactggggcgtaagctgaataatcaaggccactcaataggtatcgctctcggtgcctgtaccgttcctgccgcgggcaaaccttcttttaccctggcggataatgagatggagtttggcgtcggcattcatggtgagccgggtattgaccgccgccccttctcttcccttgatcaaaccgtcgatgaaatgttcgacaccctgctggtaaatggctcataccatcgcactttgcgtttctgggattatcaacaaggcagttggcaggaagaacaacaaaccaaacaaccgctccagtctggcgatcgggtgattgcgctggttaacaatcttggcgcaactccgctttctgagctgtacggcgtctataaccgcctgaccacacgttgccagcaagcgggattgactatcgaacgtaatttaattggcgcgtactgcacctcactggatatgaccggtttctcaatcaccttactgaaagttgatgacgaaacgctggcactctgggacgccccggtccacaccccggcccttaactggggtaaataa

SEQ ID NO: 24488 - DNA, 948 bp, Escherichia coli
gtgcctgatatgaagctttttgctggtaacgccaccccggaactagcacaacgtattgccaaccgcctgtacacttcactcggcgacgccgctgtaggtcgctttagcgatggcgaagtcagcgtacaaattaatgaaaatgtacgcggtggtgatattttcatcatccagtccacttgtgcccctactaacgacaacctgatggaattagtcgttatggttgatgccctgcgtcgtgcttccgcaggtcgtatcaccgctgttatcccctactttggctatgcgcgccaggaccgtcgcgtccgttccgctcgtgtaccaatcactgcgaaagtggttgcagacttcctctccagcgtcggtgttgaccgtgtgctgacagtggatctgcacgctgaacagattcagggtttcttcgacgttccggttgataacgtatttggtagcccgatcctgctggaagacatgctgcagctgaatctggataacccaattgtggtttctccggacatcggcggcgttgtgcgtgcccgcgctatcgctaagctgctgaacgataccgatatggcaatcatcgacaaacgtcgtccgcgtgcgaacgtttcacaggtgatgcatatcatcggtgacgttgcaggtcgtgactgcgtactggtcgatgatatgatcgacactggcggtacgctgtgtaaagctgctgaagctctgaaagaacgtggtgctaaacgtgtatttgcgtacgcgactcacccgatcttctctggcaacgcggcgaacaacctgcgtaactctgtaattgatgaagtcgttgtctgcgataccattccgctgagcgatgaaatcaaatcactgccgaacgtgcgtactctgaccctgtcaggtatgctggccgaagcgattcgtcgtatcagcaacgaagaatcgatctctgccatgttcgaacactaa

SEQ ID NO: 24489 - DNA, 852 bp, Escherichia coli
atgcggacacagtggccctctccggcaaaacttaatctgtttttatacattaccggtcagcgtgcggatggttaccacacgctgcaaacgctgtttcagtttcttgattacggcgacaccatcagcattgagcttcgtgacgatggggatattcgtctgttaacgcccgttgaaggcgtggaacatgaagataacctgatcgttcgcgcagcgcgattgttgatgaaaactgcggcagacagcgggcgtcttccgacgggaagcggtgcgaatatcagcattgacaagcgtttgccgatgggcggcggtctcggcggtggttcatccaatgccgcgacggtcctggtggcattaaatcatctctggcaatgcgggctaagcatggatgagctggcggaaatggggctgacgctgggcgcagatgttcctgtctttgttcgggggcatgccgcgtttgccgaaggcgttggtgaaatactaacgccggtggatccgccagagaagtggtatctggtggcgcaccctggtgtaagtattccgactccggtgatttttaaagatcctgaactcccgcgcaatacgccaaaaaggtcaatagaaacgttgctaaaatgtgaattcagcaatgattgcgaggttatcgcaagaaaacgttttcgcgaggttgatgcggtgctttcctggctgttagaatacgccccgtcgcgcctgactgggacaggggcctgtgtctttgctgaatttgatacagagtctgaagcccgccaggtgctagagcaagccccggaatggctcaatggctttgtggcgaaaggcgctaatctttccccattgcacagagccatgctttaa

SEQ ID NO: 24490 - DNA, 624 bp, Escherichia coli
atgcccctgcccgattttcgtcttatccgcctgctaccgctggctgctcttgtgctcactgcctgttccgttaccacgcccaaaggtcctggcaaaagcccggattcgccacaatggcgtcagcatcagcaagacgtgcgcaatcttaatcagtatcagactcgcggcgcgttcgcttatatttctgaccaacaaaaagtgtacgcccgctttttctggcagcaaaccggccaggatcgctaccgtctgctgctcactaacccattgggcagcacggaactggagctgaatgctcaaccgggtaacgtgcagttagtcgacaataaaggtcagcgttataccgccgatgacgccgaagagatgattggcaaattgaccggaatgccaattccgctcaacagcttgcgccagtggattttaggtttaccgggtgatgcaaccgactacaaactggacgaccagtaccgcctgagcgaaattacctacagccagaatggcaaaaactggaaggttgtttatggtggttatgacaccaaaacgcaacctgcgatgccagccaatatggaactcaccgacggtggtcaacgcatcaagttaaaaatggataactggatagtgaaataa

SEQ ID NO: 24491 - DNA, 1257 bp, Escherichia coli
atgacccttttagcactcggtatcaaccataaaacggcacctgtatcgctgcgagaacgtgtatcgttttcgccggataagctcgatcaggcgcttgacagcctgcttgcgcagccgatggtgcagggcggcgtggtgctgtcgacgtgcaaccgcacggaactttatcttagcgttgaagagcaggacaacctgcaagaggcgttaatccgctggctttgcgattatcacaatcttaatgaagaagatctgcgtaaaagcctctactggcatcaggataacgacgcggttagccatttaatgcgtgttgccagcggcctggattcactggttctgggggagccgcagatcctcggtcaggttaaaaaagcgtttgccgattcgcaaaaaggtcatatgaaggccagcgaactggaacgcatgttccagaaatctttctctgtcgcgaaacgcgttcgcactgaaacagatatcggtgccagcgctgtgtctgtcgcttttgcggcttgtacgctggcgcggcagatctttgaatcgctctctacggtcacagtgttgctggtaggcgcgggcgaaactatcgagctggtggcgcgtcatctgcgcgaacacaaagtacagaagatgattatcgccaaccgcactcgcgaacgtgcccaaattctggcagatgaagtcggcgcggaagtgattgccctgagtgatatcgacgaacgtctgcgcgaagccgatatcatcatcagttccaccgccagcccgttaccgattatcgggaaaggcatggtggagcgcgcattaaaaagccgtcgcaaccaaccaatgctgttggtggatattgccgttccgcgcgatgttgagccggaagttggcaaactggcgaatgcttatctttatagcgttgatgatctgcaaagcatcatttcgcacaacctggcgcagcgtaaagccgcagcggttgaggcggaaactattgtcgctcaggaaaccagcgaatttatggcgtggctgcgagcacaaagcgccagcgaaaccattcgcgagtatcgcagccaggcagagcaagttcgcgatgagttaaccgccaaagcgttagcggcccttgagcagggcggcgacgcgcaagccattatgcaggatctggcatggaaactgactaaccgcttgatccatgcgccaacgaaatcacttcaacaggccgcccgtgacggggataacgaacgcctgaatattctgcgcgacagcctcgggctggagtag

SEQ ID NO: 24492 - DNA, 3744 bp, Escherichia coli
atgagtaaattcctggaccggtttcgctacttcaaacagaagggtgaaacctttgccgatgggcatggccagcttctcaataccaaccgtgactgggaggatggatatcgccagcgttggcagcatgacaaaatcgtccgctctacccacggggtaaactgcaccggctcctgcagctggaaaatctacgtcaaaaacggtctggtcacctgggaaacccagcagactgactatccgcgtacccgtccggatctgccaaaccatgaacctcgcggctgcccgcgcggtgccagctactcctggtatctttacagtgccaaccgcctgaaatacccgatgatgcgcaaacgcctgatgaaaatgtggcgtgaagcgaaggcgctgcatagcgatccggttgaggcatgggcttctatcattgaagacgccgataaagcgaaaagctttaagcaggcgcgtggacgcggtggatttgttcgttcttcctggcaggaggtgaacgaactgatcgccgcatctaacgtttacaccatcaaaaactacggcccggaccgtgttgctggtttctcgccaattccggcaatgtcgatggtttcttacgcatcgggtgcacgctatctctcgctgattggcggtacttgcttaagcttctacgactggtactgcgacttgcctcctgcgtctccgcaaacctggggcgagcaaactgacgtaccggaatctgctgactggtacaactccagctacatcatcgcctgggggtcaaacgtgccgcagacgcgtaccccggatgctcacttctttactgaagtgcgttacaaagggaccaaaactgttgccgtcacaccagactacgctgaaatcgccaaactgtgcgatctgtggctggcaccgaaacagggcaccgatgcggcaatggcgctggcgatgggccacgtaatgctgcgtgaattccacctcgacaacccaagccagtatttcaccgactatgtgcgtcgctacaccgacatgccgatgctggtgatgctggaagaacgcgacggttactacgctgcaggtcgtatgctgcgcgctgctgatctggttgatgcgctgggccaggaaaacaatccggaatggaaaactgtcgcctttaataccaatggcgaaatggttgcgccgaacggttctattggcttccgctggggcgagaagggcaaatggaatcttgagcagcgcgacggcaaaactggcgaagaaaccgagctgcaactgagcctgctgggtagccaggatgagatcgctgaggtaggcttcccgtactttggtggcgacggcacggaacacttcaacaaagtggaactggaaaacgtgctgctgcacaaactgccggtgaaacgcctgcaactggctgatggcagcaccgccctggtgaccaccgtttatgatctgacgctggcaaactacggtctggaacgtggcctgaacgacgttaactgtgcaaccagctatgacgatgtgaaagcttataccccggcctgggccgagcagattaccggcgtttctcgcagccagattattcgcatcgcccgtgaatttgccgataacgctgataaaacgcacggtcgttcgatgattatcgtcggtgcggggctgaaccactggtatcacctcgatatgaactatcgtggtctgatcaacatgctgattttctgcggctgtgtcggtcagagcgggggcggctgggcgcactatgtaggtcaggaaaaactgcgtccgcaaaccggctggcagccgctggcgtttgcccttgactggcagcgtccggcgcgtcacatgaacagcacttcttatttctataaccactccagccagtggcgttatgaaaccgtcacggcggaagagttgctgtcaccgatggcggacaaatcccgctataccggacacttgatcgactttaacgtccgtgcggaacgcatgggctggctgccgtctgcaccgcagttaggcactaacccgctgactatcgctggcgaagcggaaaaagccgggatgaatccggtggactatacggtgaaatccctgaaagagggttccatccgttttgcggcagaacaaccagaaaacggtaaaaaccacccgcgcaacctgttcatctggcgttctaacctgctcggttcttccggtaaaggtcatgagtttatgctcaagtacctgctggggacggagcacggtatccagggtaaagatctggggcaacagggcggcgtgaagccggaagaagtggactggcaggacaatggtctggaaggcaagctggatctggtggttacgctggacttccgtctgtcgagcacctgtctctattccgacatcattttgccgacggcgacctggtacgaaaaagacgacatgaatacttcggatatgcatccgtttattcacccgctgtctgcggcggtcgatccggcctgggaagcgaaaagcgactgggaaatctacaaagccatcgcgaagaaattctccgaagtgtgcgtcggccatctgggtaaagaaaccgacatcgtcacgctgcctatccagcatgactctgccgctgaactggcgcagccgctggatgtgaaagactggaaaaaaggcgagtgcgacctgatcccaggtaaaaccgcgccacacattatggtcgtagagcgcgattatccggcgacttacgaacgctttacctctatcggcccgctgatggagaaaatcggtaatggcggtaaagggattgcctggaacacccagagcgagatggatctgctgcgtaagctcaactacaccaaagcggaaggtccggcgaaaggccagccgatgctgaacaccgcaattgatgcggcagagatgatcctgacactggcaccggaaaccaacggtcaggtagccgtgaaagcctgggctgccctgagcgaatttaccggtcgtgaccatacgcatctggcgctgaataaagaagacgagaagatccgcttccgcgatattcaggcacagccgcgcaaaattatctccagcccgacctggtctggtctggaagatgaacacgtttcttacaacgccggttacaccaacgttcacgagctgatcccatggcgtacgctctctggtcgtcagcaactgtatcaggatcaccagtggatgcgtgatttcggtgaaagcctgctggtttatcgtccgccgatcgacacccgttcggtgaaagaagtgataggccagaaatccaacggcaaccaggaaaaagcgctcaacttcctgacgccgcaccagaagtggggtatccactccacctacagcgacaacctgctgatgctgactttaggtcgcggtggtccggtggtctggttgagtgaagccgatgccaaagatctgggtatcgccgataacgactggattgaagtcttcaacagcaacggtgctctgactgcccgtgcggttgtcagccagcgtgttccggcagggatgaccatgatgtaccacgcgcaggaacgtatcgttaacctgcctggttcggaaattacccaacagcgtggtggtatccataactcggtcacccgtatcacgccgaaaccgacgcatatgatcggcggctatgcccatctggcatacggctttaactactatggcaccgtaggttctaaccgcgatgagtttgttgtagtgcgtaagatgaagaacattgactggttagatggcgaaggcaatgaccaggtacaggagagcgtaaaatga

SEQ ID NO: 24493 - DNA, 1539 bp, Escherichia coli
atgaaaattcgttcacaagtcggcatggtgctgaatctcgataagtgcatcggctgccacacctgttcagttacctgtaaaaacgtctggaccagccgtgaaggcgtggaatatgcgtggttcaacaacgtggaaaccaagccgggccagggcttcccgactgactgggaaaaccaggaaaaatacaaaggcggctggatccgtaaaatcaacggcaaactgcagccgcgcatgggtaaccgtgccatgctgctgggtaaaatcttcgctaacccgcatctgccggggatcgacgattattacgagccgttcgattttgactatcagaacctgcataccgcgccggaaggcagcaaatcgcagccgattgcccgtccgcgttcgctgattaccggggaacggatggcgaaaatcgaaaaagggccgaactgggaagatgacctgggcggtgagtttgacaaactggcgaaagacaagaacttcgacaacatccagaaggcgatgtatagccagttcgaaaacaccttcatgatgtatttgccgcgcctgtgcgaacactgcctgaacccggcatgtgtggcgacctgcccgagcggtgcgatttacaagcgtgaagaagatggcatcgtcctgatcgaccaggataaatgccgtggctggcgtatgtgcatcactggatgcccgtacaaaaaaatctacttcaactggaagagcggtaagtctgagaagtgcatcttctgctatccgcgtattgaagcgggtcagccgaccgtgtgctcagaaacctgtgtcggtcgtatccgttatcttggcgtgctgttgtacgatgccgacgctattgaacgtgcagccagcaccgagaacgagaaagatctttaccagcgtcagctggacgtgttcctcgatccgaacgatccgaaagtcatcgagcaggcgattaaagacggtattccgctgagcgttattgaagccgcacagcagtcgccggtttataaaatggcaatggaatggaaactggcgctgccgctgcatccggaatatcgcacactgccgatggtctggtacgtgccgcctctgtctccgattcagtctgcagcagacgcgggtgagctgggtagcaacggcattctgccagacgtcgaaagcctgcgtattccggtacagtatctggcgaatctgctgaccgccggtgataccaaaccggtactgcgcgcactgaaacgtatgctggcgatgcgtcattacaaacgtgctgaaaccgttgacggtaaagttgatacccgtgcgctggaagaggtcggtctgaccgaagcccaggcacaggagatgtaccgttatctggcgattgctaactacgaagatcgctttgtggtgccgagtagtcatcgtgaactggcacgggaagccttcccggagaaaaatggctgcggctttacctttggtgatggctgccacggttcagataccaaattcaatctgttcaacagccgtcgtatcgatgccatcgatgtgaccagcaaaacggagccgcatccatga

SEQ ID NO: 24494 - DNA, 711 bp, Escherichia coli
atgatcgaactcgtgattgtatcgcgtctccttgaatatccggatgctgccttatggcagcatcaacaagagatgtttgaggcgattgccgcgtcgaaaaatctgccaaaagaggatgcccatgcgctgggcattttcctgcgcgatttaacgacgatggatccgctcgatgcccaggcgcagtacagcgaactgttcgaccgtggccgcgccacgtcactgttgctgtttgaacatgtgcacggcgaatcccgcgaccgcggccaggcgatggtggacctgctggcgcagtacgagcagcacggcttgcagttaaacagccgcgaattgccggaccatctgccgctgtatctggagtacctggcgcagctgccgcaaagcgaagccgtggaaggtttgaaagatatcgcgccgattctggcattgctgagcgcgcgtctgcaacagcgtgaaagccgttatgccgtgctgtttgatctgctgctgaaactggcgaataccgctatcgacagcgacaaagtggcggaaaaaattgccgacgaagcgcgcgatgatacgccgcaggcgctggatgctgtctgggaagaagagcaggttaaattctttgctgacaaaggctgcggtgattcagcaatcactgcgcatcagcgtcgctttgccggtgccgtcgcgccgcaatatctgaatatcaccaccggaggacagcactaa

SEQ ID NO: 24495 - DNA, 678 bp, Escherichia coli
atgcaattcctgaatatgttcttctttgatatctacccgtacatagccggggcggtcttcctgattggtagctggctgcgttatgactacgggcagtacacctggcgcgcggcgtccagccagatgctggatcgcaaagggatgaacctggcgtcgaacctgttccatatcgggattctggggatttttgtcggtcacttcttcggtatgctgacgccgcactggatgtatgaagcctggctgccgattgaagtgaaacagaaaatggcaatgtttgctggtggtgccagcggcgtgctgtgtctgattggcggcgtgctgttgctgaaacgtcgtctgttcagcccacgcgtgcgtgcaaccactaccggagcggatatcctgatcctgtcgctgctcgttatccagtgcgcgctgggcctgttgaccattccgttctccgctcagcatatggacggtagcgagatgatgaaactggttggctgggcgcagtcggtggtgaccttccacggtggcgcttctcaacacctcgatggtgtggcgtttatcttccgtctgcacctggtgctggggatgacgttattcctgctgttcccgttctcgcgtctgatacacatctggagcgtaccggtggagtatctgacacgtaagtaccagctggtgcgcgctcgtcactaa

SEQ ID NO: 24496 - DNA, 909 bp, Escherichia coli
atggctgccattaatacgaaagtcaaaaaagccgttatccccgttgcgggattaggaaccaggatgttgccggcgacgaaagccatcccgaaagagatgctgccacttgtcgataagccattaattcaatacgtcgtgaatgaatgtattgcggctggcattactgaaattgtgctggttacacactcatctaaaaactctattgaaaaccactttgataccagttttgaactggaagcaatgctggaaaaacgtgtaaaacgtcaactgcttgatgaagtgcagtctatttgtccaccgcacgtgactattatgcaagttcgtcagggtctggcgaaaggcctgggacacgcggtattgtgtgctcacccggtagtgggtgatgaaccggtagctgttattttgcctgatgttattctggatgaatatgaatccgatttgtcacaggataacctggcagagatgatccgccgctttgatgaaacgggtcatagccagatcatggttgaaccggttgctgatgtgaccgcatatggcgttgtggattgcaaaggcgttgaattagcgccgggtgaaagcgtaccgatggttggtgtggtagaaaaaccgaaagcggatgttgcgccgtctaatctcgctattgtgggtcgttacgtacttagcgcggatatttggccgttgctggcaaaaacccctccgggagctggtgatgaaattcagctcaccgacgcaattgatatgctgatcgaaaaagaaacggtggaagcctatcatatgaaagggaagagccatgactgcggtaataaattaggttacatgcaggccttcgttgaatacggtattcgtcataacacccttggcacggaatttaaagcctggcttgaagaagagatgggcattaagaagtaa

SEQ ID NO: 24497 - DNA, 759 bp, Escherichia coli
atgcattaccagccaaaacaagatttactcaatgatcgcattatcctggtgacgggagccagcgatggtattggtcgtgaagccgcgatgacgtatgcacgctatggtgcgacagtgattctgttgggccgtaatgaagaaaaattacgtcaggtagccagccacataaacgaagaaactgggcgtcagccacagtggtttattctcgatttgctgacctgcacgtccgaaaattgccaacaactggcacagcgcattgccgttaattatccgcgtctggatggtgttttgcataatgccggattgctcggcgatgtttgcccaatgagcgaacaaaatccgcaggtctggcaggacgtcatgcaggtcaacgttaatgccacctttatgctcacccaggcactgcttcctttattactcaaatcggacgccggttcactggtctttacttcatcaagcgttggacgtcagggacgagccaactggggtgcatatgcagcgtcgaaatttgccaccgaagggatgatgcaggtactggccgatgaatatcagcagcgcctgcgtgtcaactgcattaacccaggcggtacgcgcaccgcaatgcgtgccagcgccttcccgaccgaagatccacagaaacttaaaacacccgctgatatcatgccgctctacctctggctgatgggcgatgacagccgccgtaaaaccggcatgacctttgacgcccaaccgggccgtaaaccaggaatttcccaatga

SEQ ID NO: 24498 - DNA, 2676 bp, Escherichia coli
atgtcgtcaaccctacgagaagccagtaaggacacgttgcaggccaaagataaaacttaccactactacagcctgccgcttgctgctaaatcactgggcgatatcacccgtctacccaagtcactcaaagttttgctcgaaaacctgctgcgctggcaggatggtaactcggttaccgaagaggatatccacgcgctggcaggatggctgaaaaatgcccatgctgaccgtgaaattgcctaccgcccggcaagggtgctgatgcaggactttaccggcgtacctgccgttgttgatctggcggcaatgcgcgaagcggttaaacgcctcggcggcgatactgcaaaggttaacccgctctcaccggtcgacctggtcattgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggggtggggcgttggtgggatcgaagcagaagccgcaatgttaggccagccggtttccatgcttatcccggatgtagtgggcttcaaacttaccggaaaattacgtgaaggtattaccgccacagacctggttctcactgttacccaaatgctgcgcaaacatggcgtggtggggaaattcgtcgaattttatggtgatggtctggattcactaccgttggcggatcgcgccaccattgccaatatgtcgccagaatatggtgccacctgtggcttcttcccaatcgatgctgtaaccctcgattacatgcgtttaagcgggcgcagcgaagatcaggtcgagttggtcgaaaaatatgccaaagcgcagggcatgtggcgtaacccgggcgatgaaccaatttttaccagtacgttagaactggatatgaatgacgttgaagcgagcctggcagggcctaaacgcccacaggatcgcgttgcactgcccgatgtaccaaaagcatttgccgccagtaacgaactggaagtgaatgccacgcataaagatcgccagccggtcgattatgttatgaacggacatcagtatcagttacctgatggcgctgtggtcattgctgcgataacctcgtgcaccaacacctctaacccaagtgtgctgatggccgcaggcttgctggcgaaaaaagccgtaactctgggcctcaagcggcaaccatgggtcaaagcgtcgctggcaccgggttcgaaagtcgtttctgattatctggcaaaagcgaaactgacaccgtatctcgacgaactggggtttaaccttgtgggatacggttgtaccacctgtattggtaactctgggccgctgcccgatcctatcgaaacggcaatcaaaaaaagcgatttaaccgtcggtgcggtgctgtccggcaaccgtaactttgaaggccgtatccatccgctggttaaaactaactggctggcctcgccgccgctggtggttgcctatgcgctggcgggaaatatgaatatcaacctggcttctgagcctatcggccatgatcgcaaaggcgatccggtttatctgaaagatatctggccatcggcacaagaaattgcccgtgcggtagaacaagtctccacagaaatgttccgcaaagagtacgcagaagtttttgaaggcacagcagagtggaagggaattaacgtcacacgatccgatacctacggttggcaggaggactcaacctatattcgcttatcgcctttctttgatgaaatgcaggcaacaccagcaccagtggaagatattcacggtgcgcggatcctcgcaatgctgggggattcagtcaccactgaccatatctctccggcgggcagtattaagcccgacagcccagcgggtcgatatctacaaggtcggggtgttgagcgaaaagactttaactcctacggttcgcggcgtggtaaccatgaagtgatgatgcgcggcaccttcgccaatattcgcatccgtaatgaaatggtgcctggcgttgaaggggggatgacgcggcatttacctgacagcgacgtagtctctatttatgatgctgcgatgcgctataagcaggagcaaacgccgctggcggtgattgccgggaaagagtatggatcaggctccagtcgtgactgggcggcaaaaggtccgcgtctgcttggtattcgtgtggtgattgccgaatcgtttgaacgaattcaccgttcgaatttaattggcatgggcatcctgccgctggaatttccgcaaggcgtaacgcgtaaaacgttagggctaaccggggaagagaagattgatattggcgatctgcaaaacctacaacccggcgcgacggttccggtgacgcttacgcgcgcggatggtagccaggaagtcgtaccctgccgttgtcgtatcgacaccgcgacggagttgacctactaccagaacgacggcattttgcattatgtcattcgtaatatgttgaagtaa

SEQ ID NO: 24499 - DNA, 789 bp, Escherichia coli
atgggttttctttccggtaagcgcattctggtaaccggtgttgccagcaaactatccatcgcctacggtatcgctcaggcgatgcaccgcgaaggagctgaactggcattcacctaccagaacgacaaactgaaaggccgcgtagaagaatttgccgctcaattgggttctgacatcgttctgcagtgcgatgttgcagaagatgccagcatcgacaccatgttcgctgaactggggaaagtttggccgaaatttgacggtttcgtacactctattggttttgcacctggcgatcagctggatggtgactatgttaacgccgttacccgtgaaggcttcaaaattgcccacgacatcagctcctacagcttcgttgcaatggcaaaagcttgccgctccatgctgaatccgggttctgccctgctgaccctttcctaccttggcgctgagcgcgctatcccgaactacaacgttatgggtctggcaaaagcgtctctggaagcgaacgtgcgctatatggcgaacgcgatgggtccggaaggtgtgcgtgttaacgccatctctgctggtccgatccgtactctggcggcctccggtatcaaagacttccgcaaaatgctggctcattgcgaagccgttaccccgattcgccgtaccgttactattgaagatgtgggtaactctgcggcattcctgtgctccgatctctctgccggtatctccggtgaagtggtccacgttgacggcggtttcagcattgctgcaatgaacgaactcgaactgaaataa

SEQ ID NO: 24500 - DNA, 1488 bp, Escherichia coli
atgaattttcatcatctggcttactggcaggataaagcgttaagtctcgccattgaaaaccgcttatttattaacggtgaatatactgctgcggcggaaaatgaaacctttgaaaccgttgatccggtcacccaggcaccgctggcgaaaattgcccgcggcaagagcgtcgatatcgaccgtgcgatgagcgcagcacgcggcgtatttgaacgcggcgactggtcactctcttctccggctaaacgtaaagcggtactgaataaactcgccgatttaatggaagcccacgccgaagagctggcactgctggaaactctcgacaccggcaaaccgattcgtcacagtctgcgtgatgatattcccggcgcggcgcgcgccattcgctggtacgccgaagcgatcgacaaagtgtatggcgaagtggcgaccaccagtagccatgagctggcgatgatcgtgcgtgaaccggtcggcgtgattgccgccatcgtgccgtggaacttcccgctgttgctgacttgctggaaactcggcccggcgctggcggcgggaaacagcgtgattctaaaaccgtctgaaaaatcaccgctcagtgcgattcgtctcgcggggctggcgaaagaagcaggcttgccggatggtgtgttgaacgtggtgacgggttttggtcatgaagccgggcaggcgctgtcgcgtcataacgatatcgacgccattgcctttaccggttcaacccgtaccgggaaacagctgctgaaagatgcgggcgacagcaacatgaaacgcgtctggctggaagcgggcggcaaaagcgccaacatcgttttcgctgactgcccggatttgcaacaggcggcaagcgccaccgcagcaggcattttctacaaccagggacaggtgtgcatcgccggaacgcgcctgttgctggaagagagcatcgccgatgaattcttagccctgttaaaacagcaggcgcaaaactggcagccgggccatccacttgatcccgcaaccaccatgggcaccttaatcgactgcgcccacgccgactcggtccatagctttattcgggaaggcgaaagcaaagggcaactgttgttggatggccgtaacgccgggctggctgccgccatcggcccgaccatctttgtggatgtggacccgaatgcgtccttaagtcgcgaagagattttcggtccggtgctggtggtcacgcgtttcacatcagaagaacaggcgctacagcttgccaacgacagccagtacggccttggcgcggcggtatggacgcgcgacctctcccgcgcgcaccgcatgagccgacgcctgaaagccggttccgtcttcgtcaataactacaacgacggcgatatgaccgtgccgtttggcggctataagcagagcggcaacggtcgcgacaaatccctgcatgcccttgaaaaattcactgaactgaaaaccatctggataagcctggaggcctga

SEQ ID NO: 24501 - DNA, 1266 bp, Escherichia coli
atgagcaacaatgaattccatcagcgtcgtctttctgccactccgcgcggggttggcgtgatgtgtaacttcttcgcccagtcggctgaaaacgccacgctgaaggatgttgagggcaacgagtacatcgatttcgccgcaggcattgcggtgctgaataccggacatcgccaccctgatctggtcgcggcggtggagcagcaactgcaacagtttacccacaccgcgtatcagattgtgccgtatgaaagctacgtcaccctggcggagaaaatcaacgcccttgccccggtgagcgggcaggccaaaaccgcgttcttcaccaccggtgcggaagcggtggaaaacgcggtgaaaattgctcgcgcccataccggacgccctggcgtgattgcgtttagcggcggctttcacggtcgtacgtatatgaccatggcgctgaccggaaaagttgcgccgtacaaaatcggcttcggcccgttccctggttcggtgtatcacgtaccttatccgtcagatttacacggcatttcaacacaggactccctcgacgccatcgaacgcttgtttaaatcagacatcgaagcgaagcaggtggcggcgattattttcgaaccggtgcagggcgagggcggtttcaacgttgcgccaaaagagctggttgccgctattcgccgcctgtgcgacgagcacggtattgtgatgattgctgatgaagtgcaaagcggctttgcgcgtaccggtaagctgtttgccatggatcattacgccgataagccggatttaatgacgatggcgaaaagcctcgcgggcgggatgccgctttcgggcgtggtcggtaacgcgaatattatggacgcacccgcgccgggcgggcttggcggcacctacgccggtaacccgctggcggtggctgccgcgcacgcggtgctcaacattatcgacaaagaatcactctgcgaacgcgcgaatcaactgggccagcgtctcaaaaacacgttgattgatgccaaagaaagcgttccggccattgctgcggtacgcggcctggggtcgatgattgcggtagagtttaacgatccgcaaacgggcgagccgtcagcggcgattgcacagaaaatccagcaacgcgcgctggcgcaggggctgctcctgctgacctgtggcgcatacggcaacgtgattcgcttcctgtatccgctgaccatcccggatgcgcaattcgatgcggcaatgaaaattttgcaggatgcgctgagcgattaa

SEQ ID NO: 24502 - DNA, 660 bp, Escherichia coli
atgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatag

SEQ ID NO: 24503 - DNA, 1374 bp, Escherichia coli
gtgaccgctttttctaccctgaatgttttgcctcccgcccaactcacgaaccttaatgagttgggttatttaaccatgacgccggtgcaggccgccgcgcttccggcgatccttgccggaaaagatgttcgcgtgcaggcgaaaaccggcagcggcaaaacggcggcttttggcctcggcttgttacagcaaattgatgcgtcgctatttcaaacccaggctttagtgctgtgtcctacgcgtgaactggcggatcaggtggcaggtgaattgcgtcggctggcgcgttttctgccaaataccaaaattttgacgttgtgcggtggtcaaccgttcggtatgcagcgtgattcgttgcaacatgcgccgcatattatcgtggcaacgccggggcgtttgctggatcacctgcaaaaaggcacggtatcactggatgcgttgaatacgctggtgatggatgaggccgaccgcatgctggatatgggatttagcgatgccattgatgatgtcatccgttttgcgcctgcatctcgacagacgcttctgttttcggcaacctggccggaagccatcgctgcaatcagcggacgagtgcaacgcgatcctttggcgattgaaattgactcaacagatgctttgccacccattgaacaacaattttatgagacatccagcaaaggcaaaattcctctgttgcaacggttattaagcttgcatcagccatcctcttgcgtggtgttttgcaataccaaaaaagattgccaggctgtctgcgacgcgctgaatgaagtagggcaaagtgcattgtcattacacggcgatttggagcaacgcgatcgcgatcagaccctggtacgttttgctaacggtagcgcccgtgtactggtcgcgactgatgttgctgcgcgtggtctggatattaaatcgcttgagctggtggtgaactttgagctggcgtgggaccctgaagttcatgtacatcgcatcggtcgtacagctcgtgcaggaaatagcggtctggcgatcagtttctgtgctccggaagaagcacagcgggccaatatcatttctgacatgttgcagataaaacttaactggcaaacgccgccagctaatagttccattgcgacgctggaagcagaaatggcaacgttgtgtatcgatggcgggaaaaaagccaaaatgcgcccgggtgatgtattaggtgcactgacaggagatatcgggcttgatggcgcagatattggcaaaatcgccgtgcatccggcgcatgtctatgtcgcggtccgtcaggctgttgctcataaagcatggaaacagttacagggcgggaagattaaaggaaaaacgtgccgggtgcggttattaaaataa

SEQ ID NO: 24504 - DNA, 1134 bp, Escherichia coli
atgaaaagcaaagtactggcacttttaattcctgccctgctcgccgcaggtgctgcacatgcagccgaagtttataataaagacggcaacaaattagatctgtatggcaaagttgatggcctgcattatttttctgataattcagcgaaagatggcgaccagagctatgcgcgtctgggttttaaaggcgaaacccaaattaacgatcaactcactggctacggtcaatgggaatacaatattcaggcaaacaacactgaatcttcaaaaaaccagtcatggacccgtctggcatttgccgggctgaaatttgcagattacggttctttcgattacggacgtaattatggcgtaatgtacgacatcgaaggctggaccgatatgctgcctgaatttggcggtgactcttataccaatgcagacaactttatgactggtcgagccaatggcgtcgcgacttatcgtaatactgatttcttcggtctggtaaatggtctgaacttcgcggtgcagtatcaaggtaacaacgaaggagccagtaatggtcaggaaggcaccaacaacggacgtgatgttcgccatgaaaacggtgacggctggggtctttccacaacatatgatttaggcatgggctttagcgctggtgcggcatacacctcttctgaccgcaccaatgaccaggttaaccatactgcggcgggtggtgataaagcagacgcgtggactgctgggctaaaatacgatgctaacaatatttacctggcaaccatgtattcagaaacgcgtaatatgaccccgtttggcgacagcgattatgctgtggcaaacaaaacccagaattttgaagtcactgcacagtaccagtttgattttggtctgcgtccggcagtctctttcctgatgtctaaaggccgtgacctgcacgctgcgggtggtgcagacaacccggcaggtgttgatgataaagatctggttaaatacgccgatattggcgcgacttactatttcaataaaaacatgtccacctacgttgactataaaatcaacctgttggatgaagatgacagcttctacgctgccaatggcatctctaccgatgatattgtcgctttaggtctggtttatcagttctaa

SEQ ID NO: 24505 - DNA, 1503 bp, Escherichia coli
gtgatgacagagccgcatgtagcagtattaagccaggtccaacagtttctcgatcgtcaacacggtctttatattgatggtcgtcctggccccgcacaaagtgaaaaacggttggcgatctttgatccggccaccgggcaagaaattgcgtctactgctgatgccaacgaagcggatgtagataacgcagtcatgtctgcctggcgggcctttgtctcgcgtcgctgggccgggcgattacccgcagagcgtgaacgtattctgctacgttttgctgatctggtggagcagcacagtgaggagctggcgcaactggaaaccctggagcaaggcaagtcaattgccatttcccgtgcttttgaagtgggctgtacgctgaactggatgcgttataccgccgggttaacgaccaaaatcgcgggtaaaacgctggacttgtcgattcccttaccccagggggcgcgttatcaggcctggacgcgtaaagagccggttggcgtagtggcgggaattgtgccatggaactttccgttgatgattggtatgtggaaggtgatgccagcactggcagcaggctgttcaatcgtgattaagccttcggaaaccacgccactgacgatgttgcgcgtggcggaactggccagcgaggctggtatccctgatggcgtttttaatgtcgtcaccgggtcaggtgctgtatgcggcgcggccctgacgtcacatcctcatgttgcgaaaatcagttttaccggttcaaccgcgacgggaaaaggtattgccagaactgctgctgatcacttaacgcgtgtaacgctggaactgggcggtaaaaacccggcaattgtattaaaagatgctgatccgcaatgggttattgaaggcttgatgaccggaagcttcctgaatcaagggcaagtatgcgccgccagttcgcgaatttatattgaagcgccgttgtttgacacgctggttagtggatttgagcaggcggtaaaatcgttgcaagtgggaccggggatgtcacctgttgcacagattaaccctttggtttctcgtgcgcactgcgacaaagtgtgttcattcctcgacgatgcgcaggcacagcaagcagagctgattcgcgggtcgaatggaccagccggagaggggtattatgttgcgccaacgctggtggtaaatcccgatgctaaattgcgcttaactcgtgaagaggtgtttggtccggtggtaaacctggtgcgagtagcggatggagaagaggcgttacaactggcaaacgacacggaatatggcttaactgccagtgtctggacgcaaaatctctcccaggctctggaatatagcgatcgcttacaggcagggacggtgtgggtaaacagccataccttaattgacgctaacttaccgtttggtgggatgaagcagtcaggaacgggccgtgattttggccccgactggctggacggttggtgtgaaactaagtcggtgtgtgtacggtattaa

SEQ ID NO: 24506 - DNA, 1428 bp, Escherichia coli
atgatgataaatgtgcaaactgtggcagtgattgggagcggcaccatgggggcaggcattgctgaagttgctgccagtcatggacaccaggttttactgtatgacatttctgctgaagcgctgacccgcgcaatcgacgggatacacgcgcggctaaattcacgcgtgacgcggggaaaactgactgctgaaacctgtgaacgcacattgaaacgcctgatcccggtgaccgatattcacgcgctggcagctgcggacctggtcattgaagcggcgtctgaacgtctggaagtcaaaaaagcgctctttgcacagctggcggaagtttgcccgccacaaacgctattgaccactaacacttcgtcaatctctataaccgcgattgctgcggagataaaaaatcctgaacgtgttgcggggctgcatttttttaacccggcaccggtgatgaagttggtggaggtggtcagtgggctggcaacggcggcggaagttgttgagcagttgtgtgaactaacgttgagttggggtaagcagcctgtgcgctgtcattcgactcctggatttatcgttaaccgtgttgcgcgtccttattattccgaggcctggcgggcactggaagagcaggttgctgcaccagaagtgattgacgctgcacttcgcgatggcgctggtttcccgatggggccgctggaattaaccgatctgattggtcaggacgtcaattttgctgtcacctgttcggtgtttaacgctttctggcaggagcgtcgttttttaccttcgctggtgcaacaggaactggtgattggtggacggttgggcaagaaaagtgggctgggcgtgtacgactggcgcgcggaacgtgaggcagttgttggcctggaagcggtaagcgacagttttagcccaatgaaagtagaaaagaaaagtgacggtgtcacggaaattgacgatgttttattgattgagacacaaggcgagacggcacaggcgctggcaatacgactggcacgcccggtggtagtgatcgataaaatggcgggcaaggtggtgaccattgctgctgcagcggtgaacccggactcagcgacccgcaaggccatttattacctgcaacagcagggcaaaacagtgctgcaaattgcagattacccaggaatgctgatttggcgaacggtagcaatgatcatcaatgaagcccttgatgcgcttcaaaaaggcgtggcctctgaacaggatatcgataccgccatgcgtcttggggtgaattatccatatggcccacttgcctggggagcgcaacttggctggcagcgaatattaaggctccttgaaaatctacagcatcactatggcgaagaacgctatcgcccatgttcattgctgcgccaacgggcgcttctggagagcggttatgagtcataa

SEQ ID NO: 24507 - DNA, 1206 bp, Escherichia coli
atgcgtgaagcctttatttgtgacggaattcgtacgccaattggtcgctacggcggggcattatcaagtgttcgggctgatgatctggctgctatccctttgcgggaactgctggtgcgaaacccgcgtctcgatgcggagtgtatcgatgatgtgatcctcggctgtgctaatcaggcgggagaagataaccgtaacgtagcccggatggcgactttactggcggggctgccgcagagtgtttccggcacaaccattaaccgcttgtgtggttccgggctggacgcactggggtttgccgcacgggcgattaaagcgggcgatggcgatttgctgatcgccggtggcgtggagtcaatgtcacgggcaccgtttgttatgggcaaggcagccagtgcattttctcgtcaggctgagatgttcgataccactattggctggcgatttgtgaacccgctcatggctcagcaatttggaactgacagcatgccggaaacggcagagaatgtagctgaactgttaaaaatctcacgagaagatcaagatagttttgcgctacgcagtcagcaacgtacggcaaaagcgcaatcctcaggcattctggctgaggagattgttccggttgtgttgaaaaacaagaaaggtgttgtaacagaaatacaacatgatgagcatctgcgcccggaaacgacgctggaacagttacgtgggttaaaagcaccatttcgtgccaatggggtgattaccgcaggcaatgcttccggggtgaatgacggagccgctgcgttgattattgccagtgaacagatggcagcagcgcaaggactgacaccgcgggcgcgtatcgtagccatggcaaccgccggggtggaaccgcgcctgatggggcttggtccggtgcctgcaactcgccgggtgctggaacgcgcagggctgagtattcacgatatggacgtgattgaactgaacgaagcgttcgcggcccaggcgttgggtgtactacgcgaattggggctgcctgatgatgccccacatgttaaccccaacggaggcgctatcgccttaggccatccgttgggaatgagtggtgcccgcctggcactggctgccagccatgagctgcatcggcgtaacggtcgttacgcattgtgcaccatgtgcatcggtgtcggtcagggcatcgccatgattctggagcgtgtttga

SEQ ID NO: 24508 - DNA, 861 bp, Escherichia coli
atgagcagcaatacatttactctcggtacaaaatccgttaaccgtcttggttatggcgcgatgcaactggcaggtcctggagtttttggccccccacgagatcgccacgtcgctataaccgtgctgcgtgaggcgctggcattgggcgtcaatcatattgataccagcgacttttatggtccgcacgtcaccaatcagattatccgcgaagcgctttatccttactctgacgacctgacaattgtcactaaaattggtgcgcggcgtggagaggacgcatcctggttgcccgcattttctccggcagagctgcaaaaagcggtgcacgataatctacgtaatctcgggctggacgtgctggatgtggttaacctgcgcgttatgatgggggatggtcatggcccagcggaaggatcgattgaggccagcctgaccgtgctggcagagatgcaacaacaaggcctggtaaaacatattggcctgagcaacgtcacaccgacgcaggttgcagaggcgcgcaagattgccgaaattgtctgtgtgcaaaacgaatacaacatcgcgcaccgtgctgatgatgcaatgattgatgctttggcccacgatggcattgcctacgtgccgttcttcccgctcgggggctttacaccgctgcaatcgtccacactttccgatgttgctgcgagcctgggtgcaacaccaatgcaggtggcgctggcgtggctgttacagcgttcaccgaatattttgctgatcccagggacgtcttcggttgcgcatttacgggagaatatggctgctgaaaaattgcatctttctgaggaagtgttgtctacgttggatggtatttcgcgagaataa

SEQ ID NO: 24509 - DNA, 897 bp, Escherichia coli
atgctggaaaaatctctggcaacacttttcgcgttgttaattttagcaacgctgataaaccgttttctgctatggcggttaccggagagaaaagggggtgaggttacattacgtattcgtacctggtggggcatcgtcatttgtttttcaatggtgatttcaggtccacgctggatgacgttgacgttttttgcgctgataagttttctggcattgaaagaatattgtacgcttatatctgtacattttccgcgttggttatattggggtattcctcttaactatttgcttatcggttttaattgctttgagctgtttctgttatttatacctttggctgggtttctgatattagccaccgggcaagttttagtgggtgacccctctggttttctgcataccgtgagcgccattttttggggctggataatgaccgttttcgccttgagtcatgccgcctggttattaatgttgccaaccacaaatatccagggcggggcgttactggtgttatttcttttggcattaaccgagtcaaacgatattgcacagtatttatggggaaaatcctgcggcagaagaaaagtggtccctaaagtcagcccgggaaaaacattggaaggtctgatgggcggcgtcatcaccatcatgattgcgtcactgattatcggaccgttactgacaccgctaaatacattacaggcattattagcgggtttgttaattggtattagtggtttttgcggcgatgtcgtgatgtcagccatcaaacgagatattggtgttaaagatagcggaaaactattgccaggacatggcggactccttgacaggattgactcattaattttcaccgctccggtatttttttattttatacgctactgctgttactga

SEQ ID NO: 24510 - DNA, 1440 bp, Escherichia coli
atgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaa

SEQ ID NO: 24511 - DNA, 594 bp, Escherichia coli
atgatcattcgtgacgaaaactattttactgataaatatgaattaacccgcacacactctgaagtactggaagcggtgaaagtggttaaaccgggtaaaacgctggatctgggctgtggcaatggtcgtaacagtctttacctggcagccaatggttatgatgttgacgcatgggataaaaatgccatgagtatcgccaacgtcgagcgcattaaatccattgaaaatctggataatttacacacccgagtcgttgatctgaataacctcacatttgatagacagtacgattttattctttcgactgtggtgctgatgttccttgaggctaaaaccatccccgggttgattgccaatatgcaacgttgcactaaacctggtggttacaacctgattgtggcggcgatggataccgctgattatccatgtaccgtcggcttcccgtttgccttcaaagagggagaattacgtcgatattacgaaggctgggagagggtgaaatacaatgaagacgtcggcgagctgcaccgcaccgacgccaacggtaatcgtattaaactgcgtttcgccacgatgctggcacgtaaaaaatga

SEQ ID NO: 24512 - DNA, 1425 bp, Escherichia coli
atgcaacataagttactgattaacggagaactggttagcggcgaaggggaaaaacagcctgtctataatccggcaacgggggacgttttactggaaattgccgaggcatccgcagagcaggtcgatgctgctgtgcgcgcggcagatgcagcatttgccgaatgggggcaaaccacgccgaaagtgcgtgcggaatgtctgctgaaactggctgatgttatcgaagaaaatggtcaggtttttgccgaactggagtcccgtaattgtggcaaaccgctgcatagtgcgttcaatgatgaaatcccggcgattgtcgatgtttttcgctttttcgcgggtgcggcgcgctgtctgaatggtctggcggcaggtgaatatcttgaaggtcatacttcgatgatccgtcgcgatccgttgggggtcgtggcttctatcgcaccgtggaattatccgctgatgatggccgcgtggaaacttgctccggcgctggcggcagggaactgcgtagtgcttaaaccatcagaaattaccccgctgaccgcgttgaagttggcagagctggcgaaagatatcttcccggcaggcgtgattaacatactgtttggcagaggcaaaacggtgggtgatccgctgaccggtcatcccaaagtgcggatggtgtcgctgacgggctctatcgccaccggcgagcacatcatcagccataccgcgtcgtccattaagcgtactcatatggaacttggtggcaaagcgccagtgattgtttttgatgatgcggatattgaagcagtggtcgaaggtgtacgtacatttggctattacaatgctggacaggattgtactgcggcttgtcggatctacgcgcaaaaaggcatttacgatacgctggtggaaaaactgggtgctgcggtggcaacgttaaaatctggtgcgccagatgacgagtctacggagcttggacctttaagctcgctggcgcatctcgaacgcgtcggcaaggcagtagaagaggcgaaagcgacagggcacatcaaagtgatcactggcggtgaaaagcgcaagggtaatggctattactatgcgccgacgctgctggctggcgcattacaggacgatgccatcgtgcaaaaagaggtatttggtccagtagtgagtgttacgcccttcgacaacgaagaacaggtggtgaactgggcgaatgacagccagtacggacttgcatcttcggtatggacgaaagatgtgggcagggcgcatcgcgtcagcgcacggctgcaatatggttgtacctgggtcaatacccatttcatgctggtaagtgaaatgccgcacggtgggcagaaactttctggttacggcaaggatatgtcactttatgggctggaggattacaccgtcgtccgccacgtcatggttaaacattaa

SEQ ID NO: 24513 - DNA, 1551 bp, Escherichia coli
ttgttcatggcaacttatatgactttttcattaaagcaatcagggagagcaatgagtaaacacgacaccgacacttcagatcaacacgccgcgaaacgccgctggcttaatgcccacgaagaggggtatcacaaagcgatgggcaatcgccaggtgcagatgatcgccattggcggcgcgattggcaccggcttgtttttaggtgcaggagcccgactgcaaatggcggggcccgcactggcactggtttatttaatttgtggcttgttttcgttttttattctgcgtgcattgggtgagctggtgctacaccgcccttccagtggcagttttgtttcttatgcccgtgagtttttgggtgagaaagccgcttatgttgctggctggatgtacttcatcaactgggcgatgacggggattgttgatattaccgccgtcgctctgtatatgcattactggggtgcgtttggcggcgtgccgcagtgggtctttgcgctcgctgcacttaccatcgttggcaccatgaatatgatcggtgtgaaatggtttgcggagatggagttctggtttgcgcttattaaagtgctcgccattgtgacctttttggtcgtgggtacagtgttcctcggtagtggtcagccgctggatggcaacaccactggctttcatttaatcaccgataatggcggcttcttcccccacggtttgctgcctgcgctggtgttgattcagggcgtagtgtttgcttttgcctccattgaaatggtgggtacagctgccggagaatgtaaagatccgcagaccatggtgcctaaagccattaacagtgtgatttggcgtattggcctgttttacgtcggctccgtggtgttgctggttatgttattgccgtggagcgcgtatcaggcggggcaaagtccgttcgtgacgtttttctctaaactgggtgtgccatatatcggcagcattatgaacattgtggtgctgaccgctgccctctccagcctgaattcaggtctgtactgcaccggacgtattctgcgctcaatggcgatgggcggttccgcaccgagttttatggcgaaaatgagtcgtcagcatgtgccgtatgccgggattctggcgacactagttgtgtatgtcgtcggcgtattcctcaactatctggtgccgtcgcgcgtatttgagattgtgttgaacttcgcgtcgctgggaatcatcgcttcatgggcgtttatcatcgtgtgccagatgcgcctgcgtaaagcgattaaagaaggcaaagcagcggatgtcagttttaaactgcctggcgcgcccttcacttcctggctgacattactgtttttactgagtgtccttgtgctgatggcgttcgattacccgaacgggacttatactatcgcggcgctgccgattatcggtattttgctggttataggctggtttggtgtgcgcaaacgcgttgctgaaattcacagcactgcgccagtcgtcgaggaagatgaagaaaaacaggaaattgtgtttaagcctgaaacggcgagttaa

SEQ ID NO: 24514 - DNA, 846 bp, Escherichia coli
atgacgcccattctgaatcactattttgcccgtattaactggtcgggagctgctgcggtcaatattgatacgcttcgtgcattgcacctgaaacacaattgcaccattccgtttgaaaacctcgacgttttgctgccgagggaaatacagcttgataatcaatcgccggaagagaaactggtgatagcccgtcgtggcggttactgttttgagcagaatggcgtgtttgagcgggtgttacgcgagctggggtttaacgttcgcagcttgttagggcgcgtagtgttatcaaatccgccagcattaccgccgcgcacccatcgtttgctgttggtggaactggaagaggaaaaatggattgctgatgtcggtttcggtgggcagacgctaaccgcgccgattcgtttagtttccgatctcgtgcagaccacgccacacggagagtatcggttgttgcaggagggtgatgattgggtgttgcagtttaatcatcatcagcattggcagtcgatgtaccgttttgatctctgcgagcagcaacaaagcgattatgtgatgggcaatttctggtcggcgcactggccgcagtcgcattttcgccatcatttgctgatgtgccgccatttgccggacggcggcaagctgacactgaccaattttcattttacccattatgaaaatgggcacgcggtggagcagcgaaatctaccggatgtggcgtcattatatgctgtgatgcaagaacagtttggtctgggcgtggatgatgcgaaacatggctttaccgtggatgagttagcgctggtgatggcggcgtttgatacgcacccggaggcgggaaaataa

SEQ ID NO: 24515 - DNA, 681 bp, Escherichia coli
atgattcagtatctgaacgtctttttttacgatatctacccgtacatttgtgcgacggtgtttttcctcggcagctggctgcgctacgactacgggcagtacacctggcgcgcctcctcaagtcaaatgctcgataaacgcgggatggtgatatggtcgaatctgttccatatcggcattttggggattttcttcgggcacttgttcggcatgttaacgccgcactggatgtacgcgtggtttttgccagtggcagcgaaacaactcatggcgatggtgctcggcggtatttgcggtgtgttgacgttgattggcggcgcaggactgctgtggcgcaggctgacaaatcagcgcgtgcgtgccacttccactacgccggatatcatcatcatgagcattttgctgatccagtgtctgttggggctaagtaccataccgttttcagcacagtatcctgatggtagcgaaatgatgaagctggtgggttgggcgcaaagcattgtcactttccgtggtggatcgtcagagatgctcaacggcgtagcgttcgtcttccgcctgcatctggtgttgggaatgaccatcttcctgctcttcccgttcacccgactggtgcatgtgtggagcgcgccgtttgagtactttactcgtcgatatcaaattgtgcgttcgcggcgataa

SEQ ID NO: 24516 - DNA, 696 bp, Escherichia coli
atgcagatcctcaaagtgatcggcctgttgatggagtatccggacgagctgttgtgggaatgcaaggaggacgcgctggcgttgatccgccgcgacgcgccgatgcttacggatttcacccacaacctgcttaacgcgccgctgctggataaacaggccgaatggtgcgaagtgtttgaccgcgggcgcaccacgtcgctgctgctgttcgaacatgttcatgccgagtcccgcgatcgcggccaggcaatggtggacctgctggcggagtatgaaaaggtcggcctgcagctggattgtcgggaactgcccgattatctaccgctgtatctggagtatttaagcgtactgcctgacgatcaggcgaaagaaggattgctcaatgttgcgccgatcctcgccctgcttggcggtcgcttaaaacaacgcgaggcaccgtggtacgcgttgtttgatgctctgctgcaactggcgggaagctccctttcaagtgacagtgtcacaaaacaagtaaacagcgaagagcgcgatgacacccgccaggcgcttgatgcagtgtgggaagaggaacaggtgaagtttattgaagataacgccacggcgtgtgacagctcgccgcttaatcaatatcagcgacgctttagccaggatgtcgcgccgcaatatgtcgacatcagtgcgggaggtgggaaatga

SEQ ID NO: 24517 - DNA, 1545 bp, Escherichia coli
atgaaaatccgttcacaagtcggcatggtgcttaacctcgacaaatgtatcggctgccatacctgttcggtgacctgtaaaaacgtctggaccgggcgcgaaggcatggagtacgcatggtttaacaacgtcgaaaccaaaccgggcattggttatccgaaaaactgggaagatcaggaagagtggcaaggcggctgggtgcgtgatgtgaatggcaagatacgcccgcgtctgggcaacaagatgggcgtaataaccaaaatcttcgccaacccggtggtgccgcagattgatgattactacgaacctttcaccttcgactacgaacatttgcatagcgcaccggaaggcaaacatattcctactgctcgcccgcgttcactgattgacggcaaacggatggacaaagtgatctgggggccaaactgggaagaactgctgggcggtgagttcgaaaaacgtgcccgcgaccgcaacttcgaggccatgcaaaaggagatgtacgggcagtttgaaaacaccttcatgatgtacctgccgcgcctgtgcgaacactgcctcaatcccagctgcgtggcgacctgcccaagcggcgctatctacaaacgcgaagaagacggcattgtgctgattgatcaggataaatgccgtggctggcgtttgtgcataagcggttgtccgtacaaaaaaatctacttcaactggaaaagcggcaagtcagaaaaatgcatcttctgttacccacgaattgagtccggtcaaccgaccgtgtgctcagaaacctgcgtgggtcgcatccggtatctgggcgtgctgctttacgacgccgaccgcatcgaggaagcggcgagcaccgagcgcgaagttgacctctatgaacgccagtgcgaagtgttcctcgatccacacgatccctcagtgatcgaggaagccctgaaacaaggtattccacaaaatgtgattgacgctgcccagcgttcgccagtctacaaaatggcgatggactggaaactggcactaccgttgcaccctgaataccgcaccctgccgatggtctggtacgttcctccgctgtcaccgattcagtcctacgcagatgcgggcggtttgccgaaaagcgaaggcgtgctgcccgccatcgaaagcctgcgtattccggtgcaatatctcgccaatatgttgagtgccggcgataccggtccggtactgcgggcgctgaaacggatgatggcgatgcgccactatatgcgttcacaaaccgtggaaggcgttactgatactcgtgccatcgacgaagtaggcctgagcgtcgcccaggtcgaagagatgtatcgctatctcgccattgccaactatgaagatcgttttgttatcccgaccagccatcgggaaatggcgggcgatgccttcgcagaacgcaacggctgcggttttacctttggcgacggttgccacggttcggacagtaaattcaacctgttcaacagtagccgtatcgatgccatcaacatcaccgaagtgcgcgacaaagcggagggcgaataa

SEQ ID NO: 24518 - DNA, 3741 bp, Escherichia coli
atgagtaaacttttggatcgctttcgctacttcaaacaaaagggcgaaacctttgccgatggtcacggacaggtgatgcatagcaaccgcgactgggaggacagctatcgccagcgttggcagttcgacaaaatcgtgcgttccacccacggtgttaactgtacaggctcctgtagctggaaaatctacgttaaaaatggtctggtgacctgggaaatccaacagaccgactacccgcgcactcgccctgacctgcccaatcatgaacctcgcggctgcccgcgtggcgcaagttactcctggtatctttacagcgctaaccgcctgaaatacccgctcattcgtaaacgactgattgaactgtggcgcgaagccctcaagcaacacagcgatccggtactggcgtgggcatcgattatgaacgatccgcaaaagtgcctgagctacaaacaagtgcgtgggcgcggcgggtttatccgctccaactggcaggaactaaaccagctgattgccgccgctaacgtctggaccatcaaaacctacggcccggatcgcgttgccggtttctcgccgatcccggcgatgtcgatggtttcttacgccgccggaacgcgttatctgtcgctgcttggcggcacctgtttaagtttctacgactggtattgcgacctgccgcccgcctcgccgatgacctggggcgagcaaaccgacgtaccggaatctgccgactggtataactccagctacatcatcgcctgggggtctaacgtaccgcagacacgtacgccggacgcccacttctttaccgaagtacgctacaaaggcactaaaaccatcgccattacccctgactactctgaagtggccaaattgtgcgaccagtggctggcaccgaaacaaggcactgatagcgccctggcgatggcaatgggccatgtgattttaaaagagtttcatctcgataatcccagcgactactttatcaactactgccgccgctacagcgacatgccgatgctggtaatgctggagcctcgcgacgatggtagctacgttcccgggcgcatgatccgcgcatctgacctggtggatggactgggcgaaagcaacaatccgcagtggaaaaccgtagcagttaataccgcaggtgaattggtagtgccgaacggttcgattggtttccgctggggagaaaaaggcaaatggaatctggaatccattgccgccggtacggaaaccgaattgtcgttaaccctgctcggtcaacatgacgctgttgcaggcgtggccttcccctactttggcggcattgaaaatccgcattttcgcagcgtaaaacacaatccggtgctggtgcgccaattgcccgttaaaaacctgacgttagtcgatggcaacacctgtccggtggtcagcgtttatgatttggtactggcgaattacggcctcgatcgcgggctggaagatgaaaacagtgcgaaagattacgctgaaatcaaaccgtacaccccagcctggggtgagcaaattaccggcgtgccgcgccagtatattgaaaccatcgcccgtgaatttgccgataccgcccataaaacgcatgggcgctcgatgattatcctcggcgcaggtgttaaccactggtatcacatggacatgaactaccgcgggatgatcaatatgctgatcttctgcggttgtgtcgggcaaagcggtggcggctgggcacactatgtcggccaggaaaaactgcgcccacaaaccggctggttgccactggcctttgcgctcgactggaaccgaccaccgcgccaaatgaacagcacctcgtttttctacaatcattccagccaatggcgctatgaaaaagtctctgctcaggagttactttcaccgctcgccgatgccagtaagtacagcggtcatctgattgatttcaacgttcgcgccgaacgtatgggctggctaccttctgcgccgcagctggggcgtaacccgctcgggattaaagctgaagccgacaaggccggattatcccccacagaatttaccgcccaggcgctgaaatcgggcgatttacgtatggcctgcgaacaaccagatagcagcagcaatcatccgcgtaatttgtttgtctggcgctctaacctgcttggctcctccggcaaaggccacgagtatatgcagaagtatctgctggggaccgaaagcgggattcagggcgaggaactcggtgccagcgacgggatcaaaccggaagaagtcgagtggcaaactgcagcgattgaaggcaagctcgacctgctggtgacgctcgacttccgcatgtccagtacctgcctgttctccgatatcgttctgcccaccgccacctggtacgaaaaagacgatatgaacacctcggatatgcatccgtttattcatccgctttctgcggcggtcgatccggcgtgggaatcacgcagcgactgggaaatctacaaaggtatcgccaaagcattttcgcaagtgtgcgtgggtcatcttggcaaagaaaccgacgtggtattacaacccctactgcatgactctccggcagagctctcacagccgtgtgaagtgctcgactggcgcaaaggcgaatgcgatctgattccaggcaaaaccgcgccgaatattgtggcggtggagcgcgactaccctgctacgtatgaacgctttacctcgctcgggccattgatggacaaacttggcaatggcggtaaagggatttcgtggaatacccaggatgaaatcgatttcctcggcaaactcaattacaccaagcgtgatggcccggcacaggggcgtccgctgattgacaccgccattgacgcttcagaagtgattctggcactggcaccggaaaccaacggtcatgttgcagtcaaagcgtggcaggcgctgggcgagatcaccgggcgcgaacatacccatctggcgctgcacaaagaggacgagaagattcgctttcgcgatattcaggcgcagccgcgtaaaattatctccagccccacctggtccggtctggaaagcgatcacgtctcctataacgcgggatacaccaacgttcatgagttaattccgtggcgcacgctgtcgggacgccagcagctctatcaggatcatccgtggatgcgtgcttttggtgaaagcctggtggcttatcgcccgcctatcgacacccgtagcgtcagtgagatgcgccagataccgccaaacggcttcccggaaaaagcacttaacttcctgacgccgcaccagaaatggggcattcactcaacctacagtgaaaacctgctaatgctgacgctctctcgcggtggaccgattgtctggatcagcgaaacagatgcccgagaactgaccattgtcgataacgactgggtggaagtattcaacgccaacggcgcgctgactgcccgcgcggtggtcagccaacgtgtaccgccgggcatgaccatgatgtatcacgcccaggaacgcattatgaatattcctggttcggaagtaactggcatgcgcggcggcattcataactcggttacccgcgtttgcccgaaaccaacgcatatgattggcggttacgcgcagctggcctggggctttaactactacggcaccgtcggatcgaaccgcgatgagttcatcatgatccgcaagatgaagaacgttaactggctggatgatgaaggtcgcgatcaggtacaggaggcgaaaaaatga

SEQ ID NO: 24519 - DNA, 3048 bp, Escherichia coli
atggacgtcagtcgcagacaattttttaaaatctgcgcgggcggtatggctggaacaacagtagcggcattgggctttgccccgaagcaagcactggctcaggcgcgaaactacaaattattacgcgctaaagagatccgtaacacctgcacatactgttccgtaggttgcgggctattgatgtatagcctgggtgatggcgcaaaaaacgccagagaagcgatttatcacattgaaggtgacccggatcatccggtaagccgtggtgcgctgtgcccgaaaggggccggtttgctggattacgtcaacagtgaaaaccgtctgcgctacccggaatatcgtgcgccaggttctgacaaatggcagcgcattagctgggaagaagcattctcccgtattgcgaagctgatgaaagctgaccgtgacgctaactttattgaaaagaacgagcagggcgtaacggtaaaccgttggctttctaccggtatgctgtgtgcctccggtgccagcaacgaaaccgggatgctgacccagaaatttgcccgctccctcgggatgctggcggtagacaaccaggcgcgcgtctgacacggaccaacggtagcaagtcttgctccaacatttggtcgcggtgcgatgaccaaccactgggtggatatcaaaaacgctaacgtcgtgatggtgatgggcggtaacgctgctgaagcgcatcccgtcggtttccgctgggcgatggaagcgaaaaacaacaacgacgcaaccttgatcgttgtcgatccccgttttacgcgtaccgcttctgtggcggatatttacgcgcctattcgttccggtacggacattacgttcctgtctggcgttttgcgctacctgatcgaaaacaacaaaatcaacgccgaatacgttaagcattacaccaacgccagcctgctggtgcgtgatgattttgctttcgaagacggtctgttcagcggctacgacgctgaaaaacgtcaatacgataaatcgtcctggaactatcagctcgatgaaaacggctatgcgaaacgcgatgaaacactgactcatccgcgctgtgtgtggaacctgctgaaagagcacgtttcccgctacacgccggacgtcgttgaaaacatctgcggtacgccaaaagccgacttcctgaaagtgtgtgaagtgctggcctccaccagcgcaccggatcgcacaaccaccttcctgtacgcgctgggctggacgcagcacactgtgggtgcgcagaacatccgtactatggcgatgatccagttgctgctcggtaacatgggtatggccggtggcggcgtgaacgcattgcgtggtcactccaacattcagggcttgactgacttaggcctgctctctaccagcctgccaggttatctgacgctgccgtcagaaaaacaggttgatttgcagtcgtatctggaagcgaacacgccgaaagcgacgctggctgatcaggtgaactactggagcaactatccgaagttcttcgttagcctgatgaaatctttctatggcgatgccgcgcagaaagagaacaactggggctatgactggctgccgaagtgggaccagacctacgacgtcatcaagtatttcaacatgatggatgaaggcaaagtcaccggttatttctgccagggctttaacccggttgcgtccttcccggacaaaaacaaagtggtgagctgcctgagcaagctgaagtacatggtggttatcgatccgctggtgactgaaacctctaccttctggcagaaccacggtgagtcgaacgatgtcgatccggcgtctattcagactgaagtattccgtctgccttcgacctgctttgctgaagaagatggttctatcgctaactccggtcgctggttgcagtggcactggaaaggtcaggacgcgccgggcgaagcgcgtaacgacggtgaaattctggcgggtatctaccatcatctgcgcgagctgtaccagtccgaaggtggtaaaggcgtagaaccgctgatgaagatgagctggaactacaagcagccgcacgaaccgcaatctgacgaagtggctaaagagaacaacggctacgcgctggaagatctctatgacgctaatggcgtgcttattgcgaagaaaggtcagttgctgagtagctttgcgcatctgcgtgatgacggtacaaccgcatcttcttgctggatctacaccggtagctggacagagcagggcaaccagatggctaaccgcgataactccgacccgtccggtctggggaatacgctgggatgggcctgggcgtggccgctcaaccgtcgcgtgctgtacaaccgtgcttcggcggatatcaacggtaaaccgtgggatccgaaacggatgctgatccagtggaacggcagcaagtggacgggtaacgatattcctgacttcggcaatgccgcaccgggtacgccaaccgggccgtttatcatgcagccggaagggatgggacgcctgtttgccatcaacaaaatggcggaaggtccgttcccggaacactacgagccgattgaaacgccgctgggcactaacccgctgcatccgaacgtggtgtctaacccggttgttcgtctgtatgaacaagacgcgctgcggatgggtaaaaaagagcagttcccgtatgtgggtacgacctatcgtctgaccgagcacttccacacctggaccaagcacgcattgctcaacgcaattgctcagccggaacagtttgtggaaatcagcgaaacgctggcggcggcgaaaggcattaataatggcgatcgtgtcactgtctccagcaagcgtggctttatccgcgcggtggctgtggtaacgcgtcgtctgaaaccgctgaatgtaaatggtcagcaggttgaaacggtgggtattccaatccactggggctttgagggtgtcgcgcgtaaaggttatatcgctaacactctgacgccgaatgtcggtgatgcaaactcgcaaacgccggaatataaagcgttcttagtcaacatcgagaaggcgtaa

SEQ ID NO: 24520 - DNA, 1041 bp, Escherichia coli
atgcagaacatcatccgaaaaggaggaactatgaaggctgcagttgttacgaaggatcatcatgttgacgttacgtataaaacactgcgctcactgaaacatggcgaagccctgctgaaaatggagtgttgtggtgtatgtcataccgatcttcatgttaagaatggcgattttggtgacaaaaccggcgtaattctgggccatgaaggcatcggtgtggtggcagaagtgggtccaggtgtcacctcattaaaaccaggcgatcgtgccagcgtggcgtggttctacgaaggatgcggtcattgcgaatactgtaacagtggtaacgaaacgctctgccgttcagttaaaaatgccggatacagcgttgatggcgggatggcggaagagtgcatcgtggtcgccgattacgcggtaaaagtgccagatggtctggactcggcggcggccagcagcattacctgtgcgggagtcaccacctacaaagccgttaagctgtcaaaaattcgtccagggcagtggattgctatctacggtcttggcggtctgggtaacctcgccctgcaatacgcgaagaatgtctttaacgccaaagtgatcgccattgatgtcaatgatgagcagttaaaactggcaaccgaaatgggcgcagatttagcgattaactcacacaccgaagacgccgccaaaattgtgcaggagaaaactggtggcgctcacgctgcggtggtaacagcggtagctaaagctgcgtttaactcggcagttgatgctgtccgtgcaggcggtcgtgttgtggctgtcggtctaccgccggagtctatgagcctggatatcccacgtcttgtgctggatggtattgaagtggtcggttcgctggtcggcacgcgccaggatttaactgaagccttccagtttgccgccgaaggtaaagtggtgccgaaagtcgccctgcgtccgttagcggacatcaacaccatctttactgagatggaagaaggcaaaatccgtggccgcatggtgattgatttccgtcactaa

SEQ ID NO: 24521 - DNA, 1725 bp, Escherichia coli
atggatattcaaaaaagagtgagtgacatggaaccaaaaacaaaaaaacagcgttcgctttatatcccttacgctggccctgtactgctggaatttccgttgttgaataaaggcagtgccttcagcatggaagaacgccgtaacttcaacctgctggggttactgccggaagtggtcgaaaccatcgaagaacaagcggaacgagcatggatccagtatcagggattcaaaaccgaaatcgacaaacacatctacctgcgtaacatccaggacactaacgaaaccctcttctaccgtctggtaaacaatcatcttgatgagatgatgcctgttatttataccccaaccgtcggcgcagcctgtgagcgtttttctgagatctaccgccgttcacgcggcgtgtttatctcttaccagaaccggcacaatatggacgatattctgcaaaacgtgccgaaccataatattaaagtgattgtggtgactgacggtgaacgcattctggggcttggtgaccagggcatcggcgggatgggcattccgatcggtaaactgtcgctctataccgcctgtggcggcatcagcccggcgtatacccttccggtggtgctggatgtcggaacgaacaaccaacagctgcttaacgatccgctgtatatgggctggcgtaatccgcgtatcactgacgacgaatactatgaattcgttgatgaatttatccaggctgtgaaacaacgctggccagacgtgctgttgcagtttgaagactttgctcaaaaaaatgcgatgccgttacttaaccgctatcgcaatgaaatttgttcttttaacgatgacattcagggcactgcggcggtaacagtcggcacactgatcgcagcaagccgcgcggcaggtggtcagttaagcgagaaaaaaatcgtcttccttggcgcaggttcagcgggatgcggcattgccgaaatgatcatctcccagacccagcgcgaaggattaagcgaggaagcggcgcggcagaaagtctttatggtcgatcgctttggcttgctgactgacaagatgccgaacctgctgcctttccagaccaaactggtgcagaagcgcgaaaacctcagtgactgggataccgacagcgatgtgctgtcactgctggatgtggtgcgcaatgtaaaaccagatattctgattggcgtctcaggacagaccgggctgtttacggaagagatcatccgtgagatgcataaacactgtccgcgtccgatcgtgatgccgctgtctaacccgacgtcacgcgtggaagccacaccgcaggacattatcgcctggaccgaaggtaacgcgctggtcgccacgggcagcccgtttaatccagtggtatggaaagataaaatctaccctatcgcccagtgtaacaacgcctttattttcccgggcatcggcctgggtgttattgcttccggcgcgtcacgtatcaccgatgagatgctgatgtcggcaagtgaaacgctggcgcagtattcaccattggtgctgaacggcgaaggtatggtactgccggaactgaaagatattcagaaagtctcccgcgcaattgcgtttgcggttggcaaaatggcgcagcagcaaggcgtggcggtgaaaacctctgccgaagccctgcaacaggccattgacgataatttctggcaagccgaataccgcgactaccgccgtacctccatctaa

SEQ ID NO: 24522 - DNA, 1593 bp, Escherichia coli
atggctcgactctttaccctttcagaatcaaagtactacctgatggcgctggatgcaggcaccggaagtattcgggctgtgatattcgacctggaaggcaatcaaatagcagtgggacaggcggagtggcggcatctggcagtaccggacgttcctggttctatggaatttgatctcaacaaaaactggcaactggcgtgtgagtgtatgcgccaggcgctgcacaacgccggcatagccccggagtatatcgctgccgtttcggcatgttcgatgcgtgaaggcattgttttatataataatgaaggagccccgatctgggcctgcgccaatgtggatgccagagcggcacgcgaagttagcgaacttaaagaactgcacaacaatacctttgaaaacgaagtttatcgcgcgaccggacaaacactggctttaagtgccatccccagattactttggctggcgcaccatcgttccgatatttaccgtcaggcatcaaccatcaccatgatcagcgactggctggcctatatgctcagcggcgaactggcggtggatccctctaacgctggcaccacgggacttcttgatctaaccacccgtgactggaaacctgcattgctggatatggctggcctacgtgccgatattctttctcctgtcaaagaaaccggcacattgctgggcgtggtaagttcacaagcggcggaactctgcggtctgaaggcgggcactccggtggtcgttggaggaggcgacgtgcagcttggttgccttgggttaggcgttgtgcgtccggcacaaaccgcggttcttggcggcacattctggcagcaagttgtaaatttagccgcgccggtgacagacccagaaatgaacgtgcgcgttaatcctcatgttattcctggcatggtacaagctgaatctataagcttttttaccggactcaccatgcgctggttccgcgatgctttctgtgccgaagaaaaactgattgccgaacgtttaggcatcgacacctatacgctgctggaagagatggccagtcgggtgccgcctgggtcgtggggcgtaatgccgatcttctccgacagaatgcgctttaaaacctggtatcacgctgcgccttcctttattaacttgtccattgacccggataaatgtaacaaagcgacattgttccgtgcgctggaagaaaatgcggcgattgtatcagcgtgtaacttgcagcaaattgctgatttctcgaatattcatccttcatcgttagtctttgcaggcggaggttcaaaagggaaattatggagtcaaattctcgctgatgtctcgggattacccgtcaatattccggtggtcaaagaagccactgcattaggatgtgccattgcagctggcgtcggtgccggaattttttcatcaatggcagaaaccggagaacgcctggttcgctgggaacggacgcacacaccagacccggaaaagcatgaactttatcaggattcacgcgataagtggcaggcagtttatcaggatcagctggggctggttgatcatggactgacgacgtcgttatggaaagcgcctgggttatag

SEQ ID NO: 24523 - DNA, 1536 bp, Escherichia coli
atgcaaacgagtgatacccgcgcgttaccgctactttgcgcccgctcggtttataaacagtattcaggggtcaatgtcctgaaaggcatcgattttacgttgcatcagggggaggtccacgccctgctcggcggcaatggtgccggtaaatcgacgttaatgaagattattgccggtattacccctgctgatagcggtacgctggagattgagggcaacaactacgtcagattaacgccagttcatgctcatcagctgggtatttatctcgttccccaggaaccgctgcttttcccaagcctgtcgataaaagaaaacatcctgtttgggctggcaaaaaaacagctctccatgcagaaaatgaagaacttgctggcggcgctgggctgccagtttgatctgcatagtctggcaggatcgctggatgtcgccgatcgccaaatggtggaaatcctccgcgggctgatgcgcgactcgcggattctgatcctcgatgaacctaccgcctcgcttacccctgcggaaaccgaacgcttgtttagtcgcttgcaagagctgcttgctactggcgtgggtattgtttttatctcgcataagctgccggaaattcgccagattgccgatcgaattagcgtgatgcgcgacggaaccatcgccttaagcggcaaaaccagcgaactgtctaccgacgacattattcaggccatcaccccagcggtacgggaaaaatcgctctctgccagccaaaaattatggctggagttacctggtaaccgcccacaacatgccgccggaacgccggtgctgacactggaaaatctgaccggcgaaggtttcaggaatgtcagcctgacgctcaatgccggagaaattctgggcctggctgggctggtgggggccggacgcacagaactggccgagacgctctatggtctgcgtactttgcgtggcggacgcattatgctgaatggtaaagagatcaataaattatccactggagaacgtttactgcgcggtctggtttatctgccggaagatcgccagtcatccggactgaatctcgatgcttcgctggcctggaacgtctgcgcccttactcataaccttcgtggattctgggcgaaaaccgcgaaagataatgccaccctggaacgttatcgtcgggcgctgaatattaaattcaaccaaccggaacaagctgcacggacattatccggtggcaaccagcaaaaaatcctcattgccaaatgcttggaagcttcgccgcaagtattgattgtcgatgagccgacgcgcggcgtggatgtctcggcccgtaatgatatctaccagctgttgcgcagcatcgccgcacaaaatgtggctgtgctgcttatctcctccgacctggaagagatcgaactgatggcagatcgtgtgtatgtgatgcatcagggcgaaattacccactctgcactgaccgagcgcgatattaatgtcgagactattatgcgcgttgccttcggcgatagtcagcgtcaggaggcgtcatgctga

SEQ ID NO: 24524 - DNA, 1413 bp, Escherichia coli
atgactcataaaggagataccccgatgaccattactccggcaactcatgcaatttcgataaatcctgccacgggtgaacaactttctgtgctgccgtgggctggcgctgacgatatcgaaaacgcacttcagctggcggcagcaggctttcgcgactggcgcgagacaaatatagattatcgtgctgaaaaactgcgtgatatcggtaaggctctgcgcgctcgtagcgaagaaatggcgcaaatgatcacccgcgaaatgggcaaaccaatcaaccaggcgcgcgctgaagtggcgaaatcggcgaatttgtgtgactggtatgcagaacatggtccggcaatgctgaaggcggaacctacgctggtggaaaatcagcaggcggttattgagtatcgaccgttggggacgattctggcgattatgccgtggaattttccgttatggcaggtgatgcgtggcgctgttcccatcattcttgcaggtaacggctacttacttaaacatgcgccgaatgtgatgggctgtgcacagctcattgcccaggtgtttaaagatgcgggtatcccacaaggcgtatatggctggctgaatgccgacaacgacggtgtcagtcagatgattaaagactcgcgcattgctgctgtcacggtgaccggaagtgttcgtgcgggagcggctattggcgcacaggctggagcggcactgaaaaaatgcgtactggaactgggcggttcggatccgtttattgtgcttaacgatgccgatctggaactggcggtgaaagcggcggtagccggacgttatcagaataccggacaggtatgtgcagcggcaaaacgctttattatcgaagagggaattgcttcggcatttaccgaacgttttgtggcagctgcggcagccttgaaaatgggcgatccccgtgacgaagagaacgctctcggaccaatggctcgttttgatttacgtgatgagctgcatcatcaggtggagaaaaccctggcgcagggtgcgcgtttgttactgggcggggaaaagatggctggggcaggtaactactatccgccaacggttctggcgaatgttaccccagaaatgaccgcgtttcgggaagaaatgtttggccccgttgcggcaatcaccattgcgaaagatgcagaacatgcactggaactggctaatgatagtgagttcggcctttcagcgaccatttttaccactgacgaaacacaggccagacagatggcggcacgtctggaatgcggtggggtgtttatcaatggttattgtgccagcgacgcgcgagtggcctttggtggcgtgaaaaagagtggctttggtcgtgagctttcccatttcggcttacacgaattctgtaatatccagacggtgtggaaagaccggatctga

SEQ ID NO: 24525 - DNA, 2046 bp, Escherichia coli
atgacaacaatgaatcctttccttgtgcaaagcacactgccgtatctggctccccattttgatcaaattgccaatcatcactatcgcccggcattcgatgagggaatgcagcaaaagcgggcagaaattgctgccatcgcgcttaacccgcaaatgcctgatttcaacaatactattctggcactggaacaaagcggagaattacttacccgcgttaccagcgtcttttttgcgatgactgcggcgcataccaatgatgaattacagcgtcttgacgagcagttttccgctgaactggcggaactggctaatgatatctatctgaacggtgaattattcgcgcgggtagatgctgtctggcagcgccgtgaatccctggggcttgatagtgaatccatccgcctggtggaggtgattcatcaacgttttgtccttgccggagccaaacttgcgcaagctgataaagcaaaattaaaagtactgaatacagaagctgcgaccctgaccagccagtttaaccagcgattactggcagcaaataaatccggcggtctggttgtgaacgatatcgcgcagctggcaggaatgagtgagcaagagattgcgctggcggcagaggcggctcgcgagaaaggtctggataacaaatggctgattccgctgctgaataccacccaacaaccggcgcttgccgaaatgcgcgatcgtgcgacgcgtgaaaaactgtttattgcgggctggacgcgagcggaaaaaaatgatgccaatgatacccgcgctatcattcaacgtctggtggagatccgtgcacaacaggcaacactacttggttttcctcattatgccgcatggaaaatcgccgatcagatggcaaaaacacctgaagcagcacttaactttatgcgggaaattgttccagcggcgcgtcaacgtgcgagcgatgaattagcctccatacaggcggttatcgataagcagcagggcgggtttagcgcgcagccgtgggactgggcattttatgcggaacaggtacggcgggagaaatttgatcttgatgaggcgcagctcaagccatattttgaattaaacacggtgttaaatgaaggtgtattctggaccgcgaatcagctcttcggtattaagtttgtcgaacgttttgatattcctgtctaccatcctgacgttcgtgtgtgggaaatttttgatcataatggcgtggggctggcgttattttacggtgatttcttcgcccgtgattcaaaaagcggcggtgcatggatgggcaattttgttgagcaatcaacgcttaataaaacacatccggtaatttataacgtctgcaattatcagaaacccgctgccggtgagcctgcgttgttactctgggatgatgtcataaccttattccatgaatttggtcatacgctgcacggcctttttgcccgccagcgttatgccacgctttccggcaccaacacgccgcgtgattttgtcgaatttccgtcgcaaatcaacgaacactgggcaacgcatccgcaggtattcgctcgctacgcccggcattatcagagcggggcagcaatgcctgacgaactgcaacagaaaatgcgtaatgccagcctgttcaacaaagggtatgagatgagcgaactgcttagcgccgcacttctcgatatgcgctggcattgcctggaagaaaacgaagcaatgcaggatgtcgatgattttgaattgcgggcgctggtggcggaaaatatggatcttcctgctataccgccacgctatcgcagcagttatttcgcccatatttttggtggcggatatgctgcaggttattacgcttatctgtggacgcaaatgttggccgatgatggttatcagtggtttgttgagcagggcggattaacgcgtgaaaatgggctgcgttttcgcgaggcgatcctttccagaggtaacagcgaagatctggaacgcctgtatcgacaatggcgcggtaaggcacctaagattatgccgatgctgcaacatcgtggcttgaacatataa

SEQ ID NO: 24526 - DNA, 747 bp, Escherichia coli
atgatcgttttagtaactggagcaacggcaggttttggtgaatgcattactcgtcgttttattcaacaagggcataaagttatcgccactggccgtcgccaggaacggttgcaggagttaaaagacgaactgggagataatctgtatatcgcccaactggacgttcgcaaccgcgccgctattgaagagatgctggcatcgcttcctgccgagtggtgcaatattgatatcctggtaaataatgccggcctggcgttgggcatggagcctgcgcataaagccagcgttgaagactgggaaacgatgattgataccaacaacaaaggcctggtatatatgacgcgcgccgtcttaccgggtatggttgaacgtaatcatggtcatattattaacattggctcaacggcaggtagctggccgtatgccggtggtaacgtttacggtgcgacgaaagcgtttgttcgtcagtttagcctgaatctgcgtacggatctgcatggtacggcggtgcgcgtcaccgacatcgaaccgggtctggtgggtggtaccgagttttccaatgtccgctttaaaggcgatgacggtaaagcagaaaaaacctatcaaaataccgttgcattgacgccagaagatgtcagcgaagccgtctggtgggtgtcaacgctgcctgctcacgtcaatatcaataccctggaaatgatgccggttacccaaagctatgccggactgaatgtccaccgtcagtaa

SEQ ID NO: 24527 - DNA, 2427 bp, Escherichia coli
atgtccaaaaatgaacgaatggtgggcatcagccgcagaacactcgttaaatctaccgcgataggttctctggcgctggctgcaggcggtttttctttgccgtttaccctgcgcaatgcagcagcagcggtacaacaggcccgcgaaaaagtggtctggggtgcctgttccgtcaactgtggtagccgctgtgcacttcgtctacatgttaaagataatgaagtgacctgggtggaaactgacaataccggcagcgatgagtacggcaaccatcaggtacgcgcctgtttgcgcggtcgctccatccgccggcgtattaatcatcccgatcgcttgaattacccaatgaaacgcgtgggcaaacgcggcgaaggcaaattcgaacggattagctgggatgaagccctggatactatcgccagtagcctgaagaaaaccgtcgaacaatatggcaatgaggctgtatatattcagtactcttcggggatcgttggcggcaatatgacccgctcttcgccatcagcctcggcggtcaaacgcctgatgaactgctacggcggttcactcaaccagtatggctcctacagcactgcgcaaatttcctgtgccatgccctacacctacggcagtaatgatggcaacagcaccacggatattgaaaacagcaagctggtcgtgatgtttggtaacaacccggcagaaacccgcatgagcggtggtggcatcacttatcttcttgaaaaagcgcgcgagaaatcgaacgccaaaatgattgttatcgatccgcgatataccgatacggctgccggtcgtgaagacgaatggctccctattcgcccgggcaccgatgccgcgctggttgcgggtattgcctgggtattgattaacgaaaatctcgttgatcaaccttttctcgataaatactgcgtcggctatgacgaaaaaaccttacccgcagatgcacccaaaaatggtcactataaagcctatattcttggtgaaggtgacgataaaacagcgaaaacgccgcagtgggcttcgcaaattaccggtatcccggaggaccgtatcatcaaactggcgcgtgaaattggcacagcaaaacccgcttatatctgccagggctgggggccacaacgccaggcaaacggcgaactgactgcacgcgctattgctatgttacctattttgacgggcaatgtcggcatcagcggcggaaatagtggcgcgcgtgaatcgacctataccattaccatagaacgcctgccggtgctggataatccggtcaaaacgtcaatctcctgcttcagctggacagatgctatcgatcatggtccgcaaatgacggcaatccgcgacggcgtccgcggcaaagataaactggatgtgcccattaagttcatctggaactacgcgggaaataccctcgttaatcagcattctgacatcaacaaaacgcatgaaattctgcaggacgaatcgaaatgcgaaatgattgtggtcatcgaaaactttatgacctcatcggcaaaatatgccgacattctgctgccagacctgatgaccgttgagcaggaagatattattcctaacgactacgccggtaacatgggatatctcattttcctccagcctgtcaccagcgaaaaattcgaacgcaaaccgatttactggatcctgagtgaagtcgcgaaacgtcttggacctgacgtctatcaaaagttcacagaaggtcgcacgcaggaacaatggttacaacatctgtacgccaaaatgcttgccaaagatccggcgttaccgtcttacgacgaactgaaaaaaatgggtatctataagcgtaaagatcccaatggccattttgtcgcctacaaagcatttcgtgacgaccccgaggcaaatccacttaaaacgccttccggtaagattgaaatttattccagcaggctggcggaaattgcccgtacctgggaactggaaaaagatgaagtgataagcccattgccagtttatgcctcaacctttgaaggctggaactcccctgaacgtagaaccttcccactgcaactgtttggtttccattacaaatcccgtactcactcgacctacggcaatattgatctcctgaaggctgcctgccgtcaggaggtgtggatcaaccctatagatgcgcagaaacgtgggattgccaacggcgatatggtgcgggtgtttaaccatcgtggcgaagttcggctaccagccaaagtaacaccacgtattctccctggagttagcgctatgggccagggagcctggcacgaggccaatatgtctggcgataaaatcgaccatggcggctgtgtgaatacgctaaccactctgcgcccttcaccactggcgaagggaaacccgcagcacactaatctggtcgagatcgaaaaaatataa

SEQ ID NO: 24528 - DNA, 1404 bp, Escherichia coli
atgaatacagtacgcagcgaaaaagattcgatgggggcgattgatgtcccggcagataagctgtggggcgcacaaactcaacgctcgctggagcatttccgcatttcgacggagaaaatgcccacctcactgattcatgcgctggcgctaaccaagcgtgcagcggcaaaagttaatgaagatttaggcttgttgtctgaagagaaagcgagcgccattcgtcaggcggcggatgaagtactggcaggacagcatgacgacgaattcccgctggctatctggcagaccggctccggcacgcaaagtaacatgaacatgaacgaagtgctggctaaccgggccagtgaattactcggcggtgtgcgcgggatggaacgtaaagttcaccctaacgacgacgtgaacaaaagccaaagttccaacgatgtctttccgacggcgatgcacgttgcggcgctgctggcgctgcgcaagcaactcattcctcagcttaaaaccctgacacagacactgaatgagaaatcccgtgcttttgccgatatcgtcaaaattggtcgtactcacttgcaggatgccacgccgttaacgctggggcaggagatttccggctgggtagcgatgctcgagcataatctcaaacatatcgaatacagcctgcctcacgtagcggaactggctcttggcggtacagcggtgggtactggactaaatacccatccggagtatgcgcgtcgcgtagcagatgaactggcagtcattacctgtgcaccgtttgttaccgcgccgaacaaatttgaagcgctggcgacctgtgatgccctggttcaggcgcacggcgcgttgaaagggttggctgcgtcactgatgaaaatcgccaatgatgtccgctggctggcctctggcccgcgctgcggaattggtgaaatctcaatcccggaaaatgagccgggcagctcaatcatgccggggaaagtgaacccaacacagtgtgaggcattaaccatgctctgctgtcaggtgatggggaacgacgtggcgatcaacatggggggcgcttccggtaactttgaactgaacgtcttccgtccaatggtgatccacaatttcctgcaatcggtgcgcttgctggcagatggcatggaaagttttaacaaacactgcgcagtgggtattgaaccgaatcgtgagcgaatcaatcaattactcaatgaatcgctgatgctggtgactgcgcttaacacccacattggttatgacaaagccgccgagatcgccaaaaaagcgcataaagaagggctgaccttaaaagctgcggcccttgcgctggggtatcttagcgaagccgagtttgacagctgggtacggccagaacagatggtcggcagtatgaaagccgggcgttaa

SEQ ID NO: 24529 - DNA, 1812 bp, Escherichia coli
atgttacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccgggatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 24530 - DNA, 768 bp, Escherichia coli
gtgtttaattctgacaacctgagactcgacggaaaatgcgccatcatcacaggtgcgggtgcaggtattggtaaagaaatcgccattacattcgcgacagctggcgcatctgtggtggtcagtgatattaacgccgacgcagctaaccatgttgtagacgaaattcaacaactgggtggtcaggcatttgcctgccgttgtgatattacttccgaacaggaactctctgcactggcagactttgctatcagtaagctgggtaaagttgatattctggttaacaacgccggtggcggtggacctaaaccgtttgatatgccaatggcggattttcgccgtgcttatgaactgaatgtgttttcttttttccatctgtcacaacttgttgcgccagaaatggaaaaaaatggcggtggcgttattctgaccatcacttctatggcggcagaaaataaaaatataaacatgacttcctatgcatcatctaaagctgcggccagtcatctggtcagaaatatggcgtttgacctgggtgaaaaaaatattcgggtaaatggcattgcgccgggggcaatattaaccgatgccctgaaatccgttattacaccagaaattgaacaaaaaatgttacagcacacgccgatcagacgtctgggccaaccgcaagatattgctaacgcagcgctgttcctttgctcgcctgctgcgagctgggtaagcggacaaattctcaccgtctccggtggtggggtacaggagctcaattaa

SEQ ID NO: 24531 - DNA, 1413 bp, Escherichia coli
atgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaa

SEQ ID NO: 24532 - DNA, 867 bp, Escherichia coli
atggatgttaccgcaaaatacgaattgattgggttgatggcctatcctatccgccacagtttatcgcccgaaatgcagaataaagccttagaaaaagcgggattgccatttacctatatggccttcgaagtggataacgatagctttcctggagcaattgaaggattaaaagccctcaaaatgcgcggaactggtgtatcgatgccgaacaaacaactggcgtgtgaatatgttgatgaattaacaccagctgccaaactggtgggggccatcaacaccatcgttaatgatgatggctatctgcgtggctataacaccgacggcacgggccatattcgcgccattaaagagagcggttttgatatcaaaggcaaaacgatggtgctgttaggggccggtggtgcctcaacggcaattggcgcgcagggggcaattgaaggtttaaaagaaattaaactctttaaccgtcgggatgagttcttcgataaagccctcgccttcgcgcagcgggttaatgaaaacaccgattgtgtcgtcacggtcaccgatctcgccgatcagcaagcctttgctgaagccctggcttccgccgacattttaaccaatggcacaaaagtgggtatgaaaccccttgagaatgaatcattggttaatgatatcagtctgttacatccgggacttctggtcactgaatgcgtgtataacccgcatatgacgaagttattgcagcaggcgcaacaagctggttgcaaaacgattgatggatacggcatgttgttgtggcaaggggctgaacagttcacattatggactggcaaagatttccctctggaatatgttaaacaggtcatggggttcggtgcctga

SEQ ID NO: 24533 - DNA, 759 bp, Escherichia coli
atgaaaaccgtaactgtaaaagatctcgtcattggtacgggcgcacctaaaatcatcgtctcgctgatggcgaaagatatcgccagcgtgaaatccgaagctctcgcctatcgtgaagcggactttgatattctggaatggcgtgtggaccactatgccgacctctccaatgtggagtctgtcatggcggcagcaaaaattctccgtgagaccatgccagaaaaaccgctgctgtttaccttccgcagtgccaaagaaggcggcgagcaggcgatttccaccgaggcttatattgcactcaatcgtgcagccatcgacagcggcctggttgatatgatcgatctggagttatttaccggtgatgatcaggttaaagaaaccgtcgcctacgcccacgcgcatgatgtgaaagtagtcatgtccaaccatgacttccataaaacgccggaagccgaagaaatcattgcccgtctgcgcaaaatgcaatccttcgacgccgatattcctaagattgcgctgatgccgcaaagtaccagcgatgtgctgacgttgcttgccgcgaccctggagatgcaggagcagtatgccgatcgtccaattatcacgatgtcgatggcaaaaactggcgtaatttctcgtctggctggtgaagtatttggctcggcggcaacttttggtgcggtaaaaaaagcgtctgcgccagggcaaatctcggtaaatgatttgcgcacggtattaactattttacaccaggcataa

SEQ ID NO: 24534 - DNA, 1206 bp, Escherichia coli
atgcggcgatgggttttgtcctgcctgaagcggctcattaacaggagtataatgatggatttttctttaactgaagaacaagaactgctgctggccagtattcgcgaactgattacgactaactttccggaagagtatttccgcacctgcgatcaaaacgggacatatccgcgtgagtttatgcgggcgctggcggataacggtatttccatgcttggcgtgccggaagaatttggtggtatccctgcggattacgtcacccaaatgctggcgctgatggaagtgtcaaaatgcggtgctccggcatttttaattaccaacggtcaatgtattcacagtatgcgccgtttcggttctgcagagcagctacgtaaaacggcagagagcaccctggaaacgggtgatcccgcctatgccctggcgttgacggaaccaggtgctggctcagataacaacagtgccactaccacttacacgcgtaaaaacggcaaggtctacatcaacggacaaaaaacctttattaccggtgcgaaagagtacccgtatatgctggtgctggcgcgcgatccgcaaccgaaagatcccaaaaaagccttcaccctgtggtgggtcgactccagtaagcccggcattaagattaacccgctgcataaaatcggctggcatatgctcagcacctgcgaagtctatctcgacaacgtggaggttgaagagagcgacatggtgggcgaagaaggaatgggtttcctcaatgtgatgtacaactttgagatggagcgcctgatcaacgccgcgcgcagcaccggctttgccgaatgcgcctttgaagatgccgcccgctatgccaaccaacgtatcgcttttggtaagcccattggtcataaccagatgatccaggaaaaactggcgctgatggcgattaagatcgacaacatgcgcaacatggtgctgaaagtggcatggcaagccgatcagcatcagtcactgcgcaccagcgcggcgctggcaaaactgtactgtgcacgtaccgcaatggaagtcattgatgatgcgattcaaatcatgggcggtctgggctataccgatgaggcgcgcgtctcccgcttctggcgtgatgtccgttgtgaacgtatcggcggcggtacagacgaaattatgatttacgtagcaggtcggcagatcctgaaagactatcagaacaaataa

SEQ ID NO: 24535 - DNA, 1701 bp, Escherichia coli
atgcatcccacaggcccgcatctcgggcctgatgttctgtttcgagagtccaacatgaaagtgacattaacgtttaacgaacaacgtcgtgcggcgtatcgtcagcaagggttatggggcgatgcttcgctggccgattactggcagcagaccgctcgtgcgatgccagacaaaattgccgtggtcgataatcatggtgcatcgtacacctatagcgcgctcgatcacgccgcgagctgtctggcaaactggatgttagcgaagggtattgaatcaggcgatcgcatcgcatttcaactgcctggctggtgtgaatttaccgttatctatcttgcctgcctgaaaatcggtgcagtttccgtgccgctgttgccttcctggcgggaagcagaactggtgtgggtgctcaataagtgtcaggcaaaaatgttctttgcaccgacgttgtttaaacaaacgcgtccggtagatttaatcctgccgctgcaaaatcagcttccacaactacaacaaattgtcggcgtggacaaactggctcccgccacctcttccctctcattaagtcagattatcgccgacaatacctcactgaccacggcgataacgacccacggcgatgaattagctgcggtgctgtttacctccggaaccgagggtctgccaaagggcgtgatgctaacgcataacaatattctcgccagtgagcgggcttattgcgcgcgactgaatctgacctggcaggatgtctttatgatgcctgcgccacttggtcacgcaacgggctttctgcatggcgtaacggcaccattcttaattggcgctcgcagcgtgttgttagatattttcactcctgatgcgtgtctcgcgctgcttgagcagcagcgttgcacctgtatgctcggcgcaacgccgtttgtctatgatcttttgaatgtactagagaaacaacccgcggacctttcagcgctgcgtttctttctttgcggcggaaccacaatccccaaaaaagtggcgcgtgaatgccagcagcgcggcattaaattattaagtgtttatggttccacagaaagttcgccgcatgcggtggtgaatctcgatgatcctttgtcgcgctttatgcacaccgatggttacgctgccgcaggtgtagagattaaagtggtcgatgacgcacgcaagaccttaccgccaggttgcgaaggtgaagaagcctcgcgtggccccaatgtgtttatggggtattttgatgaacctgaattaaccgcccgtgccctggatgaagaaggctggtattacagcggcgatctctgccgtatggatgaggctggctatataaaaattaccggacgcaaaaaagatattattgtccgcggcggcgaaaatattagcagccgtgaagtggaagatattttattgcagcatcctaaaattcacgatgcctgtgtggttgcaatgtccgatgaacgtttaggtgaacgatcatgcgcttatgtcgtgctgaaagcgccgcatcattcattatcgctggaagaggtagtggctttttttagccgtaaacgggtcgcaaaatataaatatcctgaacatatcgtggtaatcgaaaaactaccgcgaactacctcaggtaaaatacaaaagtttttgttaagaaaagatattatgcggcgtttaacgcaggatgtctgtgaagagattgaataa

SEQ ID NO: 24536 - DNA, 2379 bp, Escherichia coli
atgtccaacaatggctcgtcaccgctggtgctttggtataaccaactcggcatgaatgatgtagacagggttgggggcaaaaatgcctccctgggtgaaatgattactaatctttccggaatgggtgtttccgttccgaatggtttcgccacaaccgccgacgcgtttaaccagtttctggaccaaagcggcgtaaaccagcgcatttatgaactgctggataaaacggatattgacgatgttactcagcttgcgaaagcgggcgcgcaaatccgccagtggattatcgacactcccttccagcctgagctggaaaacgccatccgcgaagcctatgcacagctttccgccgatgacgaaaacgcctcttttgcggtgcgctcctccgccaccgcagaagatatgccggacgcttcttttgccggtcagcaggaaaccttcctcaacgttcagggttttgacgccgttctcgtggcagtgaaacatgtatttgcttctctgtttaacgatcgcgccatctcttatcgtgtgcaccagggttacgatcaccgtggtgtggcgctctccgccggtgttcaacggatggtgcgctctgacctcgcatcatctggcgtgatgttctccattgataccgaatccggctttgaccaggtggtgtttatcacttccgcatggggccttggtgagatggtcgtgcagggtgcggttaacccggatgagttttacgtgcataaaccgacactggcggcgaatcgcccggctatcgtgcgccgcaccatggggtcgaaaaaaatccgcatggtttacgcgccgacccaggagcacggcaagcaggttaaaatcgaagacgtaccgcaggaacagcgtgacatcttctcgctgaccaacgaagaagtgcaggaactggcaaaacaggccgtacaaattgagaaacactacggtcgcccgatggatattgagtgggcgaaagatggccacaccggtaaactgttcattgtgcaggcgcgtccggaaaccgtgcgctcacgcggtcaggtcatggagcgttatacgctgcattcacagggtaagattatcgccgaaggccgtgctatcggtcatcgcatcggtgcgggtccggtgaaagtcatccatgacatcagcgaaatgaaccgcatcgaacctggcgacgtgctggttactgacatgaccgacccggactgggaaccgatcatgaagaaagcatctgccatcgtcaccaaccgtggcggtcgtacctgtcacgcggcgatcatcgctcgtgaactgggcattccggcggtagtgggctgtggagatgcaacagaacggatgaaagacggtgagaacgtcactgtttcttgtgccgaaggtgataccggttacgtctatgcggagttgctggaatttagcgtgaaaagctccagcgtagaaacgatgccggatctgccgttgaaagtgatgatgaacgtcggtaacccggaccgtgctttcgacttcgcctgcctaccgaacgaaggcgtgggccttgcgcgtctggaatttatcatcaaccgtatgattggcgtccacccacgcgcactgcttgagtttgacgatcaggaaccgcagttgcaaaacgaaatccgcgagatgatgaaaggttttgattctccgcgtgaattttacgttggtcgtctgactgaagggatcgcgacgctgggtgccgcgttttatccgaagcgcgtcattgtccgtctctctgattttaaatcgaacgaatatgccaacctggtcggtggtgagcgttacgagccagatgaagagaacccgatgctcggcttccgtggcgcgggccgctatgtttccgacagcttccgcgactgtttcgcgctggagtgtgaagcagtgaaacgtgtgcgcaacgacatgggactgaccaacgttgagatcatgatcccgttcgtgcgtaccgtagatcaggcgaaagcggtggttgaagaactggcgcgtcaggggctgaaacgtggcgagaacgggctgaaaatcatcatgatgtgtgaaatcccgtccaacgccttgctggccgagcagttcctcgaatatttcgacggcttctcaattggctcaaacgatatgacgcagctggcgctcggtctggaccgtgactccggcgtggtgtctgaattgttcgatgagcgcaacgatgcggtgaaagcactgctgtcgatggctatccgtgccgcgaagaaacagggcaaatatgtcgggatttgcggtcagggtccgtccgaccacgaagactttgccgcatggttgatggaagaggggatcgatagcctgtctctgaacccggacaccgtggtgcaaacctggttaagcctggctgaactgaagaaataa

SEQ ID NO: 24537 - DNA, 1047 bp, Escherichia coli
atgaacagaactgacgaactccgtactgcgcgtattgagagcctggtaacgcccgccgaactcgcgctacggtatcccgtaacgcctggcgtcgccacccatgtcaccgactcccgccgcagaattgaaaaaatactgaatggtgaagataagcgactgttggtcattattggcccctgctcgatccacgatctcaccgctgcaatggagtacgccacccgtctgcagtcgctgcgcaaccagtaccagtcacggctggaaatcgtaatgcgcacctattttgaaaaaccacgaactgttgtcggctggaaaggactaatctccgatccagatttaaacggcagctatcgggtaaatcacggtctggagctggcgcgcaaattacttttacaggtaaatgagctgggcgtcccaaccgcgaccgagttcctcgatatggtgaccggtcagtttattgctgatttaatcagttggggcgcgattggcgcacgtactaccgaaagtcagatccaccgcgaaatggcttcggcactctcctgtccggtaggttttaaaaatggtaccgatggcaatacgcggattgctgtggatgctatccgcgcagcccgcgccagccatatgttcctctcgccagacaaaaatggtcagatgaccatctatcagaccagcggcaacccgtatggccacattattatgcgtggcggcaaaaaaccgaattatcatgccgatgatatcgccgcagcctgcgatacgctgcacgagtttgatttacctgaacatctggtggtggatttcagccacggtaactgccagaagcagcaccgtcgccagttagaagtttgtgaggatatttgtcagcaaatccgcaatggctctacggcgattgctggaattatggcggaaagtttcctgcgcgaaggaacgcaaaaaatcgtcggcagtcagccgctcacttacggtcaatccattaccgacccgtgtctgggctgggaggataccgaacgcctggtcgaaaaactcgcctctgcggtagatacccgcttctga

SEQ ID NO: 24538 - DNA, 930 bp, Escherichia coli
atggtacgtatctatacgttgacacttgcgccctctctcgatagcgcaacaattaccccgcaaatttatcccgaaggaaaactgcgctgtaccgcaccggtgttcgaacccgggggcggcggcatcaacgtcgcccgcgccattgcccatcttggaggcagtgccacagcgatcttcccggcgggtggcgcgaccggcgaacacctggtttcactgttggcggatgaaaatgtccccgtcgctactgtagaagccaaagactggacccggcagaatttacacgtacatgtggaagcaagcggtgagcagtatcgttttgttatgccaggcgcggcattaaatgaagatgagtttcgccagcttgaagagcaagttctggaaattgaatccggggccatcctggtcataagcggaagcctgccgccaggtgtgaagctggaaaaattaacccaactgatttccgctgcgcaaaaacaagggatccgctgcatcgtcgacagttctggcgaagcgttaagtgcagcactggcaattggtaacatcgagttggttaagcctaaccaaaaagaactcagtgcgctggtgaatcgcgaactcacccagccggacgatgtccgcaaagccgcgcaggaaatcgttaatagcggcaaggccaaacgggttgtcgtttccctgggtccacaaggagcgctgggtgttgatagtgaaaactgtattcaggtggtgccaccaccggtgaaaagccagagtaccgttggcgctggtgacagcatggtcggcgcgatgacactgaaactggcagaaaatgcctctcttgaagagatggttcgttttggcgtagctgcggggagtgcagccacactcaatcagggaacacgtctgtgctcccatgacgatacgcaaaaaatttacgcttacctttcccgctaa

SEQ ID NO: 24539 - DNA, 669 bp, Escherichia coli
atgtcaaccccgcgtcagattcttgctgcaatttttgatatggatggattacttatcgactcagaacctttatgggatcgagccgaactggatgtgatggcaagcctgggggtggatatctcccgtcgtaacgagctgccggacaccttaggtttacgcatcgatatggtggtcgatctttggtacgcccggcaaccgtggaatgggccaagccgtcaggaagtagtagaacgggttattgcccgtgccatttcactggttgaagagacacgtccattattaccaggcgtgcgcgaagccgttgcgttatgcaaagaacaaggtttattggtgggactggcctccgcgtcaccactacatatgctggaaaaagtgttgaccatgtttgacttacgcgacagtttcgatgccctcgcctcggccgaaaaactgccttacagcaagccgcatccgcaagtatatctcgactgcgcagcaaaactgggcgttgaccctctgacctgcgtagcgctggaagattcggtaaatggcatgatcgcctctaaagcagcccgcatgcgttccatcgtcgttcctgcgccagaagcgcaaaatgatccacgttttgtattagcagacgtcaaactttcatcgctgacagaactcaccgcaaaagaccttctcggttaa

SEQ ID NO: 24540 - DNA, 1392 bp, Escherichia coli
atgaactttccattaattgcgaacatcgtggtgttcgttgtactgctgtttgcgctggctcagacccgccataaacagtggagtctggcgaaaaaagtgctggtgggtctggtgatgggtgtggtttttggccttgccctgcataccatttatggttctgacagccaggtacttaaagattctgtacagtggtttaacatcgttggtaacggctatgttcaactgctgcaaatgatcgttatgccgttagtcttcgcctctattctgagcgcggttgcccgtctgcataacgcatctcagttaggcaaaatcagttttctgaccatcggtacgcttttgtttaccacgctgattgcggcgctggtcggtgtgctggtcaccaacctgtttggtttgacggctgaaggtctggttcagggtggtgcagaaactgcacgtctgaacgccattgaaagtaactatgttggtaaagtctctgatctgagcgttccgcagctggtcttgtcctttatcccgaaaaacccgtttgccgatcttaccggagccaatccgacgtcaattatcagcgtggtaatttttgccgcattcctcggcgtagctgcattgaaactgctgaaggatgatgcgccgaaaggtgaacgcgtcttagccgctatcgataccctacaaagctgggtgatgaaactggttcgcctggtcatgcagttgaccccttacggcgttctggctctaatgaccaaagtggttgcaggttctaacttgcaagacatcatcaaactgggaagtttcgttgtcgcgtcctacctcggtctgctgattatgtttgcagtgcatggcattctgctgggcattaatggcgtgagtccgctgaagtacttccgtaaggtatggcctgtgctgacgtttgcctttaccagccgttccagtgctgcgtctatcccactgaatgtggaagcacaaacgcgtcgtctgggcgttcctgaatccatcgccagtttcgccgcctctttcggtgcaaccattggtcagaacggctgcgccggtttgtatccggcaatgctggcggtgatggttgcgcctacggttggcattaacccgctggacccgatgtggattgcgacgctggtcggtattgttaccgttagttccgcaggcgttgccggtgtcggtggtggtgcaactttcgccgcactgattgtactgcctgcgatgggcctgccagtaaccctggtggcgctgttaatctccgttgaaccgcttatcgacatgggccgtacggcgttaaacgttagtggctcgatgacagctggcacgctgaccagccagtggctgaagcaaaccgataaagccattctggatagcgaagacgacgccgaactggcacaccattaa

SEQ ID NO: 24541 - DNA, 2262 bp, Escherichia coli
atgtcgcaacataacgaaaagaacccacatcagcaccagtcaccactacacgattccagcgaagcgaaaccggggatggactcactggcacctgaggacggctctcatcgtccagcggctgaaccaacaccgccaggtgcacaacctaccgccccagggagcctgaaagcccctgatacgcgtaacgaaaaacttaattctctggaagacgtacgcaaaggcagtgaaaattatgcgctgaccactaatcagggcgtgcgcatcgccgacgatcaaaactcactgcgtgccggtagccgtggtccaacgctgctggaagattttattctgcgcgagaaaatcacccactttgaccatgagcgcattccggaacgtattgttcatgcacgcggatcagccgctcacggttatttccagccatataaaagcttaagcgatattaccaaagcggatttcctctcagatccgaacaaaatcaccccagtatttgtacgtttctctaccgttcagggtggtgctggctctgctgataccgtgcgtgatatccgtggctttgccaccaagttctataccgaagagggtatttttgacttcgttggcaataacacgccaatcttctttatccaggatgcgcataaattccccgattttgttcatgcggtaaaaccagaaccgcactgggcaattccacaagggcaaagtgcccacgatactttctgggattatgtttctctgcaacctgaaactctgcacaacgtgatgtgggcgatgtcggatcgcggcatcccccgcagttaccgcaccatggaaggcttcggtattcacaccttccgcctgattaatgccgaagggaaggcaacgtttgtacgtttccactggaaaccactggcaggtaaagcctcactcgtttgggatgaagcacaaaaactcaccggacgtgacccggacttccaccgccgcgagttgtgggaagccattgaagcaggcgattttccggaatacgaactgggcttccagttgattcctgaagaagatgaattcaagttcgacttcgatcttctcgatccaaccaaacttatcccggaagaactggtgcccgttcagcgtgtcggcaaaatggtgctcaatcgcaacccggataacttctttgctgaaaacgaacaggcggctttccatcctgggcatatcgtgccgggactggacttcaccaacgatccgctgttgcagggacgtttgttctcctataccgatacacaaatcagtcgtcttggtgggccgaatttccatgagattccgattaaccgtccgacctgcccttaccataatttccagcgtgacggcatgcatcgcatggggatcgacactaacccggcgaattacgaaccgaactcgattaacgataactggccgcgcgaaacaccgccggggccgaaacgcggcggttttgaatcataccaggagcgcgtggaaggcaataaagttcgcgagcgcagcccatcgtttggcgaatattattcccatccgcgtctgttctggctaagtcagacgccatttgagcagcgccatattgtcgatggtttcagttttgagttaagcaaagtcgttcgtccgtatattcgtgagcgcgttgttgaccagctggcgcatattgatctcactctggcccaggcggtggcgaaaaatctcggtatcgaactgactgacgaccagctgaatatcaccccacctccggacgtcaacggtctgaaaaaggatccatccttaagtttgtacgccattcctgacggtgatgtgaaaggtcgcgtggtagcgattttacttaatgatgaagtgagatcggcagaccttctggccattctcaaggcgctgaaggccaaaggcgttcatgccaaactgctctactcccgaatgggtgaagtgactgcggatgacggtacggtgttgcctatagccgctacctttgccggtgcaccttcgctgacggtcgatgcggtcattgtcccttgcggcaatatcgcggatatcgctgacaacggcgatgccaactactacctgatggaagcctacaaacaccttaaaccgattgcgctggcgggtgacgcgcgcaagtttaaagcaacaatcaagatcgctgaccagggtgaagaagggattgtggaagctgacagcgctgacggtagttttatggatgaactgctaacgctgatggcagcacaccgcgtgtggtcacgcattcctaagattgacaaaattcctgcctga

SEQ ID NO: 24542 - DNA, 1353 bp, Escherichia coli
atgagccagaaattaaaagtcgtcactattggtggcgggagcagctataccccggagttactggaaggatttattaagcgttatcacgaattgccggtcagcgaattatggctggtggatgtcgaaggtggtaaaccgaaactggatattattttcgatctctgccaacggatgattgataacgctggcgtcccgatgaagctttataaaacgctggatcgccgcgaagcattgaaagatgctgatttcgttactacccaactgcgcgttggccaattaccggcgcgtgaactggatgaacgtattccattaagtcatggttatcttggtcaggaaaccaacggcgcgggcggtttgtttaaaggtctgcgtaccattccggtgatttttgacatcgtaaaagatgtcgaagaactttgtccgaatgcatgggtgattaacttcactaacccggcgggaatggtcactgaagccgtttatcgtcataccggatttaaacgctttatcggcgtgtgtaatattccgatcggcatgaagatgtttattcgcgatgttctgatgctgaaagacagcgatgatttatctatcgatttgttcggcctcaaccatatggtgttcattaaggatgtgctgataaatggcaagtcgcgctttgccgaattgcttgatggtgtggcgtcagggcagttaaaagcgtcctctgtaaaaaatattttcgatctgccatttagtgagggcttaattcgttcgttgaatctgctgccatgttcttatctgctgtattacttcaagcagaaagagatgctggctattgaaatgggcgaatactacaaaggcggcgcacgagcgcaggtagtacagaaagtcgagaaacaactttttgagctgtataaaaatcctgagctgaaagttaagccgaaagaactggaacagcgcggtggggcttattactctgatgcagcatgcgaagtgatcaacgctatctacaacgacaagcaagcagaacattacgttaatatcccgcatcatgggcagattgataatattccggcagactgggcagtagaaatgacctgtaagctggggcgcgatggcgcgacgccacatccgcgcattacgcatttcgatgataaagtaatggggctgattcacaccattaaaggcttcgagattgctgccagtaacgccgcacttagcggagaatttaacgatgtgttactggcgctaaaccttagtccgttggtgcattccgatcgcgatgctgagctgctggcacgcgagatgattctggcgcacgagaaatggctgccaaactttgccgactgcatcgcagagcttaaaaaagcacattaa

SEQ ID NO: 24543 - DNA, 1479 bp, Escherichia coli
atgactttatggattaacggtgactggataacgggccagggcgcatcgcgtgtgaagcgtaatccggtatcgggcgaggtgttatggcaaggcaatgatgccgatgccgctcaggtcgagcaggcttgtcgggcagcccgtgcggcgtttccgcgctgggcgcggctttcatttgctgaacgtcatgccgttgtcgaacgctttgccgcactgctggaaagcaataaagccgaattaaccgcgattattgccagagaaacgggtaagccgcgctgggaagcggcaaccgaagtgacggcgatgatcaataaaatcgcgatatcaattaaggcgtatcacgttcgtaccggcgagcagcgtagtgaaatgccggacggcgcggcgagcctgcgacatcgcccgcacggcgtgctggcggtgtttgggccgtataatttccctggtcatttgccgaacggacatatcgttccggcattgctggcaggtaacaccattatctttaaacccagcgaactgacaccgtggagtggcgaagcggtaatgcgtttatggcagcaggctggcttgccgccaggcgtgctgaacctggtgcagggcgggcgtgaaacgggtcaggcgctgagtgcgctggaggatctcgacggtttgctgtttaccggtagcgccaatacaggctaccagttgcatcgccagctctccggtcagccggagaaaattctcgcccttgagatgggcggtaataatccgctaattatcgatgaggtggcggatatcgacgcggctgtccatctgaccattcagtcggcgtttgtcacagccggtcaacgctgcacctgcgcccgccgtttattgctgaaaagcggggcgcagggcgatgcgtttcttgctcgtctggttgccgtcagccagcgattaacgccgggcaactgggatgacgaaccgcagccgtttattggcgggctgatttctgaacaggccgcacagcaggtggttactgcatggcagcaactggaagcgatgggcggacgacccctgcttgcgccgcgcttattacaagcagggacatcgttgctgacgccggggatcattgaaatgacaggcgttgctggcgtaccagatgaagaggtgttcggaccgttattgcgcgtctggcgttatgatactttcgatgaagcgattcgaatggcgaataacactcgcttcggactctcttgcggtctggtttcccccgagcgggaaaagttcgatcaactgttgctggaggcgcgggcggggattgttaactggaacaaaccgcttaccggtgctgccagtaccgcgccattcggcggcattggtgcttccggtaaccatcgccccagcgcctggtatgccgcagattactgcgcatggccgatggcgagcctggagtcggactcgttaacattgcccgccacgcttaaccccgggctggatttttccgatgaggtggtgcgatga

SEQ ID NO: 24544 - DNA, 1221 bp, Escherichia coli
atgtctcagccaattacgcgtgaaaactttgatgaatggatgatacctgtttacgctccggcaccctttataccggtacgtggcgaaggttcgcgcttgtgggatcagcaggggaaagagtatatcgacttcgcgggtggcattgcggtgaacgcgctgggccatgcgcatccggaactgcgtgaagcgctgaacgaacaggcgagtaagttctggcataccggcaacggttacaccaacgagccggtactgcgactggcgaaaaaattgatcgacgccacgtttgccgatcgcgtcttcttttgtaactccggtgcggaagccaacgaagcggcgctaaaactggcgcgtaaattcgctcacgaccgctacggcagccataagagcggcatcgtggcgttcaaaaatgcgtttcatggtcgcacgctgtttactgtcagtgcgggtgggcagccagcctattcacaggattttgcgccactgccggcggatattcgtcatgctgcatataacgatattaactctgccagcgcgctgattgacgactctacctgtgcggtgattgtcgaacccatccagggggaaggcggtgtggtgccagccagcaacgcgtttttacaaggtctgcgtgaattgtgtaaccgccacaatgcgctgttgatttttgatgaagtacaaaccggcgtcgggcgcaccggggaactgtatgcctatatgcactacggcgtgacgcctgatctgttaactaccgccaaagcgctgggcggcggtttcccggtcggtgcgttgttggcaaccgaagagtgcgcccgcgtgatgaccgttggcactcatggcaccacctatggcggtaatccgctggcctcggcggtggcaggcaaagtgctggagctcatcaacacaccagagatgcttaatggcgttaaacagcgtcacgactggtttgttgagcgtcttaatactattaatcaccgctatggtttgttcagtgaagttcgcggcttaggtttgctgattggctgtgtactgaatgccgattacgccgggcaagcgaaacagatctctcaggaagcggcgaaagcaggcgtgatggtactgattgcgggtggcaacgtggtgcgttttgcgcctgcgctcaatgtcagcgaagaagaggtgacgaccggactggatcgctttgcagctgcttgcgaacactttgttagccgaggttcatcatga

SEQ ID NO: 24545 - DNA, 807 bp, Escherichia coli
atgaaatttgtctcttttaatatcaacggcctgcgcgccagacctcaccagcttgaagccatcgtcgaaaagcaccaaccggatgtgattggcctgcaggagacaaaagttcatgacgatatgtttccgctcgaagaggtggcgaagctcggctacaacgtgttttatcacgggcagaaaggccattatggcgtggcgctgctgaccaaagagacgccgattgccgtgcgtcgcggctttcccggtgacgacgaagaggcgcagcggcggattattatggcggaaatcccctcactgctgggtaatgtcaccgtgatcaacggttacttcccgcagggtgaaagccgcgaccatccgataaaattcccggcaaaagcgcagttttatcagaatctgcaaaactacctggaaaccgaactcaaacgtgataatccggtactgattatgggcgatatgaatatcagccctacagatctggatatcggcattggcgaagaaaaccgtaagcgctggctgcgtaccggtaaatgctctttcctgccggaagagcgcgaatggatggacaggctgatgagctgggggttggtcgataccttccgccatgcgaatccgcaaacagcagatcgtttctcatggtttgattaccgctcaaaaggttttgacgataaccgtggtctgcgcatcgacctgctgctcgccagccaaccgctggcagaatgttgcgtagaaaccggcatcgactatgaaatccgcagcatggaaaaaccgtccgatcacgcccccgtctgggcgaccttccgccgctaa

SEQ ID NO: 24546 - DNA, 1344 bp, Escherichia coli
atggatcagacatattctctggagtcattcctcaaccatgtccaaaagcgcgacccgaatcaaaccgagttcgcgcaagccgttcgtgaagtaatgaccacactctggccttttcttgaacaaaatccaaaatatcgccagatgtcattactggagcgtctggttgaaccggagcgcgtgatccagtttcgcgtggtatgggttgatgatcgcaaccagatacaggtcaaccgtgcatggcgtgtgcagttcagctctgccatcggcccgtacaaaggcggtatgcgcttccatccgtcagttaacctttccattctcaaattcctcggctttgaacaaaccttcaaaaatgccctgactactctgccgatgggcggtggtaaaggcggcagcgatttcgatccgaaaggaaaaagcgaaggtgaagtgatgcgtttttgccaggcgctgatgactgaactgtatcgccacctgggcgcggataccgacgttccggcaggtgatatcggggttggtggtcgtgaagtcggctttatggcggggatgatgaaaaagctctccaacaataccgcctgcgtcttcaccggtaagggcctttcatttggcggcagtcttattcgcccggaagctaccggctacggtctggtttatttcacagaagcaatgctaaaacgccacggtatgggttttgaagggatgcgcgtttccgtttctggctccggcaacgtcgcccagtacgctatcgaaaaagcgatggaatttggtgctcgtgtgatcactgcgtcagactccagcggcactgtagttgatgaaagcggattcacgaaagagaaactggcacgtcttatcgaaatcaaagccagccgcgatggtcgagtggcagattacgccaaagaatttggtctggtctatctcgaaggccaacagccgtggtctctaccggttgatatcgccctgccttgcgccacccagaatgaactggatgttgacgccgcgcatcagcttatcgctaatggcgttaaagccgtcgccgaaggggcaaatatgccgaccaccatcgaagcgactgaactgttccagcaggcaggcgtactatttgcaccgggtaaagcggctaatgctggtggcgtcgctacatcgggcctggaaatggcacaaaacgctgcgcgcctgggctggaaagccgagaaagttgacgcacgtttgcatcacatcatgctggatatccaccatgcctgtgttgagcatggtggtgaaggtgagcaaaccaactacgtgcagggcgcgaacattgccggttttgtgaaggttgccgatgcgatgctggcgcagggtgtgatttaa

SEQ ID NO: 24547 - DNA, 1962 bp, Escherichia coli
atgcggttgtttattgccgaaaaaccgagtctggcgcgcgccattgctgatgtcctgcccaaaccgcaccggaaaggcgatggctttatcgagtgcggtaatggtcaggtggtgacctggtgtatcggtcacctgcttgagcaggcgcagccagacgcctacgacagccgctatgcgcgctggaatcttgcggatttgccgattgtcccggaaaagtggcaattacagccccgaccctccgtgaccaaacaacttaacgtcatcaaacggttcctgcatgaagccagcgaaatcgttcacgccggggacccggatcgtgaagggcaattgctggtggatgaagtgctggactatctgcaactggcaccggaaaagcgccagcaggtacagcgttgcttgataaacgacctgaacccgcaggcggttgagcgggcgatcgaccgtcttcgttccaacagtgagtttgtaccgctgtgcgtttctgcgctggcgcgagcgcgtgccgactggctgtacggcatcaatatgacccgtgcgtataccattctcggtcgcaatgccggttatcagggcgtactttccgtgggacgcgtgcagacgcccgtgcttgggctggtggtgcgccgcgatgaagagattgaaaacttcgtggcgaaagacttctttgaagtcaaagcacatatcgtgacacctgccgatgagcggtttaccgctatctggcaaccgagcgaagcgtgtgaaccgtaccaggatgaagaagggcgcttgttacatcgtccactggcggagcatgtggttaaccgcattagtggtcaaccggctattgtcaccagctataacgataaacgggaatcagaatccgcgccgctgcctttttcgctttcagcgttgcagattgaagcggcaaaacgttttggtctgagtgcgcagaacgtgcttgatatctgccagaaactgtacgaaacgcacaagctaatcacttatccgcgttctgattgtcgctatttgccagaagaacattttgccggacgccacgcggtgatgaatgccatcagtgttcatgcaccggatctgttgccgcagccagtggtagatccagatatacgcaaccgctgttgggatgacaaaaaggtcgatgcgcaccacgccatcattccgaccgcacggagttctgcgatcaacctgacggagaacgaagcgaaggtctataacctgattgcccgtcagtatctgatgcaattctgcccggatgcggtgttccgcaagtgtgttatcgaactggacattgccaaaggcaaatttgtcgctaaagcgcgttttcttgctgaagcaggctggcgcacgctgttaggcagcaaagagcgcgatgaagaaaacgacggcacgccactgcctgtggtggcgaaaggcgatgagttgctgtgtgaaaaaggtgaagtggtagagcggcaaacccagccgccgcgccattttaccgatgcaacactgctttcggcgatgaccgggatcgcgcgctttgtgcaggataaagatctgaaaaagatcctccgtgcgaccgatggtctggggacagaggcaacgcgtgccgggattattgaactgttgttcaagcgtggtttcctgaccaaaaaagggcgctatatccactccaccgacgccggaaaagcgctattccattcgctgccggagatggcgacgcgaccggacatgaccgcgcactgggaatcggtgctgacgcaaatcagcgaaaagcagtgtcgctatcaggactttatgcagccgctggtggggacgctatatcagcttattgatcaagccaaacgtacgccggtgcggcagtttcgcggcattgtggctccgggcagtggtggcagtgctgataagaaaaaggctgcaccgcgtaaacgtagtgcgaaaaaaagtccgccagcagatgaagtcggaagcggggcgatagcgtaa

SEQ ID NO: 24548 - DNA, 1359 bp, Escherichia coli
atggaacaatatgatcaaattggcgcaagactggaccgcttgcctttggcccggtttcattatcgtatatttggtattataagctttagtctgttattaacagggtttttgagttactccggtaatgtcgtcttagcaaagctggtaagcaatggatggtcaaataatttcctcaatgccgcctttacctcggcattaatgtttggttatttcatcggctcacttactggtgggtttattggtgactactttgggcggcgcagggcgtttcgcataaatcttctcatcgtcggtattgctgcaacaggggccgcttttgtccctgatatgtactggctcatcttctttcgcttcctgatgggaacaggaatgggggcgctgattatggttggctatgcctcatttacggagtttatccccgcgacggtgcgtggaaaatggtccgcgcggctctcatttgttggtaactggtcgcccatgctgtctgcggcgataggcgtggtggttatcgctttttttagttggcgaataatgtttctgctgggtggtattggcatactgttagcctggtttctctcaggtaaatactttatcgagtcgccacgatggctggcagggaaagggcaaatcgcaggtgcagaatgccaacttcgtgaagtagagcagcaaattgaaagagagaagagtattcgtttacccccgcttacttcgtatcagagcaacagcaaggttaaagtaatcaagggtactttctggctcctgtttaaaggtgaaatgttacgacgtacattagtcgcgattactgttttaattgcaatgaacatttcgctttataccatcaccgtatggataccgaccatatttgttaactccggcattgatgtcgataaatcaatattaatgaccgctgttattatgattggcgctccggtaggaatatttattgcggcattaattattgatcattttcctcgtcggttatttggctccaccttacttattattattgccgtgttaggctatatctattcaattcagactacagagtgggcgattttaatctatggactggtgatgatcttctttttatacatgtatgtttgcttcgcgtcggcggtttatatcccggagctttggccaacgcatttacgcctgcgcggttcgggtttcgttaatgccgtcggacggatcgtcgcagtcttcacgccctatggcgttgcggcattattaacacattatgggtcgatcacggtgtttatggtacttggtgttatgttattgctctgtgcgctggttctctccatttttggcatcgaaacgcggaaggtgtcgttggaagagatttctgaggtgaattaa

SEQ ID NO: 24549 - DNA, 981 bp, Escherichia coli
atgaaaaagatacctttaggcacaacggatattacgctttcgcgaatggggttggggacatgggccattggcggcggtcctgcatggaatggcgatctcgatcggcaaatatgtattgatacgattcttgaagcccatcgttgtggcattaatctgattgatactgcgccaggatataactttggcaatagtgaagttatcgtcggtcaggcgttaaaaaaactgccccgtgaacaggttgtagtagaaaccaaatgcggcattgtctgggaacgaaaaggaagtttattcaacaaagttggcgatcggcagttgtataaaaacctttccccggaatctatccgcgaagaggtagcagcgagcttgcaacgtctgggtattgattacatcgatatctacatgacgcactggcagtcggtgccgccattttttacgccgatcgctgaaactgtcgcagtgcttaatgagttaaagtctgaagggaaaattcgcgctataggcgctgctaacgtcgatgctgaccatatccgcgagtatctgcaatatggtgaactggatattattcaggcgaaatacagtatcctcgaccgggcaatggaaaacgaactgctgccactatgtcgtgataatggcattgtggttcaggtttattccccgctagagcagggattgttgaccggcaccatcactcgtgattacgttccgggcggcgctcgggcaaataaagtctggttccagcgtgaaaacatgctgaaagtgattgatatgcttgaacagtggcagccactttgtgctcgttatcagtgcacaattcccactctggcactggcgtggatattaaaacagagtgatttaatctccattcttagtggggctactgcaccggaacaggtacgcgaaaatgtcgcggcactgaatatcaacttatcggatgcagacgcaacattgatgagggaaatggcagaggccctggagcgttaa

SEQ ID NO: 24550 - DNA, 969 bp, Escherichia coli
atggcaaagcggaataatgatatggataatctcgacgttatttgtataggtgccgctattgttgatattccattgcaaccggtcagtaaaaatatctttgatgtggattcttatcctcttgaaagaatcgcaatgaccaccgggggtgatgcaataaatgaagcaacaattatttctcgtctgggccatcgcacagcattaatgagtcgtattggtaaagatgccgcagggcaatttattctcgaccattgccgcaaagagaatattgatattcaaagcctgaagcaggacgtcagcatagatacctctattaacgttggactggtgacggaggatggcgagcggacgtttgtcacaaaccgtaatggcagtctgtggaaattgaatattgacgatgttgattttgcgcggttttctcaggcgaaattattatcactggccagtattttcaacagtccactattggatggtaaagcgctaacagaaatttttacgcaagctaaagcccggcagatgattatctgtgccgatatgatcaaaccgcggttgaatgaaacgctggatgatatttgcgaagcattgagttatgtcgattatctgtttcctaattttgccgaggcaaaattactcaccgggaaagagacactggatgaaattgctgactgctttcttgcgtgcggcgtaaaaacggtggtgattaaaacgggtaaagacggctgctttatcaagcgtggtgacatgacgatgaaggtgccggcggtcgcaggaataaccgccatcgacaccattggcgcgggcgataactttgcttcaggttttattgcggcactgttagaaggcaaaaatctgcgtgaatgcgcacgctttgccaatgcaacggcggctatctcggttctaagcgtcggtgccaccaccggcgtaaaaaacagaaagctggtcgaacaattgctggaagaatacgaaggataa

SEQ ID NO: 24551 - DNA, 837 bp, Escherichia coli
atgctcgcagatatcagatattgggaaaacgatgccacaaataaacattatgcaattgcccattttaacgtatggaatgcagaaatgttgatgggcgttatcgacgcagccgaagaagcgaaatccccggttattatttcttttggtacaggttttgtcggtaacacctcatttgaagatttctctcacatgatggtatcaatggcacaaaaagcaacggtgccggtaataactcattgggatcatggtcggagtatggagattattcataacgcctggactcatggtatgaattcattaatgcgtgatgcttccgcgtttgatttcgaagaaaatattcgtttaaccaaagaggctgtcgatttcttccatccgctgggtattccggtagaggcggaattagggcatgtcggtaatgaaaccgtttatgaggaagcgctggcgggctatcactataccgatcctgaccaggcggctgaatttgttgaacgtacgggctgtgattcattggctgtcgccatcggcaaccagcatggggtttatacgtcagagccacaattgaactttgaggtcgtcaaacgcgtacgcgatgccgtttctgttccgctggttttgcacggtgcatcggggatcagtgatgccgacattaaaactgcaatttcgttgggtatcgcgaaaatcaacattcatacggagctctgtcaggccgcaatggttgcagtgaaagaaaaccaggatcagcctttcctgcatttagaacgtgaagtacgtaaagctgtaaaagaacgggcattggaaaaaattaaactgttcggttctgatggcaaagcggaataa

SEQ ID NO: 24552 - DNA, 1044 bp, Escherichia coli
atgaaaaattcaaaagcaatattgcaggtgccgggcacaatgaaaattatttcagcagaaataccagtgcctaaagaagatgaagttttgattaaagtagaatatgtcggtatttgtggttcagatgtacatggttttgaatcaggcccgtttattccgcctaaagacccaaatcaagaaattggcctgggtcatgaatgcgccgggacggttgtggctgtgggaagccgcgtgcgcaaatttaaaccgggggatcgggtaaatatcgaacctggcgttccttgcggtcactgtcgttactgtctggaaggcaaatataacatctgcccggacgttgattttatggcgacacaacccaactaccgcggcgcattaacgcactatctgtgtcatccggagagctttacttacaaactgcccgacaatatggacacgatggaaggggcgctggtggagcctgccgcagtcgggatgcatgccgcgatgctggcagatgttaaaccgggtaagaagataattattctgggagcaggttgtattggtttgatgacgttgcaagcgtgcaaatgcctgggagcaacggaaattgccgtcgttgatgtgctggaaaaacgtctggcaatggcggaacagcttggtgcgacagtggttattaacggcgcaaaagaagacactattgcacgctgtcagcaatttaccgaagacatgggcgcagatattgttttcgaaacagcgggttctgcggtcaccgttaaacaggcaccttatctggtaatgcgcggcggtaaaattatgattgttggtactgtacccggcgattcggcaatcaatttcctcaaaatcaatcgcgaagtcactatccagacggtattccgctatgccaatcgttatccggtcacgattgaagctatttcttcagggcgattcgatgtgaaatcgatggtgacgcatatttacgattatcgggatgtacaacaggcatttgaagagtcagttaacaacaaacgcgacattattaaaggcgttattaaaattagcgattaa

SEQ ID NO: 24553 - DNA, 1077 bp, Escherichia coli
atgaaagcactggctcggtttggcaaggcctttggcggctacaagatgattgatgtcccacaacccatgtgtggcccggaagatgtagtgattgaaattaaagccgcggcaatctgcggcgcagacatgaagcactacaatgtcgatagcggttctgatgagtttaactctatccgcggccatgagttcgcaggttgtattgcgcaggttggtgaaaaagtcaaagactggaaagtggggcaacgcgtcgtatcggataacagcggtcacgtttgcggtgtttgtccggcctgtgaacaaggtgattttctgtgttgtacagaaaaagtaaaccttggtctggataataatacctggggcggtggtttttccaaatattgtctggttcctggtgaaattctcaaaattcatcgtcatgcgttgtgggaaatccctgatggtgttgattatgaggacgcagccgtacttgaccctatctgtaatgcctacaaatccatcgcgcagcaatcgaaattccttcctggtcaggatgtggtcgtcatcggcactggcccactcgggctgttctccgtacaaatggcgcgaattatgggggcggtaaatatcgtcgtcgttggtctgcaagaagatgtggcggtccgcttcccggttgcaaaagaactgggtgcgacggcagtagtaaatggttctaccgaagatgtggtggcgcgctgccagcaaatttgtggcaaagacaatctgggactggtgattgaatgctccggtgccaatatcgcactgaaacaagccatcgaaatgctccgcccgaacggggaagtggtacgcgttggaatgggcttcaaacctcttgatttctcgattaatgacattaccgcctggaacaaaagcatcattgggcatatggcctatgactccacctcatggcgtaacgctatcaggctattagccagcggcgctatcaaagtcaaaccgatgatcacgcatcgtatcggcctgtcgcaatggcgcgaagggtttgatgcgatggtcgataaaaccgcaatcaaagtgatcatgacttacgactttgatgaataa

SEQ ID NO: 24554 - DNA, 996 bp, Escherichia coli
atgactatcaaagtaggtatcaacggttttggccgtatcggtcgcattgttttccgtgctgctcagaaacgttctgacatcgagatcgttgcaatcaacgacctgttagacgctgattacatggcatacatgctgaaatatgactccactcacggccgtttcgacggtaccgttgaagtgaaagacggtcatctgatcgttaacggtaaaaaaatccgtgttaccgctgaacgtgatccggctaacctgaaatgggacgaagttggtgttgacgttgtcgctgaagcaactggtctgttcctgactgacgaaactgctcgtaaacacatcaccgctggtgcgaagaaagtggttatgactggtccgtctaaagacaacactccgatgttcgttaaaggcgctaacttcgacaaatatgctggccaggacatcgtttccaacgcttcctgcaccaccaactgcctggctccgctggctaaagttatcaacgataacttcggcatcatcgaaggtctgatgaccaccgttcacgctactaccgctactcagaaaaccgttgatggcccgtctcacaaagactggcgcggcggccgcggcgcttcccagaacatcatcccgtcctctaccggtgctgctaaagctgtaggtaaagtactgccagaactgaatggcaaactgactggtatggcgttccgcgttccgaccccgaacgtatctgtagttgacctgaccgttcgtctggaaaaagctgcaacttacgagcagatcaaagctgccgttaaagctgctgctgaaggcgaaatgaaaggcgttctgggctacaccgaagatgacgtagtatctaccgatttcaacggcgaagtttgcacttccgtgttcgatgctaaagctggtatcgctctgaacgacaacttcgtgaaactggtatcctggtacgacaacgaaaccggttactccaacaaagttctggacctgatcgctcacatctccaaataa

SEQ ID NO: 24555 - DNA, 855 bp, Escherichia coli
atgcaacaaaaaatgattcaatttagtggcgatgtctcactgccagccgtagggcagggaacatggtatatgggcgaagatgccagtcagcgcaaaacagaagttgctgcactacgcgcgggcattgaactcggtttaaccctcattgataccgccgaaatgtatgccgatggcggtgccgaaaaggtggttggggaagcattaaccggtctgcgagagaaggtctttctcgtctctaaagtctatccgtggaatgctggcgggcaaaaagcgataaatgcatgcgaagccagtttacgccgtctcaatactgattatctcgatctttacttattacactggtctggcagtttcgcttttgaagagactgtcgcagcgatggaaaaattgatcgcccagggaaaaatccgccgctggggcgtttctaaccttgattatgctgatatgcaggaactctggcagctgccggggggaaatcagtgtgccactaatcaggtgctttaccatctcggttcacgaggaattgagtacgatctactcccctggtgccagcaacagcagatgccggtgatggcttacagtccgttagcccaggccgggcggttgcgcaatggactgttaaaaaacgcggtagtcaacgaaattgcacatgctcacaatatcagcgcggcacaagtattgttggcgtgggtgatcagtcatcagggtgtgatggcgattccaaaagcggccacgattgcccatgtccaacaaaatgcggctgtgcttgaggtcgaactttcttcagcggaattagctatgctggataaggcatatccggcaccaaaaggaaaaactgcgctggatatggtgtga

SEQ ID NO: 24556 - DNA, 1086 bp, Escherichia coli
atgatgaaaacgatgcgtattgctgcgatcccgggagacgggattggcaaagaagtccttcctgaagggattcgcgtgttacaggctgccgctgagcgctggggcttcgccttgagttttgagcaaatggagtgggcgagctgcgagtattacagccatcacggtaaaatgatgccggacgactggcatgagcaacttagccgtttcgacgccatctattttggtgccgtcggctggccggataccgttccggaccatatttcgttgtggggttcgctgctgaaatttcgtcgtgaattcgaccagtacgtcaacctgcgcccggttcgtctctttcctggcgttccctgcccgctggcgggaaaacagcctggcgacatcgatttttacgtggtcagggaaaacaccgaaggcgaatattcctcgctcggcggtagagtgaatgaaggtacagagcatgaagtcgtcattcaggaatcggtatttacccgccgtggtgtcgatcgcattttgcgttatgccttcgaacttgcgcaaagccgtccacgtaagacactaacttctgccactaaatcgaacggtttagccatcagcatgccgtactgggatgagcgagtggaagcaatggccgagaattacccggagatccgctgggacaagcagcatattgatattctctgcgcgcgttttgtgatgcagccggaacgattcgatgtggtggtggcgtccaatttgtttggcgatatcctttccgatcttggcccggcctgcaccggcaccattggcattgccccatccgccaacctgaatccggaacgcactttcccgtcgctcttcgagcctgtccacggttccgcgccggatatctacgggaaaaatattgctaaccctatcgccacgatttgggccggggcaatgatgctcgattttctcggcaatggcgatgagcgtttccagcaagcgcataacggtattctggcagcaattgaagaagtgattgctcacgggccgaaaacacctgatatgaaaggcaatgccaccacgccacaggttgccgacgcgatttgcaaaattattttgcgttaa

SEQ ID NO: 24557 - DNA, 1686 bp, Escherichia coli
ttgaagaaggtttggcttaaccgttatcccgcggacgttccgacggagatcaaccctgaccgttatcaatctctggtagatatgtttgagcagtcggtcgcgcgctacgccgatcaacctgcgtttgtgaatatgggggaggtaatgaccttccgcaagctggaagaacgcagtcgcgcgtttgccgcttatttgcaacaagggttggggctgaagaaaggcgatcgcgttgcgttgatgatgcctaatttattgcaatatccggtggcgctgtttggcattttgcgtgccgggatgatcgtcgtaaacgttaacccgttgtataccccgcgtgagcttgagcatcagcttaacgatagcggcgcatcggcgattgttatcgtgtctaactttgctcacacactggaaaaagtggttgataaaaccgccgttcagcacgtaattctgacccgtatgggcgatcagctatctacggcaaaaggcacggtagtcaatttcgttgttaaatacatcaagcgtttggtgccgaaataccatctgccagatgccatttcatttcgtagcgcactgcataacggctaccggatgcagtacgtcaaacccgaactggtgccggaagatttagcttttctgcaatacaccggcggcaccactggtgtggcgaaaggcgcgatgctgactcaccgcaatatgctggcgaacctggaacaggttaacgcgacctatggtccgctgttgcatccgggcaaagagctggtggtgacggcgctgccgctgtatcacatttttgccctgaccattaactgcctgctgtttatcgaactgggtgggcagaacctgcttatcactaacccgcgcgatattccagggttggtaaaagagttagcgaaatatccgtttaccgctatcacgggcgttaacaccttgttcaatgcgttgctgaacaataaagagttccagcagctggatttctccagtctgcatctttccgcaggcggtgggatgccagtgcagcaagtggtggcagagcgttgggtgaaactgaccggacagtatctgctggaaggctatggccttaccgagtgtgcgccgctggtcagcgttaacccatatgatattgattatcatagtggtagcatcggtttgccggtgccgtcgacggaagccaaactggtggatgatgatgataatgaagtaccaccaggtcaaccgggtgagctttgtgtcaaaggaccgcaggtgatgctgggttactggcagcgtcccgatgctaccgatgaaatcatcaaaaatggctggttacacaccggcgacatcgcggtaatggatgaagaaggattcctgcgcattgtcgatcgtaaaaaagacatgattctggtttccggttttaacgtctatcccaacgagattgaagatgtcgtcatgcagcatcctggcgtacaggaagtcgcggctgttggcgtaccttccggctccagtggtgaagcggtgaaaatcttcgtagtgaaaaaagatccatcgcttaccgaagagtcactggtgactttttgccgccgtcagctcacgggatacaaagtaccgaagctggtggagtttcgtgatgagttaccgaaatctaacgtcggaaaaattttgcgacgagaattacgtgacgaagcgcgcggcaaagtggacaataaagcctga

SEQ ID NO: 24558 - DNA, 1476 bp, Escherichia coli
atggcggtaacgcaaacagcccaggcctgtgacctggtcattttcggcgcgaaaggcgaccttgcgcgtcgtaaattgctgccttccctgtatcaactggaaaaagccggtcagctcaacccggacacccggattatcggcgtagggcgtgctgactgggataaagcggcatataccaaagttgtccgcgaggcgctcgaaactttcatgaaagaaaccattgatgaaggtttatgggacaccctgagtgcacgtctggatttttgtaatctcgatgtcaatgacactgctgcattcagccgtctcggcgcgatgctggatcaaaaaaatcgtatcaccattaactactttgccatgccgcccagcacttttggcgcaatttgcaaagggcttggcgaggcaaaactgaatgctaaaccggcacgcgtagtcatggagaaaccgctggggacgtcgctggcgacctcgcaggaaatcaatgatcaggttggcgaatacttcgaggagtgccaggtttaccgtatcgaccactatcttggtaaagaaacggtgctgaacctgttggcgctgcgttttgctaactccctgtttgtgaataactgggacaatcgcaccattgatcatgttgagattaccgtggcagaagaagtggggatcgaagggcgctggggctattttgataaagccggtcagatgcgcgacatgatccagaaccacctgctgcaaattctttgcatgattgcgatgtctccgccgtctgacctgagcgcagacagcatccgcgatgaaaaagtgaaagtactgaagtctctgcgccgcatcgaccgctccaacgtacgcgaaaaaaccgtacgcgggcaatatactgcgggcttcgcccagggcaaaaaagtgccgggatatctggaagaagagggcgcgaacaagagcagcaatacagaaactttcgtggcgatccgcgtcgacattgataactggcgctgggccggtgtgccattctacctgcgtactggtaaacgtctgccgaccaaatgttctgaagtcgtggtctatttcaaaacacctgaactgaatctgtttaaagaatcgtggcaggatctgccgcagaataaactgactatccgtctgcaacctgatgaaggcgtggatatccaggtactgaataaagttcctggccttgaccacaaacataacctgcaaatcaccaagctggatctgagctattcagaaacctttaatcagacgcatctggcggatgcctatgaacgtttgctgctggaaaccatgcgtggtattcaggcactgtttgtacgtcgcgacgaagtggaagaagcctggaaatgggtagactccattactgaggcgtgggcgatggacaatgatgcgccgaaaccgtatcaggccggaacctggggacccgttgcctcggtggcgatgattacccgtgatggtcgttcctggaatgagtttgagtaa

SEQ ID NO: 24559 - DNA, 1443 bp, Escherichia coli
atgtccagaaggcttcgcagaacaaaaatcgttaccacgttaggcccagcaacagatcgcgataataatcttgaaaaagttatcgcggcgggtgccaacgttgtacgtatgaacttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctgctgacgtcgtgcctggtgacatcctgctgctggacgatggtcgcgtccagttaaaagtactggaagttcagggcatgaaagtgttcaccgaagtcaccgtcggtggtcccctctccaacaataaaggtatcaacaaacttggcggcggtttgtcggctgaagcgctgaccgaaaaagacaaagcagacattaagactgcggcgttgattggcgtagattacctggctgtctccttcccacgctgtggcgaagatctgaactatgcccgtcgcctggcacgcgatgcaggatgtgatgcgaaaattgttgccaaggttgaacgtgcggaagccgtttgcagccaggatgcaatggatgacatcatcctcgcctctgacgtggtaatggttgcacgtggcgacctcggtgtggaaattggcgacccggaactggtcggcattcagaaagcgttgatccgtcgtgcgcgtcagctaaaccgagcggtaatcacggcgacccagatgatggagtcaatgattactaacccgatgccgacgcgtgcagaagtcatggacgtagcaaacgccgttctggatggtactgacgctgtgatgctgtctgcagaaactgccgctgggcagtatccgtcagaaaccgttgcagccatggcgcgcgtttgcctgggtgcggaaaaaatcccgagcatcaacgtttctaaacaccgtctggacgttcagttcgacaatgtggaagaagctattgccatgtcagcaatgtacgcagctaaccacctgaaaggcgttacggcgatcatcaccatgaccgaatcgggtcgtaccgcgctgatgacctcccgtatcagctctggtctgccaattttcgccatgtcgcgccatgaacgtacgctgaacctgactgctctctatcgtggcgttacgccggtgcactttgatagcgctaatgacggcgtagcagctgccagcgaagcggttaatctgctgcgcgataaaggttacttgatgtctggtgacctggtgattgtcacccagggcgacgtgatgagtaccgtgggttctactaataccacgcgtattttaacggtagagtaa

SEQ ID NO: 24560 - DNA, 2448 bp, Escherichia coli
ttgatcagggaggaagttatgacattaacaagacgtgaatttattaaacacagcggtattgccgctggagcgctggtggtgacatcggcagcaccgctccccgcatgggcagaagagaagggcggtaaaatcctcaccgcgggacgttggggagcgatgaacgtagaagtgaaggacggcaagattgtttcttcaacaggcgcgctggcgaaaaccataccgaattccttacagtctacggcggcggatcaggtacacaccacggcgcgtattcagcatccgatggtgagaaaaagctatctcgataatccactgcaaccggcgaaaggtcgtggcgaagatacctatgtacaggtgagctgggaacaggcattaaaactgattcatgagcaacatgatcgtattcgtaaagctaacggaccatcggccatttttgccggatcttacggctggcgctcttctggcgtgttgcataaagcgcaaaccttactgcaacgttatatgaacctggcgggcggttattccgggcatagcggcgattattcaaccggggcagcacaggtgatcatgccgcatgtggtcggttctgtagaggtgtatgaacagcagacctcctggccgctgattctggaaaacagccaggttgtggtgctgtggggaatgaacccgctgaataccttaaaaattgcctggagcagtaccgatgagcaagggctggaatacttccatcagctgaaaaaatctggcaaaccagtgattgccattgatcctatccgctccgaaaccatcgaattctttgacgataatgccacctggatcgcgccgaatatgggcaccgacgtggcactgatgttagggattgcgcataccctgatgacacaaggcaaacacgataaagtgttccttgaaaaatacactaccgggtatccgcagtttgaagagtatctgacaggtaagagcgataatacgccgaagagcgcggtctgggcggcggaaattactggcgtaccggaagcgcagatagtcaaactcgctgaactgatggcggcgaatcgcacaatgctgatggcaggctggggaattcagcgccagcaatatggtgaacagaaacactggatgctggtgacgctggcggcgatgttagggcagattggtacaccgggcggcggttttggtttctcttatcattactccaacggtggcaacccgacgcgtgttggcggcgtgctgccggaaatgtctgcggcgattgccggacatgccagcgaggccgctgatgatggcggaatgacggcgattcctgttgcccgtatcgtcgatgcgctggaaaatcctggcggcaaatatcagcataacggtaaagaacaaacgtatccgaatatcaaaatgatctggtgggcgggtggcggtaactttacccatcaccaggatactaatcgtctgattaaagcatggcagaaaccggagatgatcgtcgtttctgaatgctactggaccgcagcagccaaacacgcagatatcgtattaccgatcaccacatcgtttgagcgcaatgacttgacgatgaccggtgattacagcaaccagcatattgtgccgatgaagcaggctgttgctccgcaatttgaagcgcgtaacgattttgacgtgtttgccgatcttgcggaattactcaaacctggcggaaaagagatctataccgaaggtaaagatgaaatggcgtggctgaaatttttctatgatgccgctcagaaaggtgcccgtgcgcaacgcgtcactatgccaatgtttaatgccttctggcagcaaaataaactgatcgaaatgcgccacagcgagaagaacgaacagtacgttcgttatggtgatttccgcgccgatccggtgaaaaatgcgctgggtacgccaagcggcaaaattgaaatctattcaaaaacgttggaaaaatttggctataaggattgcccggcacacccaacctggctggctcctgatgaatggaaaggtaccgccgacgagaagcagttacagcttctgaccgcacatccggcacaccgtttacacagtcagcttaactatgcggaactgcgtaaaaaatatgcgatcgccgatcgtgaaccaatcactattcacaccgaagatgctgcacgctttggtattgcgaatggcgatctggtgcgtgtctggaacaaacgtggtcagattttgacaggcgcggtggtgactgacgggatcaaaaaaggcgtggtatgcgtgcatgaaggtgcatggccagatctggaaaatggcttgtgtaaaaacggcagtgcgaacgtgttaacggcggatatccccagctcgcagctggcaaatgcctgtgccggtaactcagcgttggtgtatatcgaaaaatatacgggcaatgcaccgaagttaacggcgtttgatcagccagctgttcaggcgtaa

SEQ ID NO: 24561 - DNA, 1425 bp, Escherichia coli
atgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtag

SEQ ID NO: 24562 - DNA, 801 bp, Escherichia coli
gtgacagaaccgttaaccgaaacccctgaactatccgcgaaatatgcctggttttttgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaa

SEQ ID NO: 24563 - DNA, 549 bp, Escherichia coli
atgcaatttaatatccctacgttgcttacactgttccgtgtcatccttatcccattctttgtattggtcttttatctgcctgtcacctggtcgccgtttgccgccgcgctcattttctgcgtcgcggcggtgactgactggttcgatggttttctggcacgccgctggaaccagagtacccggtttggtgctttccttgaccctgtggcagataaagttctcgtggctatcgccatggtgctggtaaccgagcattatcacagctggtgggtgacattaccggcggcaacgatgatcgcccgtgaaattattatttctgcgctacgcgaatggatggcggagttgggtaaacgcagtagcgtggccgtctcctggattgggaaagtgaaaaccactgcccagatggtggcgttggcatggctgctgtggcgtccgaacatttgggttgagtacgccggtattgcacttttctttgtggctgcggtactgactctgtggtcaatgttgcaatatttgagcgctgcgcgtgcagatttgcttgatcagtga

SEQ ID NO: 24564 - DNA, 1083 bp, Escherichia coli
atgacaaaaaagggcgctttcactagcgccttttttatttacgcgttttcagcgtgcataataagaaaatcacaacaacacacatcggaggctgttatgccactgcataatttaacccgttttccacggctggagtttatcggcgcgccaacgccgctcgaatatctgccgcgcttttctgattatctaggacgggaaattttcatcaaacgggatgacgtcacccccatggcaatgggcggcaataaattacgtaagctggaatttctcgcggcagatgctctgcgtgaaggtgccgatacgctgattactgccggggcgatccagtctaaccatgtgcggcagactgccgcagtcgctgccaaactcggtctgcactgcgtggcgctgctggaaaatcctattggcacaaccgcagaaaactatttaaccaacggcaatcgcttgttgctggatctgttcaatacccagattgaaatgtgcgacgcactgaccgatcccaatgcccaactggaagagctggcgacgcgagtcgaagcacaaggctttcgcccgtatgtcattccggttggcggttctaatgctcttggcgcgctaggttatgtggagagtgcgctggaaatcgcgcaacagtgtgaaggggcggttaatatttcatcggtggtagtcgcatcgggcagtgccggaactcacgccggactggctgttgggctggaacacctgatgcctgaaagcgaactgattggcgtgaccgtgtcgcgttccgttgccgatcaattgccgaaagtggttaacctacaacaggcgattgcgaaagaactggagctgaccgcatcagcggaaattttactctgggatgactattttgcacctggctacggcgtgccgaacgacgaaggcatggaagcagtgaaattgctggcgcggctggaaggcattctgcttgatcctgtgtataccggaaaagcgatggcggggctgattgacggtatcagtcagaaacgcttcaaagatgaagggccgattctgtttattcataccggcggtgcgcctgcgctgttcgcctatcatccccacgtttag

SEQ ID NO: 24565 - DNA, 1374 bp, Escherichia coli
atgaccacgcgcctgactcgctggctaaccacgctggataactttgaagccaaaatggcgcagttgcctgcggtacgtcgctacgggcgattaacccgcgctaccgggctggtgctggaagccaccggattacaattgccgctcggcgcaacctgtgtcattgagcgccagaacggcagcgaaacgcacgaagtagaaagcgaagtcgttggctttaacggtcaacggctgtttttaatgccgctggaggaagtcgaaggtgtcctgcccggcgcgcgtgtttatgccaaaaacatttcggcagaagggctgcaaagcggcaagcagttgccgctcggtccggcgttattaggtcgcgttctggacggcagcggtaaaccgctcgatggcctgccctcccccgatacgacggaaaccggtgcgctgattaccccgccatttaacccgttgcaacgtacaccgattgaacatgtgctggacaccggcgtgcgcccaatcaatgccctgcttaccgttgggcgtgggcagcgtatggggctgtttgccgggtccggcgttggtaaaagtgtgctgctggggatgatggcacgttacacccgcgccgatgtcattgtcgtgggtttgattggtgaacgtgggcgcgaagtaaaagattttattgagaacatcctcggtgccgaagggcgtgcacgctcagtggtgattgccgctccggcggatgtttctccgctcctgcgaatgcagggtgccgcctatgccacgcgcattgccgaagattttcgcgatcgtggtcagcatgtgttgctgattatggactccctcacccgctacgcgatggcccagcgtgaaattgcgctggcgattggcgaaccccccgccaccaaaggttatccaccgtcggtgtttgccaaattaccggcactggtcgagcgtgccggaaatggcattagcggcggcggctcgattaccgcgttttataccgtgctcactgaaggcgatgaccagcaggatccgattgccgactccgcgcgggcgatcctcgacggtcacattgtgctgtctcgccgactggcggaagccgggcactatccggctatcgatattgaagcgtcgatcagccgcgcaatgacggcgttgatcagtgagcaacattacgcgcgagtgcgcaccttcaaacagctgttgtcgagttttcagcgtaaccgcgatctggttagcgtcggcgcgtatgccaaaggcagcgatccgatgctcgataaagccatcgccctgtggccgcagctggagggctatttgcaacaaggcatttttgaacgcgcggactgggaagcgtctctccaggggctggagcgtattttcccgacagtgtcataa

SEQ ID NO: 24566 - DNA, 1365 bp, Escherichia coli
atgaccatgtcgcataacgttactccaaacacctctcgcgtggaattgcgtaaaacgcttacgttagttccggttgtaatgatgggtcttgcctatatgcagccgatgacgctgtttgatacttttggtatcgtttcaggcctcacggatggtcatgtgccgacagcctatgcgttcgcattgattgcgatcctgtttacggctctgagctacgggaagctggttcgccgctatccttctgctggctctgcatacacttacgcccagaaatccattagcccgactgtcggctttatggtgggttggtcttctctgctcgactatctgttcgcgccgatgatcaacattctactggcgaaaatctattttgaagctctggtgccttccatcccatcgtggatgtttgtggtggcgctggtggcctttatgaccgcctttaacctgcgtagtctgaaatccgtagcgaacttcaacactgtaatcgtcgtgttgcaggtagtgctgatcgcggtgattctgggcatggttgtttatggcgtatttgaaggtgaaggcgctggtacgctggcgagcactcgtccattctggtctggcgatgcgcatgttatcccgatgattaccggggcgacaatcctgtgcttctcctttaccggctttgacggcatcagcaacctgtcggaagaaaccaaagatgcagagcgcgtgatcccgcgtgcgattttcctgaccgcgctgatcggcggcatgatcttcatctttgcaacttacttcctgcagctgtacttcccggatatctctcgctttaaagatccggatgcgtcacagcctgaaatcatgctgtacgttgcgggtaaagcgttccaggttggcgcgctgatcttctccaccattaccgtactggcgtccggtatggcggcgcatgcaggcgtagcgcgtctgatgtacgtaatgggtcgtgacggcgtattcccgaaaagcttcttcggttatgtacacccgaaatggcgtactccggcgatgaacatcatcctggttggcgcgattgccctgctggcaatcaacttcgacctggtaatggcaacggcgctgattaactttggtgcgctggtggcgttcactttcgttaacctgtcggtcatctcgcagttctggatccgtgagaagcgtaacaagacgctgaaagatcacttccagtatctgttcctgccgatgtgtggtgcgctgaccgttggtgcgctgtgggttaacctggaagaaagctcaatggttctgggtctgatctgggctgctatcggtctgatttacctggcttgcgtcaccaagagcttccgtaatccggttccgcagtacgaagacgtagcataa

SEQ ID NO: 24567 - DNA, 1305 bp, Escherichia coli
atgagctttaacacaatcattgactggaatagctgtactgcggagcaacaacgccagctgttaatgcgcccggcgatttccgcctctgaaagcattacccgcactgttaacgatattctcgataacgtgaaagcacgcggcgatgaggccctgcgggaatacagcgcgaagtttgataaaaccacggttaccgcgctgaaggtgtctgcagaggagatcgccgccgccagcgaacgcctgagcgacgagctaaaacaggcgatggcggtggcagtaaagaatattgaaaccttccacactgcgcaaaaactgccgccggtagatgtagaaacgcagccaggcgtgcgttgccagcaggtcacgcgtccggtagcttcagttgggttgtatattcctggcggctccgccccgctcttctcaacggtattaatgctggcgactccggcgagtattgcgggctgtaaaaaagtggtgctgtgctcaccgccgccgattgccgatgagatcctttatgcggcgcagctgtgcggtgtgcaggacgtgtttaacgtcggcggcgcacaggccattgccgcactggcgtttggtacggaatctgtgccaaaagtggacaaaatcttcgggccgggtaacgcctttgtcaccgaagcgaaacgtcaggtgagccagcgtctggacggtgcggcgatcgatatgcccgcaggcccgtcggaagtgctggtgattgctgacagcggcgctacgccggatttcgtggcttctgatttgctctctcaggctgaacacggcccggactcacaggtgattttactgacgcccgctgctgatatggcgcgtcgcgttgccgaggccgtcgaacgccaactggcagaactgccgcgtgccgaaaccgcccgccaggcactgaacgccagccgcctgatcgtgactaaagatttagcgcagtgcgtggagatctccaaccagtacggcccggagcacctgatcattcagacccgcaacgcccgtgaactggtcgatagcatcaccagcgccggttcggtatttcttggtgactggtcaccggaatcggcaggtgattacgcctccggcaccaaccacgttctaccgacttacggttacaccgccacctgttccagcctcgggctggcagatttccagaagcgcatgaccgtacaggaactgtcgaaagaggggttctccgcgctggcttcaaccatagaaacactggccgccgccgagcgcctgaccgcccacaaaaatgccgttactttgcgtgttaacgcccttaaggagcaagcatga

SEQ ID NO: 24568 - DNA, 1071 bp, Escherichia coli
atgagcaccgtgactattaccgatttagcgcgtgaaaacgtccgcaacctgacgccgtatcagtcggcgcgtcgtctgggcggtaacggcgatgtctggctgaacgccaacgaataccccactgccgtggagtttcagcttactcagcaaacgctcaaccgctacccggaatgccagccgaaagcggtgattgaaaattacgcgcaatatgcaggcgtaaaaccggagcaggtgctggtcagccgtggcgcggacgaaggtattgaactgctgattcgcgctttttgcgaaccgggtaaagacgccatcctctactgcccgccaacgtacggcatgtacagcgtcagcgccgaaacgattggcgtcgagtgccgcacagtgccgacgctggacaactggcaactggacttacagggcatttccgacaagctggacggcgtaaaagtggtttatgtttgcagccccaataacccgaccgggcaactgatcaatccgcaggattttcgcaccctgctggagttaacccgcggtaaggcgattgtggttgccgatgaagcctatatcgagttttgcccgcaggcatcgctggctggctggctggcggaatatccgcacctggctattttacgcacactgtcgaaagcttttgctctggcggggcttcgttgcggatttacgctggcaaacgaagaagtcatcaacctgctgatgaaagtgatcgccccctacccgctctcgacgccggttgccgacattgcggcccaggcgttaagcccacagggaatcgtcgccatgcgcgaacgggtagcgcaaattattgcagaacgcgaatacctgattgccgcactgaaagagatcccctgcgtagagcaggttttcgactctgaaaccaactacattctggcgcgctttaaagcctccagtgcggtgtttaaatctttgtgggatcagggcattatcttacgtgatcagaataaacaaccctctttaagcggctgcctgcgaattaccgtcggaacccgtgaagaaagccagcgcgtcattgacgccttacgtgcggagcaagtttga

SEQ ID NO: 24569 - DNA, 1071 bp, Escherichia coli
ttgatgagtcagaagtatctttttatcgatcgcgatggaaccctgattagcgaaccgccgagtgattttcaggtggaccgttttgataaactcgcctttgaaccgggcgtgatcccggaactgctgaagctgcaaaaagcgggctacaagctggtgatgatcactaatcaggatggtcttggaacacaaagtttcccacaggcggatttcgatggcccgcacaacctgatgatgcagatcttcacctcgcaaggcgtacagtttgatgaagtgctgatttgtccgcacctgcccgccgatgagtgcgactgccgtaagccgaaagtaaaactggtggaacgttatctggctgagcaagcgatggatcgcgctaacagttatgtgattggcgatcgcgcgaccgacattcaactggcggaaaacatgggcattactggtttacgctacgaccgcgaaaccctgaactggccaatgattggcgagcaactcaccagacgtgaccgttacgctcacgtagtgcgtaataccaaagagacgcagattgacgttcaggtgtggctggatcgtgaaggtggcagcaagattaacaccggcgttggcttctttgatcatatgctggatcagatcgctacccacggcggtttccgcatggaaatcaacgtcaaaggcgacctctatatcgacgatcaccacaccgtcgaagataccggcctggcgctgggcgaagcgctaaaaatcgccctcggagacaaacgcggtatttgccgctttggttttgtgctaccgatggacgaatgccttgcccgctgcgcgctggatatctctggtcgcccgcacctggaatataaagccgagtttacctaccagcgcgtgggcgatctcagcaccgaaatgatcgagcacttcttccgttcgctctcatacaccatgggcgtgacgctacacctgaaaaccaaaggtaaaaacgatcatcaccgtgtagagagtctgttcaaagcctttggtcgcaccctgcgccaggccatccgcgtggaaggcgataccctgccctcgtcgaaaggagtgctgtaa

SEQ ID NO: 24570 - DNA, 777 bp, Escherichia coli
atgctggcaaaacgcataatcccatgtctcgacgttcgtgatggtcaggtggtgaaaggcgtacagtttcgcaaccatgaaatcattggcgatatcgtgccgctggcaaaacgctacgctgaagaaggcgctgacgaactggtgttctacgatatcaccgcttccagcgatggccgtgtggtagataaaagctgggtatctcgcgtggcggaagtgatcgacattccgttttgtgtggcgggtgggattaagtctctggaagatgccgcgaaaattctttcctttggcgcggataaaatttccatcaactctcctgcgctggcagacccaacattaattactcgcctggccgatcgctttggcgtgcagtgtattgtggtcggtattgatacctggtacgacgccgaaaccggtaaatatcatgtgaatcaatataccggcgatgaaagccgcacccgcgtcactcaatgggaaacgctcgactgggtacaggaagtgcaaaaacgcggtgccggagaaatcgtcctcaatatgatgaatcaggacggcgtgcgtaacggttacgacctcgaacaactgaaaaaagtgcgtgaagtttgccacgtcccgctgattgcctccggtggcgcgggcaccatggaacacttcctcgaagccttccgcgatgccgacgttgacggcgcgctggcagcttccgtattccacaaacaaataatcaatattggtgaattaaaagcgtacctggcaacacagggcgtggagatcaggatatgttaa

SEQ ID NO: 24571 - DNA, 612 bp, Escherichia coli
atgttaacagaacaacaacgtcgcgaactggactgggaaaaaaccgacggacttatgccggtgattgtgcaacacgcggtatccggcgaagtgctaatgctgggctatatgaacccggaagccttagacaaaaccctcgaaagcggcaaagtcaccttcttctcgcgcactaaacagcgactgtggaccaaaggcgaaacgtcgggcaatttcctcaacgtagtgagtattgccccggactgcgacaacgacacgttactggtgctggcgaatcccatcggcccgacctgccacaaaggcaccagcagttgcttcggcgacaccgctcaccagtggctgttcctgtatcaactggaacaactgctcgccgagcgcaaatctgccgatccggaaacctcctacaccgccaaactgtatgccagcggcaccaaacgcattgcgcagaaagtgggtgaagaaggcgtggaaaccgcgctggcagcaacggtacatgaccgctttgagctgaccaacgaggcgtctgatttgatgtatcacctgctggtgttgttgcaggatcaggggctggatttaacgacggtaattgagaacctgcgtaaacggcatcagtga

SEQ ID NO: 24572 - DNA, 1167 bp, Escherichia coli
atgaaaatcaccatttccggtactggctatgtaggcttgtcaaacgggcttctaatcgcacaaaatcatgaggttgtggcattagatattttaccgtcacgcgttgctatgctgaatgatcggatatctcctattgttgataaggaaattcagcagtttttgcaatcagataaaatacactttaatgccacattagataaaaatgaagcctaccgggatgctgattatgtcatcatcgccactccaaccgactatgatcctaaaactaattatttcaatacatccagtgtagaatcagtaattaaagacgtagttgagataaatccttatgcggttatggtcatcaaatcaacggttcccgttggttttaccgcagcgatgcataagaaatatcgcactgaaaatattatattctccccggaatttctccgtgagggtaaagccctttacgataatctccatccttcacgtattgtcatcggtgagcgttcagaacgcgcagaacgtttcgctgctctgttacaggaaggcgcgattaagcaaaatatcccgatgctgtttaccgactccactgaagcagaagcgattaaactttttgcaaacacctacctggcgatgcgcgtggcgtactttaacgaactggatagctatgcagaaagtttaggtctgaattcccgtcaaataatcgaaggcgtttgtctcgacccacgtattggcaaccattacaacaatccgtcgtttggttatggtggttattgtctgccgaaagataccaagcagttactggcgaactaccagtctgtgccgaataacctgatctcggcaattgtcgatgctaaccgcacgcgtaaagattttattgccgatgccattttgtcacgcaagccgcaagtggtgggtatttatcgtctgattatgaagagcggttcagataacttccgtgcgtcttctattcaggggattatgaaacgtatcaaggcgaaaggtgttgaagtgatcatctacgagccagtgatgaaagaagactcattcttcaactctcgcctggaacgtgatctcgccaccttcaaacaacaagccgacgtcattatctctaaccgaatggcagaagagcttaaggatgtggcagataaggtatacacccgcgatctctttggcagcgactaa

SEQ ID NO: 24573 - DNA, 1407 bp, Escherichia coli
atgtccaagcaacagatcggcgtagtcggtatggcagtgatgggacgcaaccttgcgctcaacatcgaaagccgtggttataccgtctctattttcaaccgttcccgtgagaagacggaagaagtgattgccgaaaatccaggcaagaaactggttccttactatacggtgaaagagtttgtcgaatctctggaaacgcctcgtcgcatcctgttaatggtgaaagcaggtgcaggcacggatgctgctattgattccctcaaaccatatctcgataaaggagacatcatcattgatggtggtaacaccttcttccaggacactattcgtcgtaatcgtgagctttcagcagagggctttaacttcatcggtaccggtgtttctggcggtgaagagggggcgctgaaaggtccttctattatgcctggtggccagaaagaagcctatgaattggtagcaccgatcctgaccaaaatcgccgccgtagctgaagacggtgaaccatgcgttacctatattggtgccgatggcgcaggtcactatgtgaagatggttcacaacggtattgaatacggcgatatgcagctgattgctgaagcctattctctgcttaaaggtggcctgaacctcaccaacgaagaactggcgcagacctttaccgagtggaataacggtgaactgagcagttacctgatcgacatcaccaaagatatcttcaccaaaaaagatgaagacggtaactacctggttgatgtgatcctggatgaagcggctaacaaaggtaccggtaaatggaccagccagagcgcgctggatctcggcgaaccgctgtcgctgattaccgagtctgtgtttgcacgttatatctcttctctgaaagatcagcgtgttgccgcatctaaagttctctctggtccgcaagcacagccagcaggcgacaaggctgagttcatcgaaaaagttcgtcgtgcgctgtatctgggcaaaatcgtttcttacgcccagggcttctctcagctgcgtgctgcgtctgaagagtacaactgggatctgaactacggcgaaatcgcgaagattttccgtgctggctgcatcatccgtgcgcagttcctgcagaaaatcaccgatgcttatgccgaaaatccacagatcgctaacctgttgctggctccgtacttcaagcaaattgccgatgactaccagcaggcgctgcgtgatgtcgttgcttatgcagtacagaacggtattccggttccgaccttctccgcagcggttgcctattacgacagctaccgtgctgctgttctgcctgcgaacctgatccaggcacagcgtgactattttggtgcgcatacttataagcgtattgataaagaaggtgtgttccataccgaatggctggattaa

SEQ ID NO: 24574 - DNA, 882 bp, Escherichia coli
atgaaaatgcgtaaaggtattattttagcgggtggttctggtacacgtctttatcctgtgactatggctgtcagtaaacagctattacctatttatgataaaccgatgatctattacccgctctctacactgatgttggcgggtattcgcgatattttgattatcagtacacctcaggatactcctcgttttcaacaattgctgggtgacggtagccagtggggcctgaatcttcagtacaaagtgcaacctagcccagatggcctcgcgcaggcatttatcatcggtgaagagtttattggtggtgatgattgtgctttggttcttggtgataatatcttttacggtcacgatctgccgaagctaatggaggccgctgttaacaaagaaagtggtgcaacggtatttgcctatcacgttaatgatccagaacgctatggtgtcgttgagtttgataaaaacggtacggcaatcagtctggaagaaaaaccgttagaaccaaagagtaattacgccgttacaggtctgtacttttatgataacgacgtggttcagatggcgaaaaacttgaagccgtctgcacgtggtgagttagaaattacagatattaaccgtatttatcttgagcagggacgtctgtctgtcgcgatgatggggcgtggctacgcgtggctggacacggggactcatcagagtctgatagaagcaagtaattttattgcgacaattgaagagcgccagggattgaaggtttcctgtcctgaagagattgcatttcgtaaaggttttattgatgttgagcaagtaagaaaattagctgtaccactaataaagaataattatgggcagtatctttataaaatgacgaaggattcaaattaa

SEQ ID NO: 24575 - DNA, 894 bp, Escherichia coli
atgacgaatttaaaagcagttattcctgtagcgggtctcgggatgcatatgttgcctgccactaaggcgatacccaaagagatgctaccaatcgtcgacaagccaatgattcagtacattgttgacgagattgtggctgcagggatcaaagaaatcctcctggtaactcacgcgtccaagaacgcggtcgaaaaccacttcgacacctcttatgagttagaatcactccttgagcagcgcgtgaagcgtcaactgctggcggaagtacagtccatctgtccgccgggcgtgaccattatgaacgtgcgtcagggcgaacctttaggtttaggccactccattttgtgtgcgcgacctgccattggtgacaacccatttgtcgtggtactgccagacgttgtgatcgacgatgccagcgccgacccgctacgttacaaccttgctgccatgattgcacgtttcaacgaaacgggccgcagccaggtgctggcaaaacgtatgccgggtgacctctctgaatactccgtcatccagactaaagagccgctggaccgtgagggtaaagtcagccgcattgttgaatttatcgaaaaaccggatcagccgcagacgctggactcagacatcatggccgtaggtcgctatgtgctttctgccgatatttggccggaactggaacgtactcagcctggtgcatggggacgtattcagctgactgatgctattgccgagctggcgaaaaaacaatccgttgatgcaatgctgatgaccggcgacagttacgactgcggcaaaaaaatgggctatatgcaggcgtttgtgaagtatggcctacgcaacctgaaagaaggggcgaagttccgtaaaggtattgagaagctgttaagcgaataa

SEQ ID NO: 24576 - DNA, 1371 bp, Escherichia coli
atgaaaaaattaacctgctttaaagcctatgatattcgcgggaaattaggcgaagaactgaatgaagatatcgcctggcgcattggtcgcgcctatggcgaatttctcaaaccgaaaaccattgtgttaggcggtgatgtccgcctcaccagcgaaaccttaaaactggcgctggcgaaaggtttacaggatgcgggcgttgacgtgctggatattggtatgtccggcaccgaagagatctatttcgccacgttccatctcggcgtggatggcggcattgaagttaccgccagccataatccgatggattataacggcatgaagctggttcgcgagggggctcgcccgatcagcggagataccggactgcgcgacgtccagcgtctggctgaagccaacgactttcctcccgtcgatgaaaccaaacgcggtcgctatcagcaaatcaacctgcgtgacgcttacgttgatcacctgttcggttatatcaatgtcaaaaacctcacgccgctcaagctggtgatcaactccgggaacggcgcagcgggtccggtggtggacgccattgaagcccgctttaaagccctcggcgcgcccgtggaattaatcaaagtgcacaacacgccggacggcaatttccccaacggtattcctaacccactactgccggaatgccgcgacgacacccgcaatgcggtcatcaaacacggcgcggatatgggcattgcttttgatggcgattttgaccgctgtttcctgtttgacgaaaaagggcagtttattgagggctactacattgtcggcctgttggcagaagcattcctcgaaaaaaatcccggcgcgaagatcatccacgatccacgtctctcctggaacaccgttgatgtggtgactgccgcaggtggcacgccggtaatgtcgaaaaccggacacgcctttattaaagaacgtatgcgcaaggaagacgccatctatggtggcgaaatgagcgcccaccattacttccgtgatttcgcttactgcgacagcggcatgatcccgtggctgctggtcgccgaactggtgtgcctgaaagataaaacgctgggcgaactggtacgcgaccggatggcggcgtttccggcaagcggtgagatcaacagcaaactggcgcaacccgttgaggcgattaaccgcgtggaacagcattttagccgtgaggcgctggcggtggatcgcaccgatggcatcagcatgacctttgccgactggcgctttaacctgcgcacctccaataccgaaccggtggtgcgcctgaatgtggaatcgcgcggtgatgtgccgctgatggaagcgcgaacgcgaactctgctgacgttgctgaacgagtaa

SEQ ID NO: 24577 - DNA, 1122 bp, Escherichia coli
atgtcaaaagtcgctctcatcaccggtgtaaccggacaagacggttcttacctggcagagtttctgctggaaaaaggttacgaggtgcatggtattaagcgtcgcgcatcgtcattcaacaccgagcgcgtggatcacatttatcaggatccgcacacctgcaacccgaaattccatctgcattatggcgacctgagtgatacctctaacctgacgcgcattttgcgtgaagtacagccggatgaagtgtacaacctgggcgcaatgagccacgttgcggtctcttttgagtcaccagaatataccgctgacgtcgacgcgatgggtacgctgcgcctgctggaggcgatccgcttcctcggtctggaaaagaaaactcgtttctatcaggcttccacctctgaactgtatggtctggtgcaggaaattccgcagaaagagaccacgccgttctacccgcgatctccgtatgcggtcgccaaactgtacgcctactggatcaccgttaactaccgtgaatcctacggcatgtacgcctgtaacggaattctcttcaaccatgaatccccgcgccgcggcgaaaccttcgttacccgcaaaatcacccgcgcaatcgccaacatcgcccaggggctggagtcgtgcctgtacctcggcaatatggattccctgcgtgactggggccacgccaaagactacgtaaaaatgcagtggatgatgctgcagcaggaacagccggaagatttcgttatcgcgaccggcgttcagtactccgtgcgtcagttcgtggaaatggcggcagcacagctgggcatcaaactgcgctttgaaggcacgggcgttgaagagaagggcattgtggtttccgtcaccgggcatgacgcgccgggcgttaaaccgggtgatgtgattatcgctgttgacccgcgttacttccgtccggctgaagttgaaacgctgctcggcgacccgaccaaagcgcacgaaaaactgggctggaaaccggaaatcaccctcagagagatggtgtctgaaatggtggctaatgacctcgaagcggcgaaaaaacactctctgctgaaatctcacggctacgacgtggcgatcgcgctggagtcataa

SEQ ID NO: 24578 - DNA, 861 bp, Escherichia coli
atgaaaatgtacgtggtatcgacaaagcagatgctgaacaacgcacagcgcggcggttatgcggttccggcattcaatattcacaatctcgaaacgatgcaagtggtggtagaaaccgctgccaacctgcatgcgccggtcatcatcgccggaacgcctggcacatttactcatgctggtacagaaaatctgttggcgctggtcagcgcgatggcgaagcaatatcaccatccactggcaattcatctcgaccatcacacgaaatttgacgatatcgctcagaaggttcgttctggcgtgcgctcagtcatgattgacgcctcgcatttgccttttgcgcaaaatatttcacgggtcaaagaggtggtggatttttgccatcgctttgatgtcagcgtcgaggcggagctggggcaacttggcggccaggaagatgatgtgcaagtcaatgaagccgatgcgttgtacaccaaccccgctcaggcgcgtgaatttgccgaggcaaccggaattgattccctggcggtcgccatcggcacggctcatgggatgtatgccagcgcaccggcgcttgatttttctagactggagaacattcgccagtgggtgaacttaccgctggtgctgcatggcgcgtcagggttatcgactaaggatattcagcaaaccatcaaactggggatatgcaaaatcaacgttgcaacggagctgaaaaatgccttctcgcaggcgttaaaaaattacctgaccgagcaccctgaagcgaccgatccccgggattatttgcagtcggctaaatccgcaatgcgcgatgtggtgagcaaagtgattgccgattgtggctgcgagggcagggcataa

SEQ ID NO: 24579 - DNA, 966 bp, Escherichia coli
atgagcggcgctcgattacacacgctgctgcctgaattaaccacgcgtcagtcggtgatggtcgtcggcgcggcggtcattgacgtgatcgccgacgcttatgccctcccctggcgtgggtgcgatatcgaactgaaacagcagagcgttaacgttggcggctgcgcactgaatattgccgtggcgttaaagcgcctcggcatcgaagcgggtaatgccttgccgctcggtcagggcgtgtgggcggagatgattcgcaaccggatggcaaaagagggcttaatcagcctgatcgataacgccgaaggtgataacggctggtgtctggcgctggttgagccggatggcgaacgcacttttatgtcattcagcggtgttgaaaatcagtggaatcgccagtggctggcgcgattaaccgttgcgcctggcagcctgctctatttttccggttatcaactggcctcgccctgcggcgaattgttagtggaatggctggaagagctgcaagacgtgacgccgtttatcgattttggcccacgtattggcgatatcccggatgcattactggcgcggatcatggcctgtcgacctttagtgtcgctcaatcgtcaagaggctgagattgccgccgaacgttttgctttatccgcagagataacaacacttggcaagcaatggcaggagaaatttgccgcgccgttgatcgttcgtctcgataaagaaggcgcatggtatttcagcaacgacgcttctggctgcattccggcatttccaacgcaagttgtcgacaccattggggcgggcgacagtcatgccggtggcgtacttgccgggctggcctctggtctgccactggcggatgccgtattactgggcaatgcagtggcgtcgtgggttgtcgggcatcggggcggtgattgtgcgccaacgcgcgaggaactactcctcgcacacaaaaacgtatag

SEQ ID NO: 24580 - DNA, 927 bp, Escherichia coli
atgattgaatttagccatgtcagcaaactgttcggcgcacaaaaagccgttaacgatctcaatctcaattttcaggaagggagtttttcggtgctgattggcacatctggctccggcaaatccaccaccctgaaaatgattaaccgcctggtggagcatgacagcggagagatccgctttgccggagaagaaattcgctcgctgccagtactggagttgcgccgccggatgggctatgccattcaatctattggcctgttcccccactggagcgtggcgcaaaacatcgctaccgtgccgcaattacaaaaatggtcgcgggcgcggattgacgatcgtatcgacgaattaatggcgctactggggctggagtcaaatttgcgtgagcgttatccgcatcagctttccggtggtcagcagcaacgtgtgggagtggcgcgtgcactggctgccgatccgcaagtcttactaatggatgaaccttttggcgcactggacccggtaacgcgcggcgcgttgcaacaagagatgacgcgcattcaccgtttgctggggcgtaccattgtgctggtcactcatgatattgatgaggcgctacggctggcagaacatctggtattgatggatcacggtgaagtagtgcagcagggcaatccgctgacgatgctgactcgtccggcgaatgattttgtccgccagttttttggacgtagtgaactgggtgtgcgcctgctttcgttacgtagtgtggcggattacgtgcgtcgcgaagaacgagcagatggtgaggcactggcagaagagatgacgctacgcgatgcgctctctctgtttgttgcgcggggatgcgaggtgctgccggtggtgaacatgcagggccagccttgcggcacgctgcattttcaggatctgctggtggaggcgtaa

SEQ ID NO: 24581 - DNA, 762 bp, Escherichia coli
atggcacaggttgcgattattaccgcctccgattcggggatcggcaaagagtgcgcgttattactggcgcagcaggggtttgatattggtattacctggcactcagatgaagaaggggcaaaagataccgcgcgtgaggtagttagccacggcgtacgtgcggagatcgtgcagctggatctcggcaatctaccagaaggggcactggcgctggagaaactcattcaacggctggggcgcattgatgtgctggtgaataatgcgggtgcaatgaccaaagcgccgtttcttgatatggcttttgatgagtggcgcaagatttttaccgttgatgtcgatggtgcattcttatgctcgcaaattgcggctcgtcagatggtgaaacaagggcagggcggtcgcatcatcaacattacgtcggtacatgaacatacgccgctgccggatgccagcgcctacacagccgctaaacatgcgctcggtgggttaaccaaagcgatggcgctggagctggtcaggcataagattttggtgaacgcagtcgcgcctggggcgatcgccacgccaatgaatggcatggatgacagcgacgtgaagcccgacgcggagccttcgattcccttgcggcgttttggcgcaacgcatgagattgccagcctggtggtgtggctttgttcggagggcgcaaattacaccaccgggcagtcgttgatagtggatggcggctttatgttggcgaatccacagttcaacccagaatag

SEQ ID NO: 24582 - DNA, 1242 bp, Escherichia coli
ttgctcatgttaacgaaagatctttcgattactttttgcggcgtgaagtttcccaacccgttctgcctctcttcttcgccggtaggcaactgctatgagatgtgtgccaaagcctacgacacaggttggggcggtgtggtgtttaaaacgatcggcttttttatcgccaacgaagtctcgccgcgttttgatcatctggtgaaagaagataccggttttatcggcttcaaaaatatggagcagattgctgaacatccgttggaagagaatctggccgccctgcgtcggctgaaggaagattacccggacaaagtattgatcgcttcgatcatgggggaaaatgagcagcaatgggaggagctggcgcgcctggtgcaagaagctggcgcggatatgatcgagtgtaacttctcctgtccgcaaatgacttctcatgcgatgggtagcgatgtcgggcaaagcccggagctggtagaaaaatattgtcgggcagtgaaacggggttccacgctgccaatgctggcgaagatgacgccgaatatcggtgatatgtgcgaagtggcgctggcggcgaagcgcggcggcgcagatggcattgcggcgattaacaccgttaaatccatcaccaatatcgatcttaatcagaaaatcggtatgccgatcgttaacggaaaatcgagtatttccggatattccggtaaagcggtaaaaccgatcgccctgcgcttcattcagcaaatgcgcacccatccagaactgcgcgatttcccaatcagcggtatcggcggcattgaaacctgggaggatgcggctgagtttttattgctcggcgcagcaacgttacaggtgaccaccggcatcatgcagtacgggtatcggatagtggaagatatggcaagcgggttgtcgcattatctcgccgatcagggatttgattcgctgcaggagatggtaggtctggcgaataacaatattgtcccggcggaagatttagaccgcagttatattgtctatccccgtatcaatcttgataaatgtgttggctgtggacgctgttatatttcctgttacgacggcggtcaccaggcgatggaatggagcgagaaaacccgcacaccgcattgtaataccgagaaatgtgtgggttgtctgctttgtggtcacgtctgcccggtgggttgtattgagctcggggaagtgaagtttaagaaaggcgagaaagaacacccggtaacgttgtaa

SEQ ID NO: 24583 - DNA, 1521 bp, Escherichia coli
atggtcagctcaacgactccgtcctccggggaatacttgttggaaatgagcggtatcaacaagtcctttcctggtgttaaggcacttgataacgttaatttaaaagtccggccacattctatccatgcattaatgggggaaaacggtgcaggaaaatcgacattattaaaatgcctgtttggtatttatcaaaaagactccggcaccattttattccagggtaaagagatcgatttccattctgcaaaagaagccctggaaaatggtatttcgatggtacaccaggagttaaacctggtattacaacgttcggtgatggataacatgtggctggggcgatatcccaccaaaggcatgtttgtcgatcaggacaaaatgtaccgcgaaaccaaagcgatttttgacgaactggatattgatatcgatccgcgtgcgcgcgtcggcacattatccgtttcgcaaatgcagatgatcgaaatcgccaaagcgttttcctataacgcgaaaattgtgattatggatgaaccgacttcttcgttaaccgaaaaagaggtcaatcatctgttcactattattcgtaaattaaaagagcgcggctgcggtattgtttatatctcgcataaaatggaagaaatcttccagttatgtgatgaagttaccgtattgcgcgacggtcagtggatcgccaccgaaccgctggcaggactgacgatggacaagatcatcgccatgatggttgggcgttctcttaaccagcgtttccctgacaaagaaaacaaaccgggcgaagtcatcctcgaggtacgtaacctgacgtcactgcgccagccgtcgattcgcgatgtctcgtttgatctgcataaaggggagatcctcggtattgccggtctggtgggggcgaaacgtaccgatattgttgagacgttatttggtattcgcgagaaatcggctggcaccataacgttgcacggcaaacagatcaataaccataatgccaacgaagccataaaccatggatttgcactggtaactgaggagcgccgctcaacgggaatttatgcctatctggatattggttttaactcgttaatttccaatattcgcaactacaaaaataaagttggtttactggataactcgcggatgaaaagcgatacccagtgggtgattgattcgatgcgggtaaaaacgccgggtcatcggacgcaaattggttcgctctccggtggtaatcagcaaaaggtgattattggtcgctggctactaacgcaaccagaaatattaatgctcgatgaaccgacgcgcggtattgatgtcggggcgaagtttgaaatttatcagttaattgccgaactggcgaagaaaggcaaggggattattattatctcctctgaaatgcctgagttgttagggataacagaccgtattctggtcatgagcaatggtctcgtttccggaattgtcgatacaaaaacaacaacgcaaaacgaaattctgcgtcttgcgtctttgcacctttaa

SEQ ID NO: 24584 - DNA, 669 bp, Escherichia coli
atgccatcactcagtaaagaagcggccctggttcatgaagcgttagttgcgcgaggactggaaacaccgctgcgcccgcccgtgcatgaaatggataacgaaacgcgcaaaagccttattgctggtcatatgaccgaaatcatgcagctgctgaatctcgacctggctgatgacagtttgatggaaacgccgcatcgcatcgctaaaatgtatgtcgatgaaattttctccggtctggattacgccaatttcccgaaaatcaccctcattgaaaacaaaatgaaggtcgatgaaatggtcaccgtgcgcgatatcactctgaccagcacctgtgaacaccattttgttaccatcgatggcaaagcgacggtggcctatatcccgaaagattcggtgatcggtctgtcaaaaattaaccgcattgtgcagttctttgcccagcgtccgcaggtgcaggaacgtctgacgcagcaaattcttattgcgctacaaacgctgctgggcaccaataacgtggctgtctcgatcgacgcggtgcattactgcgtgaaggcgcgtggcatccgcgatgcaaccagtgccacgacaacgacctctcttggtggattgttcaaatccagtcagaatacgcgccacgagtttctgcgcgctgtgcgtcatcacaactga

SEQ ID NO: 24585 - DNA, 1470 bp, Escherichia coli
atggtttccgaaactaaaaccacagaagcgccgggcttacgccgtgaattaaaggcgcgtcacctgacgatgattgccattggcggttccatcggtacaggtctttttgttgcctctggcgcaacgatttctcaggcaggtccgggcggggcattgctctcgtatatgctgattggcctgatggtttacttcctgatgaccagtctcggtgaactggctgcatatatgccggtttccggttcgtttgccacttacggtcagaactatgttgaagaaggctttggcttcgcgctgggctggaactactggtacaactgggcggtgactatcgccgttgacctggttgcagctcagctggtcatgagctggtggttcccggatacaccgggctggatctggagtgcgttgttcctcggcgttatcttcctgctgaactacatctcagttcgtggctttggtgaagcggaatactggttctcactgatcaaagtcacgacagttattgtctttatcatcgttggcgtgctgatgattatcggtatcttcaaaggcgcgcagcctgcgggctggagcaactggacaatcggcgaagcgccgtttgctggtggttttgcggcgatgatcggcgtagctatgattgtcggcttctctttccagggaaccgagctgatcggtattgctgcaggcgagtccgaagatccggcgaaaaacattccacgcgcggtacgtcaggtgttctggcgaatcctgttgttctatgtgttcgcgatcctgattatcagcctgattattccgtacaccgatccgagcctgctgcgtaacgatgttaaagacatcagcgttagtccgttcaccctggtgttccagcacgcgggtctgctctctgcggcggcggtgatgaacgcagttattctgacggcggtgctgtcagcgggtaactccggtatgtatgcgtctactcgtatgctgtacaccctggcgtgtgacggtaaagcgccgcgcattttcgctaaactgtcgcgtggtggcgtgccgcgtaatgcgctgtatgcgacgacggtgattgccggtctgtgcttcctgacctccatgtttggcaaccagacggtatacctgtggctgctgaacacctccgggatgacgggttttatcgcctggctggggattgccattagccactatcgcttccgtcgcggttacgtattgcagggacacgacattaacgatctgccgtaccgttcaggtttcttcccactggggccgatcttcgcattcattctgtgtctgattatcactttgggccagaactacgaagcgttcctgaaagatactattgactggggcggcgtagcggcaacgtatattggtatcccgctgttcctgattatttggttcggctacaagctgattaaaggaactcacttcgtacgctacagcgaaatgaagttcccgcagaacgataagaaataa

SEQ ID NO: 24586 - DNA, 1089 bp, Escherichia coli
atgaataaccgggaaaaggagatccttgcaattttacggcgtaacccgctgattcagcagaacgaaattgcggacatgctgcaaatcagccgttcgcgcgttgcggcgcatattatggatttaatgcgcaaaggccggattaaaggcaaaggttacattctcaccgagcaggaatactgcgtagtggtggggacaatcaatatggatattcgcgggatggcggatatccgttacccgcaatcggcttctcatcccggtacaattcattgctcagcgggcggcgtgggacgcaacatcgcccacaatctggcgctgttaggccgtgacgtccatttgctttcagtgattggcgatgacttttatggcgaaatgctcctggaagaaacgcgccgtgccggcgtgaatgtctccggctgcgttcgtttgcatggtcaaagcacatcgacgtatctggcaattgccaatcgagacgatcaaaccgtgctggcgattaacgatacccatctgctggaacagttgacaccgcaactactgaacgggtcgcgcgatttacttcgtcatgcgggcgtggtactggctgattgcaacctgacagccgaggcgctggaatgggtctttaccctcgctgatgaaatcccggtgtttgtcgataccgtttcagaattcaaagcgggcaaaatcaaacactggctggcgcatattcacaccctgaaacccactttaccggagctggaaattttatggggacaggcgatcaccagcgatgctgaccgtaataccgcagtgaatgcattgcatcagcaaggtgttcagcaactgtttgtttatttgcccgatgagtcagtttattgcagcgaaaaggatggagaacaatttttgctgaccgcgccagcgcatacgacagtagacagttttggtgctgacgatggttttatggcgggcctggtatatagctttcttgaaggatacagtttccgcgacagcgcccgttttgcggtagcctgcgcggcaatttcgcgcgccagcggcagcttaaacaaccctaccctgtctgccgataacgcgctttcattagtgccaatggtgtaa

SEQ ID NO: 24587 - DNA, 942 bp, Escherichia coli
atgcgcgaaaaggattatgtcgtaattataggttcggcgaatattgatgtcgccggatattcacatgaatcattaaattatgcggattcaaatccaggtaaaataaaatttacgcctggtggagtagggcgcaatattgcacaaaacctggcgttgctgggtaacaaagcctggctactgagcgccgtaggcagtgatttttatggtcaatcgctgctaacgcaaaccaatcaatctggcgtttatgtcgataaatgcctgattgtgccgggagaaaatacgtcgagttatttatcattactcgataataccggtgaaatgctggttgctataaatgacatgaatattagcaacgctattacagctgaatatctcgcacagcacggtgaatttattcagagggcaaaggtcattgtcgcggactgtaatatcagtgaagaggcactggcatggattctggataatgccgccaacgtacccgtatttgtcgatccggtttcggcatggaaatgtgtcaaagtgcgcgaccgtctaaatcagatccacactctcaagccaaaccgccttgaagcggaaaccctgagtgggattgcgctgtcagggcgtgaagatgtggcaaaagttgctgcctggttccatcaacatggcctgaaccgactggtattgagcatgggcggcgacggcgtttattacagcgatatcagcggtgaaagtggctggtctgcgccgatcaaaaccaatgttattaatgttaccggagcgggcgatgccatgatggcgggacttgcttcgtgttgggtagacggaatgccgtttgccgaatctgttcgtttcgcacagggatgttcgtcaatggcgctctcctgtgaatacaccaataaccccgatttatcgattgccaacgttatatcgttagtggagaacgcagaatgtctgaattaa

SEQ ID NO: 24588 - DNA, 2487 bp, Escherichia coli
atgaaactcagtcgtcgtagctttatgaaagctaacgccgttgcggccgctgcggcggctgccggtctcagcgtgccgggcgttgcccgcgccgttgttggtcagcaggaagccatcaaatgggataaagcgccgtgccgtttctgcggtactggttgcggcgttctggtcggaacgcagcagggacgtgtggtggcctgtcagggcgacccggacgcaccggttaaccgtggcctgaactgcattaagggctatttcctgcccaaaatcatgtacggtaaagaccgtttgacgcagccgctgctgcgtatgaaaaacggtaaatatgacaaagaaggcgaatttaccccaatcacctgggatcaggccttcgatgtgatggaagagaaattcaaaaccgccctgaaagaaaaagggccggaatcgatcggtatgttcggttctggtcagtggactatctgggaaggttatgccgcgtccaagctgtttaaagcgggcttccgttcgaacaacatcgacccgaacgcgcgtcactgtatggcgtcggcagtagttggctttatgcgtacctttggtatggatgagccgatgggctgctatgacgacatcgagcaggctgacgcgtttgtgctgtggggcgcaaacatggcggaaatgcacccgatcctctggtcgcgcatcactaaccgtcgtctctctaaccagaacgtcaccgtggcggtgctttctacctaccagcatcgtagcttcgagctggcggataacggcatcatctttacgccgcaatctgacctggtgatcctgaactacatcgccaactatatcattcaaaacaatgcgataaatcaggacttcttcagcaagcacgttaacctgcgcaaaggggcgacggacatcggctacggtttacgtccgacccatccgctggaaaaagcagcgaagaatccgggttctgacgcctccgaaccgatgagctttgaagattacaaagccttcgttgccgagtatacgctggaaaaaactgccgaaatgaccggcgtgccgaaagaccagttagaacaactggcgcagctgtatgccgatccgaacaagaaagtcatctcctactggacgatgggcttcaaccagcatactcgtggcgtgtgggctaacaacctggtctacaacctgcacctgctgaccggcaaaatttcccagccgggttgcggtccgttctccctgaccgggcaaccttctgcgtgtggtactgcgcgtgaagtgggcacctttgctcaccgtctgcctgcggacatggtggtgaccaacgagaaacaccgtgatatctgcgagaagaagtggaatatcccgagcggcaccattccggcgaaaatcggtctgcacgcggtggcacaagaccgtgcgctgaaagacggcaaactgaatgtttactggaccatgtgtaccaacaacatgcaggccgggccgaacatcaatgaagagcgtatgccgggctggcgcgatccgcgcaacttcatcatcgtctccgatccgtatccgacagtcagtgcgctggccgccgacttgatcctgccgaccgcaatgtgggtagagaaagagggcgcttacggtaacgccgaacgccgtactcagttctggcgtcaacaggtacaggcaccgggcgaagcgaaatcggatctctggcagttagtccagttctcccgccgcttcaaaactgaagaagtatggccggaagatctgctggcgaagaaaccggaactgcgtggcaaaacgctgtacgaagtgctgtatgccacaccggaagtgagcaaattcccggtatccgaactggcggaagatcagctgaacgatgaatcccgcgagctgggcttctatctgcaaaaagggctgttcgaagagtacgcatggtttggtcgcggtcacggtcacgatctggcaccgttcgatgactaccacaaagcgcgcggtctgcgctggccggtggtgaacggtaaagaaacgcagtggcgttacagcgaaggtaacgacccgtacgtgaaagcgggcgaaggctataagttctacggtaaaccggatggcaaagcggtgatcttcgcactgccattcgaaccggcggcggaagcaccggatgaagagtacgacctgtggctctctaccggacgcgttctggagcactggcacaccggcagtatgactcgccgtgtaccagaactgcaccgcgccttcccggaagcggtcctgtttattcacccgctggatgcgaaagcgcgcgatctgcgccgtggcgacaaagtgaaagtggtttctcgccgtggcgaagtgatctcgattgttgaaacgcgcggtcgtaaccgtccgccacagggcctggtgtacatgccgttcttcgacgccgcacagttggttaacaaactgacgctggatgcgaccgatccgctctcgaaagagacggacttcaagaagtgcgcggtcaaactggagaaggtgtaa

SEQ ID NO: 24589 - DNA, 1185 bp, Escherichia coli
atgaaaaattgtgtcatcgtcagtgcggtacgtactgctatcggtagttttaacggttcactcgcttccaccagcgccatcgacctgggggcgacagtaattaaagccgccattgaacgtgcaaaaatcgattcacaacacgttgatgaagtgattatgggtaacgtgttacaagccgggctggggcaaaatccggcgcgtcaggcactgttaaaaagcgggctggcagaaacggtgtgcggattcacggtcaataaagtatgtggttcgggtcttaaaagtgtggcgcttgccgcccaggccattcaggcaggtcaggcgcagagcattgtggcggggggtatggaaaatatgagtttagccccctacttactcgatgcaaaagcacgctctggttatcgtcttggagacggacaggtttatgacgtaatcctgcgcgatggcctgatgtgcgccacccatggttatcatatggggattaccgccgaaaacgtggctaaagagtacggaattacccgtgaaatgcaggatgaactggcgctacattcacagcgtaaagcggcagccgcaattgagtccggtgcttttacagccgaaatcgtcccggtaaatgttgtcactcgaaagaaaaccttcgtcttcagtcaagacgaattcccgaaagcgaattcaacggctgaagcgttaggtgcattgcgcccggccttcgataaagcaggaacagtcaccgctgggaacgcgtctggtattaacgacggtgctgccgctctggtgattatggaagaatctgcggcgctggcagcaggccttacccccctggctcgcattaaaagttatgccagcggtggcgtgccccccgcattgatgggtatggggccagtacctgccacgcaaaaagcgttacaactggcggggctgcaactggcggatattgatctcattgaggctaatgaagcatttgctgcacagttccttgccgttgggaaaaacctgggctttgattctgagaaagtgaatgtcaacggcggggccatcgcgctcgggcatcctatcggtgccagtggtgctcgtattctggtcacactattacatgccatgcaggcacgcgataaaacgctggggctggcaacactgtgcattggcggcggtcagggaattgcgatggtgattgaacggttgaattaa

SEQ ID NO: 24590 - DNA, 2286 bp, Escherichia coli
atgaatcagaatctgctggtgacaaagcgcgacggtagcacagagcgcatcaatctcgacaaaatccatcgcgttctggattgggcggcagaaggactgcataacgtttcgatttcccaggtcgagctgcgctcccacattcagttttatgacggtatcaagacctctgacatccacgaaaccattatcaaggctgccgcagacctgatctcccgtgatgcgccggattatcagtatctcgccgcgcgcctggcgatcttccacctgcgtaaaaaagcctacggccagtttgagccgcctgcgctgtacgaccacgtggtgaaaatggtcgagatgggcaaatacgataatcatctgctggaagactacacggaagaagagttcaagcagatggacacctttatcgatcacgaccgtgatatgaccttctcttatgctgccgttaagcagctggaaggcaaatatctggtacagaaccgcgtgaccggcgaaatctatgagagcgcccagttcctttatattctagttgccgcgtgcttgttctcgaactacccgcgtgaaacgcgcctgcaatatgtgaagcgtttttacgacgcggtttccacatttaaaatttcgctgccgacgccaatcatgtccggcgtgcgtaccccgactcgtcagttcagctcctgcgtactgatcgagtgcggtgacagcctggattccatcaacgccacctccagcgcgattgttaaatacgtttcccagcgtgccgggatcggcatcaacgccgggcgtattcgtgcgctgggtagcccgattcgcggtggtgaagcgttccataccggctgcattccgttctacaaacatttccagacagcggtgaaatcctgctctcagggcggtgtgcgcggcggtgcggcaacgctgttctacccgatgtggcatctggaagtggaaagcctgctggtgttgaaaaacaaccgtggtgtggaaggcaaccgcgtgcgtcatatggactacggggtacaaatcaacaaactgatgtatacccgtctgctgaaaggtgaagatatcaccctgttcagcccgtccgacgtaccggggctgtacgacgcgttcttcgccgatcaggaagagtttgaacgtctgtataccaaatatgagaaagacgacagcatccgcaagcagcgtgtgaaagccgttgagctgttctcgctgatgatgcaggaacgtgcgtctaccggtcgtatctatattcagaacgttgaccactgcaatacccatagcccgtttgatccggccatcgcgccagtgcgtcagtctaacctgtgcctggagatagccctgccgaccaaaccgctgaacgacgtcaacgacgagaacggtgaaatcgcgctgtgtacgctgtctgctttcaacctgggcgcaattaataacctggatgaactggaagagctggcaattctggcggttcgtgcacttgacgcgctgctggattatcaggattacccgatcccggccgccaaacgtggagcgatgggtcgtcgtacgctgggtattggtgtgatcaacttcgcttactacctggcgaagcacggtaaacgctactccgacggcagcgccaacaacctgacgcataaaaccttcgaagccattcagtattacctgctgaaagcctctaatgagctggcgaaagagcaaggcgcgtgcccgtggtttaacgaaaccacttacgcgaaagggatcctgccgatcgatacctataagaaagatctggataccatcgctaatgagccgctgcattacgactgggaagctctgcgtgagtcaatcaaaacgcacggtctgcgtaactccacgctttctgctctgatgccgtccgagacttcttcgcagatctctaacgccactaacggtattgaaccgccgcgcggttacgtcagcatcaaagcgtcgaaagacggtattttgcgccaggtggtgccggactacgagcacctgcacgacgcctatgagctgctgtgggaaatgccgggtaacgatggttatctgcaactggtgggtatcatgcagaaatttatcgatcagtcgatctctgccaacaccaactacgatccgtcacgcttcccgtcaggaaaagtgccgatgcagcagttgctgaaagacctgctcaccgcctacaaattcggggtcaaaacactgtattatcagaacacccgtgacggcgctgaagacgcacaagacgatctggtgccgtcaatccaggacgatggctgcgaaagcggcgcatgtaagatctga

SEQ ID NO: 24591 - DNA, 1131 bp, Escherichia coli
atggcatataccaccttttcacagacgaaaaatgatcagctcaaagaaccgatgttctttggtcagccggtcaacgtggctcgctacgatcagcaaaaatatgacatcttcgaaaagctgatcgaaaagcagctctctttcttctggcgtccggaagaagttgacgtctcccgcgaccgtatagattaccaggcgctgccggagcacgaaaaacacatctttatcagcaacctgaaatatcagacgctgctggattccattcagggtcgtagcccgaacgtggcgctattgccgcttatttctattccggaactggaaacctgggtcgaaacctgggcgttctcagaaacgattcattcccgttcctatactcatatcattcgtaatatcgttaacgatccgtctgttgtgtttgacgatatcgtcaccaacgagcagatccagaaacgtgcggaagggatctccagctattacgatgagctgatcgaaatgaccagctactggcatctgctgggcgaaggtacccacaccgttaacggtaaaactgtgaccgttagcctgcgcgagctgaagaaaaaactgtatctctgcctgatgagcgttaacgcgctggaagcgattcgtttctacgtcagctttgcttgttccttcgcatttgcagaacgcgaattgatggaaggcaacgccaaaattattcgcctgattgcccgcgacgaagccctgcacctgaccggcacccagcatatgctgaatctgctgcgcagcggcgcggacgatcctgagatggcggaaattgccgaagagtgtaagcaggagtgctatgacctgtttgttcaggcagctcaacaggagaaagactgggcggattatctgttccgcgacggttcgatgattggtctgaataaagacattctctgccagtacgttgaatacatcaccaatatccgtatgcaggcagtcggtttggatctgccgttccagacgcgctccaacccgatcccgtggatcaacacttggctggtgtctgataacgtgcaggttgctccgcaggaagtggaagtcagttcttatctggtcgggcagattgactcggaagtggacaccgacgatttgagtaacttccagctctga

SEQ ID NO: 24592 - DNA, 1986 bp, Archaeoglobus fulgidus
gtgatggttttggagataaggaacgttgccgttataggcgccggctcgatggggcatgcaattgccgaggttgttgcaatacacggattcaacgtgaaactgatggacgtgagcgaggatcagctgaagagggcgatggaaaaaattgaggaggggctcaggaagagctacgagagaggctacatttcagaagatcctgaaaaggtgctgaaaagaattgaggccacagctgatctaatagaggttgcaaaggatgcggacctcgtcatcgaagcaattccggagatattcgacctcaaaaagaaggttttcagcgagatagagcagtactgccctgaccacacaatattcgccaccaacacatcctctctgagcataacgaagctcgccgaagccaccaagagaccggagaagtttataggaatgcacttcttcaaccctcctaagattctgaagctcctcgaaatagtgtggggagagaagacgagcgaggaaacaataaggattgtggaggactttgcaagaaaaatcgacagaataatcatacacgtcaggaaggacgttccgggattcattgtaaacagaatcttcgtcacgatgtccaacgaggcttcttgggctgttgagatgggtgagggaacaatcgaggagatcgactcggcggtcaagtacagactcggccttcccatgggacttttcgagcttcacgacgttcttggtgggggcagcgttgatgtgagctaccacgtccttgagtactaccgccagactcttggagaatcataccgcccgtctccactattcgagaggcttttcaaggccggccattacggaaagaaaaccggtaagggcttctacgactggagcgagggtaaaacaaatgaagttcccctgagggcgggagcaaacttcgatttgctcaggctcgttgctccagcagtaaacgaggcggcatggctgatagagaagggcgttgcgagtgcggaggagatagacctcgccgttctgcacgggctaaactatccgaggggattgctgaggatggcagatgatttcggcatagacagcatcgtgaagaagctgaatgagctttacgaaaagtacaacggggaggagaggtacaaagtcaatccggttctgcagaaaatggttgaagaggggaagcttggcaggacgactggcgagggattctacaagtatggtgacggcaactacgagttcgtaaaggttgagaaggaagggaaagtaggggttctgaagctcaacagaccgaggagagccaacgcgctcaatccaaccttcctgaaggaggtggaggacgctcttgacctgctggaaagagatgaggaggtcagggcaatcgtgattgctggagagggtaagaacttctgcgcaggagcggacatagcgatgttcgcttcaggaagacctgagatggtcacggagttcagccagctcggacataaagtattcaggaagattgagatgctctccaagcccgtaatcgccgcaattcacggtgctgcggttggtgggggatttgagctggcgatggcttgcgacctaagggtgatgagcgaaagggcgtttctcggcttaccggagcttaacctcggaatcattccggggtggggaggaacgcagaggctggcctactacgtcggagtttcgaagctgaaagaggtcattatgctgaagaggaacataaagcctgaggaggcgaagaacctcggtctggttgccgaggtcttcccgcaggaaagattctgggatgaagtgatgaaactcgccagggaggttgcggagctgccgccgcttgcagtgaagtacctcaagaaggtaatagctctcggcacgatgccggcacttgagacgggcaaccttgccgagtcggaagctggtgcggtcattgccctgacagacgacgttgctgagggaatacaggcctttaactaccgcagaaagcctaatttcagggggaggtga

SEQ ID NO: 24593 - DNA, 1176 bp, Archaeoglobus fulgidus
gtgggagcagggataacgaactttggcagaagggaggcaagctggaaggaccttgtggttgaggctggcaaagcgctgttcgacgacgttccgaacctcgacaaaaaagacgttgattcatttttcataggtgcagcccagcccgaaaggtggacataccagactcacgtcgcgccgcttgctgctgagctgctcggaataaagccgaggagagttgttgccagaaccgaatcagcctgcgcgagcggtcagattgcaataaggtacgcatggctcgcagtcgcttctgggctgagtgacgttgccgtggtagtcggggttgagaagatgaacaccaagttcatgaatctaagccagaccagcatgatgaacgtcggaaacagggagttcgatactgcaatgggtctgacggccccaccatacttcgcaatggtcgcccagaggcacatgcacctctacggcacgactgaggatcagatggctttggtaagggagaaggctggagagtatgcttcggccaatccctacgcacagtttcagaaaaaaatcagcaaggaggacgttcttaacagcaggatggttgccccgcctctcaagctcctcgactgcagcggaattaccgacggtgctgctgctctgctcataaccaccgaggagaaagcgagaaagttcaccgacacgcccgtatggattctcggagggattcagagaacgatggccaactcaatcaacgagatgggtgagatgagcgactggctgtcgctgcgatacctggcgaaggacgtttacgatctcttcaacatcactcccgacgacatagacgttgcagaggtgcacgactgcttcaccatcagcgaaatcatggagtacgaggagctcggattctgcaagaaaggagagggcggaaagttcattgaagaggggcagagctacatcgggggaaaggtggcggtgaatcccagcggaggactgctggccaacggccatcctctcggcgccacgggagtgaggcaggcgtgggagatggtcatgcagttcagaggagaggtgcctgataagagatacgtcagcggtgcggagcttggccttgcccacaacctcagcggaatggcgcagttccaccacataatgctgtacagcctgaacaggccgagagaggttaagttcgggaggtga

SEQ ID NO: 24594 - DNA, 1251 bp, Archaeoglobus fulgidus
gtgttgtgtatggctgaatggccgatggacagacctgagttgagaaccatcataacgacctacagcgttccagagtcgaagcttctgctgaactcattcatcatgccgaagaccttctacgggttggccggtttgcagatgtttgctggagccatggtgcagttcggaagaaggagggctttcatagtcaccgataagggagtgagagcccttgctctgacagtgcaaaaaatgcttaagggtgtcggcattgaagtcgagattttcgacgaagcgaagcctgaggtgccgttgagctcgataaagcccgctgcagaaaaaatggaagccctccagcccgacttgattgtggcagttggtggtggaagcgttatggacatggcgaaggcctcgtggattctctacgaggctccgcagacagacctgacaaacgtcgatgcgatgcagccgatcgggctgaggagaaaggcgtttctggcgtgcatcccaacaactgccggaacgggaagcgaggcaacaaacgttgcggtcattacagatgacactgtggagccgcacaggaaagagggtgttgtgcatcctgagctttatcctgacttcgccgtcctcgacccgcgatttgttttgaaaatgcctccgaatctcacacttgggacggggctggatgccctgtcgcatgcagttgactgctacctctgcaggtcgagcaacgaaatttccgacgctctggcggtgagagcgacaaagctcgttttcaagtacctcccgttagccctgaagtaccccgacaacccgcagatcaggctcaaaactcagattgccgccatgattgcaggttcagccttttcgaacggcggaataggaacgacccacgcagttgcgcacaacataggcgcgctcttcgaggttcaccacggtatggcgtgtggggttacaataccctacgtcatcaagttctacgcggaggtggatgataagtacctcagctttgccgaggagcttggcgtgagaggaggcagcaacgaagaaacgctgaaaaagctcatagacattttcatggacttctacaggaaaataggggcaccaacgactatgagagaccttggcataaaagaggatgacttcaaggagaagctcgacaccttcgcacagtacgttgttaaagacccaacagggcccttcgctccgaggcagcttactgttgaggaggcgaaggagttgttgatggatatgtattatgggaggttgtga

SEQ ID NO: 24595 - DNA, 1254 bp, Archaeoglobus fulgidus
gtgttgaatgtgatgcagaggtggagagaaccttcagactgctgtttgagaagaacaggttcagatactacggctggaaggcccgcctgccgaggtgatatcatgagagaggttgcggttataggttgtggtgttacgaagttcgggcaccactgggagaaagaccacgaggatttgctggttgaggcaacgtatgaggctatagcagatgcaaatgtcgagcttaaggatgttgaggctgtttggtgcggaaccttctacccctcaaccggaataagcggaaacgtcttcagcgacacgctgaagttcttcggcaagccgataagcagagttgagaactactgcgcaacgggaatggacaacatcagaaatgccgcctttgccgttgcgagcggggcttacgatttggttattgctgctggggttgagaagctgatggatgctggaagcaggggactgccgccaatagagggaattttcagcgttgcgatgccctacgtcagcgctccggcaatgttcgcaatggcggcaaacagggccttcaaggagtggggatggacaagggaagatctggcaatggttgcggtgaagaaccactacaatggagcgaggcatcccaaggcacacttcagaagcgaggtaacagtggagaaggttctgaaagcccctatggttgcttacccgcttggcgtttacgactgcagcgctgtgagcgatggtgctgctgccgttgtcctcacaaggcctgagatagcgaaggagattgttggggatgactatgctgttataaaggctgtgggaatggctgtggagacgatgcacccttggcaccgcccttcggagagcttcctgagttttccagcgacggttaaggctgcgaagatggcttacaagatggcgggaattgagaatccgagaaaggagcttgacttcggcattgtccacgactgcttcacaataacggagctaatcaactatcaggacatgcagctatgcaagcccggagagggggctgagctgataagaaacggcgttacggcgattgatggcgacttccccatcaaccccgatggggggctcaagtccttcggccacccaatagctgccagcggggtgaggatggttgcagagctgacaaagcaggttctcggcaaggctgaggggctgcaggtgaaggatgctgaggcaggcttcgcccacaacctcggagggccttactcagttgccaccgtagcgatagtttcgaggccctaa

SEQ ID NO: 24596 - DNA, 651 bp, Archaeoglobus fulgidus
atggacttcgatgagaaaaggaggatccttgcagaaaggctgagggacgagctaaacctgagcgaaaaagtttacaacgcaataaaaaaagttccgaggcatctcttcgttccagaacgctatagaactatggcttacgtcgatacacctttgccaataggctatgggcagacgataagcgctccacacatggttgcgatcatgtgcgaactcctagatctgagagaaggggaaagagttctcgaaattggaacgggttgcggttatcatgctgctgttacagctgagatcgttggaaaaagaggactcgtagtttccgtggagagaattccggagctagcggagattgcgaagaggaatttatccgctcttggctacgagaacgtagtagttatcgttggcgatggcagcctgggctatgaaccgatggcgccatacgataagatatacgtcacagcatcagcgccagacattccgaagccgcttttagaacagctcaaaattggtggaaaaatggttattccaatcggagaaactactcagtttctctacgttgttgaaagggacaacggggttcgaaaatggagctggggggctgttaggttcgtcccgctttacggaaagtatggctttagacctcttgaggagtag

SEQ ID NO: 24597 - DNA, 714 bp, Archaeoglobus fulgidus
atgatagaggctgaggggatatcgaagaagttcagaataccaagcgagaaaaggtttacgttatttgaagagctctcagcattttttaaaggtaaaagagatttcgtagagttctgggcactcagggatgtaagcttcagagtaaaaaaaggcgaaacattcggaatcttcggaccaaatggctcgggcaaatccacgatcctcaagataattgccggaattctttatcctgacactggtagtttaagtgtttctggaaaggtcacaccaattcttgagctcggtgtgggcttcaatccagagttaacggctaaggagaacgtttacctttacggagtcattatgggtatgagtaaggaggaaataagaagtaagattgaagaaatcttcaggtttgcagaacttgaaaagttcaaaaacatgaagctcaagaactactcatctggtatgtatgcaaggctagcattcgcaacagcagtagcaactgagcctgaaattctcctgatcgacgaagttctagccgtcggtgatatctatttccaaagaaagtgtataggcagaattagggagttaaaacagaatggaaccacgatagtcctcgtttcccattctccaaatactttactggagttgtgcgatagagtcatgttgatcgaggctggaactgtaaaagctataggtgaacctggaaaagtacttgagggctatctttaa

SEQ ID NO: 24598 - DNA, 591 bp, Archaeoglobus fulgidus
atgctcatcgctgtcgagggcattgacggggcgggaaaaacaaccattgctgcttacattgcagaactgctcaaagaaaagggatacaaagtcaaggtgcttaaagagccgggcgacagcaaattcgggaaaaaaataaagagttctgaggagagactctcgcccgaggaggagcttgagctttttttgaaggacagggagattgacgcgagggagaacatacttcccgcattgcagagcgggtatgctgtcgtcatggacaggtactacttctcaaacatagcttatcagtcagcgaggggcattgacgcaaggctgatcagggaaatgaacgaaaaaattgctcctaaacctgatttaacgatacttctcgacgtagagccggagatagcgcttgagagggtcaggaagaggggcaaactttcacctttcgagaagctggattatctcagaaaagttaggaaatgctttcttgagaacgcagacgagacgacagtcgtcgtcgatgcgtcaaaaccgctcgaggaagtcaaagaggaggtaaggaaggtgattgagagctttttaaacctcaagaagaactctaattaa

SEQ ID NO: 24599 - DNA, 1128 bp, Archaeoglobus fulgidus
atggactggatcgagagggagaaaaagcacattctgcaaacatatacaaggcagaaggtggtcattgaaagaggagagggttgttacgtttacgacgtcaacggaaaaaggtatttggacctggttgcaggaatagcgacggtgagcataggccactgtaacagccacctcgttgagaggctgaaagagcagctcgaaaagctaatccacatttcgaacctttactacaccacccctcaggtagagctagcagagaaattgagcgaaattgcaggaatggacaggttcttcttctgcaacagcggagcggaggctgttgaggctgccctgaagttcgcaaggagggccactggaagaaagaagttcgtttcctttaccggtgactttcacggcagaacgatgggggctctgtctgtcacgcacaaggagaagttcaggaaaccgtttgagcctctggtaagccccgttgagttcgccgagttcaacaatccagagagtctggagaaggtggtggatgaagaaaccgctgccgtcattgtagagctcgtgcagggcgaggctggagtttatccggctgatagggagtttgtgaaagcgattgaggagcttagggaaaaatacggatttctgctcatagttgacgaggtccagacgggcttcggaaggactggcaggtggtttgccaaggaccactacggcattgagccggacatgataacgatggcaaaggcaatgggctcaggagtgccgatagggtgctgcgcattgaaggaggaggttgctgagaagatacaggtaggagaccacggttcaaccttcggcggaaaccctctggcctgcactgcagcactggcgacgattgaagtcatcgagagagaggggctggtggagaactcagccaggatgggcgagtatttcgttaagaggctgaaggagagctttgagaacgtcatcggagtgggactcatgattgggtttgacgtaggagatgcggctgaattcgtcaggaagtgccttgaaaatggattgctggtcaacaacacctccgaaaggaggattcgcttggtgccgcctctcgtaattacggaaagagaggttgataaagctgttgaaataatgctgaattaa

SEQ ID NO: 24600 - DNA, 1629 bp, Archaeoglobus fulgidus
atggagttgaagtacaaaatcggatttccaagtttgtattacccaaaaatctcgttggcggacagaatagatgcagcagccgaaaaatttggggaaaagacggcaataatttctgcagaaccaaaattcccttctgagtttcctgaaagtatgaattttctggagatatgtgaggttacgaaaaagctcgccagcggcatctcgaggaaaggagtgaggaaaggggagcacgttggtgtgtgcatacctaactctatcgattacgttatgacaatctacgctctctggagagttgctgcaactcccgttccgataaaccccatgtacaagtcgtttgaattagagcacatcctgaacgacagcgaagctacaacgctggtcgttcacagtatgctctacgagaatttcaaacctgttcttgaaaagacaggagttgaaagagttttcgttgtcggtggtgaggtaaacagcttgtcagaagttatggattccggcagtgaggattttgaaaacgtgaaggtgaatcccgaagaggatgtggcactgattccctatacgggcggcacaactggaatgccgaagggtgtgatgctcacacactttaatttagctgcaaacgccttacagcttgccgtagctacagggctttcgcacatggacacgattgtgggctgcatgccaatgttccattcagcggagtttggactggtcaatttgatggttaccgtcggtaacgagtatgttgtgatgggaatgtttaaccaggagatgctggctgagaacattgaaaagtacaagggcacattttcatgggccgttcctccagcgctcaacgtgctcgtcaacactcttgaaagttcgaataaaacctatgactggagctatctgaaggtctttgctacgggtgcctggcctgttgctcccgctctggttgaaaagcttctgaaactggctgctgaaaagtgtaacaatcctcgcctcaggcacaatcaaatctggggaatgaccgaggcatgtccgatggttacgacgaatcctcctttgagactcgacaagagcacgacacagggcgttccaatgtctgatatagaactcaaggttatttcgcttgaggatggcagagaacttggtgttggggagagtggtgagatagttatcagaggtccgaacattttcaaagggtactggaagagggagaaggaaaatcaggagtgctggtggtacgatgagaagggaagaaagttcttcagaaccggggatgttgggtttattgatgaagagggatttctgcactttcaggatagagtaaaggaagtcatcaagtacaagggttatacaatcgcaccgtttgaacttgaagctctgttgatgaagcacgaggctgttatggacgttgcagttataggaaagccggatgaggaggctggagaagttccaaaggcattcatagttctcaagccagaatacaggggaaaggttgacgaagaggacataatagagtgggtaagagagaggatttcgggttataaaagagtaagggaagttgaatttgttgaagagctacccagaacggcgtcgggaaaacttctcaggaggttgctgagagagaaggaggccgaaaagggttga

SEQ ID NO: 24601 - DNA, 900 bp, Archaeoglobus fulgidus
gtgatgaggcacctcatttctatcggcgaccttgatagggaggacataaactacattctcaaaaaagctgaagagtttgaggatgttgcgaggggggagaaaaagctgagaattcttgagggcaaaatactcggaaacctcttcttcgagccttcaacaagaaccagaatgagttttgaaacagcgatgaagaggcttgggggagatgtcatcaacatgaccgctcaggaggcgagcagcattgcaaagggagaaacgcttgcagacaccatcagagttgtctctggatactgcgatgctatcgtcataaggcacccgctcgaaggagcggcgaggtttgctgcagagaactcatccgtgccggtcatcaacgcaggcgatggagctggccagcatccaacccaaacgctccttgacctctacaccatcaaaaaggagtgcgggaggcttgatggtataaccattgctcttatgggtgacctcaagtactcaaggacgatacactccctgataaaggccctcgccctctttgatatgagaatttacctcatcagcccggaagcactcgctttacctgaggacataattgaagatgttagtgcggaaatcaggagggcaaggctggaggaggtaatctccgagatagatgtcctttatgttacaagaatacagaaggagcgctttccggatgaggaggagtacaggaaggtttccggcagctaccgcatcactgcggagacattaaagagcgccaaggacagcatgattgtgatgcaccccctgccgagggttgacgaaattcacccatccgttgactccacaaagcatgcccgctacttccagcagtccttttacggagttcctgtgagaatggcgatactcagcgaggtgatgctgtga

SEQ ID NO: 24602 - DNA, 462 bp, Archaeoglobus fulgidus
gtgagggagcttgttgtaagcaaaataaaggaggggaccgttatagaccacatcaacgcaggaaaagccctacttgtcttgaaaatactgaaaattcagcccggcacagatttgacggtctcaatggccatgaacgtcccgagcagcaagatggggaagaaggacattgtcaaggtagaggggatgtttattcgggatgaagagttaaacaaaatcgccctgatttcaccaaacgcaacaataaacctgataagagattacgagatagagaggaagttcaaggtaagccctcctgaggtggtggagggagtgctcaaatgccccaaccacgcctgcatttccaatgctgaaagggagccgataacacccaagttttacatcaaaacggaagaaatgagggcaacggcaaggtgccactactgcgggaggaaaatagaaaatcttgataattacataagctaa

SEQ ID NO: 24603 - DNA, 681 bp, Archaeoglobus fulgidus
atgaaagttctgattctccgtccggctgagctgctcagcgagacgattaggaggttccgcgaggagggattcgacgcctacggatgccccttcataaagctaatctacacagatttcgatgttccggagcacgacttcgcgatagttacgagccagaatgctgcgcgagttttgagggagaggggtgtcaggctgaaaagagtaatagccatcggcaaaaaaaccgctgagctaatagaggctgaggaagtgcttttgccctcaaaattcgactccgagaccctttacgaagaatttgctgaaatgcttaggggaaaaagggtggtggccttcaggagcaatgctggcagtgaggcagtaaaaagactgtcggaagtggcagatttcagggaaatccaggtttacagaatcgaaaagctgcagggagaggagcagagaagagaggttgagaaggttagagagggattttatgatgcaattgttttctcaagcagcatgatagcgagaagccttcttgagctgtgcgatgaaaaatgcttagaggcccttaagaacatcttcgttgtagccatcggccctcccacggcaaaggttttggctgaaaagggtataagggcggagataccggaagagtacacatttgatggggtgatagagcttttaaagtccaagaagatgtag

SEQ ID NO: 24604 - DNA, 1080 bp, Archaeoglobus fulgidus
atggttaccggcattgtctttcatgaggagtatctgaagcacgagcagagcccaactcatcccgaaaggcgtgagaggcttgcttacacaatggaccagctgagggaggaggggatattcgagagcgagcgtattgttcttcttgagcccttcaaagcatcgcttgaggatgttcttgaggtgcacactgaggagtatgtaagattccttgagatggagagcaagaagggcggaattattgactttgacaccaacattcctgtaggggtttttgacagggccctgttggcggctggtggagcgataagggctgctcaggccgtgctaaacaaggagtgcgagaacgcttttgcgatgattcgccctccggggcaccatgcgaagccctacatcggggctggtttttgctacctcaacaacatggcgataatggtgaagtggctgctgaagcagggctttgaaaggattgccattctggactgggacgctcaccacggcgacggcactcaggagattttctacaacgacgacagagttcttttcatatcaacccaccagatgcccctctaccccggaacgggctatcctgaggagtgcggaactggcaagggcgagggctacacggtaaacatccctctccctcccggaacgggagatgagggctacatgatggtcattgacgagataattgagccagttgtcaatgaatttaagccgcagttcattgctatctctgccggacaggacaaccacttcacggacccaattacaagcctggctttgactgcaaggggatatgcggagatgatgcggagggctgttgcaatggctgaaaagcactgcgacggaagacttgttgccgttcttgagggaggttacagcgttgaaggggccctgccttacacaaacctcgggataattgcggcgatggcgggctttgacctgtcagccataagggagcccgaaaactacctccccgagctgctctggcggaagagggattcggcattggtgaagctgaagcacaacatagaggatgtgaagagggttcactcaaaatactggaagtgcttcaaatga

SEQ ID NO: 24605 - DNA, 1311 bp, Archaeoglobus fulgidus
atggcaattgaagtcgagcttcacaaactgcgggaatggatgtggaaatactccctcggcagagatgggggcaataattctgatcactttcttcgtataaaaattccgggcgggataatttcaccggatcggctgagaggtgttgctgagctatcagataaatatgggagaggttatgctgagattacgacgaggcaggacatacagcttcactggatcgaggctgaggatgctctggaaatcttcgctgagatggaaaagcttggcttcacaacagacctgtgcagtcaggcttttgccgaaacatgccacggtgatgtgagaaacgccgtctgctgccctctgtctgggaaaaagggatacgatgcttactggcttgttagggagattacggatttcttctcaggcaacccggattacgtcagccttccgcacaagttcaagattggcatctctacttgcgagagcaactgcataagggaggaggcgcaggacttggcaatgcagtggaacggcgaggggtttgtaccgcttgttgggggaggactgggggcttcgaagcccggagtcaggaaggcaaagagcttgagaatcgttgtttacgaggaggatgccttcgattttataaggacggtcatagacatctacaaagacttcagagctgagagaaaagcagaggcaaggttcaagaacttttttgagactgctggatgcgagtggctgagaagagaaattgagctcagaatgggtgttaaattcgatttagctgatgatttcaactgcaatccgccatcagagcacactgagggcttgcaggatgatggcagcaactactacacccttcctgtgttcgcaggtatcctcgactcggaaaggctgagcttcattgctgaggttgctgaggagtttgatggaggaatcaggctcacaccatggcagaacgttgttttcaccgatattgacgacttgaaggctttgaaagagaggctttccgagcagtttgacctcagtgctccaagaatgcacatcgcctgtgcatcgaacttctgcggtaagacgctggtgcacgcaaaggacgttctcaggcacattccagcgagcgatagatttgtgggggtgagcggatgcagcaacgcctgtgcctgccatcctcttgctgaaatcggactttgtgggaaggttaaagcaggaaagcagctctacgacgtcttcattcacggctggaaggaggcggagaacctgagcgttgaggaggcggttgagctcattaaaaaacatcttggtgatggatatggagctaaagctgattga

SEQ ID NO: 24606 - DNA, 2691 bp, Archaeoglobus fulgidus
atgaaggtaagcaggagagactttatcaagctctctgcagcgactgcttttgcttccggtttaggtcttggctacttccagaaaagtcgtggagtgcagcaaaatgcaggcgaaatcaaaactgtgaggtcggtttgctcaccaaactgcacgggagcatgcggttttgatgcgcttgtttacaacggcagaatcgagacactcactcaggcagcagattatcctgagcctgaatataacccaaggggatgtctcaggggacagtcaatgatgaacttgatttacggtccggacaggttgaaaaggccgttaatcagggtgggaaaaagaggagaggggaaattcaaagctgtgagctgggatgaggctttggattacgttgcagacaggctggctgacataatgaagcgacacggtccggaatcggtggcaatttcgattcaggttccagggactggctacgttcacaaaggggctatgatgagactcgcatccatgttcggatggagtgctttgcacggctatacgatgaatggagacctgccagccttctggtcacaaaccttcggagttcaaacggaggagttcgagtcccttgaatggaccaactcgaagtatatagccattttcggctccaatataatggtcacccgccttccagatgcaaagttcgtaaacatcgctgcggagaggggggcgaaggttgttgtagtggacccgaacttcagccccacagcagctaaggctgatgaatgggtgcagataaatccttcaaccgactcagctttcgcgctggcaatagcgagagagataattgaaaacagactctatgacgaggaattcatcaaaacatacaccgacatgccgctgctggtgagaatggacacccagaaaaggctgatggcgaaggaagtaaaggaacttgaggagattgctggaaaactaaacgttccagaatacagagatgtgttcgtcgtttacgacgtcaacgagggattcaagccggtgaatccagaaacccttgagagggattttgagcctgcgatagaaggagaatttgaggtagagcttgttgacggaaaaagggtgaaggtaaaaccggttttccagcttctaaaggaggaggttcagaagtacacccccgaaaaagttgctgagattattactcctccaaacagaaataagggcgagtacgtggatatgatcaaaagacttgcatttgaaatggcaaccgtaaagcctttgcacatcatctacggtgcgagtaattaccagtggtaccacggtgacctgaagggaagggctctggcgctgattgttgcattaacaggaaatctcggaaagagtggcgcaggaatatccacatatgctggacagttcaagattcgctggcctcttggagcatggtggagcttcaagggtaggaagaataaatgggtaacctacctcctctggatgaacaaggaatacaggcaaagcgaggagttcaaaaaatacaacagagaaaccccctatcctaagaacgatgttaaagctttcctcttcggctggaacaatcccttcgaccagcacaacatggctaacaggatgattgaatacgccgagaatggagacttggaactcatagttgcgatagacttccagatgacgacctcatgcaagtgggcagatgtggtgttgcccggtgtcgcatggtacgagaagtacgagctaacagcaacgattctccatccctacgtccagctccagcagcctgcgatcgagccacttttcgaatgcatgccagaaatatggattttcaaggagctggccaaaagactcgtccagaagtggaacgatgaagagctcaaatccagcatttctgagttctatcctgatccagagcttttcgatgaggaggagagggcgagaaaggatgggacgtggagtttcaggttggcaaggaatattgcacataaggcctccctgaaagctgtcgagctcatgctcaagactggtggcgagcttgtggaagggataactcttgaaaaactgctaaaaggacctgtgagattgaacctgccaacccctaataaaagacagattccattctgggagcagataaaccttaaaaagcctttcccaccccagtcctatcctgttccacttcaaaaaacggcgagatttgtgaaaagtggaagaattgagttttacaaagaggaggacgttttcatagaccttggggaaactctgccagttcacaaagacccgtttgttgatactgagtacaggctgaatcccgaagcgaagaggaaatacaggtacttttacatcaccagaaacgcgctctacagagttcactccacccacagcaacaacataacgatgcttgagcttcaggacttcaggccgagagtttggttgcatcctataacagcaaaggagaacggaattgctgagggagaccttgtagaggtttacaacgacaggggcagggtatacggctatgccgtactggatgagggactgcatccctcggtaatcatattcgagcagggctggtggagcagatatttgagaggaacatcctacaacagcctgaccttcccctggattaaaccaacccatattgtctacttcgtccccggcatctgggaacccactacagcgtggaatgaggttgcgtgtgcagtaaggaaggtggaggtgtag

SEQ ID NO: 24607 - DNA, 1623 bp, Archaeoglobus fulgidus
atgaggtacaacctgaccataaagaagaccctctttttccccctgcacgcctttccgaacaaggagatagtctacagggacatcaacagatacacctacaggagattctacgaaaggttgcagagagttgccagctcccttgaaaatattggggctaggggagcgaagattgccttcatagactggaacacgcaccagtatctggaagggatgttcgccattccaatgatgggcagcattctgcactgcgtaaacctaagactggctccagaagagatagtttacacgatgcgctacgtcgaggacgactttgttgttatcagggacgagtttctgcccttggccgagaagctcgctccccatgtgccatcagtgaagggctggatagtgacgggcgatgatgtggacaaagtcgagacaagcctcaagccggtttacatctgggaggatcttgttaaggagggttcgagctacgattttcctgagcttgacgagcatgaaacggcggtggtttacttcacctcaggcaccacaggattgcctaaggctgtccacttctcccacaggcaggtggtgatgcagtgcataatcaacggccttgccctttcagccaatgaatccccagcgaggatgagctctgcagacaccataatgcacatcccgcccttcttccacggaatgggctggactttcccgtatctggcaacaatgcttggaatgaagcaggttctgccgggaagatatgagcctcaggtaatgctggatttgataaagaatgagggcgttacctttgcaggcggggtgccggtgttccttaaaatgctcattgagcatccagaggctgagaagtacaaggatgctctgtccaagttcaagtttgtgtgcgatggtgagcacccgcagagagtgctttttgagagagctaagcagctgggcataaagatgattgaagcttttggcatgtctgaaggagtggggtttacctttgccgttctaaaggaccacatgctggactgggactgggagaggcaggtggagtatctcaacaaggcaggcttgcccgctcccttcgttgaggtcaggattgttgacgatgagggcaaagaggtgccgagggacttccagacgatgggtgagattctcatcagaagtcccggcctgacggagggatactggaagaatccggagaagactgctgaatcttgggatgaggaaggatggttccacaccggcgatttgggagtgtgggatgaggagggctacatcctgattctcgacagggctaaggacgtcataaagagtggaggcgagtggataagctccgtaaggcttgagggatacattctggagcatcctgctgtcagcgaggctgcagtagttgctgcgaggagcgagaagtggagtgagaggcccatagccgtcgttgtgccaaagcccgggatgagcgtgacagagaaggagataatagacttcctgatgaagaacttcgttgagacgggaaagatggcgaagtggtggctgcctgacagggttttcattgtggatgagatgccgagaaccactgtgggcaagataaacaagagggcgataagggagaagtacaaggacctcgtactcccctga

SEQ ID NO: 24608 - DNA, 1989 bp, Archaeoglobus fulgidus
atggagccgaaaattttgtgggagccggattcggagtttatcaaaaactccaatctggccgagtttgttgagtggctttcttcaaacaagggtctcgattttgtggtttcagagaatgcgagggagaacgttgagaactacaagaacctctggaagtggtctgtggagaaccttgaggacttctgggagagcgtgtgggagttctttgagattaagagctacagcgattacaagactgttctcgatgaaaggaagatgccgggagcaaagtggtttgagggggcaacgctgaactatgcggagcatgcctttttgaaggctggtgagggagaagcggttgtttacgttagagaggacggtttgaggagggctttaacatggagcgagctggagaggcagactgcagcctttgctgcttggcttaaagatatgggtgtaaagaagggagacagggttgttgcctactgcagtcaggttcctgaagcggttattgcattgctggcaacggcgagcattggtgcaatctgggcggccgttggtggtgaggttgcgccaagggctgttattgacaggttcaagcagcttgagccaaaggttctgatcgcatctgatggccacttctacaacgggaaggagttcaacaagctggaggacattaagaccgttgtcagcggcatcccgagccttgagagggttgtcttgattcccaacctctacgagtcccacgacctgaagcttagcatcccactccactattgggaagagacggttgatagaaaggagaagctcaccttcgagcctctgccctttgaccatccactatgggttctttacacctcaggaacaacaggaattccgaagcccattgttcacgggcatggggggataacggtcgagatcttcaagggctccttccacatggacttcaaggagggcgaccgcttcctgtggtactccccgccctcatggatgatgtggaacactgttgttagcggtctcctcgctggagctaccattgtcttctacgatggcagcccgctttacaacttcctccagccgctgtggcagatatgcgagaaggagaagctgaacatcttcggaacgagtgctcccttcctccacggctgcatgaaattcggcctgcagcccggctcgcagtacgatttgagcagcttgagaatggttggctccaccgccgccccgctatcgcctgagggctttgagtgggtttacaggaatgttaaggaggacgtatggctgaactctgcaagcggcgggacggatgtgatgacgggctttgttggaggctgcccaattctccccgtctggagtggagagcttcagtgcaggtggctggggacgaaagttgaggcttacaacattgaaggcaagcctgtaatcaatgaagtgggagagcttgtcatcgagctcccgatgccctcaatgcccctctacttctggaatgacaaggacttcagctggtataaagagagctacttcagcatgttccccaacgtctggtggcacggggactggctgatgattacagacagaggaacggcaataatcttcggccgctctgattcaacaatcaagagaaagggagttagaatgggaactctggacttctacaaggttgtcgagagtatgaacgaaattatcagcagcctcgttgttgaggtcaagggcaagattttcctcttcgtggttccagcacatggaattgaggtcaacgaggagcttaaggagaagataaacagagccttgaaagagaatctcggagcctacttcgttgcggactacattattccagtgcccgacattccaatgactttgaactacaagaagctggaggtgccgataaagaagattctgctcggctgggaagtggagaaggcagtgaaccttgacagcataatgaatcctgatgccgttttcaaggtcgttgaggctgcaaagccctacgtggagcagctggagggagaatga

SEQ ID NO: 24609 - DNA, 1233 bp, Archaeoglobus fulgidus
atgcactttgaattcaacgaggaacagaggatgattgccaatgcagcaagagacattgcaaaggacttcccgcctgaatactggagggagaaggaggagaatggtgagtttgcggaggagtttttcaaggctgtatgcgatgcgggcttcatgggcatcgtgattccagaggagtacggcggtggcggctacgggatgactgagcttcttattgccatggaagagctttcagccaatggctgcggtgctggaggagtgtggtattttgtgctgactgaagttttcggggctttgcccatagtaagatacggcacagaggagcagaaggagaagtacctgcccaaaatcgccaagggggagatggagttctgcatggccttaaccgagccagatgcgggcacaaacacgctgagaatcaagacttttgcagaaaaagatggagaggagtatgtcattaacgggaacaagattttcataagcggggttgacagggcgaaggggatgcttcttgtggcaagaacaacacctcctgagaaagccccaagaagaaccctcggtattacacttttcctcgttgacctgcccaacgaggcggttaagtggaatccaataccaaagcacgccataaacttctcgaaaacctgtgaggtgagcataaacaacctgagagttgaaagcaatgcgattctcggcgagaaagatctgggctggtatctgctgcttgatgtcctcaatcctgagaggatgagcgccgctgcaggagcaattggaggggctaagttagcgataagcaaggcagttgagtattcaaagcagcgcaaggtttttgctgatccgattggcagctatcagggtctgcagttccccttagctgaggcctatgctgccttagaatgtgcaaggctcatgatgtacaaggctgcatggctctacgataccaaatttgccgctgaagatgtcaaagacccgaagaagagggtggagatggccgctgttttcagggagataggagatgctgcaaacatggctaaggctgtggctgttgagaacgcgctgaaagcagtttactgggcaatgcagaccttcggcggctacggctacgccaaggagtacgatgttgagaggtggtggagggaggtcaaccttctccgccttgcaccgataacacagcagatggctctgaactacatagctgaacacatcctcggaatgccgaggagctacagagtttag

SEQ ID NO: 24610 - DNA, 1806 bp, Archaeoglobus fulgidus
atgaaggttgtcaaagacccagagctgaaaattgagcgaaaggaatcgctcaacaagatgctctggaacaccgttcagagtcatccaagagtgtcggccattggctactgggacgatggaaagctgaaatatctcacctacgaggagttctgggagagggtgaggaagctatcaaagtttttaatttcttccggcctgcggaagggagacagggttgcgatttacgccgacacacgctatgaatgggagattgccgactttgcagttctaactgctgggggagtggttgttacagtccacagcgttcttaacagagagcaggttgaatacatcctgagagactcggagagcagagttgttttcacggaaaagaagtatgctgaaaacgttcctgaggactttgaggtttactttctggaggagctggaaaagcttgtcggtgaggtttctgatgatgaattcgaaagcagatggaagagcgttgagcctgacgaccttgcaagcattgtttacacctctggcaccacaggagagccaaagggggcgatgctcacgcactggaactggaggttcaactgccactctgtgatgtccatcacgcccttctatcccggagagccccacatctgctatctgccattgagccacgtttaccagaggcttgttttctttgctggaatttcgagggcagcaacagcagttttctgcagtccccagcagttcctcgaaacgtcaacagcagtgaagcctgttggactaatagttgtgccgagaattcttgagagggtgaatgcgggaattgtcgagaaagttgagaagtcaccagctttggcaaagaagattttctactggtcgagaggagttgccattgagtgtggaaagagaatgagcagaggggagaaatacggcttctggctgaatataaagagaataatcgcagacaggcttgttttcagcaaaattcgggagaacctcggcctcacaagaatcaggtttgtctgctcctctgccgcagaactacagaaggagctggcctacatgttcaatggcatgggaattcccgtaattgagggctacggaatgacagagactgcagcaccatccaacctcaatcctgtcggaaggttcaaacccggcacagttggcccgccaattcccggcatcgaggaggcgatagctgaggatggagagattctcgtcaggggagacaacgtgatgaagggctactggagaaaggaagctgagacgagaaaaaccttcaccgaggatggatggctgaagacaggtgaccttggagagttcgacgaggatggctacctcgtctttctcgggaggaagaagcacataattgtccttgacacgggtaaaaacgtttctcctgtccctatagaggaggaattgctcaaaaatccgcttgtgagtgatgcggttatcattggtgacggaaagccctacgtaactaccctcatagtcccgaatttcagcatgctccttgagtttgccgataaaaacggaattgagtatgacaggagtagaacgattgttcagaggagcatttctggagaggaggagattgtggctgttgatgaaaaccttgtggagaataatgcagttaaggagctttacgcaaaaattgttgatgatgtcaacagcaggctggcaaagcacgagacaatcaagaagttcaaaattttgcctgaggctttcagccttgagaagggggagataactccaactttgaagaagaggaggcacgtcattctgaagaggtatgagaaatttattgaggagatgtataagaggtga

SEQ ID NO: 24611 - DNA, 1143 bp, Archaeoglobus fulgidus
atgagagttgcggttgttggattcggtcaaactcccttcaggacaaagaggaaggataaaacccatccggagcttgccttcgaggcaataaatgccgccctcgaccatgctggactggagatgaaggatgtcgaggcagtagcttacggctgtatggaccccttcgacggtatctactgccctgagaggtgggatgctactgcagcgggcctcgaaaagccgataatgaagatttccactggtggcacaacgggaatgaccacagccttggcggcatacgagcacgttgccagcgggctttttgatttggtaatggccgtctgcgtgcagagggtaggggagtgcgttgatgcgcagcccgttctcaacacagcagtcgaccccatttacgagagacactcaggtctgggagccattcacgtagcctcctttcaggccacagcatatatggcaaagtatggcgcaactgaagaggacttggcgtgggtgagcgtcaaggatcacaaaaatgccctcaagaatccctacgcccacattaagatggatgtgagcgtcgagggtgttctcaaaagcagggttgtctgctctcccctcaagctgctggagtgctgtccgaggagcgatggtgctgctgccgtcatcttcgcttctgaagatgtggcgaggaagataagggacaatccagcttgggttgttgcggagacaacaatcagcgacagctactacctcggtgacaggccgagctttgccgagtgggattcattggcaatagctggcagaaggcttttcaaggctgctggaattgagccagatgagatagatgttgccgagctatactctccctttaccattcaggagattctggagctggaggctctgggctttgccaagaagggagaggggaagaactttgcgagggagggtgtaacctttgtggatggcgattttcccaccaacccctcaggaggggtgctgtgcacaaatcccattggagctactggccttgtgaggtttggtgaagctgccctgcaggtgatgaacgaggcgaaaaatcaggttgatggtgctgaagttgcacttgcacacgcatggggtgggactttgcagttccacaccctcgctttgctttcttcaaggaggtga

SEQ ID NO: 24612 - DNA, 1215 bp, Archaeoglobus fulgidus
atggaggaaattctgaggctcagaaggagtgtcagcattgacgattacattgaaaaggtaaagccaatcgttgaggccgtcaaaagggagggagataaagctgtaatccgatttacgagggatttggacggagtcgagcttgacagcctgagagttacggaggatgagtttgagaaggcttatgatgcggtggatgacggcctcattgacgctcttgaagtggcgaaggagaacatctacaggttccactacgtcacatcagttgagagggatatgaaggttgagttcgaggactgcgttatggggaaaatctacacccccatagagaaggttggcgcttacattccaggcgggagagcaagctatccatcaacggccttaatgataggcgttccggcaaagattgcgggagttgagaaactggtcgcctgcacccctcccaacaaggatggtaaagtaaacccactaaccctcgttgccctcgatattgccgaatttgatgaggtttacaaggcaggcggagcgcaggcgatagcggccatggcatacggaaccgaaactgttgagaaggtttacaagattgtggggcctggaaacatctacgtcacagcggccaagcttcttgtggcaaaggatgtggcaatagacatgcctgcaggcccttcggaaattctcgttatagcggacgaaactgctaatgcggacttcatagcctgcgactgcctcgctcagcttgagcacgacccgatggcagtggctgtggttctcacaacctcccggaaagttgccgacgaggtggaaaaaaaggtcaaatcggaaggagatttcagcaacttcgccgttttcgttgttgaggacttggcggaggcctttgaaatttcgaacgaatttgctccggagcacctcacggtagcggttaaaaatccggaggaatggctcgggaaagtcagaaatgctggcagcgtttttctcggaaacttctctcccgtcgcagcaggagactacgcctctggaacgaaccacgttttacccactgcaggctacgccaagatttacggcggcctgagcgttgagagctttctgaagcacttcaccttccagatgctgagcgaggagagcatgaggagaattggaggggatgtagtaaaaattgcagaagctgaagggttgaggtggcatgcggagagtgtgagaaaaaggttggaaaaaatttag

SEQ ID NO: 24613 - DNA, 1521 bp, Archaeoglobus fulgidus
atgttcagcaaaattcttgtggcaaacagaggggaaatagccgtcagggtgatgagggcctgccgggagcttggaattaagaccgtcggggtttacagctctgcggacaaaagggcctttcacagggtttacgctgacgagtgctactacatcggcaaagctgatccaagagacagctatctcaacattgacagaatcattgaagttgccaagaagtctggagcggaggcaattcaccctggctacggctttctcgcggaaaatgccgagtttgcggaaaggtgcgaagaggagggaatcgttttcatcggaccatctcctgaagttatacgcatcgccggctcgaaggtgaggtcgagagagagcatgcagagggctggagttcctgtcattccgggctcaccgaaaattgataccgttgatgaggcgaaggagtgggcggagaagattggataccccgtagcggtcaaagcttctggaggtggaggcggaataggcattgtagttgtcaacagtcaagaagagcttgaggaagctttcagaaagtcgaaaaagctcggtgagagctacttcaaggactccaccgtttacctcgaaaagtatcttgcgagaccgaggcacatagaggttcagattcttgcagaccagcacggaaacgtcatccatctgggcgagagggagtgcagcatccagaggaggcaccagaagctcatagaggaggctccatctccagcgttgaacgaggaaatgagggaggagctcggaaagcttgcggtgaagggagcgagggaaatcggatacacaaacgccggaaccttcgagtttctttacgagaacggaaacttctacttccttgaaataaactcaaggcttcaggtcgagcacacaataactgaagttgttactggcattgacatcgtgaagtatcagattcgcatcgcttacggtgaggaactcaggcacggacaggaggatgtagccattaggggacacgcaattgagtgcagaataaatgccgaggaccctgtaaacttctatccgagaagcggacggattttgcactacagaagcccgggaggaattgggataagggttgacagcggaatccacatgggctacaggattccggaggagtacgacagcatgatttccaagctcatcgcctacggcgagacgagggaggaggccattgcgaggatgaagagggctctctacgagtacatcatagagggtgtggaaacgaacatccccttccatttcgctgtgctcaacgatgaggagtttgttaggggcaacatccacacgaagttcgtggaagagaggaacattgcggagaaggtaaaggagtacttgaggattttcaggccgataaaggcgaggctcgacgagatattcatggagagcgagtttacatgggaggaaatatccgccatcgtaactgcaatcgacgcatacgagcaggaactggagcgcggaattgaagagagaatctggcaggcaattttcagcctgggagcctga

SEQ ID NO: 24614 - DNA, 846 bp, Archaeoglobus fulgidus
atgacgcctatgaccaccttatccctttcagccttctccggttgcgcacatagcgatgtgatagcggcaagcagtattagggctgttagcacagctttagcatgtctcatggtttggataagcaaagcaaagtatttaaaccttgccgaaacagtaaaaagcatgctaaaagtcagaaacgtgcacaagaggttcggggagtgcagcgtgcttgagggtgtaaaccttgagattgacaagagtgagagggtcggcatcataggcccgaacggggctggcaagacaacgcttttcaacatcatcacgggctttctgaaacccgacagaggagaaataaggttcaggagcagagatataacgggccttaagccaaaccagctggcgaagatggggatagtgaggaccttccagattgtgaaggttttcagcaacatgacggttgagcagaacatgctcacggtctcggatgacctcgactacctcagagagtttgggctgtgggagaagaggcacgagcttgcagcaaacctatcttacggggagctgagaaagctgagtatagctcttgccctagccccaaatccgaagcttctcctcctcgacgagcccttctcagggctaagcccgaaggaggctagggaccttgcggggataattgagagcataaaccacaacggccagtcgatagcaatcatcgagcacaggctgaaagatttgttcaatgttgcagagagggttgtcgtgctgaactcaggcaggataatcttcgaggggcaccctgaggaggttgttagggagaagaccgttgttgaggcctatctagggaggaagtatgccgttgcttga

SEQ ID NO: 24615 - DNA, 591 bp, Archaeoglobus fulgidus
atgaagcttgttgcaacgctttcaagtccggaggagctcgaattagctgagaaggctgatgttgtcgagctaagaatcgaccttttcgattttagcggtgccagagttgataaagagaaaattctgacgtgcagaagggtttcggacggagggaagttcgagggtgatgagagggagaggattgaaaagatgaagagagcctttgattcgctcaaccccgattacgttgacctcgaaagcgacctcccggactcggcctttgacttcaactgcagaataatcgaatcctaccacaactttatccgcactccagactactccgagctcaaaggcatcgttgagggcaggaggggggatttggtgaaaatagccacgatgggaaaaagcaagagggacgttgagaccatcgtccgaatcctcacgaattacgatgacgttgtagctttcctcatgggggagaggtttagcttcacgcgcgtcctcgcagcttacttaggctctccattcatttactgctatgttggaagcccaaaggcgcctgggcagataagcctggatgatgcgagggaaataatcagcaggctggggtga

SEQ ID NO: 24616 - DNA, 1230 bp, Archaeoglobus fulgidus
atgaatatctttgacaatattttgagctcagcgacaatatttaaaaatagagatgttttaaggcatagttacacaccagaaaagctcccgcacagggaagagcagatcaaccagcttgcactactgctctcccccatgcttaggggcgggactccctcaaacatcttcatttacggaaaaacaggtacgggaaaaaccgcaaccgtgctttttgtagccagacagctggaggaggcgagcaggaaggcgaagctgaatgtagcggtacattacataaactgcgagatcgttgataccgcctacagggttcttgcaagcctggcgagaaagttcggcagcaacgtccccatgaccggctggcctaccgaccaggtttatgaagaggtcaaaaaagctcttgagaggagaggaaccagagttgttgttattctcgacgaaatagacaagctggttaagaaggccgaggaagctctgtacggcctcacgaggataaactcggagcttgagaattcgagcatctgcattgttgggatatctaacaacctgaaattcaaggagtatctggatgcgagaattttgagctcgctcagcgaggaagagattgtttttccgccatacaatgcagagcagcttgaggacattctgcagcagagggcaaagctggcttttgaggacggagtgctggaggatggagttatccagctctgcgctgcaatagctgctcaggagcacggtgatgcgagaaaagccctcgatttgctgagagtgagtgctgagattgctgagagggaaagggacagcatggtgagggttgagcacgttaagaaggccgtaaggaaaattgagacagactacatgattgagacagtaaggactttaccggttcacagcaaaattctgctctacagcatgtccttgatttctgagaactcgccaaagttcacgacaggggaggtttactgcgtttacaagaagctttgcggaaaggttggagttgacccgctcacgcagagaagaatcagtgatttgatttctgaactcgatatgctcggaattctgaactccgttgtaatatccaaagggaggtatggcaggacaagggagatgaagcttgaagctgacgaaaaagttcttagaaaagctcttgaggaagattacaggctgcaaaacctcagaaaattcgagggggagctgaagaagctggcgaacctcaacttattccagttttag

SEQ ID NO: 24617 - DNA, 1656 bp, Archaeoglobus fulgidus
gtgaaagaagtcataatgaaatacgtagttcagaacgccgcaaagtacggaaaagccagtgaaaaggctgtaatggggaaggtgatggcagaaaatccagaactcagaaaaaaagctaaagaggtccttgaactcgtaaaggagtgcattaccgagttcgaagcgctttctgaagaagtaaggaaggagctaatcaaaaaatacagcatggatagcgaagctaaaagggagttggagacgaagaagcttccagagcttgagggggctgagaaagggaaagttgtgatgagattcgctcctaatccaaacggtccacctacactcggttctgctagggggataatcgtcaacggtgaatacgcgaagatgtacgaagggaagtacattatcaggtttgacgatacagaccccagaaccaagagaccgatgattgaggcctacgagtggtacctagaggacattgaatggctcggttacaagcctgacgaggttatttacgcctcaagaaggattcccatctactacgattatgcaagaaagcttatagaaatgggcaaagcctacacctgcttctgcagtcaggaggagttcaagaagttcagggacagtggtgaggagtgcccacacagaaacatcagcgtcgaggatacacttgaagtctgggagagaatgcttgaaggagactatgaggaaggagaagtcgttcttagaattaagacggatatgcgccacaaggatccggcaataagggactgggtggctttcaggataataaaggaatcacatcctctcgttggggataaatatgttgtctatcccacactcgattttgaatctgctatagaggatcaccttttaggcataacgcacattatcaggggtaaggacttaattgattctgagaggaggcagagatacatctacgagtattttggctggatttaccccattacaaagcactggggcagggttaaaatcttcgaattcgggaagctatcgacttcttcaattaagaaggatattgaaaggggtaagtatgagggctgggatgacccaaggctgccaaccttgagagccttcaggaggagaggatttgagcctgaagccataaagagcttcttcctttcgctgggagttggcgagaacgacgtttccgtcagtctcaagaatctttacgctgagaacaggaaaatcatcgatcgcaaggcaaaccgttactttttcatttgggggcccgtgaagattgaaatcgttaacctgccggagaagaaagaggtcgagctcccgctgaatccgcacacgggcgagaagagaaggctgaaaggtgaaagaactatatatgttacaaaagacgacttcgagaggttgaaagggcaggttgtaaggctgaaggacttctgcaacgttctgcttgacgagaaggcagagttcatgggttttgagcttgagggggtcaagaaggggaagaacataatccactggcttcctgagagcgaggctatcaagggcaaggttatcggcgaaagggaagcggaagggcttgtggagagaaacgcagttagagatgtcgggaaagtcgtgcagttcgagagatttgctttctgtaaagtagagtctgctgacgaggaactggtcgcggtgtacacgcacccgtga

SEQ ID NO: 24618 - DNA, 1656 bp, Archaeoglobus fulgidus
atgcgttttgtaagaggttttccgtcgacaatgatggatgaataccagctgaacattacaaacatactgagacatgcggccacgaattttccagagagggaggttgtttcgagaaacctggatgggagcctgttcagatacagctatggcgaggcttacgagagagtttcaagactggccaacgtcctcgaagagcttggggtcgatgttggagatagagtgggagttctgagctggaacactcacagattctttgagctcttctttgccattcccgggatcggagcagtccttctggagatgaacctgaggctgcatccgagggagattgcctatgttgcaaaccacagcggtgcgaaggtgatattcgttgatgaatccttgcttccaattgccgaagctatagccccgtctataggtgtggagaagtatgtggtcatgaccgacggggaaactccggagacgaagcttccggaagtttacagctatgaagaacttttgagaaaagcaagtaaggactacgatttcccgatggtggatgaaacttctgcctacgcagcctgctacacatccggcacaaccggaaatccgaagggagtttactactcccaccgctcgatggtgctccactcactaatagcggcaatcggaatgggtttaaggcccgaagacgcttacatgcagcttgttccgatgttccacgcaaatgggtggggtgttttcttcgctgcaacactggcagggagcaagctcgtcttccctgggagatatgctgtagacaaccttgctccggtggttgaactgatgcagagcgaaaaggttacagcaacagctggagctcctgccattttccttcccatgctaaactacctccagaaggtcgagccaaagccgaagttcaacataagggcgtggagcggcgcaactgagccaccgcttgcagtgatgaagggattgaaagaattcggcattgaaataattcatgcttatggggcaaccgaaacatccccgctcgtgtgctacaactacgtaaaaccggagctgagggaaaaactgaacgaagaggagttgtgggagctcaagaggaagcagggaatccccgtgtttggcgtggaggtcatgctggttgacgaggaggggaacagacttccacacgatggcaagacgattggcgaactctgcatcagggggcactggattacgggaagctactacaaggatgcaagaacgttcgagtcgttcatcgatgacgggctgttaaagtggtggaagagcggtgatgccgcaaccatcgacgagtggggatacatcaagattgtagacaggttcaaagatctaataaagagcggtggagagtggataagcagcgttgaccttgagaaccaccttatggctcatccaaaggtatttgaggcgtgcgttgtgggcattccccaccccaagtgggaggagagacctctagcgtttgtcgttccaaagcctgaattcaaggacagcataacaaaggaagagctgtacgagcatttaaaacagagatttgcaaagtggcagttaccagatgacatcatcataactgacgagataccaaaaacaagcgtaggaaagttcagcaaacggacgctgagggaacagtacaaggattactatactaaataa

SEQ ID NO: 24619 - DNA, 1011 bp, Archaeoglobus fulgidus
atgggtgcggatattggtgacctctttgagagggaagaggtcgagcttgagtacttctcaggaaagaaaattgccgttgatgctttcaacacgctataccagttcatctcgataataaggcagcctgacggtacgccgttaaaggactcacagggcagaatcacctctcacctttccggaatcctatacagagtctccaacatggtcgaggtgggaatcaggccggtgtttgtattcgacggagagccaccggagttcaagaaggctgaaattgaggagaggaaaaagagaagggctgaggcagaggagatgtggattgcggctttgcaggcaggagataaggacgcgaaaaagtatgctcaggctgcagggagggttgacgagtacattgttgactccgcaaagacgcttttaagttacatggggattccctttgtcgatgccccgtctgaaggagaggcgcaggctgcttacatggcagcaaaaggcgatgtggagtacacaggaagccaggattacgattctctgctcttcggaagcccgagactcgccagaaatctcgcaataacgggaaaaaggaagcttcccggcaaaaatgtctatgtggatgtaaagccggagataataattctggaaagcaacctcaaaaggctgggtttgacgagggagcagctcatcgacatagcgattctggtcgggacggactacaatgagggtgtgaagggtgtcggcgtcaagaaggctttgaactacatcaagacctacggagatattttcagggcactcaaggctctgaaagtaaatattgaccacgtagaggagataaggaatttcttcctgaatcctcctgtgactgacgactacagaatagagttcagggagcctgactttgagaaggccatcgagttcctgtgcgaggagcacgacttcagcagggagagggtcgagaaggccttggagaagctcaaagctctgaagtcaacccaggccacgcttgagaggtggttctga

SEQ ID NO: 24620 - DNA, 588 bp, Archaeoglobus fulgidus
atgaagctgccggaagcctttaaagggaagtggttcgttctgttcagccaccctgcagacttcactccagtctgcacaaccgagtttgtggcttttcagaatagatacgacgagttcaggaagcttaactgcgagctgattggccttagcatcgaccaggtgttctcgcacattaaatggatagagtggattaaggaaaagctcgacatcgaaatcgagttccccgtgattgccgacgatacgggcagagtcgctgagatgctcggtttgattcatccagccaagggaacgaacacagtaagggcggttttcatcgttgatccagaggcggttatcagggcagtaatctactacccgcaggagctgggaagaaacatggacgaaatccttagggctgtgaaggctttgcaggtcagcgaccagaacggtgttgcgatgcctgccaactggcccaacaatgagcttgttggtgatgctgtgattattcccccaccaatcagcgaagctgaggcaaaagagaggcttgaaaaggctaaggctggagatatcagctgctacgactggtggttctgctacaagaagatttga

SEQ ID NO: 24621 - DNA, 1191 bp, Archaeoglobus fulgidus
gtgatgtcggagaacgttgctgttataggagtgggacattccaagtttggaacaaggaaggacgtgaacattgcagagctatgctgggagtctatgaaaccggcttttgagtcagccaatcttgagccaaaagacatagaattctttgtcgtgagcaatgcaggcatgtggagcagcgaggctgctgttccggcgctgatggcggagtatgcagacctcgccccaaagggctcaatgagggttgaagcagcatgtgccagcgggagtgctgcagtgagagttggttacactgctgtgaagtccggaatggctgacatcgttctggttctcggcgtggagaagatgcaggagtcccccaatccgaacgtaattgagctaatcggcaggttcggaagctacttctgggagttcgagaacttcggcctcacctttccagcttactacgcccttcatggcacggcttacatgatgaagtacggagctaccgaagaggactacgcaaaggttgcagtaaagaaccactactatggagctaagaacccctacgcacagttccagagggagattgatgttgagactgtgatgaaaagcccatacgttgcttggcccttcaagctcttcgactgctcacccatcaccgatggctcagcctgcattattctggcgagcgaggagaaggtaaaggagcttggaatagatgagaaaatctggattctcggacagggtgttggaactggaactgcaaacctgagcagaagggaggaattcagctcccttgcctcagcaacctacgctgccgagcaggcctacaagatggccggaatcgacatcgacgacccaactaagtatctggacggtgccaacgtccacgactgcttcaccgctccagagattattgcctacgaggacctcagattctgcaagaggggagagggctacaagctgatcagagaggagcagacctacatcggaggaaagattccggtaaacgttgatggtggcttaaaggccaaaggtcaccccattggagcaactggtgtaagtcaggcagtggaggcttacaagcagctgctgcagaaggcagagccgggaaggcaggctgacataaacaagggaaggtggcttgcccacaatgttggaggaacggggcactacagctacgtgacaatttacgggcttgagaagaggtga

SEQ ID NO: 24622 - DNA, 1977 bp, Archaeoglobus fulgidus
atgaaggtaaagaaggtttgtgtgcttggagctggagcaatgggcagcggaattgcccaggtgtgtgcgaccgcaggctatgaggtatgggtgagagacataaagcaggagtttctggacagagggaaggcagcgattgagaagaacctccagaaggctgtgagcaagggcaaaatgaccgaagagaaggcaaaggaaattctcagcagaattcacttcaccctcgacatggaagaggctgttaaggacgctgatctggtcatcgaggcggtgcccgagataatggatctgaaaaagcaagttttcgctgaagttcagaagtacgccaagcctgagtgcatctttgcaagcaacacctcaggtttgagcataacagagcttggaaatgctaccgacagaccggaaaagttccttggtctgcacttcttcaaccctccgcctgtgatggctctcgttgaggtcattaagggagagaagacaagcgatgaaacgatcaagttcggcgtcgagttcgtaaaaagccttgggaaggttcctgttgtggttaagaaggatgttgctgggttcatagtgaacagaattctggtgccctaccttgtccttgcaattgacgacgttgagaagggagttgcgacaaaggaggaaatcgatgcgacgatgatgtacaagtacggcttcccgatggggcccatagagctttcagacttcgtcgggctggacattctctaccacgcaagccagcagtgggacattgttccgcaatcaaagcttcttgaggagaagttcaaggcaaacgagcttggaatgaagacgggcaagggattctatgactggagcgctggaaggccaaagattcctcaggagcttgctgggaagtacgacgcaatcagactcatagctccgatggtgaacatagctgcagacctaattgcaatgggtgttgcagatgcgaaggacatcgatactgcaatgaagctgggaaccaacatgcccaaagggccatgtgagcttggcgatgagattggtctggatgtaatccttgcaaaggtcgaggagctttacaaggagaagggattcgagattctcaagccctcagaacacctcaagaagatggtgtcagagggcaagctgggagagaagagcggtgagggcttttacagctatggcaagggagagatgaccttcaagaacatcgagattgttaaggacaccgagaacaagattgcaaagctcataataaaccgcccgcagagactgaacgccctctccctcgacacgctcgatgagatcttcgaggctctgagaatgcttgagaaggatgacgacgtgagagttgttgtaattaccggagccggagacaaggctttctcagcaggctttgacttgcaaaccgcaatgcaggtgccggacttcttggccccggcaaactcgatgatggtggcggcgaagggacagtgggtcttcacgcagattgagaggttcccgaagccggtcattgcagctataaacggatacgcctttggtggagggtgcgagcttgccttggcatgtgatttcagaataatgaagagaggtgccaagattgggctcacggagatcagcctcgccctcatccccggctggggcggaacgcagcgcttgccaaagctggttggacttacaaaggccaaggaaatgataatgctcgcaaagagaattgatgccgatgaggcagagagaattgggcttgtcaacaaggctgttgatccggagaagttcgaggaggaggttatggccctggcaaaggagctcgcagctggcccaccagtcagcctgagggcggcaaagtacgccattaacttcggagctgagcttccagcagagattggacagatgatcgaggccggaatgttcgctgttgcaacctcaactcaggatgttgtagagggtgtttcggccttcttccagaggaggaagcctgagttcaaaggaaagtaa

SEQ ID NO: 24623 - DNA, 468 bp, Archaeoglobus fulgidus
ttgagttttgttatctggatcaccgggcctagcggtgcgggaaagacgacgctcgctaatgctctttacaaaaaactggagagtatggggtacagggttgagttgctggacggagatggcgtcaggagaaagctatacccaaacttaggttttagcgaggaagagaggtggatgcacaatagagttgtcgtggagatggcgagaaggttgtcgagaaacggtatcataacgatagtttcagtcgtgtccccttacagggcgtggagagagtacgcaaggaaggagatagaaaaattcgtggaggtttatccaagatgtcctctcgaagttaggatgaaacgcgaccctaaagggctttacagcaaagctttgagaggagagataaaggggttgactggtttggatggtgaatatgaggagccagagaatcctgaagttgtggttgatacggacaaaaatgaccgttga

SEQ ID NO: 24624 - DNA, 975 bp, Archaeoglobus fulgidus
gtgaaggtttcaatcataggctgtggatacgttggattagtgaccggacttggtttcgcagaactcggcaacccagtagtttttgtcgattcgaatggaagcaaaatcaaatcaataaacgatcttatccctccaatttacgagcccggcttggaggagctaataaaaaagaatgagggaaaattttacgccacaaatgattattttgaggcattagacaattctgaggtgtctttcatatgcgttggaacgccctcaaaagaggatggttctcttgatctcaggcaagtagaagaggcttcaagtaaactggggaaagcactggctgaaaaggaatttcatgttatcgtcgttaagagcacggttttgcctggaacgactgagaacttcgtgaagccgataatcgaaaaagaatctggcaaaaaagcgtttgacgattttggtttagctatgaatcccgaattcttgagggaaggcaacgcagttgaagacttcttcaatccggatagaatagtgattggtgttaaggatgaaaggaccaaatctgtcttagaggaattgtataaacctttcgattgcccaaagcttattacagagataaaaaccgctgaaatgataaagtacgcttctaacgccttcttagctacgaagataagcttcgccaacgagataggaaacatatgcaagaagcttgggattgatgtttacaaggtgtttgagggtgttggtttggaccacagaataaatccatcatttttcagagctgggattggattcggggggagctgttttcctaaggatgttagagctttgattaggaagtctgaagaactcggtgaagacctacagatactaaaagccgttatcgaagttaacgagaaacagccgttgaagatgatcgagcttctgaagaagcacattcccgacttaaggggaaagattagtgttttttgtccatttctgggtcttaagtaa

SEQ ID NO: 24625 - DNA, 1059 bp, Archaeoglobus fulgidus
gtgaagggcgtactgcttcacggtggtgccggcacccgattaagaccactaacctttacggggccaaagcagctgattcccgtagccaacaagccggtttcccagtattgccttgaggacatgattggtgcaggaatcaaagaggtagccataattttgggggagacctatccagaaatggtggaagagcactacggagatggttcgaggttcggatgcaagattacatacatccatcagggtaagccactcggtattgctcatgcagtctatcttgccaaagacttcgtcggtgatgaaaagtttgtagtttatctcggcgacaacctgattcaggatggtataaaggaatacgttaagagatttgacgaggaagattttgacgccttcatacttctcaaggaggttgaggatccaagagcctttggtgttgccaagtttgagggcgagagactggtcggactcattgagaagccaaaagaacctccaagcaactacgcggtaattggtgtatatatgttcaaaccagttgtttttgacataatcaaagacctaaaaccgagctggagaggagaacttgaaatcaccgacacgctacaaaaaatgattgaaaacggttacaatgtgggatatgctaaactgaagggttggtggttcgacacaggcaaggcagaggacatactgaaggtgaacgcaacgattctcgatgagagggcaaaaaggagtgtaaagggagaggttttggcgtcgcaaattgagggaagagttgaggttggagaaggggcaaaaataactaacagcatcgtaagggggccagcggtcatcggggaagactgcataatcgagaactcgttcatcgggccctacacgagcgttggtgaaagaacggtcattaaaaacagctcgcttgaatactgcatagttctcagcgagtcaattatcgagggtgtggagagaattgaggagagtctcattgggaggaaagtcagaatcagaaagaacgacagaaagaggttcctaagattcaccattggggattactccgagatcctgctttga

SEQ ID NO: 24626 - DNA, 738 bp, Archaeoglobus fulgidus
atgatagacgtcataatgaccggagagttgttgaagaccgtaacgagggctatagttgcgctggtcagcgaggcgagaatacacttcctagaaaagggattgcattcgagagccgttgaccccgcaaacgttgcgatggtcatagttgacatcccgaaagacagctttgaggtttacaacatagatgaggagaaaaccataggagtggacatggacaggattttcgacataagcaagtcaatctcgaccaaagacctcgttgagctgatcgttgaggatgagagcacgctgaaggtaaagttcggaagcgtggagtacaaggtggcgctgatagacccctccgcaataaggaaagagccgagaattcccgagctggagctgccagcgaagattgttatggatgcgggggagttcaagaaggcaattgcggctgcagacaaaatcagcgaccaggtgattttcaggtcagacaaggagggcttcaggattgaggcgaagggggatgttgacagcatcgttttccacatgacggaaactgagctgatagagttcaacggaggggaagcaaggagcatgttcagcgttgactacctcaaggagttctgcaaggttgcgggaagcggtgatttgctcacgattcacctcggaaccaactatccagtcaggctggtttttgagcttgttggcggcagggcaaaggtcgagtacatcctggctccgcgcatagagtcggagtga

SEQ ID NO: 24627 - DNA, 1188 bp, Archaeoglobus fulgidus
atgaacattgaaaaacattttatattgttcaatcatcctctcatcatgtggtggtttgttgtaccaaagacagttttcggtgacgatgccattgagcacctgcagagcgagagagcagagagggtgctgattgtaactgacaaggttctgagcgagatgagctaccttgaggaggtaaagaaaaatctcaaggcggagagaatagaggttttcgacgaggtagagccggagccgagcatagaaactgccctaaaatgctcaaaagtggcgagagagcttgatgcgcagctcataatcgctctcggtggtggcagcgttatggacgttgcgaagatggcgaggatactgatggagcttgacgtcgatccagagttcatcacgccctttacagatctctatgagctcggttttcaaaagaaagcaaagctcatcgccattccgacaaccagcggcacgggagcggatgcaacatgggcaatggtgcttaccgacaccaaggaaaagagaaaagttcttcctgcgaacagagaagcgataccggatttaacaatactcgactacaggtttgttgaaaaccttccgcccaagctcgtagccggcacgggaatggatgcgctaacccatgcaatcgagggtgctctggctccgtggagaaacgacttcagcgatgcaatgtgcgagaaggcaattgaattaatcttcgacaaccttgagaagtcttacaacggggacaaggaggcgagggctaagatgcaccacgccgcaacgatggccggaatgggattcggaaactctcaggtggggccggtgcactccttgggccatgctttcggagcctacttcaaggtgcaccacggcatttgcgttgcggtgttcctcccctacgttttgcagttctaccttaacgatgaaggctcgagggcaatgatggattatctggctggtagggttggattggagagcggagagtctatggtggagaaagtaatggacctcatgaagaagatagaggctccgacaaaggtttcagacattgttggtgagaaggagtactttggggcaattgaggatatatggagccatgctatcaacgatgcgtgcatgattacctctccgagatgtccagacaccgagcaaacgaggaagctgcttgagtacgcattctacggaaagagggttgacttctga

SEQ ID NO: 24628 - DNA, 753 bp, Archaeoglobus fulgidus
gtggggctttcgagactaggcattgagacagcatacataggtaaggtcggaagcgatgaagaaggcagaattctcctcgctgattttgaaagagagggcgtgagcacggatttcgtaatcagggcggaggggagaagcggaactgccatgattttcgttgacgagaagggaaacagggccatcctcgtcgatcctggtgtgaacgacacaatagcctacgatgaaatcgacgtcgattcagcgagaaagtacgacctcatccacctaacttccttcatatgcaagaacggtctggattcgctgaactcgcaaaaaaggatagttgaggagtttgatagtgtcagcttcgaccccggaatgccctacgctgagaggggactgggggacatggagaaaattctgaaaaacaccacgatattcctcccaaacaggcaggaaatcgagatgctcttttcggaggattacaggactgcagcggaacgctgcattgaaatgggtattgaaatagttgcggtcaagctcggctcggagggatgctggataaaaaagggagacagggaagttaccgtaaagcccgtgagcacaaaggttgttgacacaacgggtgcgggagatgctttcaacgccggattcctatatggatacctgaaaggaaaggacatagaggagtgcggaaggctcggaaactttgttgcggcgaagtgcatagaaaagtacggtgcaagagagggccttcctagaagtgtggattaa

SEQ ID NO: 24629 - DNA, 2046 bp, Archaeoglobus fulgidus
atggcagacccgatggaagctatgaaaaaagagtttgagaaccgcatcattccaccaagctggaaggacagggtttgggaaatagaagattacaggaagttccacgaggacaccatcaaggacaaggaatcgatagagaagtggtgggagaagtgggcaaacgagattttctggttcaggaagtgggacagggctcttgacgatagcaacccgcccttctacaggtggtttgttggcggagagacgaatctcgcttacctctgtaccgactggcagattgagcagggaaggaagaacaaggtggcgattatctgggaaggagagccggttaaggaaaatggagagccggttgaagtgagaaagctaacttactacgacctttacagggaatcgaacaggattgccgcgatgctgaaggacaagcttggagttaagaaggacgagatcctgaccttctacctgccaatgattcctgaactgccgcttttcatgcttggagtgcagagaataggggcgaagcacagcatagtgttcagcggattcagtgctcaggctctggcggttagaataatggatgctggtgcgaggtatgttgtcactgcagatggcgtttacaggagagggaaggtgctgaacctcaaagcgattgtagatgacgccgttaagatttgcgagcaggagggtcacaaggttgagaaggttatcgtggtcaagagagcaggaaatgaaatcccgtggaacgatagcagagatgtttggtttgaggacctgatggcagacattggaaagaacgtgaaggttgagtgcgagaaaatgggttctgaggacttcagcttcatcctatatacctcgggaaccacaggaaggccgaaaggagcgcagcactccgtcggaggctatgcggttcacctctacactacaatgaagctcattttcgatatcaaggatgacgacatattctggtgcactgccgacatcggctggattacgggacacagctacattgtttacggtccactgatgtgcggtgcgacgaccatgatgtatgaaggcgccccagacttccctgacgtgagcagatgggcagcgatgattgagcgctacggagtgacgatattctacaccgccccgacggcaataagaatgctcatgcgcttccctgaggagaactacaccaagtacgacatgtcaacgctgagaataatccacagcgttggagagccgattaaccccgaagcttggagatggtactacagggttttcggtagagaagatgttgtctgctcaagcacatggtggatgacggaaactgggggtatgctgacggaccacttcccaggattggggaagataattccacttaagccgggcacaaatggctatccaattcctggagttaggatggaggttcttgatgatgagggcaattctgtgaaaccgggagaaagaggctacctcgttatctccacaccatggcccggaatgctcatgacgctgttcaaagacccaaacaggttcattgacgtttacttcggcaagtacaagagcaagggttggtattactacacaggcgactttgccatgttcgatgaggacggctacgtctgggttcttggaagggctgatgatatactgaaggttgctgggcacagaattggaactgctgaaattgaatcggcaatggtctctcatccggatgttgctgaagcagcctgcgttggcaaatccgacccggtaaagggagagattccgataatctacgtggtgctgagagaaggtgttgaaccctcaccggatatggtgaacgagctcaagaagcacctcagagccactctcggccctgttgttgccagcgatgctgtgataaccttcgttaacactctacccaaaacaagaagcggtaaaatcatgaggaggctgcttagggctgttgcagagggcaaagagctcggtgacgtcacaacccttgagagcgaggttgcggttgaggaggcgaagaaggcctacgagatggttaaggcggcccttgaggggtccaaatcctaa

SEQ ID NO: 24630 - DNA, 1194 bp, Archaeoglobus fulgidus
atggcttcaaagtggctcgttatatttgcaggctttctgctcaatctcatgctcggaatagtttacgcatggagcgtctttgttaacccgctaatgaataccttcggctggagcaaaaccatcgcttcactgcctttctcaatattcctgctgattttcgcactcatgatggttcccgcaggaagaacgcaggacaggatagggccgagaaaggttgcaatgctgggtggtgtgctgcttggtgtcggctttctgctatcggggttaattgagtccatccagtcaccctactggctcattttcagctacggcgtcatagctggagctggatgtggactcggctacgcatgccccatcccagtggcaagaaaatggttccccgaaagggttggtctcgccactggactggtggtcatgggtttcggaatgagcgccctcatctttgccccccttgagaggattttaatcgatacatacggcataagcaccaccttttacattcttggagtcattttgctcatcgtcgcagtttttgccgcatctctgctttccaaccctccagaactgcctgctgtccaagcatcaaatcctgccaaggttgaggttgtaacaggtaagcctgagctcgggccgtcagaaatgcttagggattacaggttctacgtcctctggctgagcttcttcttcatggctctggcaggattaatggtcatcggccacatcgctccctacgctcaggagaggggcttggagcctctggccgctgcattcgccgtgagcattctgtcagtagcaaacgctgtcgggagaccgggggctggagcactttctgacaaaatcggcagggcaatgacaatgttcgtcctctttctgattcagggaattacactcattgccttcccgcacgttgcccttacactgataaccatctacatctgcgctgcaataataggttttaactacggagcgaacttctcgctattcccttccgccacaggagactttttcggcacgaaaaacctcggtgtgaactacggccttgtctttacgtcctacggagtcggagggctggttggaccaataatggctggttacgtctttgacgttacgggaagctacgaaattgcctttctcgttgcaggagtgttagctttaattgcagcctttatgagcttcctcctcaggaggaagtga

SEQ ID NO: 24631 - DNA, 552 bp, Archaeoglobus fulgidus
atgcaggattacaagataaaaatcgagaatgttgtggcatcaacccagattggagaaaatatagatttgaacaagatttctagggaaattaaggactcagaatacaaaccaaagcagtttcccggactggttttgagaacgaaggagccaaaggctgccgctctggttttcaggagtgggaaggtcgtgtgcacaggctccaagagcgtggaggacgcaagaagggcggtaaagcaaatcgtgaagatgctgaaggaaatcggcatttcggtaatcgacgagcctgaggtgaaggttcagaacatcgtagcttctgcggacctcggagttgatttgaacctcaacgcaatagctatcggtctgggacttgagaacattgagtacgagccggagcagtttccgggtctagtttacaggcttgacaatccgagagttgtcgtgctgattttcggttccggcaagatggttgttacaggcggtaaaagccctgaagatgctagaaaggctgttgaaaggatttctgaggagctcagaactctgggactgatgtaa

SEQ ID NO: 24632 - DNA, 1332 bp, Archaeoglobus fulgidus
atgagctggattgatgagctttcaaaaattgttgaggtctttccaccatcggacgcttatcgcttcgatgaaactccacctctcgttgctcccagagcagctgaaaatttcgttgtggtgaagcccagcaacagcgaggaggtctcggcgattttgaagttcgccaacgaaaaaagtataccagttttcatgaggggcggtgggactgggcttagcggcggggctgtgccgactgaggagggcattgtactctcaactgaaaaaatgacagagcttgaggttgatgccgacaacagagttgctatttgcggtgcgggagttactttgaagcagcttgacgatgcagccttcaggcacggcttgagcttcccgccccatcccggagctgaaaccgcaacagtcggagggatgattgcaaccaacgctgggggagtgagggctttgaagtacggaaccatgaggaactacgttctcagcctcgaagctgttcttgccgacggcaggataatcaatgttggcgggaaaacgataaagaactcctcgggctactctctccttcaccttcttgtggggagtgaggggacgcttgcagtgataactaaggcaacaattcgccttttcccgcagatgagggacatgactgtcctcgccatcccctttccgacgatggaggatgctatgaactgcgttgttgaggttgcgagaaaaatgctccccatggccctcgaattcatggaaaagagggcagttgagattggggagaaggttagcggggagaggtgggtgagcagggagggggaggcacacctcctgatggtcttcgagagctttgatgaggccgaggaggctgcaaaaattgcccagtcgcttggagcgattgacgtttacgcagcaaccacaaagaaggatcaggacaggctgctgaaagtgaggggaatgatttacgaggggctgagaaaggaggtcattgaggttctcgacgcctgcgttcctccagctaaaattgccgagtactggagaaggagcaacgagcttgctgaagaatatggcatcgagctaataacctacggccatgctggagatggcaacgtccaccagcacccgctggtttacgagggatgggagaaaagctactttgagttcagaaagtccctcctcagcctcgctgtcagccttggcggtgtgatcagcggcgagcacggtataggggcggttaagctttcggagctagaggagctgtttccagagcagttcgagctgatgagacaaatcaagctcctcttcgacccaaaaaacatcctcaaccccggcaaggttgttcgcaaactataa

SEQ ID NO: 24633 - DNA, 855 bp, Archaeoglobus fulgidus
atgttctcagcacacgctcctgcgcttgtggattatatctatctcatcgacaggtatccacaaaggggcgggcacagcataatcctctccacccggaaatcgccgggtggtgcaggtgcgaacgtggcccacaaccttgccagcctgggtgttgaatcaacgctcttcacgacactgggaagggacgaggacggaatttacttcgtcgagaacaccttggcgaaggtgaaagccgagataactgatgagaaaacgggcaaagttcacgttttcgtcgatggggagggagagagaacgttttttgtagagccaaatgccgctggaaagccatttgttgaggtggatggcggggattacctctacctcgaccccttcccttccgagcacagctttgaagttcagagaaaggaggctgagagatttgatggctttgtaatactcaatcccggttttccctattcaagcctcggatttgaaaggctcaagcagattcttcagcacgtggacatgctcataatgtccgctgacgagttcagccttcttggtgttgagaccgcagacgtgctgagattcgtggactacctgattgtcacccaggggaagctaggcagcgcttgctacaccaagaagggcagctttcagtccccagcatttccagccaaggttgctgacaccactggagcgggggatgccttcgctgctggcttcatctatggctttatcaaaaattaccccctcgaagtctgccttacgctgggaaacttctgcggagcttacaacgtcgaaagggttggagcgagaaactttccatcaaagagcaccatcgatgaatttctcgcaagagttttaagatga

SEQ ID NO: 24634 - DNA, 1161 bp, Archaeoglobus fulgidus
atgtttaagttggcggacagactggaaaagattcccccgtatcttttcgcagagatcgatgcaatgaaaaggaaaaagttgcaggaaggagttaaggtaatcgatttcggagtgggcgacccggacctaccaacgcctgagcacatcgttgaggcgctgaaaaacgccgctgagaaggttgagaggcagaagtatccaagctacgaggggatgcttagcttcagagagagtgtggcaaggttctacaggagaagaaagggagtgaatcttgaccccgaatcggaggtaatctctctcatcggctccaaagaggggatagcgcaccttccgctcgccttcgtgaacgacggagactatgttctcgtaccagagccggggtatcctgtgtactactcctccacattgcttgccgacggcgtaccttatgaaatgccgctaaaggaagaaaacaaattcctgcccgattttcagttgattcccgatgaaattgccagaaaggccaaaataatgtttctgaactacccaaacaaccccactgcagccgtggctccaaaggagtttatcaaggaggcaatagacttctgcatagacaacaaaattattctagcccacgatgcagcctacagcgagattaccttcgatggctacaaggctcccagcttccttgagtttgaggatgcctttgaagtctgcgtggagttcaactccctctccaaaacctacaacatgaccggctggaggataggattcgcctgtggtaacagagatattcttgccggccttttaaaggtgaagaccaacgttgacagcggggtttttgaggcgatacaggaggctgccatagccgcgatggatggccctgacagagttatagaggaaaactgcaaggtgtaccagaggagaagggacctgctggttgaagggttgagggatgttggaattgacgccgaaaaaccgaaagctaccttctacgtctgggcaaaggtgggcgggagcagcatcgagttcgtaaagcagttaatagataaggcaggaatagtggcaactccggggattgggttcggcaagtctggagaagggttcgtcaggtttgccttaaccagaggagagggtgttatagaggaggcaatagataggctgaaaacaatattacataaataa

SEQ ID NO: 24635 - DNA, 915 bp, Archaeoglobus fulgidus
atgttcgagaagattggagttgtcggattcggcctgatgggcacccagataacccaattttttgcccagcagggtttggaggttgttgcgattgacgttagcgaggaaaggctgaggaagggaatggaggcgataaaagccggcagatttggactgcagaggcttgtggaaaaaggaaaaatcacggaggaggagatgaacgctgtgctgagcagaatatccaccagcacatctcacagcgctttaaaggactgtgatctggtaatagaggccgttttcgaggacgttaacctgaagctgaaggttctgagggagattgatgctgttacggatgcggtcataggctcaaacacctcctcaataagcataaccaagctctcctccgccgtcagcaacccagagaggtttctgggcattcacttcttcaacccagcgcagattcagaagcttgttgagcttgtaaagggcttgctgagcgacgagaagcttgttaacggcatcagagactggttcctcaagctgggaaaagtgcccatcgtcgtcaatgactcccccggctttgctacctcccgccttggccttgttcttggcaaggaggccttgctgatggttcaggaaggtgttgcgacaccgcaggacatcgacatcggcatgatgctcggctacggctactctatgggccccattgagacgggagatttggtcggcctcgacacgaggctcagaatctacgaggcgatgttcgaggcaacgaaagaccccaagtgggcacctccaaagctactcgtccagcttgtggatgctggctatctgggcgacccatcgttaaagccgggcagcaagggaggtgtttacgagtacttcgggcaggagagggctactgaggtgctgaggaggttgggggttcgtaagtga

SEQ ID NO: 24636 - DNA, 771 bp, Archaeoglobus fulgidus
atgggagagagagtcaagcttgagcttgatggtgaaattgctgttgcaaccctcaacagaccagagaagctaaacgctcttgacaccaaaacgaggatggagctggctgaggttattgagggcatcgaggaagtggcaagagttttaatcattaccggcagcggcaaggcctttgctgccggcgctgacatcaacgagcttcttcagagggatgcaattaaggcttttgaggcaacaaagctcggaacggatctcttttcgagaattgaggagcttgagattccggtgattgccgcagttaacggatacaccctcggtgggggttgtgagctggcgatggcgtgcgacataagaattgccagtgaaaaggcaaagttcgggcagccagagataaacctcgccataattcccggagcgggagggacgcagaggctgccgaggctcgtggggctggggatggcgaaaaagcttgttcttacgggggagataatcgatgctcagactgctttaagaatagggctggttgaggaggttgtggagcacgaaaggctgatggagagggcaaaggaggttgccgctaaaataatcgagaaatcgcctctcgctgtaaaggtggcgaagaaagctttgaacgcatcaatcaacatgcccctgaaggaggggctgaggtatgaggcaagcctcttcgccctgctcttctccagcgaggatgctaaggaggggatgagggcgtttctggagaagaggaagcctgagtttaggggaaggtga

SEQ ID NO: 24637 - DNA, 1149 bp, Archaeoglobus fulgidus
atggattttaagctaactcctgagcaggaggacataaggagggctgcgagagagtttgctgagaaggagttcacccccgaagttatagaggagtgcgatagagaggaaaagtatccaatggaaatcgtcaggaaggcgagagaccttggcttctcgacagtgaagattcctgaggagtatgggggtatggggttaagtctttttgaggaagctctggttacggaggagttctacagggttagtccggggatagggaatgcttgccttagctcaaccttcggcactgagcttctcatcctgttcggcagtgaggagcagaaggagaagtatcttagatgggtgactgagaggcacgggatttcggcaatggcgacaaccgagccagaggcgggaagtgatgtggctaacgttaagaccaaaatcgtcaaggagggggacgagtgggtcataaacggcaccaagatgttcatcaccaacggcactgtctgcgatttcgttttggttctgggtagaacctacgagggggagaagaggcaccacggcctcaccttcgccattgtggagagcaagagtaaggggtttaaggctacgaagataaagaacaagctcggcctcagggcgagtgatacagctgagattgtgctgaaagatgtaaaggtgccggaggagaacattctgggcgagccgggaaagggcttctactacctcatggagttcttcaaccacacgagaccgagggtggcggctcaggctgtggggatagctcagggggcttttgagcttgctttgaactacgttaagcagaggaagcagttcgggcagccgattgctgcatttcagcacacgcaattcaagattgccgagatggcgacgcgcattcaggctgcaaggctgctgacgtggcaggctgcttggcagtgcagcatcgggcagtcaaggcctgagctttcctcgatggccaagtggtttgcaggggagacagctgtttacgtcgcagactggtgcgtgcagcttcatggtggctacgggtacatcggcgagtatccggcagagcgctactacagggatgcgaagctgatggagatttacgagggaacgaaagaggttcagaagcagataattgcgagaaggttgataggaaagctttga

SEQ ID NO: 24638 - DNA, 1164 bp, Archaeoglobus fulgidus
atgagagttggagttatcggcgttggatgttcaaggtttgggagaagagatgatgctgtaattcaggagcttgcctatgaggctgttaaggaggcgcttgacgatgcagggataactcaggatgaggttgagctgagcgttgttggatcagtaaatacgaggggatacgagctgatgcctgctgttcctgtaaacgagtattgcggttttgcgggtaaggggcctctgagggtggaggctgcctgtgcaacaggagctgctgcggtttatacagcgtacacatcaatcgcttcaggcatggctgacgtggccatagccattggcgtggagaagatgactgaggttgacactgccacctccctcgctatcggcggcagggcggggaattatctgtgggagttccaccagtacggcacgacctttcccgcttactacgcaatgcacgcaaccgcccacatggcgaagtatggaactactgaggagcagatggcaaaggttgcggttaaggctcacagaaacgctgccagaaacccgaaggcgcacttccagaaggagattgccgttgaggacgtgctgaattcgaggtacatcacctatccactgaagctctacgactgctccccgataagcgatggctcggcagcagcaattctggcgagtgaggagaagataagggagctcggcattgacgatgtcgtgtggattgactcggttggctacgcatcagacacctcaaatatgaccaacagggagagctttgtcggccttaaagctacggttctggcgagggagatggcttacaggaaggctggcatagaggagccggtaaagcagcttgattttgctactgtgcacgactgctttaccatcgccgagattatggcctacgaagacctcggcttctgcaggaagggcgagggagggaagcttgtggagagcggggagacagagctgggcggaaagcttcctgtaaataccttcggcggtttaaaggcgaaaggtcatccgttggcagcaacaggagttgcgatggtttacgaaatcgtaaagcagctgcgtggagaggctggggagttgcaggttgaactgaggaacaacagggctttgctgcacaatgtgggcgggacgggacattttgcctttgtcatgattttcgggaggtga

SEQ ID NO: 24639 - DNA, 1341 bp, Archaeoglobus fulgidus
atgagagcaggaggagccggagagctttttggaaccaatggagttagagggattgcaaattccgagcttacagccgatatggctctaaaccttggcaggaccattggaacgctaaggcagggcaagatagccatcgcatgcgacacgagaatttcaagctcaatgctcaaatctgcagtttcggctggaataatgtccactggcagtgatgttgttgacatcggcattgcccccacaccggcccttcagtattacgtgaaggagacggactgctcagcaggggttatagtgactgcaagccacaatccgagagagtataacggcatcaagttcgttcaggagaatggggtggagttctacagggagatggacgaggagagcgagagagtttacatgagcaagaagttcaggatcgcagaatggagcgaggtggggcagctttaccaagacaattcggggctgaggaagtacatagaggccatcatcaactcagttgagcttgacaaatcctacagggttgccgttgactgtggaaacggagctggctgcttcaccactcccgaaattctgaaggagcttggctgcgacgtttatggaataaactgcaaccccgacggcagattccccgcaagaaatcccgagcctgtagaggcttcgctggatttgctgaagaaggctgttgttgacttcagggcagatttcggcgttgctcacgatggagatgctgatagagcggtttttgttgacgagaagggaaacttcgtcaatgaggatgtgatgctcgctctcatggcaaagcactacgttgagaagaatggaggggggttggtggtaactccagtctcatcctcaaaatgcgttgaagatgcggttaagatggctggtggagagattatttacaccgccgtaggctcgccagtggttgcaaaggtgatgattgaaaaggaagctgttttcggcggagagggaaatggtgggctgattttcccagagcatctcattgcgagagatggggggatgagcgttgcaaaggttctggagcttcttgatgagaaaagaaagaggttgagcgagcttgcggctgagattccaagataccacattgtaaaaggcaaagtggagtgcagggagaagaagagactgcttgaagggctgaaggaggagtttcccgaagccaatcacatcgatggagcgaggattgacttcgaggacgggtgggttttaattcgcccctcagggactgagcccattgcaagggtttatgcggaagcaaaaactgaggatagggcgagggagctttacgagctgggattgagggcgataaaaaagattttaggctaa

SEQ ID NO: 24640 - DNA, 1233 bp, Archaeoglobus fulgidus
gtgcaccggctgcggaatctgcgtgaagatgtgtccgatgggagccttggccatggtggaggtggactaatgtacgacgttgtggttgttggagccgggccagcgggaagcatggcagcgaaaaccgctgcggagcagggtttgaaggttcttctggtggaaaagaggcaggagattggcacgcctgttagatgcgccgagggaattagcagggagagcattgagaaattcttcgaagtggacaagaagtggattgcggccgaggtaaccggagcgaaaatctatgccccgaacaaaaccgaaatcgtgatgtcagaggagatggctggcaatgaggttggttacgttcttgagaggaaaattttcgaccgccacgttgccagacttgccgcaaaggctggggcggaggtttatgttaagacggcaatggtcgattttgagagaaaagatggaaaggtgaaggtaaagctcaggaggctcggagaagactgggaagttgagacgaaaattttgatcggagctgacggcgtggagagcaagattggcagaaaggctgggataatcaagaccctcaagcttaatgaggtagagagctgtgctcagtacctcatgaccggtctcgatatcgatgagagctacacgtacttctacctcgggagagagcttgctcccggcggctatgcctggattttccccaagggaaacggttcggcaaatgtgggtataggagttctgccgaaaatggccgaaaggactgcaaaggagtaccttgacgcattcatcgagaaagagggtattgagggaaagatagttgagtttgttgccggagctgtgccggtttacggagaaatcgagacagctgtggcggacaacataatgctcgctggagatgctgcgtatcatgcggaccccattacgggaggtgggattgcgaacgccctgtctgctggctactacgccggaaaggttgcggcagaggctgttcagaaaaacgatttctcggcagatttcctgagaagatatgatgagctctggaaaaacgacttcggtaaaaagctgagaagaaacaagaagctgcagctcaagttcatcgacatggatgatgcgctcctcaacaagcttgcaggggcgattgcgggcaaaaatttaagggagatgagcgttgccgcgatagtcaaggagcttctaaaggcgcatccgaagctcctctgggacctcaaggaccttttctaa

SEQ ID NO: 24641 - DNA, 2415 bp, Archaeoglobus fulgidus
gtggtaaaggatacttatatctcttcagccagcaagactccgccaatggaaagaaccgtcagagttaccggaatgacgtgcgccatgtgcgtcaagtcgattgagacggctgttggaagcctggagggtgttgaagaggttagggtaaatctcgccaccgagacggcttttataaggtttgacgagaaaaggatcgattttgaaacgataaagagggtgattgaggacctcggttatggtgtggtggatgagcaagctgctgttagtgcggaggttgagcacctttcaagaatgaaaaggaagctctacgtggcagcctttgccggagtattgctgctctttcttgcgcactttatcagcttaccttacgaggacttcgttcagctcttgatagccttgcccgctatcttttattcggggagctcgattttcaaggctgcattctccgctttgaggcgcagaacgcttaacatggatgtaatgtactcaatgggagttggggcggctttccttgcaagcgttctatcaaccgccggagtccttccaagagaatactctttttacgagacgtcggttttgctgcttgcctttcttctccttggcagaacgcttgaggcgagggcgaagagcagaaccggggaggccataaagaagctcgtagggcttcaggcgaaaacagcggttgtaatcagggatggaaaggaaatagcggttccggttgaggaggttgctgttggagacatcgtgattgttaggcctggggagaagataccggttgacggtgtggtggtggagggggagagctacgttgacgagtcgatgatttcaggtgagcctgtgccagtgttgaagagcaaaggtgatgaggttttcggggcaacaatcaacaacacgggtgttttgaaaataagggccacgagggttgggggtgaaactcttcttgcccagattgtaaagctggtcgaggacgcgatgggcagcaaacctccgattcaaaggctggcagacaaagtcgttgcatatttcatccccacagtgcttctcgttgcgatctcagctttcatttactggtacttcatcgcccacgctccgttgctctttgccttcacaacgctcatcgcggttctggtggttgcctgcccctgcgctttcggccttgccacaccgacagcattaactgttggaatgggaaagggggccgagctcggaattcttataaaaaatgccgacgctctcgaagtggctgaaaaggtcacagctgtaatttttgataaaacgggcactctcaccaaaggaaaaccggaggttacggatttagttcccctcaacggggatgaaagggaacttttgaggttggctgcgatagccgagaggaggagtgagcatcccattgctgaggccatcgttaaaaaggctttagagcatggcattgagcttggcgagcccgagaaggttgaggtcattgctggcgaaggtgttgtggcagacggcattttggtggggaacaaaaggttgatggaggactttggggttgctgttagcaatgaagttgagctagcgctggagaagctggaaagggaagccaagaccgccgtaattgttgcaaggaacggcagagttgaggggattatagcggtttctgacacgctcaaggaatctgcgaaacctgctgtgcaggagcttaaaagaatggggataaaggttggaatgattacaggggataactggaggagcgccgaagccatttccagagagctgaacctcgacctcgtcattgcggaggttctgccacatcagaagtccgaggaggtcaaaaagctgcaggctaaggaggttgtagcctttgtgggggacggcataaacgatgccccggcactggctcaggcagacctcggcattgccgtagggagcgggtcggatgtggctgttgaaagcggagacattgtgcttataagggacgaccttagggacgtcgtagcggcaattcagctcagcagaaagaccatgagcaaaatcaagcagaacattttctgggccttgatttacaacgtaatcttaattcccgccgcggcgggcttgctttatcccatctttggcgttgtcttccgccccgaatttgcaggtttggctatggcgatgagcagcgtgagtgttgtggcaaactccctgctcttgagaaattacgttcctccgataaggaggggaggtgatagtgtggagaagattgtattggagctttcaggactgtcatgccaccactgcgtggccagggtgaagaaggctttggaggaagcaggagcgaaggttgaaaaggtcgatttgaacgaggctgttgttgctggaaacaaagaggatgtggataaatacataaaggcagttgaagcagcaggataccaggcaaagctcagaagctaa

SEQ ID NO: 24642 - DNA, 1230 bp, Archaeoglobus fulgidus
atgagcgctgttaagcttgtggaacttctgctaactgcagaaatattcaacaggtatgaggagctaactgaagatgacataccgaaggaaatcaggaaactgctctacaacaagggaggtataaaaagaccggtagtgatcagggaggatactgtaatgagatatgcggggaaagttgagcagaagccaccttttgttgaccttaactccttctcaagacagtacattctcacatcctttgatttagctgtcaaatggtttgcaagcaggggagttgagttgataaagaaaaaccccgcactcgcttacttctaccagaattacgactccctcgatgtatcctacgaggaggcgaagaaggccaaccttccgaagcacggagacaaggagtggctcaaaggcttgatagaggaacttgagaagaaggacgagacaagggagatgctgtcccttgtgagagtgctgtcccccgaagaaattccagttgacttcagggaggtggccctaagcgaggagcagcttgaagaggtcaggaagattgagattgcattggaagagagaagttttctgaggaaaattggcctttcggacattggtaagcttctgttcataggcccgcccggcacgggaaaaaccaccactgcgagggccttgagcaaaaagctttaccttccactgcttgaagtgaagctctcaatgattacaagccagtatcttggcgagacttcgaagaacatcgagaaaatcttcgacatagcgagaatgatgtctccctgcattctgttcattgacgagtttgattatgttgccaaaatgaggacgagcgacgagcatgctgccattaaaagggccgttaacaccctccttaaatccatcgacgacataaacctcgttgaggatggagttctgcttatagctgcaacaaaccacccctccctgctcgaccctgcagtctggaggaggttcgacaaggttattgagttccctgagcctgctgaagccatcaggaagagaatctttgaaatatttctggcaagaattgatggcaatttcaacattgacgagcttgtgagggagaccgatgggtttacgggagcggacataaagctcgttgttagggaagctgttctcgatgccctccttcaggggagaagagagctcactcaggaagaccttctgaatgcgataagggaagtcagggagaggctcaagcttaagaaatcctactga

SEQ ID NO: 24643 - DNA, 642 bp, Archaeoglobus fulgidus
atgagcatgatagaggagaagatatataagggaaccacgacggtgggcttggtttgtaaggacggagtagtcatggctaccgaaaagagagccacgatgggaaacttcattgccagcaaagctgcaaagaaaatctaccagattgccgacagaatggccatgaccaccgcgggcagtgttggtgacgctcagttcctcgcaaggatcattaaaatcgaggcaaacctgtacgagataaggagggaaagaaaaccgaccgtcagggcgatagcaaccctaacgtccaaccttctcaactcctatcgctatttcccctacctggtgcagcttctcataggcggaattgactcagaggggaagagcatatactccatcgacccaatcggtggtgcaatagaggagaaggatatcgttgccactggcagtggtagccttaccgcctacggtgtgcttgaggacagattcacaccggaaattggagtcgacgaggcggttgagcttgcggtgagggccatatactccgcaatgaaaagagactctgcttcgggagatggaattgacgtggtgaagataactgaggatgagttttaccagtacagtcccgaagaggttgagcagatactggccaagttcaggaaataa

SEQ ID NO: 24644 - DNA, 741 bp, Archaeoglobus fulgidus
atgcatttaccgcaaatgggatatgatagggcaataacggtattcagccctgatggaagactgttccaggtggaatacgccagagaggctgtaaaaagaggagcaacggctataggcattaagtgcaaagagggtgtcatcctgatagctgataagagggtaggcagcaagcttctcgaggcggacacgattgagaagatatacaagattgacgagcacatctgtgccgcaacatctggactagtggcggatgcaagggtgcttatcgacagggcgagaatagaggcccagattaacaggcttacctacgatgagcctataacggtgaaggagcttgcaaagaaaatctgcgacttcaagcagcagtacactcagtacggaggtgtaaggccctttggcgtttcgcttctcatcgccggtgtcgatgaggttccgaagctatacgaaactgacccaagcggtgccctgctggagtacaaggcaacggccataggtatgggcagaaatgcagttaccgagttcttcgaaaaggagtaccgcgatgacctcagcttcgatgacgccatggttctcggactcgttgcaatgggactttccattgaatcggagctcgtcccggagaacatcgaggttggctacgttaaagttgacgacagaaccttcaaggaagtgtctcctgaggagctcaagccttacgtggagagagcgaacgagaggattagggagctgctgaagaagtga

SEQ ID NO: 24645 - DNA, 2346 bp, Archaeoglobus fulgidus
atggaaagagttgagggctggctcatcgatgcagattacgagacaatcggtggtaaggccgtagtaaggctgtggtgcaaggatgatcaggggattttcgtcgcatacgactacaacttcgacccgtacttctacgttatcggcgttgatgaggatattctgaaaaacgctgcaacttctacgagaagagaggttattaaattaaagtccttcgaaaaagctcagctgaagactctaggaagggaagttgagggatacatcgtttacgctcaccaccctcagcatgttcccaaattgagggactacctgtctcaattcggcgatgttagggaagcagatattcctttcgcgtaccgctacctaattgacaaagacttggcttgcatggacggcatagcgatcgagggggaaaagcagggaggggttatcaggagctacaaaattgagaaagtggagagaattccgagaatggagtttccagagcttaaaatgctcgttttcgattgtgaaatgctatcttcatttggtatgcccgagccggagaaggacccaatcatagtcatatcggtaaaaaccaacgacgatgatgagataatcctcaccggagatgagagaaaaatcatctcggattttgtcaagcttataaagagctacgatcccgacataatcgtcggatacaatcaggatgccttcgactggccctatttgaggaagagggcggagagatggaacatcccgcttgacgttggaagggacggttcaaacgtcgttttcagggggggaaggccaaagataactggaaggctgaacgttgacctttacgacatcgccatgagaatctcggacatcaaaataaaaaagctcgagaacgttgcggagtttctcggcacgaaaatagagattgccgacattgaggcgaaggacatttaccgctactggagcagaggggaaaaggagaaggtgctcaactacgccagacaggacgctataaacacctatctcatcgccaaagagctattaccgatgcactacgagctttcgaaaatgatacgtctgccagtggatgacgtaacgaggatgggaaggggaaagcaggtagactggctgctgctcagcgaggcaaagaagattggggaaatagctccaaacccacctgaacacgcggagagttatgagggtgctttcgtccttgagcccgagagggggcttcatgagaacgtcgcctgcttagactttgcaagcatgtatccttccataatgatagccttcaacatcagcccagacacatacggctgcagagatgactgctacgaagcccccgaggttgggcataagttccgcaagtcacctgacggatttttcaagagaattcttagaatgctcatagagaagaggagagagctcaaagttgagcttaaaaacctcagtcctgaaagttctgagtacaaacttctcgacataaagcaacaaactctgaaggttctcaccaactcgttctacggctacatgggctggaacctcgcaaggtggtactgccatccctgcgctgaggcaacaacagcttggggaagacacttcatcaggacctcggcaaaaatagcagaaagcatgggattcaaagttctttatggggatacggacagcattttcgtcaccaaggcaggaatgaccaaagaggacgtggataggttgatagataagctccacgaggagctgccgatacagattgaggtggatgagtattactcagccatattcttcgttgaaaagaagcgctatgcggggcttactgaagatggaaggctggtggtgaaggggcttgaggtaagaaggggagactggtgcgagctggccaagaaggtgcagagggaagttattgaggttatactcaaagaaaagaaccccgaaaaggctttgtctctggttaaagacgttattttgagaatcaaagagggaaaagtgtctttagaagaggtggtgatttacaaaggtctaacgaagaagccgtcaaagtacgagtccatgcaggcccacgttaaggccgctctaaaggcaagagaaatgggaatcatttatcctgtctcgtcaaagattggctatgtgatagtcaagggctccgggaacataggggacagagcctaccccatagacctgattgaggacttcgacggggaaaatctgaggataaaaacgaagagcggaatagagataaagaagcttgacaaggactactacattgacaaccagatcatcccgtcggttctgagaatacttgaaaggttcggctacaccgaagcctccttgaagggttcatcgcagatgagcctggattcattcttcagctaa

SEQ ID NO: 24646 - DNA, 1761 bp, Archaeoglobus fulgidus
atggcgatagaggggattgtcaggaaggttactgaagtcaggccgagaattgttgaagccgcctttgcctgcctgaactgcggaagcataaccatggttcctcaggaggacagccagctcagacagccctttgagtgcagcaagtgcagcacgaagaagatgatttttctcccggacagcagcatctccgttgacagtcaaagggtgaagattcaggagtaccccgaaaatctcaggggtggggagcagccgcagacgatagacgtcatacttgaaggtgatttggcaggctccgtgaatccgggggacagggtgataataaacgggatcgtgagggcgaagccgagagggcttgggcagaggaaaatgacgcatatggacctttacatcgaagggaactccgttgaggttctccagcaggagtacgaggagttcgagattaccgagaaggacagggaactgataatgcagcttgccgcaagcgacgacatctacgagaagatagtaaagtcgatagccccctcaatatacggtcatgaggacgtgaagcttgccattgcccttcagcttttcggcggcgtgcccaagaagctgcccgacggcactgaaataaggggggacattcacatccttcttgtgggcgatccgggcgttgccaaatcgcagcttttgaagtacgtccacagaatagctccgcggagcgtttacacaaccggaaaggggacaacaactgcaggcctcactgccaccgcagtcagagatgaggtggatggcaggtggactcttgaagccggagccctcgttcttgcggataagggcattgcgttggttgatgagattgacaaaatgcgtaaggaagacacctcggcattgcacgaagcacttgagcagcaaaccatcagcgttgccaaagcgggaataaacgccatcttaaaggccagatgcgcgttgctcggtgcggcaaatccgaagtacggcagattcgagaaattcactcccgttcctgagcaaattgagatgtcccccaccctcctttcaaggttcgacctgattttcgttctgaaggacgagccggatgaggagaaggacaagaggctcgttgaacacattctctactctcaccagcttggagagatgacggaaaaggccaagaacgttgccgcagagtacgacgaggagttcataaggcagaggtcggagaggatagttccggaaattgaccccgacctcctaaggaagtacatagcatatgcaagaaaaaccgtctatcccgttttgacagatgaggctaaggaaaaaatcaaggagttctacttgtcactcaggtcgagagttaaggagaactcccccgttcccataaccgcaagacagcttgaaagcatcgtcaggcttgcagaagcctctgcgagagtcaggctcagcgacagggtggagccggaggacgtggacagggttatcgaaatcatgatgaggagtctcagggagattgcggttgaccccgaaacgggggagatggacatagacctggcctactcgggcacctcgaaaacgcagagggacagaatcatgatactgaagaaaatcatcgagcagcttgaggaggagcacgaaaggggtgttccggaggagctaattctggaggaggcagagaaggagggaatcgataggacgaaggccaaagagattctttccaagctcaaactgcacggagaggtttacactccaaaacacgggcattacaaattggtaagcaaactttag

SEQ ID NO: 24647 - DNA, 804 bp, Archaeoglobus fulgidus
atgaaagaaaagaggctaatcataaagagaagtggttatccttctaagggcgagattgtcataggaacggttaagagggtgctcgattttggagcctttgtttcccttgatgagtacgagggcagagaagggatggttcacattagcgaggtcgcgtcaggttggattaaggacatcagggagcacgtcaaaaaaggacagaaggtaatatgcaaggtactcgatgtaaatccgaaaagagggcacattgacctctcgataaaggacgtcaacgagaggcagagaagggagaagcttcagcagtggaagaacgagatgaaggcattcaagtggctcgaaataatcggcgaaaagctgaatatcgatttcaaggagcttgagaaaatcgggaagaaactcatgaaggagtacgattccgtttactccgccttcgaggaggctgcttttgagggatatgaggttctcgctcccattgtaggggaagagtttgccaaggagatggcggagatagccagggagaacataaagcccaaaagggttaaggttagagggtacttcgagcttaagagcagcgcttctgacggaatcgagaggataaaaaaggcccttcttgaggccaaaaaggctctggtaaatggtgtggagatgaagcttgagtacgtcggcgcacccaagtacagaatcgtcgtagaggcggatgattacaaaaccgccgaaaacgttttgaagaaggccacagaaaatgtactgaaagcgatcaaaaagcttggtggagagggcaacttcatcagggaagcggcatga

SEQ ID NO: 24648 - DNA, 774 bp, Archaeoglobus fulgidus
atgctcaaaatcgccaccttcaacgtaaactccatcaggagcagactgcacatcgtgattccgtggctgaaggagaacaagcctgacattctatgcatgcaggagacgaaggttgagaacaggaagtttcctgaggccgattttcaccgcatcggctaccacgtcgtcttcagcgggagcaagggaaggaatggagtggccatagcttccctcgaagagcctgaggatgtcagcttcggtctcgattcagagccgaaggacgaggacaggctgataagggcaaagatagctggcatagacgtgattaacacctacgttcctcagggattcaaaattgacagcgagaagtaccagtacaagctccagtggcttgagaggctttaccattaccttcaaaaaaccgttgacttcagaagctttgctgtttggtgtggagacatgaacgttgctcctgagccaatcgacgttcactccccagacaagctgaagaaccacgtctgcttccacgaggatgcgagaagggcatacaaaaaaatactcgaactcggctttgttgacgtgctgagaaaaatacatcccaacgagagaatttacaccttctacgactacagggttaagggagccattgagcgggggctgggatggagggttgatgccatcctcgccaccccacccctcgccgaaagatgcgtggactgctacgcagacatcaaaccgaggctggcagaaaagccatccgaccacctccctctcgttgctgtgtttgacgtgtag

SEQ ID NO: 24649 - DNA, 915 bp, Archaeoglobus fulgidus
gtggggatattaatacttccgcacctcaaactatatctatcctgcagccctcaaaatttcatggtaatcttggtgggcgggacaaacgggctgatggctctgaaagttgcgaaaatctccggcctccctctctgctactcccacgttgaccgctatcctgacggagagaagtacttccgctttgcctcgaacattgatggggaggatgttgttatattcaactccatgcatcccaatcctgacgagataatcttcgaaacgctcctcatagctgaaacggcctacagcaacggagcaaggtcggttacatgcgtttttccctactttgcctacgcgcgtagtttggataccgtaaagggggaagctttgcccatcaaaaccgtcgtgaaggtgctgaaagcagcaggtgttaagaaaattatcacggttgacttccaccttcaggagaacgtgtttggcgttgaacatgttgacctcaccggaatggagaagctggcggaatactgccttgaggagttctccgacagttttaccgtccttgcccctgacgagaaagcggcattctgggcggagaagtttgcggccaaggccaactgtgacgttgtggctctgagaaagataagaatagatgcggagaacgtgattatagacgatttaaggacgggagttgagggcgatgttgttatagtcgacgacatagtttccaccggaggaactgtctgccaggctgcaagaatagcgaaaagggctggagcaagaagagtctttgtagcatgcacccacgcaattcttgcgagagatgcgatgatgagaatcctcgaatccgggatagaggatatcgtttccaccgacaccatacttagcccggtcagccacgtgagcgttgctgatgttatcgcctccgcgctaagttaa

SEQ ID NO: 24650 - DNA, 1275 bp, Archaeoglobus fulgidus
atgaggcgaaatccctcaacatttaaatacattcccctaaggattgatttcatgagtgaagttccgcttcctgaagttaatatcggacttgtcggtcacgttgatcacggtaaaaccactcttgttgcagcgttgagtggtgtctggactgacagacatagtgaggagttgaaaagaggtatctcaatcaagctcggttatgcagatgcgacattcagaaaatgtccggaatgtgaacctcccgaagcgtacacggttgaagaaatctgcccgattcatggcgttgaaactgaaattttgaggacggtaagctttgttgacagcccgggccacgagatgctgatggcaacgatgctcagcggtgcggcaatcatggatggggccgtgctggtcatcgccgctaatgagaagtgtccccgtccccaaacaaaggagcacctgatggctctgcagatcatcggtatcgacaaaatagtcattgcccagaacaagatagatatcgtaagcagagagagggtgctggaaaactatcaggaaataaaggagtttgttaagggaacagtggcagaaaacgctccgataatcccaatctcagcgcagcagaaggtgaacatggacgcactcatcgaggctatcgaggaaaccatcccaacacctgaaagggaccttgactccccgccgctaatgcatgtggcaagaagcttcgatgtcaacaagccaggcactccgcccgagaagctgctcggaggtgtgctcggagggagcctttcgagaggcaggataagagttggcgatgagatcgaaatcaggcccggggtgaaggatgaaagggggaactggaatcctctctttaccgaggttcagagcattgtggcatcgggaagatttgttgatgaggcaacaccgggagggcttgtgggtatagcaacgaagctcgaccctacccttacgaagagcgacgccctcgtgggaaatgtagtaggccacccgggcaatttgccagacgtgctgacgagctttacgatggaagtgaacctccttgaaagggttgtggggcttgatgaagaaatggaggtcgagaagataaagatgaacgagcccctcatgctcgcagtggggactgcaataactctgggagttgtgacatcagcgagggatgacatcgttgaggtgaagctcagaaggccagtgtgtgctgataagggttcgagagttgccatcagcaggagagtagggagcagatggaggctgataggggcaggaataataaggtga

SEQ ID NO: 24651 - DNA, 1398 bp, Archaeoglobus fulgidus
atgtggaatggcccactcttaaattaccgtgatactttcccccaatttagaacttttgtggcaattgtgaatgctataaataacataaggataaacttaatatccgttcttactagacaccatacaatgaagatagcaattttaggaagtggatacgttggaatagtcacgggtattggttttgctgaacttggtcacgagatagtattcatagatgttgatgaaagaaaagttgaaatgttaaattcatcaaaaccaccgatatacgaaagaggactcgaagaacttatgaagaaaaacaggggcaaatacagagccactacagactacagagaagctctggagagttcggagctaacattcatatgcgttggaacaccatcgaaaggtgatggctctattgatctaaaatacgctgaatcggcatcgaaagaaataggaaaggctttgaaaaacaacgataactttcatgtcgtcgtggttaaaagcacagtcgttccgggaacaacggaggataaaataaaaccgataatcgagaaagaatctggcaaaaaagcgttcgaagatttcggtttagctatgaatcccgaattcttgagggaaggcaacgctgtttatgatttcttcaatccggatagaatagtgattggtgttaaggatgaaaggactaaatcggtcttagaggaattgtataaacctttcgattgcccaaagcttatcacagagataaaaaccgctgaaatgataaaatacgcatcgaacgcttttttagctacgaagataagcttcgccaacgagataggaaacatatgcaagaagcttaggattgatgtttacaaggtgtttgagggtgttggtttggaccacagaataaatccatcatttttcagagctgggattggattcggggggagctgttttcctaaggatgttagagctttgattaggaagtctgaagaactcggcgagaatccgaagatactgaaagctgttatggaagtaaatgagagacagccgttaaagatgatagaacttctgaagaagcacattcctaacttaagaggaaagaagatcggagttctgggtttggcgttcaaacccgatacggatgacgtaagagagagtagggctataccaatcgtcaaagctctgctggaagagggggcagagatcatagcctacgatccaaaggccatagaaaactttaggaaatttttccctcaagtagaatatgctaactcagctgaagatgttattacaaaatcggatgctgtgctgatagttaccgaatggaaggagttcgaggagcttgattacagcggtaaaattgttattgatggaagaagagttgagaaggctatgaaagaagctaagatatacaaaggggtgtgttggtaa

SEQ ID NO: 24652 - DNA, 1077 bp, Archaeoglobus fulgidus
gtgaaaatagcccaggtttgtccgagattttatccccacataggaggagtcgaaactcacgtttacgaaatagctagtagaatagcaaagaagttcgatgttgaggttctgactaccgacccaggcggaaaattgccgaaagttgaagaaattgatgggcttaccgtgagaaggtttaaatctctcgccccttccgaggcgtattacttctctcccgaactctacgactatttaaagaaaaatagctcggactacgatgtagttcacgcccacaactaccacgcgtttcccgctctgtttgctgccttgaccaaaggaaaaaacaaattgattttcacgccgcattatcacgggagcggtcacagctttttcagaaacgtccttcataaaccttacaagatattcggaaggaagatctttaagagagccgacgcaatcgtttgcgtttccaattacgagaaaaatctggttttgaaaaatttcaaggtcgccgaggatagaacgtatgtaatcccaaacggaataaatttagatgagtttaaagacattgaaaaaattaagagaaataaggaaagttggaagaaaactatcctctacgtagggagagttgagaagtacaaggggttggattatgttgtgaaatcattgaaacacttgcccgataacttcacgcttgaggttgtcggtaaaggtagttacaagtcgaagatagttgaaatggcgaagaagttagatgttatcgacaggattaggttttatcaggacttaagcagaaaagagctcatcgataggtatgcgaaggctgatgtactagttcttctatctaagcacgaagcttatggaattgttgtagccgaagctctagctgcaaagactccatgcattgttgctaacacatctgctttgagtgagtggatagataacaagaacgtttttggtatcgattacccaatcaacgtttcggagcttgcaagactgatagagagagtttcaaatgttaaagctggagatatgaaattgttggattgggatgatgttaatgaaagattaataaggatttattccgcaaaaatttaa

SEQ ID NO: 24653 - DNA, 618 bp, Archaeoglobus fulgidus
atgaaggcaggcatcgatgaggctggaaagggctgcgtcatcggcccactggttgttgcaggagtggcttgcagcgatgaggataggctgagaaagcttggtgtgaaagactccaaaaagctaagtcaggggaggagagaggaactagccgaggaaataaggaaaatctgcagaacggaggttttgaaagtttctcccgaaaatctcgacgaaaggatggctgctaaaaccataaacgagattttgaaggagtgctacgctgaaataattctcaggctgaagccggaaattgcttatgttgacagtcctgatgtgattcccgagagactttcgagggagcttgaggagattacggggttgagagttgtggccgagcacaaggcggacgagaagtatcccctggtagctgcggcttcaatcatcgcaaaggtggaaagggagcgggagattgagaggctgaaagaaaaattcggggatttcggcagcggctatgcgagcgatccgaggacaagagaagtgctgaaggagtggatagcttcaggcagaattccgagctgcgtgagaatgcgctggaagacggtgtcaaatctgaggcagaagacgcttgacgatttctaa

SEQ ID NO: 24654 - DNA, 1671 bp, Archaeoglobus fulgidus
atgatgttgtttgccgagtttgccgagttctgcgaaaggctcgaaaaaatatcgtcaacacttgagcttaccgcgaggatagctgcgtttcttcaaaaaattgaggatgagagagacctttatgacgttgtcctttttatcaccggcaaggtttacccgccgtgggatgagagggagcttggtgtcgggattggattgctctacgaggctcttgaaaacgtaagcggagtcaagagaagcgagatagagagtatgataagggagtacggagacctcggtctcgttgcggagcagctgataaagaagaagaaaatgacaaccctcgccttcgaggagcttacagtgaggaaagtgagggagaccttcgatgagatcgcatctttgacgggagaagggagcatgaaaagaaagattatgctcctcaccggcctctacggtctcgcaactccactagaggcgaggtaccttacaaggctgattttgaatgagatgcgccttggtgttggagagggcataatgagggatgctatagccagagctttcagggcggatccggaaacggttgagagggcttacatgatcaccaacgacctcggcagggtggcagtggttgccaagaaagagggcgaggagggcttgaggaaaatgaagatagagattcacattccggtcagaatgatgctcgcacaggttgctgagagcctcgaaagcgcagttagagagatgagaacagcggcggtggagtggaagttcgacgggagcagagttcaggttcactgggatgggagcagagttacaatctactcaagaaggcttgagaacgttaccaacgccttgccggacatagtggaggagataaagaagagcgtcaagccgggcgtcattcttgacggagaagttattgcggtcaaggaaggaaagccgatgccgtttcaacatgtgctgagaaggttcaggagaaagcacgatgtggcaaagatggttgagaaaataccgcttgaagctcacttctttgacattctctaccacgatggagagtgcatagaccttccgctgagggagaggagaaagctactggaatccgcagtaaatgagtcggagaaaatcaaactggcgaagcagatagttacggacagtgttgatgaggtaagaaagatgtacgatgaggctatcagcgcagggcacgagggagtgatgatcaagctaccctcatccccctacattccggggaagaggggcaagaactggcttaaggtcaaggcgataatggaaactctcgacctcgttgtggttggaggagagtggggagagggaaaaaggagtcactggttaagctcctttgagctcgcctgccttgatccggtaacgggcaaactgcttaaggtaggaagggtcgccacgggcttcactgaggaggatctggaggagctgacagagatgttcagacccctcatcgtctcgcagcaggggaagaaggtggagttcatcccgaagtacgttttcgaggttgcgtatcaggagattcagaaaagcccgaaatacgagagcggttatgcgctgagattccccaggttcgtcagactgagggatgataaggatgttgacgaggcggatacgatagagagggttgagaacctttataagctacagttcgaggtaaagagacaatga

SEQ ID NO: 24655 - DNA, 981 bp, Archaeoglobus fulgidus
atgaagaaaattgtggtaatccccggagacggcataggcaaggaggttatggaggctgcgatgctaattctcgagaagctcgacctgccctttgaatacagctactacgatgctggagatgaggctctggagaagtacggaaaagctctgcctgatgagacgctggaagcttgcaggaagagcgatgcggtgcttttcggtgccgccggggaaacggcggcagatgtcatagtgaggctgagaagggagctcggaacctttgccaacgtcaggccagcgaaggcaattgagggcattgaatgcctctatcccggcttagacattgttgtggtgagggaaaacacagagtgcctttacatgggcttcgagttcggcttcggggacgttactgaagccatcagagtgattacgagagaggcttccgagagaattgcgaggtatgcttttgagctggctaaaagggagggcaggaagaaggttacagccctgcacaaagccaatgttatgaagaaaacatgcgggctatttagggatgtgtgcagagaagttgcgaaagattatcccgaaattcagtacaatgactactacatcgatgcagcttgcatgtacctcgttatggaccccttccgcttcgatgtaatcgttacgacaaacatgtttggtgatatcgtctctgacttagctgcaggcctcgttggaggacttggtcttgccccctcagccaatgttggggagaggacggccattttcgagccggtacatggtgctgccttcgacatcgctggaaagggaattgcaaatccaactgccatgattctcacagcctgcatgatgctccgccacttcggctatgttgaggaggccaagaaggttgaggaagctgttgagaagaccattaaggaggggaagaagactccggatttgggaggtaacctcaaaactatggagtttgccaacgaagttgcatcccttttggattag

SEQ ID NO: 24656 - DNA, 828 bp, Archaeoglobus fulgidus
atgcacatcgattcctacttttccctttcaaactgcgatgccgaggaggctgaatacctaatctacggtatcccctacgacgcaactcagtcgttcaagcctggctctcgcttcgctcccaacgcgataagagaggcaagctggaatctggagtcctattcgaacctttttgacgtggagctttcgctggtcaaagtgggcgatgcgggcaacataaactgcgatggcggttttgagcagattgttgagagaacgaaggaatttcttggtgaagttgagggttttcccgtagccattggtggagagcactcaatcagctttgcagcaacgagcaagttcagaaaagcgtgcttcgtcgttttcgatgcgcactttgatttgagagacgagttcgatggggacaggttcaaccacgcctgcacaacgcggagaatctttgagagcgggatgcgggtggcaattttcggcgtcaggagcggtattaaagaggagaagaggtttgcggaggaaaacggaataaaatacctccacgcgtgggactttgaggtcgagaaggcggttaaaatggtggaggactttgacaaaatctacgtttcccttgacgtggacgctttcgaccccgccttcgctcccggcgtttcaacgcctgagccttttggtttgaagcctatagattttattaggttttttgcaggcatagcagacagagttgttggttttgatgttgtagaggttgttcccgactcgaacaaggttactcagactctcgctgcgaaaatcatacttgaggccattgcggcaaaggtcaggtgtgatattccgaaataa

SEQ ID NO: 24657 - DNA, 1239 bp, Archaeoglobus fulgidus
atgcagtacgagaaggtcaaacctccagagaacggagaaaagataagatatgaaaacggcaaactcatcgttccagataaccccatcatcccgtatttcgagggagatggcataggcaaggatgtggttccagctgcaatcagagttctcgatgccgctgctgataagattggcaaggaagtcgtctggtttcaggtttatgctggggaggatgcctacaagctctacggcaactatctgcctgatgacactctgaacgccataaaggagttcagagttgccttaaaaggccctctcacaacccccgttggaggtggctacaggagtctaaatgtcacaatcagacaggttctcgacctctatgccaatgttaggccagtctactacctgaaaggagttccaagcccgataaagcatcctgaaaaggtcaacttcgttattttcagggagaacaccgaagacgtttacgctggcattgagtggccgaggggtagcgaggaagcccttaagttaataagattcctcaagaacgagtttggtgtcaccataagggaggactctggaatcggaataaagccgatcagcgagtttgccaccaagaggcttgtcaggatggccatcagatatgcaatagagaacaacaggaaaagcgtgactctcgtccacaagggcaacataatgaagtacacggagggagccttcagggattggggctacgaggtggcaaagcaggagtttggcgagtattgcataacagaggacgagctctgggacaagtacggcgggaagcagcctgagggcaagatcgtggtgaaggacaggattgcggacaacatgttccagcagattctgacgaggacagatgagtatgacgtcattgccctgccaaacctcaatggtgattacctcagcgatgctgctgctgccctgattgggggacttggaatagctccgggcagcaacataggtgatggcattggcgtcttcgagcctgtgcacggctctgcaccgaagtacgctggccagaacaaggtcaaccccacagccgaaattctcacaggagcgctgatgttcgagtacatcggctggaaggatgcgagcgagatgataaagaaagctgtggagatgacgataagcagcggaattgttacctacgacatccaccgccacatgggcgggacgaaggtaggaacgagggagtttgcagaggctgtggttgaaaacctgcagtcgctatga

SEQ ID NO: 24658 - DNA, 1083 bp, Archaeoglobus fulgidus
atgaacaccttcggccattttttgagggtcacaacctggggagagagtcacggcagagcggtgggctgcgttatagacggctttcccgcaggtcttgaggttgacgaggagttcattcagagggaaatggaaaggaggaggccggggaagaagtacactacgcagagaaaggaagttgacagagttgaaatcctctccggagtttttgagggtctcactaccgccacgcccatatcaatggttgtctggaacgtcgatgcggattcgagcgcttacgagagcttgaagaccgttttcaggccgggacacgctgattacacgtactgggccaagtttggcgtgagggactggagaggtggtggaagggcttcagcgagggaaaccgctgcaagagttgctgcaggggcgatggcaaagctgctgctcagaaggtatgacgttaaagttatggggtacgcgaaggaaattgcaggagtaagctgtgaggtcgatgatgctgaaaaggcctttgagagggctgaaaggagtcctttgaggatgccggacgagagagcggagaaggaggcggagcagaggctaaaggaggcgatgagcgagggggatagcgtgggtggggtggtggaggtcgttgcaaaaaacgtccctgccggtttgggtgagccggtcttcggaaagctcgacgcctacttggcttacgccgttatgggcattcctgctgtaaagggtgtggaaatcggcgccggatttgaggccgcaagaaagagggggagcgagaacaacgaccccatagtgctgaaggatggcagaatccgctttgccaccaacaacgcaggaggaattctgggagggatttcgaatggggaggatatagtgttaagggcagcaatcaagcccacaccatcaatttcaaaaaagcagagaaccgttgactacgaaaaaatggaggaggctgagataagcgtaaagggcaggcacgacccctgcatagttccaagggccgtgcccgtggttgaggcaatggtggctttggttttggccgactgcatgctgatgcaggggctgataccgaggagtttgctgtaa

SEQ ID NO: 24659 - DNA, 1245 bp, Archaeoglobus fulgidus
atgctcgaaaacgacgcccttcttactgaagaggagattaagataagggaggaggcaaaggagcttgttaatgctattgaccccgagcttctgaggaaaatggacagggatgaggttgactaccccttcgagtttcttgaggaagctgcgaagaggaaaatgcttggattgagatttccggaagagtacggggggagagggcttagctggactgctgagagcgttgctgttgaggaggttggcgttctgggcaacggaatagggtgcagttatgcgatggtcagcattgttggggaagcaatttaccgcttcggtcaggagtggcagaaggaggagtttctgaagccgataataaagggtaagaaagtctctgccgaaggactgacggagccgagaggagggagcgacttcttcggaacaacaacgagggcggagaagaaggggaatgtgtgggtgctgaatggtgcgaagaggttcatagctggtggcaaggtagcggacttctacctgatttacgccagaactgatccaactgctccaggccacaaggcccttacagcttttctggttgagagggacatgggcgttgaggtggaggagctctacaacctcctcggcttcaggggaatggggactgcgaggattgtgtttaaggatgttgaagtgccagatgagtacaggctgggagaggttaatggggccagagtgattttcaacaggatgatgattcccgaaaggatgacctccgctgcaggagcgcttggaaccgcaagggcggcgctggaggtggcggtgaagtactccaacaaaaggaaagccttcggcaggaaaataagggagtttcagggagtcaacttcatggttgctgaggctgtgacgaagcttgacgctgcaagggctttaacctacaacgctgcgagggctgtggacctctacgatgcgggaaagggccccgacccaagaaggctggtcagcgaggcgaagtactttgcaaccgacgtaggatgggatgttgtcaacaaagcaatgcagattctcggtggaataggctacacccaggtttatccggtcgagaggatgctgagagacatgcgtctcgcccctatatggactggcagcaacgaaatcatgaaggtgctgatacagcacgaaacctacaagatgatggggctgccgtcaaaggacagggatgttgagaaggacgcgatggactggtacaaggagtgggagaaggtttacgagtga

SEQ ID NO: 24660 - DNA, 1515 bp, Archaeoglobus fulgidus
atggcttatttttgtttgggtgagagtgtgtttactataccgtatcttctggaaagagcggcaaagctttttcccaacaagggagttgttggcagggaagggacaaaaagctactcagaagtaaggaaaagggttcttgggctaacagcgttttttgagaacatagggatacggaacgaggttgtggcagtagcggactggaacacaccggagttcttcgagctgatttatgcgataactgcagctggagggattctgtatccggtcaacataagactgccaccagatcaaatagcctacacgctgaaaaaatcggaatcgggacttctgatttactccgacgacttttcagcccttgcaaaagttcatgaaggagaaagcttgcacataaaagaggtggctgagaaggctgatgaggcagagcctgaagtcaacgttaagcaggatgatatggctgttatgctctttaccagcggtaccacgggattgccaaaggctgtgagatacactcacgaaaaaatgattcacggagctcttagcatagcacatcagcttgctcaccacgagactcctgcaaatctaactccgagggacgtaatcttccctcagatacccatctaccacattctcgcttggggaactgtgttcatagccccctacatgggtttgaatctggtgatgggcggaagatttgatccggcagaggctgtgaggctcatcaaaaaagagggggtaacatggattaacgccgttccgacaatggttaacatgctcctcgagacgaaagaggacctcagcggcattaaggtgctcatcggagggagtacgattacaattgacctggcaaggcgcatggaaaaagcaggaatgaagttctcaacaatctatggcggtaccgacatgctggctgcatccattgctattatgaccgaagaggccaaggtgaagggtgttgactacatcaggcaggtaactcatcccgttccctttgcggagttcaaaatagtcccccaggagggaatggggggtgagtcgggggagatatacttcagagccccttggctacccatggagtactacaaggacgaggagaaaaccaaagaagcctacaccgaagatggctggttcaaaacaggagacctcggagttgagatgccagacggaggagtaaagatactcgacagggtgaaggatgccatcaaatccggcggagagtggattccgagcagcattctcgaatcagtgatttcggaaattgagtgggtggagtacgttgcagttctcggcaagcccgacgagaagtggggtgagagaccttttgcagtaataaagcccgttgacaggagtaaggcgagcattgaagaggtgaaagagcatctggccaaagctgttgaagagggcagaattgccaagtggtggattccggaggaaattgcgattgttgatgatatgcctctcacgagcacgggaaaaattaacaaactttcgttaagaaaaatgctgttggagaggtga

SEQ ID NO: 24661 - DNA, 1932 bp, Archaeoglobus fulgidus
atggaagagtttagaaagttgtggcaggaagcgtatgaaaatcctgaaaagttctggaatgagagggctgaggaggccatggacgacataaactggtttgaaccttggaagaatgtttttaaatgggaatacccaaagttcagctggtttgaaggggggaagaccaacatctgctacaactgccttgactacaaggtgaagaggtacggttcaaagcctgcctacatctacgaaaaccccgaaatggacttgagctatgcaattacctacagacagctttacagcatggttaaaaagtatgccgcatctctgagaggagctggactgagcaagggggacagaattcttctttatcttccaaactcaatcgaagctgcggcaatgctgctcgcagcagcaagaattggcgttatttctgtgacagtctttgctggtttctcccccaaggccgttgccgacagaattgagctgaccacaccgaagctaatcttcacgcaggatttctccacaaggagagggaagctggtgaggctgaaggacaacatcgatgaggctctgagctacgtgcctgaaaacgtaagggaaaacgtcggaatggtggtcgtgaagagagcgatgccggaagaggaggtcgatttaaaggaggggcgggatttcaccctgaaggagtttcttgacctgaaaggaggagaaagcagtgattatgttgagatggatgcgatggacccaatcttcgtcatgcccacatcaggcacaacggccaagcccaagcctgtggttcacgttcagggaggttatcagatatggaactactatgctgctaagtgggtttacggcctgaagcctgacgatgtgatattcaacacctcggacataggctggattgtcgggcagagctacatggttttcggcccgcttctcgcaggctctacgtgcattctcttcgacggcactcctgattatcccgagccgggcacgtggtgggaggttgtggagagaaacggagcaacgctgatatggacatccccgactggtgcgaggatactgagaaagcttggagtggagaaggcaaaggagtacgacgtgagctcggtcgagagggtggtttgtgcgggggaggttctgaatccagaggtgtggtactggctctacagagatgtttttgaggaggaaattccaataattgaccacatgtggcagaccgaaaccaccggagcgctattcggctatccctacggtctctacggggatgaaattaaggagtacatcaagcccggctccgccggacttcccttacctggaataattcccgtcgttcttgacgagctgagtggagaggagctaccaccgagggaaaagggagtcatgtacctcaaaagacctttccccggcctaacaccaacgctctgggacagctttgacagatacgtgaggtcatattgggaggttggagcgggcagaggaatgtactgcaccggagatgctgcctacattgacgaggatggctacgtgtggttcacgggaagggctgatgaggtcataaagattgcaggtcacagaattgggacaatagaggttgagaatgccctgataagtcatccggcagtagctgaggcaggtgtaagcggcatacctgatgaaatcaggggagaggttgtggcagcattcgtcgttctcaagcccggctactctccgagcgaggagctgaagagggagataatagaccacgtgaggaaaactctcggcccgattgttgttttcaaggacatacagttcgtgaacatgcttccaaagacgaggagcggtaaaatcatgaggagggtcatgaagaggcttttcctcgggcaggagcttggtgacctgtcaacgatcgaggaggaggcatcggttgaggaaatcaaggaggcggttgagaagctcaagaaactttaa

SEQ ID NO: 24662 - DNA, 1692 bp, Archaeoglobus fulgidus
atggaacacgacatcgttattgtcggggcagggattgcagggatgagggctgcaatagctgcagcagaaaaaagcagaaagctatccatcgctcttatcgcaaaaacttaccccatcaggtgccacagcgtttgtgcggaaggtgggacggctgctgttttaagggaaggggacagctttgacctgcacgcctgggatacggttaagggtgcagactttctcgctgatcaggatgcggtggagttttttgtgagggaatgccctaaggaaatcataaggctggaaaactgggggtgtccgtggagcagaaacgaggatggaacgattgcccagaggccattcggaggacacagcttcaatcgcgccacatacgcgaaggacaggacgggctttcatgaagttcacaccctctacgagcggatgctgatgtacgacaatgtcgagattttccctgagtacttcataaccaacttagcgattgagaatggagcggtgcagggagtttcagcaatccagctcaagacgggagagatggagttttttgaagcaaaagccgtgattttcgccaccggaggagcggggaggctctacggcttcacaacgtacagccaccaggttacgggagatgggctggcgatagcctacagaaatggcatcccgctgaaggacatggagttcttccagttccaccccacaggccttgtaccttcaggcatcttgatgaccgagggatgcagaggtgagggtggctacctcttgaacaagaacggtgagaggttcatgaaaagatacgctcctgaaaaaatggagatagcgccaagggatgtcgtttcgagggcgatgtggactgagatcattgagggaagaggatttgagggggagtatggcccctacatagccctcgacctgagacatcttggcgaggagaagatagaggagaggttaccgctaatcagagatgcagcaataaaattcgctggcgttgaccccgtggaggagccgattccggtaaggccggtcgctcattacacgatgggtggaatagataccaacgtgaggtgtgagacagcagtaaagggcttcttcgctgccggtgagtgcgcatgcgtaagcattcacggagcaaacaggcttggttcaaactccactgctgaatgcttggtttttggaagggttgcgggagaggttgcggctgagtatgcattgaaggcgaagcaggggaagatttcagccgagttcagggagaaggaggagaagagaatattcgatgagcttctgggcaaaagcggggacgagagcccataccagataaagaaggagctgaacgaaacgatggaggctaacatgtggattttcagagaggagaagggactgaaggaagctgtgaagaaaataaaggagctgaaggagcgctacagaaacgtggaaatcaacgacaagtcgaggggcttcaataccgatttgacctctgccatcgaaatcggctacatgctcgacttggctgaggttgttgccataggggctttgaagagacaggagagcagaggagcccactaccgccttgattacccaaagagagacgacgagaactggctgaagcacactctcgcctactacacccccgaggggccgaaattcgactacaagccagtaaccataacgaagtggcagccggttgaaaggaaatactga

SEQ ID NO: 24663 - DNA, 711 bp, Archaeoglobus fulgidus
atggtggagttcaggattagaaggtttgatgggacaaaggcttactggcagagcttcgaggtgcctgcaaagagggggatgaccgttcttgaggctctatactacatcaaggagaatctcgattcaagccttgctttcagagcctcatgcagaatgggaatttgcggtagctgcgcgatgaagataaacgataagccacggttagcgtgtgagactcaggttttaactctcggcaatgctgtgaaggttgagcccttggataacttcaaggtgattaaagacttgattacggagtttgatggattcttcgccaagcacaaggccgtgaagccatatctgataagaaaggatgacaactacgcagagcccaaagaattgctgcagactccggaggagctgaatgagtactacgtcttcacactctgcatcaagtgcggagcctgctactcggtctgcccagcagcagcaactcttgacggctaccttggccccgctgcaatgactgctgcctatagattctgcgctgacagcagggatgatgggcagagggagaggtacgagattgccagctcatcaaacggagtctggaggtgccatctagcaatggagtgcagcgaggtttgtccaaaaaatgtggagcctgccaaggctgtgcagatgctgaggaaaaagacagctttcagcattctgaagagccttttggggtggtag

SEQ ID NO: 24664 - DNA, 1650 bp, Archaeoglobus fulgidus
atgagaggagaggatgtattttacgaaattaatgacgaaaacgtcagagagctgagaaagagatacaacaaaatcagaaggtgggtaattgcggactttttgaggcggagcgggagaagatatccggaaaaaactgcgcttatcttcaaccatcccgatggcagggagatcagactaacttacagcgagctggacaaaatggcaaataaggtggcaaatgctctcctgaatttggggataaagaagtatgacagagttgccattctcgctcacaacaccctgcaccacgttttgacaatcttcggctgtgctaaggctggagcgatatatctcggcctgaactacctgatgtacggaaaagatctggcctactgcatcaaccactcggaggcaaaggttctgattgttgaggatgctctgtttgaaagaatcgagccggcgatggaccagctcaagacggtcgatacgttcctgtggtcgaatcagggtgttggggttgaaggtgaagggagatgggaaagtttcgatgatttctttgatggagagagtgatacggagccagatacgatactgaacatcgaagacccggtgcagatgacctacacaagcggaactgagagtctgccgaagtgtgttgttcacaccaatgagtcgcttatagcccaatatgttggatgcatagtggatggggagtacacagctaatgacatcatgcttaacacgatgcccatctaccactgcgcccagcgagatgtcttcatgatgccaatattctacgttggcggaacgaatgtaatgatgacggagcccaatctggatttaatgctggaatacattgacagatacaagcccacgatgctcttccttgcccccactgtctggataggattgctgagacatcctgatatcgacaaatatgaccttcaatcactgagaaagtgctactacggggcctcaatctttccggaggagcccctgaaagagctcatggagaagcttccacaggcgagatttttccagtactacggacagacggagctcgctccataccacacagttgcgaaccatgaagagatactggagtacacaaagactgctggcagaagcgggctgaatcttgagtcaaggcttgaaaacgacgagcatgaggagatagctgaaataggggttccgggagagattaccgcccgcggacctcacgttatgctgatgtactacaaagacccggagaagactgaagaggctttcaaatgcggatggttccacagcggtgacattgcggtgaagtacagggaaagctacttcgaaatcgttgacagaaagaaggacatgataaagactggtggtgagaacgtatccagcagggaggtggaggaggttatatacaagcaccctgacgtctgggaggttgccgtcatcggtttgccgcatgaaaaatggattgaggctgtaacggcaatcgttgtgcccaagccggggaaaacaatcaatcctgaggagattattgagttctgccgtaaggaactctccccctacaaggttcccaaaggtgtaatcgtgcttaagcctgaagatttgccaaaaacgccgtctggaaagataatgaaaagggagttgaggaaaatctttaaggattattattcggcttga

SEQ ID NO: 24665 - DNA, 1389 bp, Archaeoglobus fulgidus
atgagaatcgtaatgaagttcggaggagtgagcgttaaagatggggaaaacatttaccattgcgctaatctcgttaaaaagttctcggagggaaatgaagttgtagtcgttgtctcagcgatgcagggtgtgactgatgcacttttaaaggccgcgcaccgctgctgctctgaaccatctgccggattcatcaagatgttcatcgcggatatgatgaagagacactacgaggcgatcgagtatgcggtcaggaacgacgaaatcaaggcaaaggtgattgcagctgtagagcgacttcttgatgagcttgaaaaggttctcctcggaatcagctaccttggcgagcttacgaggagaagtgaggactatatagtctccttcggcgagaggctctcagctccaatattttcagcagcccttctttccctcggcgttgattctgtagctctcactggaggggatgcaggaataatcacggacaggaactttgggagggcaaagccgcttcccggggtttacacaacaatcagaaacaggcttgagcctttgctgacgataaagaaaactattcccgtcgttacgggcttcataggcgcaacggatgacggcagcataacaaccctcggcagaggagggagcgactacaccgcaacaatactcgccgcagcccttgacgcggacgaggtgtggctgtggaaggaagttgacggaataatgacctgcgaccccaagtacgtgcccaatgcgagggtgattccggagatatcctatcaggaggcaatggagctgtcccacttcggagcaaagatacttcacccgagagccttggagccggtgatgaggaagaacattccagtaagaatcaagaacaccttcaaccccgatgctccgggaaccgtgattggcccgacaacgaaggattcaagcgagatagtgaaggctttaagcctcattccgcaggcggggatagtcaacgtcagcggtgcgggcttcgattttgcggagataatgtcggaggtttttggcagacttgctgaggagagggtaaacgtcattatggtagctcagagctcctcagagctgaatctgtcgatagtggtcgatatccgggacttggagaaggcctacaacgccctgaaaagcttggaaaacggcgtgataaaggtcgaaaagattccctacatagcggtcgtgagcgcagttggttcgggaatggctggaacgccgggcgttgcaggaaagattttctcagcgcttggcaagaacggaataaacgtaataatgatcagccagagctgctctgagtacaacgtttcgttcgtcgttgacggtagcgatggcgttaatgctgtgaaggtagtgcacgatgagttcgggctcggcaattaa

SEQ ID NO: 24666 - DNA, 2262 bp, Archaeoglobus fulgidus
atgccggtactctggttggcggatgttgataaaaacgatattcctcttgttggtgggaagggtgcgaatcttggtgaacttttaagagctgaaattccggttcctgatggtttcgttgttgacgctcgaacgtttcgcgaattcattcagaaaacagggatagctgagaaaatttactccctgctaagggaactcgatgttgaggatacggaaaagctggatgctgtttcgagggaaatcagggaaatcatcgaaaagacggagatgcctgaagacattgagagggagatcagagaggcgtacaggaagctctgcgaggaggagggaaaggaagtttacgttgcggtcagaagctcagcaaccgcagaagatttgccggatgcaagctttgcggggcagcaggagacttatctgaacgttgttggcgaggacgaggttgttgagaaggtcaagaaatgctgggggagtcttttcacacctagggccatttactatagagtccagaagggcttcaggcatgaggacgtcagcatcgccgtcgttgtgcagaagatggtgaacagcgagaagagcggagtaatgttcacgtcccatccggttagcggggagaagaagtgcatcatcgaggcggttttcggcctgggagaggctattgtaagcggtctcgtcactcccgacacgtacgtttacgacagagtgaagagaaagatagaggaggtcaagattggtgagaagaagttcatgcttacgagaaaagacgggaagaccgttaaggtcgagcttccacccgagaaagcaaacgagagggtgctgagcgatgaggagatagaaaagctcgtaactcttggagagctgatagaggaccactacggcaagccgcaggacgtcgagtgggctattgaggggggcaagatatacatagtccagtcgaggccgatcacaaccataagaaaagagaaaaaggaggctgaagaagaggtttcggaagaggcagagggcaaaatccttctgaaggggcttggagcatctccgggtatcgcctcgggtaaggtgaaggtgattttcagcgagaaagagatttccaaggttgaagagggagacatactggtcacaacgatgaccacaccagacatggtcccggcgatgaagagagcagccgccattgtgacggacgagggaggtatgacctgccatgcagccatagtttcaagagaactcggagtgccggcggttgttggaactaaagtcgcaactaaggttctgaaagacggaatggttgtaaccgttgacggtgagaagggaatcgtttacgagggcagaattgagaagaaggaggaaccaaaaccggtagtggcttccgctccaatcataaccgcgacagaggtgaaggtgaacatctcaattcccgacgtggcggagagggttgcgagggagacaaatgcggatggggtcggtttgttcagaatcgagcacatggttctcgggctcgaaaagcatccgatgaagttcataagagatggtgagattgacaggtacatcgatttgctctatcaggaaatgaagaaggttgtcaaggcgttctatcccaagccggtttggatcagaaccatcgacgctccaacggatgagttcagggctatggagggtggagaggacgagcctattgaggccaatccgatgctcggattcagaggaatcagaagggacctggcggaggaggagcacttcagggccgagatgagggcgataaagaagcttgtggacgagggatacaccaacgttggggtgatgcttccgctgataacctctccggaggaggtcaaaagggctaaggagatagccatcagcgagggattgccgctggacaaaattgagtttggagtgatggttgaaacgccggcagcagcgctaatacttgaggatatcattaaagagggcatagacttcgtcagcctaggaacaaacgatttgacgcagtacactctggcggtggacaggaacaacgagaacgtcgcatacctttacaacgaaacccatcctgccgtgctcaagctcatcgagagaacaataaaggtttgcaaggagcacggagtgaagagctcgatctgcggtcaggctggcagctatccgcacgtcgttgagaagctggtcgagtttggcatcgacagtgtttcggcaaatcccgatgcggtccaaaggataagggaagtcgtggcaagagctgagaaaaggataattctggaaaagctcagaaagatttag

SEQ ID NO: 24667 - DNA, 900 bp, Archaeoglobus fulgidus
atgaacccgctggaaacggagattggcggtttaagaatgaaaaaccctctcatgcttgcaagcgggattatgggcagtaaggttcactccctcaatctcatcgcgcgggatgcgggagcggttgttacaaagtctgtcggtgttgaggagagggagggctacaggaatccgaccgtcgtaaactggaaatgcgggctgataaacgcagttggactagcttctcctgcggccaaagattttgccgaggagctgaaggactacacgaatgaggcacctctcctcataagcctctacggacattccgttgaggagttttccgatctcgttgacacctttgactccgctcttccctatctccacggttacgagctaaacctcagctgccctcacgtgaagggagcgggcctcgatataggaatggaccttgagctttcagcggcaatagttgaggagctgaaaggaaagacgaagaacccagtttttgccaagctgtcagcgatgcacgactacctgaagctcgcaaaggtccttgaggatgccggagttgatggaataacgatatcaaacactctcaggggaatgaagatagacataatgtctggaaagccggttttgagcaacctctctggcggtgtgagcgggccggcaatcaagcccatagccctaaagtgcgtttacgacctctacaaggaaatcgaggttccaatagtgggctgtggggggataacgagctttgaggacgttcttgagtttataatggcaggtgcaagggccgtgcagataggctcggcggtttactacagccggagaattttctacagcctgaaggagagcctgatagcctttacgagggcaagagactgcacaatctccgacctcatcggaatcgcccacagctga

SEQ ID NO: 24668 - DNA, 843 bp, Archaeoglobus fulgidus
atgcgaattgcctttactaaaatgcacggtaacggtaacgacttcgtcctgattgacgaattcgaaggagtgattgtgggagaagaggagaagccgaggtttgtaagggcagtatgccacagaaacttcggcgttggtgctgacggtgcgctttttgttcagccctcgcaaaaggcggacgtcaggttcaggtacttcaacagcgatggcagcgaggctgcgatgtgcgggaacggtataaggtgcttctcccgctacgtcgtggaggagggctatgctggggagaggttgagagtagaaaccctcgctgggattcttgagcttgaggtaaagagggagaacggctggtgggtgaaggttgacatgggaaagcctaagtttggaagggaggagattccagcaaaaaccgacgtgtgggggtatgaggtggagcacgacggcaggaagttcaggatttacgctgccaacaccggagtgccgcacgtggccgttttcgtggacagtctcgacttcgacatcgtcccccttgcgagaaaaatccgctattccgagatttttccggagggaaccaacgtaaactttgcgaaagttgatggggacacaattacggtcagaacctacgagaggggtgttgaaggggaaacactgagctgcggaaccggaagcgttgccgttgcggcaatagcaaacaggctcggcctaaccggaagtaaggttgacgttgtaacgaagggaggtttgctcaagatagagcttacagaggatactgcctacatgacgggtggggcgagcagagttttcgacgggattttgaggctaaacgagctgagatatgatatttga

SEQ ID NO: 24669 - DNA, 969 bp, Archaeoglobus fulgidus
atggagcacgtggtttatgttgttggacacaagaatcccgatacagacagcgtctgttctgcaattgcctttgcctatctctggaacaagtggaaagagggcggaaatgtggccaagatgatgaagattgaggctgaagcgaaaccagtaatccagggagatgtgaatccggaaacgaagtacgttcttgagaagtttgggtttgaagtgcctgagattatgacgaacggtgagggcaagaaggttgccctcgttgaccacagcgagaaggcacagaccgtcgacggcatagacaaggctgaggttgttgcaatcgttgaccaccacaaaatcggggatgttaccaccccacagccaatactcttcgtcaacctgcctgtagggtgcactgcaactgtcataaagctgctgttcgacaagacgggagttgagattccaaaggatattgccggaattctgctctcctcgatactgagcgatacggtaatattcaagtcggcgacaacaaccgagcttgacaaggaggttgcagaggagctcgcgaagattgcaggaattgatgacttgacgaagttcggagtggagatcaaggccaagctttccgcagttgacgatttgacggccatggacatcataaagagggactacaaggacttcgacatgagcgggaagaaggttggtgtgggtcagattgagcttgttgacctctcgctaatagaaagcaggattgacgagatttacgaggcaatgaagaagatgaaggaggagggcggctacgccggaatcttcctgatgctgaccgacataatgaaagagggcacagagttgctggtggttacagactatccggaagttgtcgagaaggccttcggaaagaagcttgagggcaagagcgtgtggctggatggtgtgatgagcaggaaaaagcaggttgtaccgcccctcgaaaaagccttcgctgaactctaa

SEQ ID NO: 24670 - DNA, 456 bp, Archaeoglobus fulgidus
atggaaaggaccttcgttatggtaaagcctgacggggtacagaggggtctcgtcggagaggtcatcggcaggcttgagaggaaggggctgaagattgttgcaatgaaaatgctctggattgcaagggagatggcagagaaccactacgcggagcacagggagaagcccttcttctccgctcttgttgactacatcaccagcgggcctgttgtggcgatggttgttgagggcaaaaacgccatcaaggttgtcagaacgctggttggagcaaccaacccagctgaggcagcaccgggaaccatcagaggagattttggacttgatgtgggcaggaacgttgttcatgcgtccgactctcctcagtccgcagagagggaaatttcgcttttcttcagcgatgatgaaattgtgaactgggagaaggctgacgaagactggatttacgaggagagatga

SEQ ID NO: 24671 - DNA, 1788 bp, Archaeoglobus fulgidus
atgagcaaaaagaaagaagaagcaaaagctctgagaactccaattgttgccgtgctgggccacgttgaccacggcaagacaacactactggacagaatcagaaagtcgaaggttgtggcaaaggaggctgggggaataacgcagcacatcggggctactgaggttcccctagatgtcatcaagcagatttgcaaagacatctggaaggttgaggttaagattcccggtcttctttttattgacactcccggccacaaggccttcaccaacctcagaagaaggggtggagctctggcagatctcgccattctgattgtggacatcaacgagggctttaagccgcagacggaggaagctttatccattctcagaactttcaaaacgcccttcgttgttgccgccaacaagattgacagaattcccggctggcagagccacgaagacacgcccttcatgaagagctacgcgatgcaggaggactttgcgaagcagaaccttgagaacaggctctacaacctcattgcagagctttaccagcgtggcttctctgctgagcgttttgacaggatatctgacttcacgagaactgtcgcagtggtgccaatctcagccctaaagggagaggggattccggagcttctcctcattcttgttggccttgcccagaggtaccttgagaagaacctgaggctccacatcgagggtaaggggagaggaactgtcttggaggttaaagaggagcgcggtttaggggttacctgcgatgcaatcctctacgacggaacgctcaaagttggggacaggattgccattgcaggaaaggatgaggtaatcgtcacaaacgttaaggcgattctgaagccccctccagttagagaaatgagggttgagagcaaattccagagcgtgaagagcgttaccgctgcagccggtataaagattgttgccccaaacctcgaaaacgtgcttgcgggaagcgagttcgaggttgttgagagcgaggaggacataaagaagttcgaggagagggtcaggaaagagtacgaggagattgccattagaactgatgaggagggggttgtgctcaaaaccgacactctcggctctctcgaggcattaatcaacgagctgaggcaggagggcatccccataaagaaggcagaagtgggggatgttgataagagggacgttgtcgatgcctccgccaacaaggatgagcttaacaaggtcgttctcgccttcaacgtcaagcttcttcccggagttgaggaggaggcgaagaagtacggtgtcaggattttctcccacgaaatcatctacactctcatcgaaagctttgtcaagtggagagaggaggagaggctggcgagggagaggcagaaggttgaggctttaatcaagcccggcaagatcaagcttctgaaggagtttattttcaggaggagcaagccggcaattgttggagtgagagttcttgcgggtgagctgaggaggggggttgacctaatcaagcccgacggcacgaaggttggggcagtgaggacaatgcagaaggagggcaagaatgttgcaatagcctctgccggtgatgagcttgccatcgccattgaggatgttaccatcggcaggcagcttgagggagatgaggagctttacgttgatgtccctgaaaggcatgcgaaggttatagagcgcgaccttctggactcgctggacgaggaaacaaagagggcctttaaggagtttcttgagattaagagaaaggacaatcccttctggggcaagtga

SEQ ID NO: 24672 - DNA, 1260 bp, Archaeoglobus fulgidus
atgttctcaactagcgacggaattctgacagtggagggtgtgaaggtaacggagattgtcagggaaactggcacgcccgtttacgtcacttcaagggccctacttgagagaaacctagaggcttacaaaaaagccttctccaacgaagggctgctttatgctgtaaaggccaataacaacctcgctttgatgaggataatcgcctctcatggctttggtgctgatgtttttagcgatggtgagctgtaccttgcatctctcgcaggcttcaggaaggatatggttctcttcaacggcaactcgaaaagcagaaaagagatagaaatgggggttactgctggagtcaagttcagcgttgacagtctggatgagctcagaactatttcgaaaattgctaaggaggttggaaaggaggttgagattgctttcagggtcaatcccgacgttgacccgaaaactcatccgaaaatcgctacggggcttagagagtcaaagttcggcattccgcatgaaatggtgagggaggcttacgagatggctttgaagctggacggtgttgttccggttggaatacactgccatatcggcagccagatactcgacctctccccgttcgtgcacgcgctgaacaaggttatggacatcgccgtggatatcgagaagcttggtgttgagctgagctttgtggacatgggtggtgggctcggaattgactacgaggggaagggcgctccaacccccaaggacctcgcaagcgcaattctacctgaattcgaaggaagaaaggctgatttaacttccgacccgcagctctggctggaacctggaaggagcattgttggcaacacaaccgtcttgattacaagagtgaacgccgtgaagaagggctacaagaactttgttgctgttgatgccggcttcaacgtcctaatccgtcccgcgatgtacggttcctaccacagggtggcggtagcgaacaagatggatgccgagcctgaggaggtttatacggtcgttgggccgatatgcgagagtggagatgttctggccagggacaggaagctacccaaagttgaagtgggtgatttaatcgccgttttcgacgcgggagcctacggtttcgtgatgagcagccagtacaacggcaggccgaggtgcgcagaggtgcttgtgagcggggatagatgggacgtaatcagggagaaggagagctacggtgatttaatcgagaagcaaaggttacctgaatggctgctatga

SEQ ID NO: 24673 - DNA, 1386 bp, Archaeoglobus fulgidus
atgaagataacaaaagagcttgagaaaatccttggtaaggggaacgtcagcaccgaccctcttgttgtaacgctccactcgactgatgctattggaaaagccggtaacgcaactgcggtagtttttccggaaaatacggagcaggttgcgaggattgcaaaactctgctacgagaacaacattaaaatctaccctcagggaagctcaacggagttaagcgggtcttcggttcctgaagacgggatagtcataaacttctcaaaaatgaataaaatcgaggagataaacgttgtggatggctatgcagtggctcaaccgggagtgagaattgcggagctggaggaaaggttgaacgaacacagctacacgttccccgtcgatccgggttcggtgaggtcagcaacagttggcggagcgataaacaccggagcgggagggatgaggggagcaaagtatggaaccatggttgactgggttctgggactggaagttgtcacagcagatggagaagttctcaacataggttcaagaacgctcaagtgcaggcaggggtacaacctgactaagctgattgtgggaagcgaggggactctcgcaatagttacaaaggcaattctgaaaatcgccccgctaccggaaaatatagtctatgcaggggctttcttcgacagcccggaaaaggcgatgcaggccgttgtggaaatcaagcacatgtggccggcaataatggagttcctcgacagcgacctcgtgaaagctggtcgggagatttctggaattgacgaggaaggaaacatgcttgttgttggaattgagtgcaatcacgaggcgagtgagagaatcgcaagcgctctggaaagcatactgtcacagacagcgagaagagtgataatagcaagaaatcagagagagctagaggagaaaaacctgctggctctgaggagagcgttctaccctctggcaatcaaattggcttccaaggagtttggaaccaaaaagtcgctcgttttgattgaggatatatccgttccggtctcaaagctgccagaggcaatcagagggataaaggaaattgcccggaaatacgactttacagttttcatagccggccacgtcggtgacggaaacctccatccaacgatatggacgtctccggaggacgaggagctgatgagcaggtcacataagttctacacggaagttatggagctcgctctaaggcttggtggtacgataagcgctgagcacggaattggcgtggttaaaaaagaggggcttgaaatggaaatgaagtacaaaaagagcgagaaagctctggaaataatgagggaaatcaagaagctctttgaccctaagaacatcctcaatcctggaaaggtggtatag

SEQ ID NO: 24674 - DNA, 816 bp, Archaeoglobus fulgidus
atgctggccaaaagaataatcccctgtctcgacgtaactcttgacgaaagtgaagcgagggttgttaagggagtggagttcgtcaatcttagggatgctggcgacccagttgagctggcgaagaggtacgacgaggagggggcagacgagcttgtttttcttgacatcacagcctctccagaagggagaaggacgatgattgatgttatagagagaactgcggagcaggttttcatccccttcaccgttggaggggggataaagagcattgaggacataaacaccattctctctgctggagcggacaaggtttctatcaacaccgccgccgtcaaaaaccccgaatttgtgagagaggctgcggatattttcggcagccagtgcattgttgttgccattgactgcaggaggaacttcgacctgagcaagggtgaatacatcgtggagcttgaggatggcacgaaggcgtggtacgaggttgtgatttacggcgggagaaagcccgtcggcatagatgcggtctggtgggcgaagagggttgaggagcttggcgctggagagattctgctcacgtcgatgaacagagacggcacgaaggatggtttcgacatccccataacgagaaagataagcgaggaggttaacattccagtcatagcttcaggaggagctggaacaaaggagcacttctacgaggggtttgtggaagggaaggccgatgcgtgcttagctgcaagcatcttccactacagagaaattggaatcagggaaattaaggagtatctggctgagaggggcgtgcaggtgagattgtga

SEQ ID NO: 24675 - DNA, 747 bp, Archaeoglobus fulgidus
atgctgaaagttgagggagttggaataagatttggaggtctaatagctctgaacaacgtaacctttgaaatcaggaagggggaagttctggggattattgggccaaatggggctggaaagacgaccttgttcaacgtcatttcgggcctttacaaaccagatgagggtgttataatcttcgaggggaagaacataacgaccatgcctccacataaaatcgtaaggctcgggataagcagaactttccagacggtcagtctgtacttcaacctacctgcaatcggtaacctgctcataacgctcaccgcatggtacagaagcggcgttctatccgccctgagagaagagaacggtgacgagaccttcaaggaggccatggaacttttaaactttgttggacttgatgaaaaggccttcactcctgtcaaaaaccttccgcaggaagctcaaaggaggctttccatcgccattgcactggcaacaaagccaaagctgcttttgctcgacgagcctacagcaggtctgaatctggaggagacggacagaattctggaaattataaggactctgaaggagagaggtgttacagttgcaataattgagcataaaatgaggttcataatgggtgtttctgacagaattgtcgttctggacagcggagagattatcgcagaaggcagccctaaggaaatcgtagagaacgaaagagtcattaaggcatatttgggtgagagctatgttgtttga

SEQ ID NO: 24676 - DNA, 1734 bp, Archaeoglobus fulgidus
atgaacgtacttggtgtggaaggagagaacatccgagaggtggacgtgacaaaaataaaccgcgtttggactaagttttacgatgagggtgtgagagcaaacatcgattatccggtaatgcccgcttacaggattcttgaagatgccgccgcgtccgatcccgacaagatttgcttcgagtttttcggaacaaagtggacctacaggcagatgaaggatgcttcggataaggtcgcaaacttcctgttcgacataggggttgagaagggagacagaatcgtcgttgcactgccaaacctcccgcactacgcaatcatagccaacgcaatatacaaggtggggggcatagtggtgcagtgcaacccgatttacaccgagagggagatcagatacatcgtaaagaacagcggtgcaacaaggatgttcgcctttgaggggatgtatccgagaataaggcccctaatcgaggacggcacgcttgaaaaggttgtgatatgcagaattgaggattttctggggtttgtgatgagcgcacttttcaaggcgtttctgaagaagaagatggtcggtaaggttgatatcgacaggaggaaggaggttgttttctggcaggacgttttgaagtacgaaagaactgacaagagggctgaaataaacccgaaagaggacgtggcaatgttccagtacacgggcggcacgacaggattcccaaaggccgttatgctcacccactacaatctcgtggtgaatgcttatcaggttgctgagtgggacccgagaacgacgccaagcgacgttgctgttggttgcttgccggtcttccacgtttacggcatgaccatgctgaactcatcggcggttctgaggatgaaggtcattccaatccccgacccgagggatgttgaggcaatactgaaagccgtgcacaagtacaaagccacaaccttcaccggagtgccgactatgttcataagcatgctcaaccatccgaagcttagcaagtacgacttaactagcctcagggtctgcgtgagcggtgccgctcccctgcctgttgaggtgaaaaggaagtgggaggaaatcaccggaggaaagcttgttgaaggctacgggttgagcgaggcttcccctgttacgcactgcaacccgctctatgggcttaataaggccggaagcattggagttccctatcccgacacctatgccgttgtgatagacgaggagggcaacattctcccgcccggtgaggagggggagcttgccatatacggccctcaggtgatgaagggctactggatgatggatgaggaaactgaaaaaactctgatcaacggatggcttttaacgggggacatggcgaagatggacgaggatggctacttctacatcgtggacaggaagaaggatatgattgtggcaggaggttacaacatctatccaagagaggttgaggaagttctcttcgagcatcccgctgttgctgaagctgctgttgtcggagtgcctgatccgtacagaggagagacggtcaaggcctttgtggtcttgaggccagaatacaaggggaaggtcacggaaaaagacctggacaagttctgcagggagaggctcgctgcctacaaagtaccgaggctgtacgagttcagagatgagcttccgaagtccctcgttgggaaggtgctgaggagggttctgagggaggaggaagcagagaaattaaagaaaaagagttaa

SEQ ID NO: 24677 - DNA, 1014 bp, Archaeoglobus fulgidus
atgggagctacgataattgttggcggattctggggagatgaggggaagggaaagatagtggctcacgttgcacacagcgataagcctgttattattgccaggggaggcgtagggccaaatgcgggccacacagtggagattgacggtcagaagtttggagtgaggatgattccgtcggggttcgtttacaaggacgcgaaactgctgatcggggccggagttctcgtcaatcccgaggtttttctcaaagaggttgaacttctgaaggttggggacagggcgagggttgattacaggtgtgcgataattgagccgaagcacattgaggctgacaagggaagcgagcacctgagcaagaaaatcggcacgaccggaactggctgcgggccggcgaatgttgacagggttaacagagttgcaaagcaggcgaaggacattccagaactcaaagactaccttgctgacgtcccccttgaggtgaatcaagctatagagaacggacagtttgtgctgatagaggggagccaggggttcggtctcagcctgtactacggaacctacccgtatgtgacgtctaaggacacaactgcctcggccatagcctcggacgttggggttgggccgacgagggttgatgacgttattgtcgtcttcaagtgcttcccgacgagagttggtgctggtccgttccccacggaaatgcctcaggaggaggccgagaagctcggcatagttgagtacggcaccgtgaccggaaggaggaggagaataggctactgggacggagagttcgctcgctattccgcaatggttaacggcgcaacgcaggttgcgataaccggagtggacaagctcgacaaggagtgctacggggttacggagtgggagaaacttactcccaaagcgaaaaagttcattgagcaggttgaggaggacgtcagggttccggtaacgctcatctccaccggacctgagctgaagcagattatagatttaagaaaagaaaagctttaa

SEQ ID NO: 24678 - DNA, 1146 bp, Archaeoglobus fulgidus
atgaactttgagtttgaggaggagcaccgaattctgagggacagcgttagagagtttgctgaaaaggagatcatgccttacggcaaggagtacgacgaaaagggagagtatccctgggaaatattcaggaaagccgccaagctcggctatgtggctgcggacattcccgagaagtacggtggtgcggggctcgattacctcggatgcgccataattgctgaagagttcacaagggctgacagcagcataggctcagcggttttgacagcttcccttggttgcccgatggtcaagtactttggaacggaggagcagaaggagaggtatctgccgaaagttgtaaagggtgagacgccctcggctatcgccataaccgaaccggatgcggggagcgatgtgcaggccataaagacaaaggcggaaagggttgatgggggctggaagcttaacggaaccaagaccttcataaccaacggcagcgtctcggagtgggttgtgattctcgccaaaactcagcctgatgctggctacagaggaatttccgcctttctcgtcgaaacgggatgggatgggtatgaagcgaggagaataaagaagatggggctgaattgccacgatactgcggagatatacctgaaggacgttttcgttcccgaaacgcacattatcggccaggagaactttggcttttaccagcttatgaggttcttcaacgagagcagggtgtttgttggtgccgttcagctcggaatggctgttggagcctacgaaagggctttggagtacgcgaagcagagaaaggcctttggaaaaccgctcatagagcatcaggcgatacagttcaagctcgctgatatgtggaaggatattgaggctgctaagcttctgatttacaaggccgcttggcttattgataggggaaaagcgaatcctgcgttgagctctgcagcaaagctcttcgccagcgagactgcgattaaggcaacgtatgaagctttgcagattttcggcggctacggctacagcaaggagtacgacatcgagcgctactacagagatgccagagttggaacgatttatgagggtacgagcgagatacagaagctcatcatcgcgagagccattgctggaaagctcagattatga

SEQ ID NO: 24679 - DNA, 885 bp, Archaeoglobus fulgidus
atgaaactcggttttgttggtgcgggaagggttggaagcacttcagcattcacgtgtttgctaaaccttgacgttgacgagatagcacttgtggatatagccgaagacctcgcagttggggaggcaatggatttggctcacgcagcggcgggaatagacaagtacccgaaaatagttggtggggcggactactcactgcttaagggtagtgaaatcatcgtcgtcactgcaggcctcgcaagaaagccggggatgacccgcttagacttggcgcacaaaaatgcgggaataatcaaggacattgctaaaaagatcgtcgaaaacgctcctgagagcaagattctggtcgtgacaaacccgatggacgttatgacttacataatgtggaaggagagcggaaagccgagaaatgaggttttcggcatgggcaaccagctcgattcgcagagattgaaggagaggctttacaatgccggggcgagaaacatcaggagggcatggataattggagagcacggagacagcatgttcgttgccaaaagccttgccgacttcgacggagaggtggactgggaagctgtggagaatgacgtcagatttgtagctgctgaagtaataaagaggaagggagctacaattttcggtcccgccgtagcaatttaccgcatggttaaagccgttgttgaggataccggcgaaatcatcccgacaagcatgattctgcagggcgaatacggaattgagaacgtggctgtgggagttcccgcaaagctcggaaagaatggggcggaggttgcggacatcaagcttagtgacgaggaaattgagaagctaagaaactccgccaagattttaagggagaggcttgaggaactcggatattag

SEQ ID NO: 24680 - DNA, 1479 bp, Archaeoglobus fulgidus
atgattggggtaatcgatgcgggaacaacaacgataaagcttgccgtttacgatgaggataaacttgtagcgatcaaaaaggagccggttgtcaagcacaatccaaagccgggatgggttgagatcgatgcagaggatttagcgaggaagtgtgtgagcttcgctgacacagccattgacgagtatggtgttgaggtaattgccataaccaaccagcgaaccaccgcagttctgtgggatggtaaaacgggcaggccagtcttcaatgcccttggatggcaggacatgagggccaacgctcttgctgaggagatgaacagagactctaccatcaggatggcaaggactgctggaatgattgcgagaggggtggtgaagctgcttccaacgctgaaaaacaagagaagggttaagtggctcatcacactctcccgcctctcaatccgccccaaccacaccagcgtgaagctctgctggatgctgagggagcttggagagaaaaaggagaagtatgatctgaaagctggaaccgttgacagctggcttgtatacaggctgacaggtgagcatcttacagattactccaatgctgctgctacaggcctctacgactcctactacctgcggtggagcgagcccattctaaaaattgttggagcagatgaggaaatgcttccgaaaaccctcgaaagcgacagaatctttggagagtacagaaatgtgccagtcactggagtcatcgccgaccaatccgcctccctctacgccctcggatgctgggaggagggagacatcaaggccaccaacggaaccggaaccttcgtcgacctcaatgttggagaagagccccaagcctctcccggaggtttgcttcccctcatagcgtggaagctgaagtcggaaatgagatacatgatggaggggatgctcttctacagcggttctgccgtggagaagctgaaggaaatcggcatctacgatgatgtttctaaaacttcagaaatggccttcaggtcgaagaatgacgacatgctgctcatcccctccttcaccggcctcgcaactccccactacgtctcggttcccggcttgctttacgggatatccaacgccatgacgagggaggatatagtgaaagccctgctcgaatccatagccttcagaatagccgaaatcgtcgagattatgcggaaggagtttccctacgaaactgacagaatcagatgcgacggagagatgtcctccaacgacttcttcctgcagagaattgccgacgttacaggcttgaaagttgagaggggggcagtgctttcgggaacttctttcggggcgcacctcgttgctgggagggctttgggcaagtggaaaaaggacttctgcatgcccttcgataaagttttcgaaccctctttggatttatcggagaagtacagaaggtggaagaggctgcttgaaatatcgaaaaagcttaaggtgtga

SEQ ID NO: 24681 - DNA, 1344 bp, Archaeoglobus fulgidus
gtgatagccatcgaaaaagctcttgaggaaatcagggctgctgggatagcggtctccacaaacatggaggacagaattgcctactgcaaggactacaatccccttcaccttcccaagctgctcaggcgagagttttctgcaatgcctgacgctgttgttttcccgaagagcactgaggaggtttcagtcattctcaaggtcgcaaacacctacggcatacctgtgtacgttttcggcggtgggagcggggttatagatgcagcaactccctacgaggggggaatagctctctccacgctctccctcgaccagatagagattgatgaggagaacatggttgttagagcgggagctggggttgttgggggaaggctggagaagattctgaaccatcggggcttcacgctccgccactctccccagagcctctactgctcgaccgttggcggctgggttgctacggcagcgagcgggcagttctcaactggctacggcaacatcgagaaccttcttgtctccctaacggctgttctcccggatggtgaagtggttacggagagggcaactcccagaagggctgggcccgatttaaagaaaatttttgtgggaagcgaggggctgctcggtgttgttaccgaagcggtaatgaagatttttccattgccggaagagtttctaacgctctcagtcgaatacgatggtattggtgaggctgtgagggatgcaaaggctttgatgcagctaagaccagctctcatgagaattttcgacgatgaggagagtctgaggtacttcgactcggaaagcttcactctgatagcggttttcgagggaagggctgcgtctgcaaagctgaaggaggccagaaatctcgttaggggaaggttggttgagggaagggcggagaagtggcttgagaagaggttcgacgtttcggatataagccgaatcgtccccctcggcttcatcttcgacaccatagaggttgcgtgcttctggaaggatgcggagagagtttactcagaggttttgaaggccataaggagcgttgagggaacagtcacagcctcagcccacgcatcgcacttctacgagagcggtttgtgcttctacttcacctttgccggtttgccggcagacatagagagctactactttgaagtatggaggagggccatcgaggcttcgctgaagaacggtgggaatctgacgcaccaccacggcgtggggaggttgaggaagaggtggctttcggcagagattgggggatactatcctctgctgagagacctgaagagcgttctggacaggaggaacatcctcaacaggggggtgatgctgtga

SEQ ID NO: 24682 - DNA, 1008 bp, Archaeoglobus fulgidus
atgattgtttcgatactgggagcgggtgcaatgggctcagccctctccgtcccgctcgtagataacggcaacgaagtgagaatctgggggaccgagttcgatacggagattttaaaatcaatctcagccggcagagagcatccaaggcttggtgtaaagctcaatggcgtggaaattttctggccagagcagcttgaaaaatgtttggagaatgcagaggttgtacttctgggtgttagcacggatggcgtgctgcccgtaatgagcagaattctcccgtatctcaaggaccagtacatcgtactcatctctaaagggctgattgattttgataacagtgttctgacggttcccgaagctgtatggaggttaaagcacgatttgagggaaaggactgtggcgataaccgggcccgctattgcaagagaggtggcgaaacgcatgcccacaaccgttgttttcagcagcccatccgaaagctcggccaataaaatgaaagaaatctttgagacagagtactttggcgttgaagtaacaacagacataattggcacggaaataacctccgccctcaaaaacgtttattccatagccattgcatggataaggggctacgagagcagaaaaaacgttgagatgagcaatgcaaagggagtgattgcaacgagagccataaacgagatggcagagctgatagagattctcggaggggatagagagaccgcctttggcctttccggatttggagacctcatcgcaaccttcaggggaggaaggaacgggatgctgggagagctgcttggaaaggggcttagcatcgatgaggcgatggaggagcttgagaggagaggagttggtgtggttgagggctacaaaacggcagagaaagcatacaggctgtccagcaaaataaatgcagacacaaagctgctcgacagcatctacagagtcctttatgaaggactgaaggttgaggaagtgctgtttgaactcgctacatttaaataa

SEQ ID NO: 24683 - DNA, 1452 bp, Archaeoglobus fulgidus
atgctgagagaaagcaggatgaagaaaggcatggacccaaaggctctgaagctctcctcttcaatcgagcacgataaaaatatcttcctgtacgatattctcgttgacgttgcccacgtcctgactctcaagaagggaggctacttaagcgaagaagaagcaaaggagataattttggctctgaaaaaggtaaaggattctggatttagggaagattggccctacgaagacgttcacgaagccattgaggcagaggtgacgaagataacccctcacggtgcaaaaatgcacacgggaaggagcagaaacgatgaggttgcaacctgcctgagaatgttcgcgagagaccacctgctgaatctcgcagaggcaatcctcaacgcgctggatgttttgattaagaaggccgagaagtcccactttctgatgcccggattcacgcatctccagtatgcgcagccaacgaggctgtcgcatcaccttctcgcttatcacgatatgctctcaagagactttgagagggcaatagaggcgttcaggagagtgaacaaatcacctctcggttccgctgccttcgcgtccacgggatacagccttgacagagtctacgctgcaaggttgctgggatttgacggagtcgttgagcacagcgaggatgcagtggcgtcgagggacttcgttattgagtccatttttgtggcggccgaggcaatgctttcaatcagcagaattgccgaggaaattgtcctgttttcgtcagaattcggcttcatcaccttacctgatgagttttcgtcaacgtcctccatcatgcctcagaaaaagaatcctgacattgcagaacttttgagagccaatgcgggaaaaattgcggggaatttaacgtcagcaatgatgatttacaaggcgacacccttcagctacaacagggactttcaggagatgaatcccctgctctacgaatctctgaaaagaacgcacttggctgtggaggtttttgcctcaatgatgggtaaaataaagttcaaccctgagattacggaaagaaaagcctcaaaggggtttgccaccgcaaccgagcttgcagacatgctcgtaatgaagtacggcgttcccttcaggatggcgcatcgcattgttgggaggttggctgcaaaggagctggagaggcctacagcatccgatgttaattcggcagctaaagaacttggtgttgaaataaacgtcagagatgaagacgtgcttgaagctctggacgttgagaaggtcgtggagaacaggggaaatctgggagggacgagcaaggctgaggtggagagaatgataaaagcgaggaaaagcgatctgaaagacaggaaaactttgttaaggaagcttaggggagaggttaaaatggggcttaaaatgctttacgatgaggccaaaaagctgggggtggatatcaatgtctga

SEQ ID NO: 24684 - DNA, 981 bp, Archaeoglobus fulgidus
atgaagctcgtcaggaaatttgccagggacattgaggtggatgagctggctatctgcattcctctcgaatacaagtccgcttgtctaatttacgagctttccaggtacaccaacgtctatgctgcaaagctcgacgatttttcaacgaaacctgaggttgttagttggttgaaggagaagggtgttgaggtgaagatgaaaagggacgttgttaatgctgagtacttccttgattgtgcagcggtgctttcgagagtggcggtaaaaagcgggaaggaaaggcttaaggttgtggagctcacgaaaaccggcgaggagtacctgcgaaagatggatgttaggatgaaagcaatatcgcttgactcctcgacgttaaagggcactggagagaacacacatgggacggcttttggtttgctcgatgcgttgctaaggctgaacgtgtttttgccgggaaaaaaggcccttattctgggttttggcagagttgggagaggttgtgcgagactcctgaagtctgtaggctgtgatgtagccgtttgggacaatgacgaaacgaggcagattgaagctctttatgagggattcagagtcgagaaagattttaccgcggaagtggtggtaacgtgcaccggagttaaaggtgttctcggtaaagaggagcttgaagaaatctctgatgggagcattattctgaacatgggtgctgagatggaaattgagcctgcaggtgagcttatcaaagactacggcctggttaaggagtacgagatagccgggaaaaggtatttcttggtcgctgacggttatgcggcaaacctcgccctcggtagcggaacaccgattgaggtgatggacaggaccttttccgcggcaatccttgctttaaaccatttgagcaggagcgattttgacggaattatcccccttccccaccacatagaatcgacaattttggaagccataatgatgtacaaatag

SEQ ID NO: 24685 - DNA, 1260 bp, Archaeoglobus fulgidus
atgaaaaaagttcatatatttttgcgcttacgaactcaggtgggggcgagcaggtacagatgggttgtattcggtgtgatggcttcaatctacttctttgtttattttcaccgcacgtcatcagctatcctcgcaaccacgctcatggaggagtttgccgtaaccgctcttgccgtcggtgtactctcatctgcctatttttacccctacggcttaatgcagattccggtgggttacctctccgacaccaagggaccgaggttgacaacgaccgtgttcacgctgctggccttcgtagggactgtactcttcgccgtgtccccaaactttgaagtggccgttcttgggagattcctgattggcatcggcgtgtcgggagtttacatccctacgataaaactgctatcccgatggtttagagtagacgagtttgccaccttgacaggcgtgctgttcgctgtgggcaatatgggtgcattagtttcggcctatccgcttgcaacgatggtctctctgttcggatggagggtcacgtttctcttcattggggcaattacctttgttcttgctctcagttgctggattttcgtgagggattcaccgggaggagttttggaaaagtccagagagggtgggaggtttgcgactaattttcgcgtggtggtgctcaacccggttgtctggttaatcgccacgtctgcctttctgagatacggcatcgtaatgggctaccaggggctgtggggtggtccgtacctaatggacgtctacggaatgcagagggaagaggctggcggtgtgttgatgatggtcggtctcggaacgattctgggagcgccaatcataggattcctctcagacaaggttttcagaacgagaaagtggttcctcgttgctgcgggtatcggattcacctttacgatggctccgctcgtcttcttcacggccagcctcacggtattccagctgtacgcaatatcatttcttattggccttttcagcgctgcgggtccggttgcctacgccctgattaaggagtcttacccgctcgaagttaccggtctggcgacaagcatcgtaaacgttttccccttctttggcggagccctcttccaggttttcatgggctatcttatggacacggtggggatggttgatggctcctatcctccggaagcatactcactcgcgttctccttttgcctcgctgcatcagtggtttcggcggtgctgattttatttgtccatgaaaaacgataa

SEQ ID NO: 24686 - DNA, 774 bp, Archaeoglobus fulgidus
atgcgagttgcggtttccggggcagcgggcagaatgggcaggcttgttgttaaaaatgcagtggcagagggcttgaaggtcgttcaggctttcgacatcaacgaagttggaaaggatgcgggagaacttgctggagttggaaagattggtgttccgattgaggacgacatctcaaagcttgatgctgatgtgctgattgacttcaccacagcagaggctgcaatgaagaacgctgaggttgctgcggagaagggagtgagggtggtgatggggacaacaggcttcactgacgaggacaggaagaggcttgcagagctggcggagaaggttccgatgattgtttcgccaaacttcagcctcggtgtcaacattttctggaaaattgttgaatacgccgcaaaaatgctctacgagtgggatgcagagattgtggagcttcaccacaggcacaagcgtgactctccgagcggaactgccctgaagcttgctgagatcataaggaaggttaaggaggaaaagggaatagaagcagacctaaagacgtgcagagagggaatttcgccgagggaaagcgagattggtgtttttggtattagaggaggagacgtcgttggagagcatacagtcttcttcttcggaagcggggagaggattgagcttacacacagggcgatgagcagagagtgctttgcgattggggcagttagggctgcgaagtggattgcaaaggttgacaagcccggcttttacaccatggacgactttttggagtga

SEQ ID NO: 24687 - DNA, 870 bp, Archaeoglobus fulgidus
atgtttgagggcgtgattcccgcaatggtaacgcccttcaaggaggacttcagcgttgactacgaggggatagcgaagaatctcgactaccttgagaagcacgtcaacgctctggttcctgctgggacaacaggagaggctgcaacactcagctacgaggagcacatcgatgttgtgaggtatgttgcagagacgtcaaagcttcctgtaattggtggtgcaggttcaaactcaacgagggaggcaatttggcttgcaaaggaagttgagaaggctggtgcagaggctgcaatgctcgtcactccctactacaacaagcccaacgctgaggggctctaccagcactacaaggctgttgcgtctgaagtttccattccaatcatagtttacaacgttcccagcaggacgggcataaacacaactcccgaactcgtaagaaggctggcggagattgacaacatttttggcattaaggaggcgagcgggaacctcaagcagatctccgagattataagaacaacaccagacgactttgtcctgctttctggcgatgattttctcaccctgcccattctctgccttggaggaaagggcgtaatcagcgttgccgccaacgtcgccccccacctgatgaaggagatgtacgaagctttcgttgaggggaacatagaaagggcgagggagatgcaccacaggcttacgccactcttcgacgtgctcttcatcgacaccaatcctattccggttaagaaggctttgcagcttatggggcttgcagcgggaaagccgaggctgcctctggtcgagctctctgaagagaaaactcagaaggttaaagaagttctcaagagtcttgagctgattagctga

SEQ ID NO: 24688 - DNA, 981 bp, Archaeoglobus fulgidus
atgataaagatagccatcgtgggattcggaactgtcggacagggggttgccgagcttttaatcaggaaaagggaggagattgagaaggccatcggtgagttcaaagttacggcggttgcagactccaagagctcgataagcggggacttcagcttagttgaagcgctgagaatgaaacgagagaccggaatgcttagggatgatgcaaaggccatcgaggttgtgaggagcgctgactacgacgtgctgattgaggcgagcgtgacgagagttgacggaggagagggggtgaattacattcgcgaagctctcaagaggggcaagcacgtagtaacctccaacaagggcccgctcgttgccgaattccacggtctgatgagcctcgcagaaagaaacggagtaaggctaatgtacgaagcaacggtgggaggggcgatgcccgtcgtaaagctggccaaaaggtaccttgccctctgcgagatagagagcgtaaaggggatattcaacgggacttgcaactacatcctctcgagaatggaagaggaaaggctcccctacgagcatattctcaaggaggcgcaggagctcggctatgccgaagctgacccgagctacgacgttgaggggatagatgcagcgcttaagctcgtgataattgcgaacacgataggtgttaaagctagttacgaggacgttgaggttacggggataacccagataactcctgaggcttttcaggttgctgccgagaagggatacaccatcaggctaattgcagaggttagcagagaaaagctaaaggtctcccccagactcgtgccgttccaccacccccttgcaatcaaagggacaatgaacgcagccatgttcaaaacagatacagcaggaagcatcttcgtggcgggaaggggagcaggaaaggaggagaccgcctcagcgatactgtcagacctgtacgagatctatgctggacctcgctaa

SEQ ID NO: 24689 - DNA, 1272 bp, Archaeoglobus fulgidus
atggctaaggaaaaggagcacattaatgttgccttcatagggcatgtggaccacggaaagagcactctgattggaaggctgctctacgaaacgggtgagattccggagcacatcatcgagaaaatgaggaaagaggctcaggagaagggcaaagccaccttcgagttcgcgtgggtcatggacagactgaaggaggagagggagagaggagttacaatcgacgtagcccacagaaagttccagaccgacaaatactacatcaccatcgtcgactgccccggccacagggacttcatcaagaacatgattaccggcgcatctcaggcggatgcagcagttctcgtcatggatgtcgttgagaaggtgcagccgcagacgagggagcacatcttcctcgcaagaactctcggcattaaccagataatcgtggctataaacaagatggacagagttaactacgaccagaaggagtacgaggctgcaaaggaggcggtaagcaaacttctcaagatggtgggttacaaggtcgacgagattccgttcatcccagtttcagcctactacggagacaatgttgcaaagaagagcgataagaccccctggtacaacggtccgacgctgcttgaggccttcgacctgctcaagccaccggagaagcttgttgataagccgctcagaattcccatccaggacgtttactcaatcagcggtgttggaacggtgcctgttggcagagtcgagagcggtgtgctcagagttggagacaaggtcgtgttcgagcctgccggcgtaagcggtgaggtaaagagcatcgagatgcaccacgagcccatccaggaggcttatccgggtgacaacatcggcttcaacgttagaggtgtcagcaaaaaggacatcaggagaggagatgtcgctggccatccagacaacccgccaactgttgtgaaggacttcacggcccagcttgtggttctgcagcatcccacagcaatcacagtaggctacactccagttgtgcacgctcacaccgcccagattgcctgcaggttcgtagagctgcagaagaagattgacccgagaaccggccaggttaaggaggagaacccgcagttcctcaagacaggtgatgcagcgattgtcaagcttgagccaacaaggccgatggtcatcgagagagtcaaggacatcccgccgatgggcaggttcgccatcagagacatgggcatgaccatcggagccggaatggttctcgaccttaccccaagaaaataa

SEQ ID NO: 24690 - DNA, 780 bp, Archaeoglobus fulgidus
atggctgcagttgaatacagagaggaagacggagttctgtgggtgaagttcaaccgtcccgaagcgctcaacgctataaacaaggacttcgttaaagggctgagagaagtcgttgattatgcgaggaacaacaagactgtgagagttatcgtcctcactggagaggggaaggccttctgtgctggagcggacataaagatgttctctgaatcctcccattttgttgcgagaagcacaattgaggagctcggcaaagttcttgaggagatggaggatttggaggtgccggtgatagcagccataaacggctttgcccttggtgggggctgtgagattgcgatggcgtgtgatattataatagcaagcgagagggcgagcttcggtcagcctgaaattaacctcggcatcattcccggagcgggaggaacgcagaggcttgccaggatagtgggctggaagaaggccatggagctctgcctcacgggagagagaatctccgcagaggaagcctacaggctcggcttggtaaataaggttgtggagcacgataagttgatggatgaagcaaaaaagatggcagaggtcatcaagagcaagtctccctacgcagtaatgctggttaagcaggccgtgaacaggggcttcaagatggggctgagagatggtataatgtatgagagggacctcttcgccctctccttctcatctcccgatgcggaagaggggataaaggccttcgtggagaaaaggaaagctgacttcaggagggagagggagtga

SEQ ID NO: 24691 - DNA, 1185 bp, Archaeoglobus fulgidus
atgaattttgagcttagcgaagagcagagaatgattgcaaacgctgcgagagacattgcaaaggactttccgcccgagtactggagggagaaggaggagaatggtgagtttgcggaggagtttttcaaggcgataagcgatgcgggcttcatgggcattgttattccagaggaatacggtggtggcggctacgggatgacagagctgctcattgcaatggaagagctcgctgccaacggctgcgggatggctggagtctggtacatggttctgacggaggtttttggtgcccttaccatcgtcagacacggaactgaggagcacaaagagaagtatttgccgaagattgccaagggggagatggagttctgcatggccttaacggagcctgatgcgggcacaaacactttggcaataagaaccactgccgtgaaggatggtgacgagtgggttataaacggaaacaagattttcatcagcggggcggacagggcgaagggaatgctcatcatcgccagaacgacgccgagggagaaggctgagaagaaaactcacggcataagccttttccttgctgatcttcccaacgatgcagttaaggttaacccaattccaaagcacgggataaactactcaaagacctgcgaggtgagcttcaacaatttgagactgcctgaaaacgccctcatcccgcccctcgatggcgggtggtatcacctgctcgacacactcaaccctgaaagaatgagcttcacaactgctgccatcggcatcagcagattggcaataagcaaggctgttgagtattcaaagcagcgcaaggtttttgcagaccccatcgggagctatcagggcctgcagttccccttagctgaggcttacgctaccctcgaatgtgcggaactgatgaacttcaaggcagcaactctctttgatcagggggcacactacagagaagttggggctgctgccaacatggctaaagctgtggctgttgaggctggcattaaggcggtttactgggcaatgcagaccttcggcggctacggctacgctaaagagtacgacgtggagaggtggtggagagaaatcaatctgattcgcctcgctccagtgacgcagcagatggcgctgaacttcatagcggagcacatcctcggcatgccgaagagctacaggacgtga

SEQ ID NO: 24692 - DNA, 1929 bp, Archaeoglobus fulgidus
gtgagaaaaatgggctttatctggcatccgccaaaagaattggttgaggagtccaacgtcaaggccttcatggatgctgagggcttttccgactacaagcagatggttgagaagtccactgacgacatagagtggtggtggagcaaggctgttgagtggctcaatgtggagtggttcaagccctacgagaaggtctacgacatgtcgaagggcatagagtggactgactggttcgtgaacggcagagtaaacgccgcttacaacgccttggacaggcacagaaagaagaggaacaagttagcgttcatctggcagggagaggatggagaagtgaggagatacacctacctcgagctttacagggaagtgaacaggctcgccaacgccctcaaggcctttggagttgggaagggggacgttgtggccctctacctcccaatgtttcctgaaactgtcgttactctctttgctgccatgaagattggcgccattgcgatgccgatattctcgggctatagctctgcagccattcagacgaggcttgctgattcagatgcgaaggttgttgttacagcagatgcaagctacagaagagggagggctgtgccactcaagcccgaactcgacaaggcccttgaggggacgaaggttgagaaggttgttgtggtgaacagggcggacaccgaagttgagatgaaggaggatagggacgtttactgggatgaggttaaggagagcagcaggtgtgagacggttgagatggaccccaacgatgctgctttgctgctctacacctcaggcacaaccggaaagccgaaaggggttgttttatcccatgcgggagtgattttgcagagcagcaaggagattttcttcaacatggatttgaagcctgaagacgtttttctttggatcaccgacattggctggatgatggggccttggcagattattggctgccagcatctcggcgggactcacgttctctttgagggagcccccgactatcccaacaccgacaggatatgggcgatgattgaggagtttgaaattacgcagcttggtggttcagcgacggtttacagattgctgaagagatacggagatgaggcggtaaagcagcacgacctgagcagtttaaaggctacgggcaacaccggagagccgatagaccacgacacgtggatgtggctgctgaaggtcgttggcgaggagaggtgcccgatcataaacctctcaggaggaaccgagatcttcggctgctttttgcttccctctcccgcaatgcccctcaagccgacaaccttgggctatcccggattggggatggacgtggatgtgtttgatgacgctggaaactctgtgaggcagcagattggatatctggtttgcaagaagccagccccatcaatgacaagaggcttctggaaagaccctgagaggtacatcaagacctactggagcaggtggaagggagtctggtaccacggagactgggcttatgttgacgaggatggtttctggttcctcttcggcagggccgatgacgtcataaaggttgcaggaaagagaatgggacctgcagagattgagaccatcgtgaactccattcctgctgtccaggagtccgcatgcattggagttccgcatgagcttaagggagaggttgtttgggtttttgtgactctaaagcccggctatgagccgagtgaggagctggagaaggaaatcgttgacaaaattgtgaaggagttcggaaagcccttcaagccggacagggttgtgtttgtccccgatctgccgagaacgaggagcgggaagattatgaggaggctgataaaggctgttgttgccaagcaggagcttggcgacacctcagctctggaaaatccggactcgctggagaagataaaggaggttttggggtga

SEQ ID NO: 24693 - DNA, 1656 bp, Archaeoglobus fulgidus
atggagattgagagatatatcgttccaaaggagacttggcccgagataataattcctgtcgaggtgcaggagtatattggagagaggaaggagctgaatctggctgaagagttgcttgaccgaaatatcagggaagggcgaggcagaaaggtggctgtttactttgaggacaggagagtaacttacagagacctctacaggctgagcaacaagattgccaacttccttgttgggataggcgtccaaccgtatgatagagtcggtttcagaacgaggaacatgccggaagcaattgcagtgaacttcggcataatgaaggcaggagccattcctgtgcctctaaacccaatgtgggcgggcaaggaggtgtcattcgtctcgaacaacgctgaaattaaggccttgtttgtcagcggtgacgagagagtattcccggcggtgaatgaggtcaaggatgagatcaagactgcaaaggccatggttgtgatggatggggagaaggagggcttcatccccttctcggaggttacggctgagagtgcgaagtttgacccaatactgctcaaaatcggaaccccagcactgattctctacacctctggcacaacaggcttgccaaagggctgtgtgcacttcgttgagaatgtgatatcatcagtctacctcgtgggcaagcacgtctggaagctcacaccagatgacgttgttggagggcccgctccggtaagctttgcgatgggctacggcaacggctgcctaattccctacttccacggtgctgcagcgagcatctggccgagattcagcgttgagaacttcttcaagtacgtggaggagcacggcatcacagtcttttcctcacttccaacatcctacagaatgattctcgccgaccccaagctggaggagtacatgaacaagtacgacatcagcagtctgaggctcttcacgggcggtggagaagctttgggtgctgagacggcaaagaggtggaaggaggtcttcggaatggacatctacgagtctctgggtgctacagagatgctgcacatctgtatcgccaacgcctgcgctcccaagcccgttgctggaagcataggttttccagtgccgggctatattgctaagatagttgaccctgaaactggaaaggagtgcggggcagatgaagtggggagcttatacatcaaaggtccgaccggaataagatactggaatcacccatcgagagacctgagcgagaagcaggcgaagagtgtgaagaacggctggaacgtgctcggagacttcgtcaggaaagatgaaaacggctacatatacttcgtttccagagatgacgacctaatcaagtccagcggctacagaatcgggccagatgaaatagagcaacccctcaacacccatccggcagttgccgagtgtgctgtcataggcgttcctgacccagagggaatcaggggacaggtagtgaaggccataataaggctcaaggagggttatactccagacgagaagctcaaggaggacattttagccttccttgaaaagcacatcgccaagtacaagctaccgaggataattgagtttacggataaacctctgccaagaacacccacaggaaagctgctgagaaggctgttgaagcagagtagctga

SEQ ID NO: 24694 - DNA, 537 bp, Archaeoglobus fulgidus
atgaaaaagtttagcaggaaaacggaggagacagaggtggaagtcgttcttggagaagagctgaaagttgatactggcatcgcttttctcgaccacatgctgaaaacgctttcaaggcactccgggataaagctgagagtgaaggcaaagggagaccttgagcaccacgttatagaggatgttgccatcgcgctcggaaaggctcttgccggggtggataaaaagggtttggagaggtttggagatgccatcgttccaatggatgatgctgtagcaatctgcggtctcgacttcagcgggagaggcgtgcttgtggtggaggggacttttggggatggtgagatgagggaagaggactttctccacttcctcgacaccctctgcagaaatgctggcttgaacgtttaccttagcgttaaggggagcaattcccaccacaaaatggaggctgcggttaaggcagttgctatatcgctgaaaaaagctttgacaaaaaatggaaatgattacagaagcgcgaagggagttctggactga

SEQ ID NO: 24695 - DNA, 1188 bp, Archaeoglobus fulgidus
atgttcagaggagtggacttttacaatgttgacgagcttttgagcgacgaggacaggcttgtaaggcagtcggtgagagagtttctggagaaggaggttgtgccgcttgttgccgatgcctggcacgaggagaagccgttaaacttccatgagctggggaagaagtttggggagcttggaatgctcggcaccttcctgccagaggagtatggatgccccggaatgacctacacaacttttggtgtagtctgtcaggaggtcgagagggttgacagcgctctgagaagctttgttgccgtcacatctggcttggtaatgtatcccatctggagatacggcagtgaggagcagaagggggaatacctgccaaaacttgcaaggggagaaattatcggggctttcggccttacagagccgaatcacggcagcgacccgggcagcatggaggcaactgcaaggagagatggggatgagtgggtgctgaatggcaccaagacctggatcagcgaggctgatgtggctgacatagctgttgtctgggcgagggatgttgaagatggaaagataaagggctttattgtagagagaggcacgaagggattccagcagacggcaataacaaagaaagcctcgatgagggctggaagtgtgggcgagcttggccttgtcaactgcagagtgcccgaggagaacaggttgcctgaggcaagagggctgggggcaccgctcagctgcctgaatcaggcgaggtttggaatctcatggggggcgataggagcagcaatggactgctacgagactgcgttaaactacacgaaggagaggaagcagtttggagctcctttagcatcttaccagcttgtgcaggagaagctggttaacatgctcattgagataaccaaggggcagcttctcgcgtggaggctggcaaagctgatggatgaggggaaggctacaaccgagcagatttcaatggccaagaagaacaatgttagagtggctcgctactgtgcaagaactgcgagagaattgcttggggccaatggcataagccttgactactcgccgataaggcacatggccaacattgagtccgtctatacttacgagggcacggatgacatccacacgctgattttgggcagggctataacaggatatcaggccttcagaagggagctaaggtga

SEQ ID NO: 24696 - DNA, 1014 bp, Archaeoglobus fulgidus
atgagtgaagagagcaacgaagagacgaagattattgagcttgaggatattcccggagtcggtcctgagacggcaagaaagcttagagaggctggatattcaacaattgaggctgttgccgtagcatcaccctcagaactcgccaatgtgggtggaatcactgaaggtaacgcggtaaagataattcaggcggcgaggaaattggccaacataggtggttttgagagcggagataaggttttggagagaagaaggtctgttaagaaaataactactgggagcaaagacctcgacgagttgcttggtggtggagttgagacccaagccataaccgagttttttggagagtttggtagtggtaagactcaaatctgccatcagctcgctgtaaacgttcagcttcctgaggatgagggagggcttgaaggctcggtgattatcatcgacacagagaacacattcaggcctgagaggataatccagatggctgaggcgaaggggcttgatggcaatgaggttctgaagaacatctacgttgctcaggcttacaactccaaccaccagatgcttcttgttgataacgcgaaggagctggctgagaaactgaaaaaggaggggaggccagtaaggctaataatcgtcgattctctcatgtcacacttcagggcggagtatgtcggcaggggaacgctggcagacagacagcagaagctcaacagacacctccacgacctgatgaaattcggtgagctatacaacgctgcaattgttgtgacgaatcaggttatggcgaggcctgacgtgcttttcggcgacccgacgaagcctgtggggggacacatcgtagcccacacggcaactttcagaatttacctcaagaagggcaaggatgaccttagaattgccaggctgatcgactctccacatttgcctgaaggggaggcgattttcagggtgactgagagaggaatagaggatgctgaagagaaagacaaaaagaaaaggaaaaaataa

SEQ ID NO: 24697 - DNA, 858 bp, Archaeoglobus fulgidus
atgaacatcctcgaaatctcaaacctcagcgtcaggttcggggacttttacgccgtcaagggattgactctcaacgtcagaaggggcgagattctgggactgctgggaccaaatgggagcggtaaaacaaccaccatcagggcgattttcgggatggtgccctacgaaggcgaaataaggaattacgccacctcagtaggctggatgccccagaactctcccctctacctcaatctctcggttgaggagaacctcaggttcttcgcatccctttacggaattgaggacgagaggagagtagaggagatgctgaagctcgttcagcttgagaggtatcgcaaaaggcttgtcaagaacctgagcggcgggatgaggcagcgagccatgcttgcatgcgctatgctccacgaccccgagctgctcgttctcgacgagccaactgcgggagttgacccaccattgagggtaagcttctgggagcagtttgagaagctcagggaggagggaaagacgatcctcgtaacaacgcactacatggacgaggctgagaggtgcgagaggctggttctgataagaaacggctcgaaaattgccgaagggacgcctgaggagataaagaggagagcttgtggtgacaggctgcttcttgaggttgacgatgcccttgccgcatccagaatactgtcagattaccgttcgtggataaacgggaaggttgttgttgaggtggatgatgcggcttcagaggctccgaaaatcatcgagatgcttagcagggctggagttaaggttttcagggtagaaataaggcggtgcaccctcgaagaggcttttatgaggttgatggagcatgcttga

SEQ ID NO: 24698 - DNA, 1095 bp, Archaeoglobus fulgidus
gtggatgctgcagtagtcggtgggggtcctgccggaagtcttgcagcaattttgctcgggaaaagctacgacgttgcgcttttcgaggagcaccagagcgccggctttccagttcagtgtgcagggctggtgagtgataaatgctataaaaagctgaaggagcactgcaaggctgaaaaggcaattgaaaatcacataaagggggcgttcttcttctctccatccggaaaaattgttctggaaggcagaggagaagcggtggtcgttgagaggaaaattctcgacagattgctttttgagagagctgctgagagagcgaaggtttttgtaaaggaaaaggctcggttgaatggtttcaggattataactccgtccagagaagtttcagcagagaaaataatcggagcggatggtgtgaactccactgttagagagcacttcggcttccccacaatggggttttttaccgcagtccaggtcgaggcgaagttcgagccgctcgacgagaattgcgttgagctctactttggcgggaactggagcgactcctttttcgcctacgccataccgctcggcgataccgcaagaatcggagttgtcagcagaagcagtccgctgcgctatctggaaaatctgatgaaaaggcatccttcagtgtccggcagggtggaggggagcgctgtggagctgaacgcaggggcgattcccgacaggctcgttaagttctcgaagagagacgttgctctgatcggcgatgctgcagggatggtgaagccctacacgggaggtgggctttactatcaccttatcgccgcagaaaagcttgccgaatcgtttccggatttgaaaggctacgagaagagctatctgaaggaaatggggagggagtacaggtttggctatgcggtgagaaagctgtactctcttcctgacgaaaagctggagcagcttttctcggcaatggcagattttgatttcaggggtgtgcacatggacagcccctcaactctcatcagaaaagctgcggatatcagctttaggcttttgagaaaaccctccctcgccttttaccttgtgaagagcctgtttctctaa

SEQ ID NO: 24699 - DNA, 1122 bp, Archaeoglobus fulgidus
atggagataaaaaccgttgcagttctcggtgccgggctgatgggacacggaattgctgaagtctgcgcgatggcgggctacaacgtgacaatgagggacatcaagcaggagtttgttgacagaggaatgaacatgataaaggagagccttgcgaagctcgagcagaagggcaaaataaagagcgccgaagaagtcctttccagaataaagccaacagtagatctggaggaggctgttaaggatgccgacttggttatagaggcagttccagaagtggttgaaatcaagaagcaggtctgggaggaggttgacaagctggcaaagccggactgcatcttcacctccaacacctcaacaatgagaataaccatgctcgcagacttcacctcaaggcctgagaagtttgcaggcctgcacttcttcaacccgccagtcttgatgaggctggttgaggttataaggggagagaagaccagcgacgaggtaatggacttgcttgttgagttcgtgaagagcatcggcaaaacgccggtgagagtggagaaggacgtgccggggttcattgccaatagagttgttgcaccaagaggcgttttgcttcatgcagtggttgaggccgagaatttaacgcctgaggaagttgatgcagctttcagaaaagcgggttatcctatgggtccctttgagcttgcagattacgttgggatagatgtcaattacaatgctgccagatactttgccagagcagttagccccgaatacgaaccgcccgaaagggttaggaaaatggttgaggaaggcaggcttggaagaaaaacgggcagggggtggtacgactggagtggtggtaagccaaaaattgacctgagcaaggcaacaggcaaaatcaacgtcgaggattttctgatggtcgaaataaacgaagcggttaagctcgttgaaatgggagtggcgaagcctgaagacatcgacatcgctctgaagcttggatacggcaggcagaaaggaccgtttgagctccttgaagagtttggaaaggagagggttgcaaggaggctcgaggagctggcgaaaaaatatggaaagaagatttttgagccagcggaatctctcagaacctaa

SEQ ID NO: 24700 - DNA, 1194 bp, Archaeoglobus fulgidus
atgctggctgaatacatcctcacggaagagcaaaaggccataaaggaggctgcaagggagttcgcggagaaggagtttcctaactacgttgaggagtgcgacagggaggagaagttcccctttgagctttggaagaaggctgcccagctcggattcatcgggatgtccattcccgaggagtacggagggcaggggcttggaattcttgattcctgcctcgttgtcgaggagttctggagggtcgatgctggtgttgggcagattgtcggaacggtgttcggctcagagcagataacgctattcggcaacgaggagcagaagaagaagtacctgccaccgctcgcaaagggagagaaaatctgcgccgcctgctacacagaacctcaggcggggagcgatgttgcgggaattaaaacaagagcggacaaggatggagatgagtacgtaatcaacggaacgaagatgttcatcaccaacggcagcattgcagactactacatagttctggcgagaactgatccaaatccgccgaagagacatcatggcatgtcagtatttctggttgaaagagaaagagagggtgtgcaggcgaacaagctgaagaacaagcttggtattagggcaaatgacactgcggaagttgtgttcaaaaatgtaagagtgccgaaggagaacctcatcggcgaggaagggaaaggtttctaccagacgatgattttcttcaacgtcacaaggattcctgtcgcatttcaggctgtgggccttgcacagggggcatttgagcttgcgtaccactacgccagaaacagggaggttttcgagaggaagcttgcagacttccaggttacgcaggagaagcttgcgaagatgaggacggagcttgaggctgcccgcttactggcatatcaggctgcctacttccaggacaagatggggatgccagatccgggattgacggcgatggcgaagtactacacggccaaggccgcgcagttcattgttaatgaggctttgcagatacacggaggttacggatttatgggagagcagcacataagcaggatgtacagggacgttagaattctggagatctacgagggtacaagggaaatagagatggagataatagggaggtctttgctgggcaaagtgccctcgaggcttggagcggtgaggaagcatcccctccagtaa

SEQ ID NO: 24701 - DNA, 1191 bp, Archaeoglobus fulgidus
gtggaagaagtgtatattgtagagtatgcaagaacgcccttttcgagaagcaggccgaagaagcccgaaagggacgtgttccacaagattagaggagacgagctaatggcgttggttctggaaaagctgcctgagagggcggggattgagaagaaggaagttgggaggattttactcggatgcgcctttccggtgtcggagaactggccttacggagggaagatggcgtcgctgctggcaaagtaccctcccgaaacctcagcaagccacgtggacatgcagtgcgggtcgtcccttgcaacaaccgcctacgcgtatctggaaattgcaagcggaaacgaggacatgatgatttccggcggttacgagcacatgacgagggtgccgatgggtgccgacaatccgcacgttgaccgccatccgaagttgctcacggaggagtacaaggactacagaatggacatcgggtttgtcatgggcttgactgcggaaacgctctttgagatggcgggctacctgaccaaagaggacctcgacaggtggtctctgaggagccaccagcttgctgccaaggccctcaaagatggttacttcaagggggagataatccccgttgaagccccgcaggctgatggtagtgtgataaccgtggattcggatcagtcaataaggccagacacatcccttgagcagatagcctctctgccaccagcctttaagcctggaggggtgattacagccggaaactcctctcctctcaacgctggagcttcaggcctgctgcttgcctctaaaaagaaggttcaggagcttggacttgagccaatcgccaaaatcatcggatacggcacagcgggagtgcctccttacataatgggagcagggccggttcctgcaagcagaaaggctctggaaaaaactggcttgaaggtgagcgacatagactactgggagattaacgaggcctttgcgatagtcccgctttacgccatccacgagctcggaattgagccggagagggtgaatatacatggtggtgcagttgccatcggtcatcctctggcagcgagcggtgcgaggctgattggcacgctggcaagaatccttcaggagaacaatggcgattacggcgtggcaaccgcctgcgtcggcggcggacagggcgcggcggttgtaattgagagagtttaa

SEQ ID NO: 24702 - DNA, 1782 bp, Archaeoglobus fulgidus
gtgagagttatggaggtgcctgagtttgtaaaaaacaggtactggcttgaaagggcctggattgagggtgttccggcagatgtcgagattccggaaaagcccctttacgaagtaattgacgaagtctgccagaaatacgcggataggactgcaataatcttttacggcgctgaaatcaagtacggtcagcttaaggagtacacggacaggtttgccacatcccttgcaaaaatggggataaagaagggggatgtggttgcaatctactccccaaactgcccgcagttcgtcatcgcctactacggggcaatgaaggccggtgcaacggtcacggccctctccccgctcttcgcgccgagggaggttgagtaccagctgaacgacagcggggcgaaggtgcttgtcaccgttgagcagctttatccgaacttcgctgctgttagggagaacacaggcgtggaggaggtgctggttgcgaacattgccggtggagaggcgaaggtcgaggggaagttcagggacttcagggagatgctcgcctcaccacctgaaccgccggaagtgagctggaacgttaaggatgacgttgcggttttgcagtacaccggtggaaccacaggtctgccaaaggcggcgatgctcacacactacaacgtcgtggcgaacatgtacgagctcatccccttcaccgacctgataagaggctggctgaagtcgcacaaagtgatcagggaggagggggattacgtcattgtcgaccttgacgggaaggagtacaggacgtttagggactactactacaacgactactccccgagagtcgcgatacttccatggtatcacatctacggccagacggttgacctcaacacaggtttggcgacaggagacatcctcgtcgttttcgcccagttcgagccggaaaagatactggaggctattgaaaggtacagggttgcgaccttcatgggtgctcccgcaatattcgtctttcttgcgaacaatcccgacttgctgaagaggtacgatttgacctccctgctttacgttaacaacggagctggcccggttccgccggaaatcatcgaaaagtgggatgagcttctcaaggatgcgggaagggggattcttgttgagggctacggactgagcgaggcctcgccggtgacccacaccacggttggcccgccgttcaggaagagaaagattggctctgttggcccgcccattcccaacacctacgctgctatcatcaatccggaaaccatggagtttctgccgattggtgaggaaggggagcttgtgatagccggccctcaggtcatgaagggatactggaacaggccgagagagacagaggacgtcttctttgaggccggcggaatgaagtggctcaggactggagatatagcgaagatggatgaagatggatacttctacatcgttgacaggctgaaggacatcatcaagtacaaggggcacagcgtctatccgagagagatagaggacataatgtacgagcatccagcaatcaaggaggtctgcgtcatcggtctgccagatgaggttgccggagagacgatcaaggccttcgtcgtccttcatgaagattacagggggaagattacggagcaggacatcatcaactggtgcaaggagagaatggcggcctacaagtatccgagaattgttgaattcagggatgagctccccaagtccgctgctgggaagtatttgaggagaattttgagagaggaggaattgaagaagatgaagaggtga

SEQ ID NO: 24703 - DNA, 2661 bp, Archaeoglobus fulgidus
atgattctgctcaaggagcttcaaatcaaaaacttccgctcccactcagactctaaaattgagtttgacaccggaatcaacctcattgcggggagaaatggtgcgggaaagagctcgatacttgaggcaattctcgttgccttctacggattgaagcccgccacgttgagaaaaaacgaccttgtgagggtgaacagctcaggatactcgctcagcctgaccttttctttaaacggtgatgattacacaatttcaagaaagagcaacggtgagtcaattttaacgggaaaggagattgtggagggagacagcaacataacggagtgggttgaaaggcacctctgccctgcacacgtttttacgggggcaatttacgtcaggcagggagagatagacagcataatcagggacgatgagagcagggagaggattataaggcagattacgagaattgaggactacgagaacgcctggaaaaatcttggagctgtaataagaatgcttgaaagggagaaagagaggttaaaagaattcctaagccaggaagagcagattaaaaggcagaaggaagagaaaaaagctgaaatcgagagaatcagtgaggaaatcaaaagcatcgagagcttgagggaaaagctttcggaggaggtcagaaatcttgaaagcagactaaaggagctcgaagagcacaaaagcaggctcgaatctttgagaaagcaggagagctccgttcttcaggaagtgcggggactggaggagaaactgagggagcttgaaaagcagctgaaagaggtggtggagagaatcgaagatttggaaaaaaaggcgaaagaggtcaaggagctgaagccaaaggcggaaagatactcaattcttgaaaaacttctctcagaaataaaccaggctctcagagatgtcgaaaaaagggagggggatttgacgagggaggccgcgggaattcaggctcagctaaagaaagccgaggaagataacagcaagcttgaggagataacgaagagaattgaggaacttgaaagggaactggagaggtttgaaaaaagccacaggctgctggagactctcaaaccgaagatggatagaatgcaaggcataaaggcaaaacttgaggaaaagaacctcacacctgataaagttgaaaaaatgtacgatttgctctcaaaagcaaaagaggaggaaaaggagatcactgaaaagctcaaaaagctgatcgcgaagaagtcgtctttgaagacgagaggtgctcagctgaagaaggctgttgaggagctgaagtccgctgaaagaacatgtcccgtttgcggaagggagcttgacgaagagcacagaaagaatataatggcggaatacacgcgagaaatgaaaagaattgccgaagagctggcaaaagctgatgaaattgagaaaaagcttaaagagaggctggagaaggtcgaaaaggctcttgaaaagcaggagactgttctaaagtacaggcagatggtagatgagctcaaagccctggaaaatgagctgtcctcccatgacgctgaaaaactctctgcggagagcgaagagtacagaaaagttaaggagaggctcgacgggctcagagggcagcagaagattcttctcagctccgcaagcaggattaaagagctgaagagctcgctaagagagattgaagaagctctcaaaaatgtggaaagcgaaaggggggagcttcacaggaaaatcagggaggaggggtttgagagccttgaagagctcgaaagggaggttcagagcctaagacctttctacaacaagtggctcgagctgaaggatgcggaaagcaggcttgaaagcgagctaaaaaggagggaaaaacttgaggatgagatttccgaagctatagcaaaacttgaggaggctaacggaaaggctgaggaaatccgcggtcaaatcgatgagctgctgaggatttacagtgaggaagagcacagaaggttgagcgacgagcacttgaggaaatcgaaggagcttgctggattgaaaagcaggcttgagactttaagagaatctctgcaaagcgcagaaaaagacttgaagtttctggaggagcagcttgcaaagatggatgagtacagaaagaaggtggaagttttcgagaaaatcgcgattcctgagctgaccagaattagagaaaagttcagaaaatacagaaatctggttgcggagaactcgatgagggaagtcgagaggtacgcgagccagatcttcgaggagctgacggaagggaagtactctggggtaaggctgaagaaaacgaccgagaggggaaaggagaagctcaaggttttcgttgtttaccagggtgaggagagggagataggatttttgagcggtggagagattattgctctcggcctcgccttcaggcttgctctctccatgttcatgataaggggcaagatacccctcctcatactcgacgaaccgactccgtttctcgatgaggagaggaggaggaagctcgttgacatcacgaccaactaccttaggaagatacctcaggttataatcgtatcccacgatgaggagctgaaggatgccgccgataaggtgattttcgtcgagtctcaggggggagtttcgagggtcagatatgtggaggctcagtga

SEQ ID NO: 24704 - DNA, 1953 bp, Archaeoglobus fulgidus
atgaaggttcttgtggtcggtgcgggcacgatggggcacggaattgctgaagtttgtgcccttgctggaaatgaggtaattctctgcgacataaacgagaacattttgaaaaatgcgctctcaaggatagagtggagcgtcagaaagcttgaacaaaagggaaggataaaaggggcagatgatgtgctgaagaggctgaaaaccacaacggatttggttgaagctgctaaagaggctgatttcgtcatagaggctgttgtcgagaagaccgaagtgaagcatgaggtcttcaaaactcttgatgagaactgcagggatgacgtcattctcgccacgaacacctccaccattccaataacagacatagcgatggcaacaaagagaaaggacaaggttgtggggctgcacttcttcaaccctccaactctgataaggctggttgaaataataagggggagagacacgagcgatgaaactgtaaggaaaaccgttgagtttgccaaatcaattggaatggactacgttctcgttgagagggacgttcccgggtttttgattaacaggataaacataagggttttcgtggaggcgataaggctgcttgaggagggttttaaacctgagcagattgatgcagccgttaaatacagagcagggctgcctatgggcctcttcgaggttgttgacttcagcggagttgatacggtttacaatgtcctcaatgaagtgaggaagaggggctttgaggtggaggtgcctggactgctcgagagaatggttttagagggcaggctggggatgaagactggcaaaggcttctatgagtacagtggcttttacacgagggctaaaatctcaaaagaccttgcatacagcgtcaacccgataaatctgctggctccggggattaacgaggctgcgtggctgataagaaacggaatcgcaacgaaagaagacatagacaaggcaacggtgaagggaatgggctatccgaagggcattctggactttgccgacagctatggcatagacagggttgtttcggtgctggaaacgaggaaggggaagacgggactgaaggagtacgagccggatgagctgctgaaagagcttaaggagaatggaaagctcggaaagaagaccggagagggtttttacaagtggaactacgaacttgaggatatcgggccagtaaggtatgagaagaggcacaactatgcagttataaccatgagaagggctgagaagctgaatgccttaaacgaggagatgtgggttggtttgacaaaggctttcaggaaggcgaggcttgacagggatgttagggctgtaatcataactggagaggggagagccttctgcgctggagacgacatagctgtaatgggctcttggaaaagcttcagggatggcgttgagttcttcgagaacattgccatgcccctcgtttcggagcttgctgactacgacaagcccataatatctcttgtgaacggaaatgcgttcggtggagggatggagctcaacatgttctttgacatcgttatagccagcgaagatgcaagctttgccgttcctgaggggctgattggagctatcccgcctatcgcctcatccttcggatacgcccttttcggcaggaggatggcctactacgccctaactggagagacgatggatgctaaagaagctaaggagttcgggctggttgatttagttgtgccgaagcactgcttggaggatgcggggatagagcacgttgataaggtttgcagagttgctcccttagcggcgcagtcgataaagaggtcgatgaatgctgtaaggcagcttttcaggaacgccttagagcttgctggaaaggagattgagcttctaatcccaactgaggactttgctgagggaatggcggcctttgttcagaaaaggcgacctcagtggaagggcaggtaa

SEQ ID NO: 24705 - DNA, 1101 bp, Archaeoglobus fulgidus
atggctccgagcggagcctctactggcagtggagaggctgtagtagtcagcccctacagatacgaggagattgaggaggaagtttcaaaggcgattatcggaatgagcgtctttgatcaggagagcgttgatgaggcattgagagagcttgacggaaccgataacttttccagaattggtggcaatttcgccataaccgcaagccttgcagttgctaaagcagctgcggaaattctcggccttccgctttacgcttacgttggtggagtttttgcaaaggagcttccctaccccttgggcaatgtcataggtggtgggagacacgcagaaggctccacaagcattcaggagtttctggtaattccagttggggcaaaaaccttttttgaggctcagagagcaaacgccgccgtacacaagcagcttaagaagattttcaaagaaaggggaattttcgctgccaaaggcgatgagggggcttgggctgcacagataagtgacgagcaggccttcgagattctcagcgaggccatccagagagttgaggacgagctgggagtgaaggtcaggatggggattgacgttgcggcaactgagctatgggatggtgagaggtacgtttactccgacagaaagctaactacagaggagcagattgcctacatggcggagcttgctgacaggtacgacttgctctatatcgaagaccccctccacgagaaggactttgaggggtttgcggagctgacgaagcaggtaaagtgcatggtctgcggggatgacatcttcgtaaccaaccccgaaatcataaagaagggcattgaggttggtgcagcaaacacagtcttaataaaacctaaccagaacgggactctgagcgggacggcaaaggcggtgaaaattgcgaaggataacggatacagcgttgttgtgagccacagaagcggagaaacggaggatgagactttagcacatctcgccgttgctttcaacgcaaagttaataaagaccggagtggttgggggagagagaatatccaagctcaacgagctcatcaggattgaagaattgatggacaaaccgagaatggtgatgatatga

SEQ ID NO: 24706 - DNA, 699 bp, Archaeoglobus fulgidus
gtgctcagcgaagtgagttttgtagctgaaaatgagattctcggccttctcggcccaaacgggagcggtaaatcaacgctgatgaagataatcgccggagttattcccccggatgaaggggatgtcattgtaaacggcgtatctgtagctgagaacccccttaaagttaaggagcttgttggattcgtccccgaaactccagtgctttacgagagccttactgcatccgaactcttcagctttgtcggggcagttagaaaaattgagtcctctctgctgaaagagagggttgagaggcttgctgaggcccttgagttcacggcgatggacgaactttttgcaaatctaagccttggaaacaggcagaaggtttccataatcgctgctatgctccacaacccctcggtgctgattctcgacgaggctttcaacggcctcgacgttgcttcagcaaaggttttcagagacctgattttccagttcagagaggaggggagagaggtgattctctcaacccacatcatgcccattgccgagagaatctgcgacagaattctcataattcaaaacggcagaataatcgctcagggcactcctgatgagctgaaaaaggatgaggatcttgaagatgtttttctgaagctcacgaaaatagagagggacatcaaacctctgctggaggtgctgtcttctggctga

SEQ ID NO: 24707 - DNA, 1164 bp, Archaeoglobus fulgidus
atggcaatcggttttacctttaccgaggagcaggaggatataaggagagctgcaagagagtttgcggagaaggagttcacgcctgagctggcgagggagtgcgacagggaggagaagttcccctacgagctgtggaagaagtgtgcaaagcttggctttcatgctgtcgacatccctgaggagtacggtggaggcggttatgggccgatagagaagatgattgtgatggaagagttctcagccgtcaaccccggcctcggacttgcgtgtttgctaccgaccttcggctttgaaattcttgttctgcacggcagcgaggagcagaaggagaagtggctgacgaagcttgcaaggggagacgtgataatgggcatggccaacactgagcctgatgcgggcagcgatgctgcaaacatcaaaacgagggccgttaaggagggagatgagtgggtgattaacgggacgaagcagttcatcagcaacggctccattgcggactttctgctcgtcactgcaaggacgagggagatggaccccaaggctaagcacaggggaataagctacttcatcgttgagacgaacagggagggttacaaggcgaacaaaattaagggcaagatgggaatcagggcgactgacacagcagaaatcagcttcagcaatgtaagagttccggcagagaaccttgtcggagaggagggcaagggattctactacatgatggagttcttcgacatgagcagagtgtgggttggagcgcaggctgtggggattgccaaaggggctttgaagctcgtaattgactacgtgaagcagagaaaggccttcaacgttcccctcgcaaccttccagtacatacagttcaagattgccgaactggcaacaaagattgaggctgcaagaaccctcgtttacagagccgctgctgtgcaggttgagcagggcaagcctgacaacaccctctcatccatggcgaagtggtatgctggagaggtggcagttgaaacagccaactgggctctgcagttccacggaggctacggatacatcgatgagtatgcgataaaccagttctacagggatgccaaaatcacagaaatctacgagggggcgaaggagatagagaagctaataatcgcaaggaatcttctcggattccgttaa

SEQ ID NO: 24708 - DNA, 1224 bp, Archaeoglobus fulgidus
gtgatgatagacggccttccaacactagacgatattccgtacagaggaaagcacgttctgctgagggttgacatcaacgctcctattgtgaactcaacgattctcgacacgagcagattcgagagccacattccgacaattgaggctcttgaagactcaaagctcgttttgctcgcacaccagagccgacccggaaagaaggacttcacgagtctcgaaagccacgcatccacactttccaaactgctcgggaagagagtcgagtacatagacgaaattttcagcaaaggcgttctgagaagaataaaggagatggagaacggtgaggtaattttgctcgagaacgtgaggttctactccgaggagcagttgaacagaagcgctgaggagcatgccgagtgccacatggtcaggaaactcagcacagcctttgacctctttgtcaacgacgccttctccgcatcccatcgaagccacgcatctttggtcggcttcgttccggttctgccatccgtcgtgggaaggctcgtcgaaaatgaggttaccgccctcagcaaacccctcaagggggaggggagaaagatatttgtcctgggcggagctaaaatcaaggactcggtgaaagttctaaaaaacgtgctggaaaacaacattgcggaaaaagtcgttctcacgggtgtagttgccaactactttctcatgctgaaaggttacgatataggtgaagtgaacagaaaggttgtggaggacaacaaggaagacgtgagcgacgaggagatgataaacatactcaagaagtactccgacaaaattatccttcccattgacctcggtatagagaaagacggtgtcagggtagatatcccattggagaagtttgatgggaaatacagaataatggatattgggcttgaaaccgttaaccagctttcggaaatcatcccgaagtacgattatgtggttctgaacggtcctgcgggagtttttgaggatgagcgtttctctctcggaacttacgagattctgagggccgcgacaagggctggttactcggttgttggcggggggcacatcgcctcagcagcacgcctcttcggcctttcggacaagttcagccacatatcaactgcaggaggggcgtgcataaggttcctgagcggtgaaaagctggtagctcttgaggttatcaaggaatactgggcgaagaagtggggcaaatcttaa

SEQ ID NO: 24709 - DNA, 1140 bp, Archaeoglobus fulgidus
atggaaataacggacattggcggtgtcctctgcaacggaataaaggagggaaaatacggccttggactcgttagggttagaggaagtattgcaggagttttcacgcagaacaaaatccgggctgctccggttatcgtttgcgaggagaacatcagggatggggttgtggagggtgtgattgtgaacagcggaaatgcaaatgcctacaccggggagcaggggatgagagacgcgagggagatgtgcagaatcgctgcaaatcttcttggatgtgaggagaggagagttgcggtcgcctctaccggcgtaatcggaagaaagctggacatggagtggataagaaaaaaagcaccggaggtttactcaggtctcggaaattcggtggagaatgcagagaggttcggaagggcgattgtaaccacggacagattcgtcaagaaggcctactcagagaaggcgaggattgctgctgttgcaaagggggcgggaatgattgcaccgaatatggctacaatgctctgctttgccttcacctccgcaaaatttgacagcggagagctttacgatatgctgagaagggcagccgataaaaccttcaacagacttacggttgacggggatacctcaaccaacgataccgttttgctgatttcaaccggcaaggagagggtggagagagatgttttcgaggaggagctttgctcggtcttttacagcatcgcaaagcagatggcgagagatggagagggggcgacgaaggttttcgaagtcagggttgacggagcgagaaatgatgaggatgcgaatctgatagccagagctgttgcaagctcgctgcttgttaagacggcaatattcggctgcgaccccaactgggggagaattattgctgctgccggctacagcggggcagatgtggatgagagaataactcttagcctctcagacgggagggatgaagtctttctaatcgattccggaaggcctttggggaacgaagagcgggcgagagtgttgatggagaaagcagaggagcttgtaatcaggctgaggcttgaaaaaggtaatggaaagggctttgccatcggctgcgacctaacctacgattacgtgaagctgaatgccgagtacacaacttag

SEQ ID NO: 24710 - DNA, 2031 bp, Archaeoglobus fulgidus
atgcttaagccggaacgaatggttagggtttctgtagtgggtcccagggagaaactgggcgaaactgcagaccttctccacagactcaacctcgtccacatagaggagcctgaagaatcggaatacttcagaatcggcgagccgcatccggatgcatcagttgtttcaagagcccttgtccagatgaggagcttcatctcccacctgaagctcgatccatcgaggatagtgcccagaagaaagttcagagagtccgagattgaagcccagcttaaggagaagctcgacgagtaccagcaattgattggagagcgaattgagtatctgagaagcgttgatgaaaagattgcatccttgcaggagcagctcaaccagatagagcctctcaagaggctcggaatacccgcaagactgcttaagggctacaagacgctcagagttttcgtcgggtttgtaaaggagaacccgacggagaagtttgcccaggtaacgagcgattttgaagttttcgccaccgaatacgagaaagagctcgttgtagcggttttcgttaaagccgagtacggggacgagttcctgagaatcttgcaggagtgcggttacagggagattcaggttcccgacgttgaggactttgaggcaaaaatttcggagatagagaaggaaatcgaatcgctgaagtcaagaaaggagcaggtagagaaggaaatagaagaggtaaaggtaaaggaggccgaaactctgcttgcaattgaagaatacctcagctcgcagatggacaagtacgagctgcctttgagaactttggtttcgaagtactcattcgtcctcgtgggctatctgcctgcaaaggctttgaacgagttcaaggccaagatggatgcaaacggcgttgcggttgaggtgcttgatgaagagggtgaacctccaaccaagctcagcaaccctgctggtgtgagaaactttgagctcctcacaacaaccttcggaattccgaagtacaaggagattgacccaactgtgttcatagcgatcttcttcccgatcttcttcggtatgatgctgggagatatcggttacggtttgctcgtcacggtcatttccctgtacctcaagagggtgtttaagactgagggctggcagaggatgctgaacatcggtgtgtacgctggagtgatgtcaataatcttcggcttcatctacggagagtgcttcggccccttcatagtgcctggagagtacgagccataccagatccacttcattggctcgcagcttgagcacctctacgagttccaccacggtcatccgattttcgacagggttgaggagatgggtgtcaagattctgctgttcgcaacgattgtgatcggtatcgcgaagattctctttggattcgctctcggtttctacaacgtctatgtcgagcatggccttaaggatgcgattctcgagaagctctcgtggatcataggtgttcttggccttgcaatgatcatcttcggcttcgcgtacaacgtgggagtgttctaccagctcggaatgggtccgaatccgggcgatgtgcctccgcttccactgcctggacttatggaaggctggcaggcaggactgaacgtttactacttggcagcacttccattgctcgtcgtctggttcatactgttcgtcatgggcgaagtgccgaaaatgggtgctatgggagtcatacttgcagtcgagctgctaacgtggttcggccagatcatgagctacgcgagacttctagccattggactgtcttcagtctacatagccttcgtcatcaacttcatcggaatgaagctcattgatccagtgggtataagtataccgatagttggcgcaatagtcctgctaatcggacacgtgggcaacttgattctcggcattctcgatccaggtttgcagtcattgcgtttgcactacgtagagttctttacgaagttctttgagggtggcggaaggctctacgagcctttcggcaggataaagaggtttattgaggagtga

SEQ ID NO: 24711 - DNA, 1746 bp, Archaeoglobus fulgidus
atggaagtgaaagaagctggatacgtgggagaaatttataggatttctggacccctcgtcgttgcggagggattgaaggccagaatgtacgacctctgcaaggtaggtgaagaggggctgatgggagaggttgtaggtttagtagggcagaaggttctcattcaggtttacgaggatacagagggtgtaaagccgggtgacaaagtagagaacaccggaatgccgctcagcgttgagcttgggcctggattgataagaaacatctacgatggtgtgcagaggccattgccggtgctaaaggaggtcagcggagatttcatcgggaggggcattgaagctccgggcttggacagaaaggcaaagtgggagtttaagccgctggtgaagaagggagaaaaagtaaaaccgggagaaataatcggaactgttcaggagactgaggttgtagagcagaagattctcgttccgccgaacgtcaaggagggagtaatcgctgagatttacgagggcagctttacggttgaggacaccattgcggttcttgaggatggcacggagcttaagctctaccacaagtggccagtcagaattccgaggccgtacgtagagaaacttccacccgttgtgccgctcataactggtcagagaattctggacaccttcttcccggttgcaaagggaggtaccgctgcaattccgggcccattcggaagcggtaaaactgtgacccagcaccagctggcaaagtggagtgatgctcagattgtcgtttacatcggatgcggtgagagaggcaacgagatgacagaggttcttgaggagttcccggagcttgaagacccgagaacaggaaagccgttgatggagagaacggttcttgttgccaacacctccaacatgcctgttgcggcgagagaggcttcggtttacaccggaatcaccattgcggagtacttcagagacatgggctacgatgtagccatacaggctgactcaaccagcagatgggcagaggcaatgagagaaatctcaggaagacttgaggagatgcccggtgaagagggctaccccgcttacctcgcatcaaggcttgcagagttctacgagagagctggcagagttaagaccctcgcagggaacatagggagtgtcacggttgtcggagcagtttcaccgcccggcggtgacttcagtgagccagtaactcagaacacgctcagaattgtgaaggtgttctgggccctcgatgcgaagctcgctgccagaaggcacttccccgccataaactggctgcagagctacagcctctacgttgacaccctgaaggactggtttgctgagaacgtcagcgaggagtggaacgagctgagaagatgggcaatggaggttctgcaggaggaggctaacctgcaggagattgtgcagcttgttggtagcgacgcactgccagaatcccagagagtccttctggaggttgcgagaatcatcagagaggtttacctcatccagtacgcctaccaccccgtcgatacatactgcagcgtgcagaagcagtacgacatgctgaaggccataaagcagatcaacgactggttctatcaggctctcgaagcaggaaagaccatcgatgaaattgcgggagtcgagggtctcgaagagtttgccagagccaagttcgaggaggactacaagcccgccatggaggctgcgctggagaagattagaaagaatctgctcggagagtga

SEQ ID NO: 24712 - DNA, 1419 bp, Archaeoglobus fulgidus
atgaagatgaaggagtataagaccataacccaggttgcgggtccccttgtttttgttgagaaaaccgagccggttgcctacggagagctcgtcaccataacgcttcccgacggctcaacaaggagaggtcaggttctcgacacgtccaaagatgtcgtcgttgttcaggttttcgagggtacgagaggagttgacacctcaagcaccgtcaggttcaccggtgacatcgtcaagctcaactgctcccaggacatgctcggaagaattctgagcggttccggtgagccgattgatggtgggccaaagatcgttccagaggagaggagaccaattgtcggtgcggccatcaacccctacgccaggcagtatccgagagagttcatccagaccggtatttcagcaattgacggaatgaacaccctcgtcagaggtcagaagctcccgattttcagcggttcaggtttgccgcacaacgacatcgctctgcagattgcgaggcaggcaaaagttaggggcgagggtgaggagttcgctgtcatattcgcggctatgggcataacttacgaagaggcgtaccagttcatgaaggagttcgagaggactggggcactggagagggctgttgttttcctcaaccttgccaacgacccggctatcgagagattgctgactcccagaatggcactcaccgctgcagagttcctcgcctacgagtacgacctgcatattctggttattctcacagacatgaccaactactgcgaagctcttagagagatttcggcagcaagagaagaggttcccggaagaagaggatatccgggttacatgtacactgacctcgcaactatctacgagagggctggccgtatcaggggcaggaaggggacgattacgcagatgccaatcctcacaatgccgggcgatgatatcacccacccaattcccgacctcaccgggtatatcaccgagggacagatagttttgagcagagagttgcacgccaagggtatttatccaccaatcaacgtccttccgtcgctcagcaggttgatgaaggaaggtatcggcgagggatacacaagagaggaccacccgcagtggaacgaccagatgtatgcggcctatgctgagggtgttgacctcagaggtctcgtcgccattgttggtgaggaggctctgtcagagagggacaggctcttcctgaagtttgccgacgagttcgagaggaggtttgtccagcagggaagatacgaggacagagatattgagtacactctcgacctcggatgggagctgctcgcaatgcttcctgagagagagctcacgaaggttgagagaaagttcatagagaaatatcaccccaagtacaggaaaaaagaagctaagcccgaggaggccacagaggaggcctcctga

SEQ ID NO: 24713 - DNA, 630 bp, Archaeoglobus fulgidus
atggcagaggtccaaccgacacgaatggagctcataaagctcagaagaaggataaagatggccacccgtggccatgcactgcttaagatgaagagagatggcctcatcatggagttcaggcagcttctggaggaggcaaaggaagtcattggtgggatggttcagaagtacgagaaagctcagagcaagcttgcgttagcgatagcagttgacggtatcgtagctgtcaggtcaatcgccctctcctgctgccagattccgccagagttcagcatgaagaggaagaacataatgggagtcgttgtgccagtcatcaagagagagccaataagaaagaagcccacggagaggggatacggaatcctgagcacatccacgagagtcgatgaagcggtcgaggcttacgaggagcttgttgatgctgtacttgaggttgcggagattgaaacaaccctcagaaagctcattgaggaaattgagaggacgaagagaagagttaacgctctcgaataccgcgttattccaacgatggaggagcttgcaaagttcatctcgttcaagctggaggagatggacagagagaacattataaggttgaagaagctcaagatgaagaaggcaaagtcttaa

SEQ ID NO: 24714 - DNA, 1314 bp, Archaeoglobus fulgidus
gtggtatggatgccaaagtacctcgacctcgatgagctcagcgaagaagacaggatgctcaaggaggaggtccacaggtttgctgaggaggtaataaggcccgcatcgattgagctggacagaatgcctcccgaagagagagttaagccgggttcgccctacttcaaggtctggaagcagattaaaaagctcggctaccaccgcatgtacctgcccgagaacaaaggcggtccgggcttgacacccttgcagcgctacattctcttcgaggagattgcgtggggaagtcttggcttcgccaccgctttgggagtggacatgattcccttcgtttcggcagcgtttttcgggactcctgagatttacgaggaccttgtcgttccttggattgaggacagcgagggaaaattccacggatgctggggtgtaacagagccggagcacggaagcgattacctgattacgctcagagaggagccggaactcgttgcgaagttcggtaagggaaacgttgtagctgagaaggacggggatgagtgggttataagcgggcagaagtccgcctgggtttcctccgctccggttgcaactcactgcggattgcatgcacagcttaaagggtcaagaagtatcgctgaggggcttttctgcatagttcccctcgatgcggatggtgtgaagaagggaaggccagcggacatgctcggaatgagagatgacccgcagggagagcttttcttcgacggcgtaaggattccggagcactacgttgttgtggctccaggctttttctacggcgtattctttgatcagcttctctgcctgacaagctgcgggatgggagcttttgctgttggcctcgcgagggcctgcttcgaggaggccttgcactacgcgaggcagagagttcagggaggagtacccatcgtgaagcacaagaacgtaaagctgaagctctacgagatgttcgagaaggtggagacggcacgctactacgttcggaaggctacggagtacactcacaaaaagataatagagcagcagaccgccgacgcctcgccgaggcatgcgagagcggcgcagatttacgcgaaaaagatagcctacgaggttgctcacgatgcccttcagattttcggtgcttacggactgatcaaggagttcgtaattgagaagttcttcagggatgccaggtgcatgcttattgaggacggaacggttgaggttctcagccttgaggcggctgaggatgttatagacaactacgaaaaggagttttacgatgtgaaccatgttatgagggttttgggttga

SEQ ID NO: 24715 - DNA, 939 bp, Archaeoglobus fulgidus
gtggaggctgtgatagcggttatcggcgcgggaacgatgggggcggcgattgccttgcttttcgccaacgcaggctttgaggttacgcttgtggacaaaagcaggggagctctcagaagggctgaggataggcacagaggggaaagcttggaagagcttgaggaggcagggttgaggaagcaggataatccagcatctttgataacctacacgaccgagctgagggtttatgagtgcgattttattgttgaggcaatagtggaaaggcttcgggataaaattgagctcttcagaaaaattgaggagataaacagcccggcagttctcgcaacaaacacctcaagcttcatgccgtccgagattgcaagacatctcgcaaatccagaaaggctgacgctattccatttttccaaccctcccatccttatgcccctcgtcgaggttggtggggagattgtttctgacgaaacggttgagagggccgttgagatggcaaagtccataggcaaggagcccgtggttttaaggaaggagtgcagggggcatgttttgaacagaatgctcgctgctgctggtgtggcggttgggtactgtctgctttacagcaggccggaggagattgacgctgcactgagaaacctcggcatgaggtacggctttttcgaaactatcgacctcataggccttgatgttgcaaaggacgtccttgagagcttcagggagtactatggggataagtacaggggaatcagagcaatggacttcttcatggagaagatggtcgagtggggtaagcttggaaagaagagcggtgaggggttctataagtgggatgggagaagggcgagcatcccggaaagccaatcctgcggatgtaacaccactcgttgccgcaattgtcaacgaggcgttcagaatcgtggaggacgggattgctga

SEQ ID NO: 24716 - DNA, 888 bp, Archaeoglobus fulgidus
atgaagctggaggatattaaggttattggagttgttggcgctggagttatggggcatggaattgctcaggtggctgcgagaaccggctatgatgtggtaatggttgacgtgagtgaagaagtgcttaaaaaggcgatggagctgatagaatcaggcccctttggcctgagaaggcttgtggagaagggaaagatgagcgaggatgaggcaaaggcggtgatggcgaggataaggacatcaacgtctctcgaagctttaaaggatgcggacttcataattgaggctgtaaccgagaaagctgacctaaagaagaagatttttgccgagctggacagaatatgcaagccagaaaccatcatagcctcaaacacctccgcaataatgatttctgatctggctacggctgtggagaggaaggacaagttcatcgggatgcactggttcaatcctgctccggttatgaggctgatcgaggttataagaggggcattaacgagcgatgaaaccttcaacatcaccgttgagctttccaagaagatgggcaagattcccatcgaggcaggagatggtccgggcttcttcacaaccagattcataaactcgtggctcgttgaggcggtaagactcttcgagattggaattgcaggaattaaggagattgacgagatgtgcaagctggctttcggcttcccaatgggtccctttgagctcatggacctcattggcttggatactgcgctgcacattgccgagtatctgtacaacgaaacgaaggagccgcactacgctgcaccaaacacgttgaagaagctcgtcctttcaggttacgtgggaaggaagcccggaagcagaggagggtggtacgactactacgggatagagcgctaa

SEQ ID NO: 24717 - DNA, 723 bp, Methanococcus jannaschii
atgaaagttgtgataacgagacctaaggaaagggctgatgtttttgccagtttattaaaaaaagaagggtttgaaccaataatatttccaacattggagattgtatataataaagatttagatgttaatttagacagctatgattggatagcttttacctcaccaagtggtgttattggactatacaatatactaactgaaaatgaaagagaaaatgtaaaaaataaaaaaattgcagttattggagaaaaaacagcaaaaacttttaaaaaatattttggtagggacccagatataatgcctaatgaatacactgcagagtccctcctaagagagattaaaaaagtttctaaagaggaggaaaaatttttaatcccaacaacaccatcaacaagagacgttttaaagaataacttaaatgctgatttgttatttgtgtataaatcagcagagccagaaaacttaaaagaggatattaaaaaactaaaagagttaatagcaaaagataaatttattctaacatttacaagtggattaacagctaagaatttttttaagtatgtggatgatgagtttgctgaaattataaaagataactacatagtcgccattggtcctataactgccaaagttattgaaaaatttggttttaaaccattaattcctaaagtatatacgattgaagggatgttagaagttattagaacattaaaggagaggtag

SEQ ID NO: 24718 - DNA, 1629 bp, Methanococcus jannaschii
atggcaatggcaggagcaccaatagtagtattaccacaaaacgttaagagatacgttggaagagatgctcaaagaatgaacatcttagcaggtagaattatcgctgaaacagttagaacaacattaggtccaaaaggaatggacaaaatgttagttgatgagttaggagacattgttgttacaaacgatggagttacaatattaaaagaaatgagtgttgagcacccagctgctaagatgttaatagaagttgctaaaacccaagaaaaagaagttggagatggaacaacaacagcagttgttattgctggagagttgttaagaaaagctgaagagttgttagaccaaaacatccacccatcagtcatcatcaacggatacgaaatggcaagaaacaaagcagttgaagaattaaagtcaatagctaaagaagttaagccagaagacacagagatgttaaagaaaattgcaatgacatcaattactggtaaaggagcagagaaagcaagagaacagttagctgaaattgttgttgaggcagttagagctgttgttgatgaagaaactggaaaagttgataaggacttaattaaagttgagaagaaagaaggagctccaattgaagaaaccaagttaattagaggagttgttattgacaaagagagagtcaacccacaaatgccaaagaaagttgaaaacgctaagattgcattattaaactgcccaattgaagtcaaagaaacagagacagatgcagaaataagaattactgacccagctaagttaatggagttcattgagcaagaagagaagatgattaaagacatggttgagaagattgctgctacaggagcaaatgtagtattctgtcagaaaggaattgatgacttagctcagcactacttagctaagaagggaatcttagcagtaagaagagttaaaaaatcagacatggaaaaattagctaaagcaacaggagcaagaatcgttacaaagattgacgacttaacaccagaggacttaggagaagctggattagttgaagagagaaaagttgctggagatgcaatgatattcgtcgagcagtgcaagcatccaaaggctgtaacaatcttagcaagaggttcaacagagcacgttgttgaagaagttgcaagagcaattgatgatgcaattggagttgttaagtgtgcattagaagaaggtaagattgttgctggtgggggagcaactgaaatagaattagctaagagattaagaaaattcgctgagtcagttgctggaagagaacagttagcagttaaagcattcgctgatgctttagaagtcattccaagaacattagctgaaaactcaggattagacccaattgacatgctcgttaagttaagagctgctcacgagaaagaaggcggagaagtctatggattagatgtcttcgaaggagaagttgtcgatatgttagagaaaggagttgttgaaccattgaaagttaaaacacaagctattgactcagctacagaggcatcagtcatgctcttaagaatcgatgacgtcatagctgctgagaaagttaaaggagacgaaaaaggaggagaaggaggagacatgggaggggatgaattttaa

SEQ ID NO: 24719 - DNA, 1263 bp, Methanococcus jannaschii
ttgacattggtagagaagatactatcaaaaaaagttggttatgaagtttgtgcaggagatagcatagaggttgaagttgatttggcaatgacacacgatggaacaacacctttagcatacaaagctttaaaggaaatgagtgatagtgtttggaatccagataaaatagtcgttgcctttgaccacaatgttccaccaaacacagttaaagctgctgaaatgcaaaaattagctttggagtttgttaaaagatttggcattaaaaatttccataaaggtggagaaggcatctgtcatcaaatcttagctgaaaattatgttttgccaaacatgtttgtagctggtggagacagccatacatgcacacatggagcttttggagcttttgctactggctttggagctactgatatggcttacatctatgcaacaggagaaacatggattaaagtgccaaaaacaattagggtagatatagttggaaaaaatgaaaatgtttctgccaaagatattgttttaagggtttgtaaggaaattgggagaagaggagcaacatacatggctattgagtatggtggagaggttgttaaaaacatggacatggatggaaggctaactttatgcaacatggcaatagagatgggaggaaaaacaggagtgatagaggctgatgaaattacttatgattatttaaagaaagagagaggactttctgatgaggatatagctaaattaaaaaaagagagaataacagtaaatagagatgaagcaaactactataaggagatagaaattgacataacagatatggaagaacaagttgctgttccacaccacccagataacgtaaagccaattagtgatgttgaagggactgagataaatcaagtttttattgggagttgcacaaatggaaggttgagtgatttaagagaagcagctaaatatttaaaaggtagggaggttcataaagatgttaagctaattgttatcccggcatcaaaaaaggtatttttgcaagcgttaaaagagggtattatagatatctttgttaaagctggggcgatgatttgcactccgggatgcggaccttgcttaggagctcatcaaggggttttggctgagggagaaatttgtttatcaacaacaaacagaaactttaaaggaaggatggggcatataaatagctatatttacttggcatctccaaagattgccgcaataagtgcagttaagggatatataaccaacaaattggattaa

SEQ ID NO: 24720 - DNA, 1065 bp, Methanococcus jannaschii
atggaggcagtgttaatcttagaggacggaacaattttaaaaggaaaaggttttggagcagagaaagaggtttttggagaattagtttttacaacagttatgactggttatgttgaagttttaacagacccttcatataaagggcaaatagttatgatgacttatccattagaagggaattatggagttaaaaaggattggtttgagtcagatgggataaaggcagagggttttgttgttagagaggtaacaagtaaagctttagatgactttttaaaggagtatgatatcccaggaattcaagatattgatacaagattcttaacaagaaagattagggataaaggagttgttaaaagctgtttaaaggttgctgaagaaataagtgatgatgaaatatctgaattattggagagagttaaaagatacagtgatatatcagatattgatttagttcctttagtttcaacaaaagaaccaaaaattcataaaacagctaacccaaaggcaagatgtgttttaattgattgtggagttaaattgaatattataagaagtttagttcaaagaaactgtgaagttattcaagtcccatacaacacaaagtatgatgaaatcttagaatacaaaccagattttgttttaatctccaatggcccaggagacccagcaagattaaaagaagttattaaaaatattaaaaacttaattggtgttgtcccaataacaggaatttgtttaggtaatcaacttttatccttagcatttggtggagaaacatacaagatgaagtttgggcataggggaggaaaccagccagttaaagatttaaaaacacaaaaagtttatataacctcccaaaaccatggatttgctgttagaaaggagagcttaccagatgatgtagaagttagctttataaatctaaacgatatgactgttgaaggtattaggcataaggatttaccaatattctcagttcaattccacccagaggcaagaccaggacctcatgacacaatgtttttattcgatgagatgattaagctgaaggataggaaataa

SEQ ID NO: 24721 - DNA, 789 bp, Methanococcus jannaschii
atgaaaccaaaaattaaggtagagaacttaacaaaatactttggagataaaaaggttttggatgagatttcttttgaagtttatgaaggggagatttttggattattggggcataatggagctggaaaaacaactactttaagaatattggcagggattattgaggaatatactggctatgtagaagttaatggaaaaattggttatttgccagaggagaggggactttatagggatgagaaagttgtagatgtattaaagttttttggtgaattggctgggatgaaaaaagaagagattgccaaaagtattgattactggttaaataaactaaaaattagtaattacaaatactcaaaaattaaagaactatctaaaggaaatcagcaaaaagttcaatttattgtttcagttattcataatccagatattgttattttagatgagccgttttctgggttggatgttgttaatgttagactactgagagatataatatttgagctaaaggaagaaggaaaaacaataatactatcaactcatcaattagaaaagatagagaggttgtgtgatagagttttaatcttaaagaaagggaaagcagttcattatggaaagattgaagatatctgtagaaaaatggcatacattgagtatttagataacggaaagttaataaagaaagagattccttatgaagaggctgttttaattttaaaagaaaaggcagaagatgtaattaaatttgaggttagatattcattggaagatctatttttagatgaatag

SEQ ID NO: 24722 - DNA, 1911 bp, Methanococcus jannaschii
gtgaaaaacttggcatcaagggaagtaaatatttatgttaatggaaagttagttggaactacagacaaaccagaagaacttgttaattttattagggaaaaaagaagaaaaggagagctccctcaatatacaacagttgcttacaatgaagaaagtaatgacattcatataaacacggatgctggaaggattgttagacctttaatagttgtagaaaatggaaaaccaaaactaactaaagaacatattgaaaaattaaagaaaggagaaattacattctcagatttagttaaagaaggagttattgaatatttagacgctgaagaggaagaaaatgcctatattgctctatctgaagaagaattgactgagaaacacacacacttagagatagacccattaaccatattaggtattggggcaggggttgctccttatccagaacacaactcagcaccaagaattacaatggctgcagcaatggggaagcagtcattaggaattccaatgagcaatataaaatggagattagatacaagagggcattatctccactatccacaagttccaattgttaggacaaaacaccaagagattttaggtttcgataaaagaccagcagggcagaacttcgttgtagctattatgagctatgaaggatacaacatggaggatgctatagtctttaacaaatcagcaattgatagaggtttgggaagaagcaccttcttcagaacttacgatgcgtgtgagagaagatacccaggaggacagatggataggtttgagattcctgataaaggagtaaggggttataggtcagaggagtgttatagatacttagaagaggatggaatagttgcagttgagtcccatgtaaaaggtggagatgtaattgttggtaaaacctctccaccaagattcttagaggagcatgagataacaattcaagttaaaccacagagaagagattcatcagttgttgtaagacatggggaagaaggttatatagataaagttatattaactgaaacaaaggaaggaaacaggttagttaaggttaaagttagagatttgagaattccagagcttggagataaatttgcttcaagacatggacagaaaggagttatgggacttacagttccacaggaggatttacctttcactgagagtggaatagttcctgatatcataatcaacccacacgcaattccatcaagaatgactgttgggcagttattggagatgcttgggggtaaagtaggagctttagaaggaagaagaatagacggaacaatatttagcggagaaaaagaatgggatttaagaaaggctttagaggctttaggattcaagcatcacggtaaagaggtcatgtatgatggaaaaactggaaagaagtttgaagtagagatttacattggaatagcatactaccagaaattacaccacttagtagctggaaagatacatgcaagaagtagaggacctgtccaagtgctaacaagacagccaacagaaggtagggcaagagagggaggtctaaggtttggagagatggagagggatgttttaattgggcatggtgcagctatgctattaaaagagaggcttatggatgaatcagacccatatgatatctgtatatgttcaaaatgtggagactttgccatattagactacaagagagggctaaaatactgtccaatttgtggagagattgaaaacctctacagctctaagaagataccattcgttagaataccttacgcattcaagcttttattagatgagttgaagagtatgtgtatcttgccaagaattaaggttagagataaggttgaattagaggattttgaggagtttgttgaaaaattggagaaagaaaaagttaaacagaaacaataa

SEQ ID NO: 24723 - DNA, 2688 bp, Methanococcus jannaschii
atgaacatttcagttattgggactggttatgttggcttaatacaggcagttggtttggctgagtttggttttgatgttgttggtattgatatcgatgaatcgaaagttaaagcgttaaacagaggcgaatgcccattatatgaagaaggtttggaagggttattaaaaaaacatgtaaataagaatctaacattcactacttcttataaaccaataaaggattcagatgttatctttttatgtgttgggactcctcaagataaagacggaaatgctgatttgagatttctattttctgcagttgagaagataaaagagacaatagataaggaggattataaggttattgttataaaatctactgttccagtgggaacaaataggagggttaaagagcttttaaaggattataatgtggatgttgtttcaaatccggagtttttgagggaggggattgctgtctatgattttttcaatccagagagggtaattttagggtttgaaaaccttaacaataaaaaaccgatagaaattatggaagaagtttataaatactttaaagataagaatattccatttgtaataacaaactgggagactgcagagttaataaaatatgcctctaacgctttcttagcaacaaagatatcttttataaatgagttggcaaaattatcggataaagttaaagctgatataaaaacaataagctatgctatgggtttagatccaagaattgggaataagtttttaaatgctgggattggttatggtgggagctgtttccacccagatgaagttttatttatagatagaggtagaggtttagaatgcataacattcaaagaattatttgaattagaagataaagataatgtaaagattctatcctttgatggagaaaaattatctttaaaaaagttaaaattagcatcaaaaagatactacaacgatgatttaattactttgaggtttaatttaggtagagaaataaagataacaaaagaccacccagttgtgattttagaagatggagaattaaaaattaaattgacatctgatgttaaagagggggataaggtaattttaccttatggaaactttggagaagaaagggagatagaaatagacattttagaagaactcagtaagacagaccttattgaaaaagtttggatacacaataaggacttggcaaccaatgaatttaacattataaaaccatacttatcaaacaaatatcctcacgatgttaagagaaatggaacaataagagctaaggatatactaccaataaaagaaattttggataaatatggttcaaaaaatagattatttactgcaaaaagcaaatcaacaacaatcccatataaaataaagatagataaggattttgcaaggttaattggctattatctatcagaaggctggatatcaaaagactatggaagaaatggtgttgtaaggaagagaattggactatgttttggtattcatgaagaggaatacataaacgatgttaaaaacatattaaacaaattaggtataaaatacatagaaaaaataaaagacggttctcattcaatcctcatctcatcaaaaatattggcttatgtatttgaaaatatcttaaactgtggaattaactgttataataaaaatattcctccacagatgttcaatgcaaaagaggaaataaaatgggagttcttaaaaggtctttttagaggagatggcggaattgtaaggttaaataacaacaaaaatctaaatattgaatttgcaactgtcagtaaaaaaatggctcattccttgttgatattactgcaattgttgggtattgtggcatccgtgaaaaaatgctacaacaacaaatcaacaactatggcttatattataagaatcaatggattagaacaagttaagaaaatcggagagttatttggtaaaaaatgggaaaactacaaagatattgcagagagctataaaagaaacatagaaccgttaggttataagaaatcagataactttgctatattggaggttaaagaaattataaaagagcattatagcggttatgtatatagcgtagaaacagaaaactccctgctcataacatcttatggaatattaatccataattgcttcccaaaagatgtcaaagcattgataaaacaatttgaaaataacaacatagaaccaatattaataaaagctaccgacatcgtcaatgaagagcaaataaaatggttctttgaaaagattaagaattattatggaaatttaaatggaaaaacctttgctgtcttgggtttagcatttaaaccaaatactgatgatttaagagagagtagggcaataaaattgattgatatgcttttagagagtggggctattgttaagggctttgattatgttgaaaaggcacgagaaaacaccatcaacatgtataagttagataaatcaaaaggattttatggctataacttgtatgtattggatgatttatatgagacagttaaaaatgtcgatggaataataataactgttgagtatgattttaataaggaagactgggaaaagattggaaatttagttaaagaaaaagtagtattcgatggaagaaatattttagatgttgaaaagattaaaaagttgggatttaaatattatggagtgggaagatga

SEQ ID NO: 24724 - DNA, 1179 bp, Methanococcus jannaschii
atgagaaaaataaaattaattatctttccaggatattatattccacatattggtggattagaaactcatgtagatgaatttactaaacatctttcagaagatgaaaattacgatatttatatatttgcaccaaacattccaaagtataaggaatttgaaataagacataacaatgtcaaagtttatagatatccagcatttgaaattattccaaattatccagttccaaatattttcaatataaaattttggagaatgttttttaatttatataaaattgattttgatattgtaatgacaaggacaaggtttttttcaaatactttattaggatttattttcgcaaaattgagatttaaaaagaagaagttaattcatgtcgagcatggtagtgcatttgttaagttggagagtgaatttaaaaataagttatcttatttctatgataaaaccattggaaaattaatatttaaaaaggcagattatgttgtagcaatatctaaggcagttaaaaacttcatattagagaattttgttaatgacaaagatattccaataatctataggggtttagaaattgaaaaaattgagagtattggagaagataaaaaaatcaaggaaaaatttaaaaataaaataaaactatgttttgttgggaggttatataagtggaaaggggttgaaaatattataaaagcttatgttgatttgccaaaagatttaaaagaaaaaataattttaattgttgttggatatggagaggatttagagaggttaaaaaaattggctggtaattatttaaataatggcatttatttcactggaaaagttgattttgagaaagcaattgcaattgtgaaggcatctgatatttatattcactcttcatacaaaggagggggcttatcaagctctttactgcaagcgatgtgttgcggcaaagcgatagttgcaagtccctatgagggggctgacgaagtagttatagatggatataatggcattttattgaaagacaattctccagaagagattaaaagaggaattattaaattaatagaaaacaacaatttaaggaaaatttatggtgaaaatgcaaaaaattttataaaagagaattttaactggaagaagtcagttaaggaatataaaaagatttttgagagattagttaattag

SEQ ID NO: 24725 - DNA, 849 bp, Methanococcus jannaschii
atgataaatgctaaaacaaaggttattgggttgattggacatcctgtagaacattctttctcaccaattatgcacaatgcagcttttaaagataaaggattaaattatgtttatgttgcatttgatgtgttgccagaaaatttaaagtatgtaatagatggggctaaagcccttggaatagttggatttaatgtaacaatccctcataaaatagagattatgaagtatttggatgagatagataaagatgctcaattaattggggctgttaatactataaaaatagaggatgggaaagcaatcggctataatactgatggtattggggcgaggatggctttagaggaagaaattggaagagttaaagacaaaaatatagttatttatggagctggaggggctgcaagagctgtagcatttgaattagcaaaagataataacataataatagccaatagaaccgttgaaaaagctgaagcattagctaaagaaatagcagaaaaattaaataagaaatttggtgaagaagttaaattcagtggattagatgtggatttagatggagttgatataataattaacgctactccaataggaatgtatccgaatattgatgttgaaccaatagttaaagcagagaagttgagagaggatatggtggttatggatttaatttataatccattggagacggttttattgaaagaggcaaaaaaagttaatgcaaaaacaataaacgggttaggaatgttgatatatcagggagcagttgcatttaaaatatggactggtgtagaaccaaatatagaagttatgaaaaacgcaataattgataagataactaaataa

SEQ ID NO: 24726 - DNA, 939 bp, Methanococcus jannaschii
atgataattgaaacaccatcaaaagttatactattcggagagcatgcagttgtttatggttatagagctatatctatggctattgatttaacatcaaccatagaaataaaagaaacacaagaagatgagataattttaaacctaaatgacttgaataaaagcttaggtttgaacttaaatgagataaaaaatatcaatccaaataactttggagattttaaatactgcctctgtgcaattaaaaacactttagattatttaaatatagagccaaaaactggttttaaaattaacattagctcaaaaattccaataagttgtggtttgggaagctctgcctcaataacaattggaactataaaagctgtaagtggattttataataaagagcttaaagatgatgagattgcaaaacttggatatatggttgagaaagaaatccaaggtaaggcaagcattacagacacttcgacaataacgtataaaggtatcttagaaataaaaaacaacaagtttagaaaaattaaaggagagtttgaagaatttttaaaaaattgcaagtttttaattgtttatgctgaaaaaaggaagaaaaaaactgctgagttagttaatgaagttgccaagattgaaaataaagatgagatatttaaagagatagacaaagttattgatgaagctttaaaaatcaaaaataaagaagattttgggaaattgatgactaaaaaccacgagttgttaaaaaagctaaatatctcaacaccaaaacttgatagaattgtagatattgggaatagatttggttttggggcaaaattaactggagctggagggggaggatgtgtaataatcttagttaatgaagaaaaagagaaagagcttttaaaagaactaaataaagaagatgtaaggatttttaactgcagaatgatgaattaa

SEQ ID NO: 24727 - DNA, 1128 bp, Methanococcus jannaschii
ttgagaattataattaagttaagtctggaaatattattaatattaattaggatatttattcccaaagaaaatcctaataataaaaagaaaattggtgaaaggatgaaagaagttgctataattggggctactggctatactggggcagagttattgagattattagcaaatcatgaaaaagttaatgtaacatatataacctcaagaaaagaagctggaaagcatgtttttaaagttcatcctcatttaaaaggtattgaaaagtataaaaacctatgttttactggagatattgataaggttgatgcttatttggtatttactgcaactccacacggagcttcaatggatatagttccagattttattgagagagggatgaaagttattgacttaagtggagattatagatttgaggatttaagcttgtatgaaaaatactataagataaaacataaaggattacctgatgtaaaaattgcttatggattgccagaattacatagagaggaaataaaagaagctcaacttgtagcaaatcctggatgtttcccaactggagctattttggcagtagctccattagttaaagagaatattatagaggaaaggattatatttgattcaaaaacgggagttagtggagctggaataaagccaacggaaacaacccacttcccaaatgtaaatgaaaatataaacccatacaaaataacaacccacagacacactccagagattgagaaggagttaaaaaagcttggaaaggctaaggtttcattcactcctcacttagctccaataacaagaggaattttaacaactgcacacacattcttagctaaagatgttgatagagaggagataattaagatttatgaaaaattctatgggagtgaggtttttgttaggatattttcagaagagattccaaaattaacatgggttagaggaacaaacttctgtgatatcggaggatttgagattgatgagcatggtagattggtagttatctcagcaatagataatttagttaaaggagcgagtgggcaagcaatacaaaacatgaatataatgtttggatttgatgaaaaagaggggttatttgatgtagggttaaatccataa

SEQ ID NO: 24728 - DNA, 1317 bp, Methanococcus jannaschii
gtgaaaataatgtttttaggtaatgacacagtagagataaaggatggaagattcttcatagatgggtatgatgcaattgaattagcagagaagtttggaacccccttatatgtgatgtcagaagagcaaataaagataaattacaacagatacattgaagctttcaaaagatgggaagaagagactgggaaggagtttattgttgcctatgcatataaagcaaatgcaaacttagctataacaagattgttagctaaacttggctgtggagcagatgttgttagtggaggagagttgtatatagcaaagctatcaaacgttccttcaaagaaaattgttttcaacggaaattgtaaaacaaaagaagaaattataatgggtattgaagcaaatataagggctttcaatgttgatagtataagcgaattaatcttaataaatgagacagcaaaagagttgggagaaactgctaatgtagctttcagaataaaccctaatgtcaatccaaagacacatccaaagatttcaactggtttaaagaaaaacaagtttggtttggatgttgaatcaggaattgcaatgaaagcaataaaaatggctttagagatggagtatgtgaatgttgttggagttcattgccacattggttctcaattaacagatataagcccatttattgaagaaacaaggaaagttatggattttgttgttgaattaaaagaagagggcattgagattgaagatgtcaatttagggggaggtttaggaattccctactacaaagataaacaaatccctactcaaaaagatttagctgatgcaataataaacacaatgttaaaatacaaagataaagtagagatgccaaatctcatcttagagcctggaagaagtttggtagctactgctggctatctattaggaaaagttcatcacataaaagaaacaccagtaacaaaatgggttatgatcgatgctggaatgaatgacatgatgagaccggcaatgtatgaggcatatcatcatataataaactgcaaagttaagaatgaaaaagaggttgtaagcatagcaggaggtttatgtgagagtagtgatgtttttggtagagatagagagcttgacaaagtagaggttggtgatgtattggctatatttgatgttggagcttatggaattagtatggctaacaactataacgcaagaggaagaccaagaatggttttaacaagtaagaagggagtattcttaattagagagagggaaacttatgctgatttaattgctaaggatatagttccaccacatttattgtaa

SEQ ID NO: 24729 - DNA, 1347 bp, Methanococcus jannaschii
atgggaagattatttgggacttctggaataagaatgaaaaatttatctccaaaaattgcctataaagttggattagcagtggcaaaaaaatataagaaagttgtagttgggagagatacaaggactacaggaaaattaattgaaactgcattaacagcaggaatcttaaatggtgggggggaagttacaactataaacatagtcccaacaccagttttaggttttaatgcacgaaattatgatgttggcataatgattactgcctctcacaaccctccagaatacaatggaataaagctcttcaataaaaatggtttagcttttaataaaaaagaagaggatgagatagaggagattatatttaaagaagattttattgaagttgagtggcatagtgttggcgagatttgggaagatagcagggcgataaggaactatatggaacatattcttaaaaatgttgagataaatgaaaaatttaatgtggttattgattgtgcaaacgcctctgcttgtttagtatctccatatttatttacagatttaggatgtcatgttatctcagttaatagtcacatggatgggagatttattggtagattaccagagccagatgaaaaaaacctcaaaaaaactatggatatgattaaaggcctaaatatgagtggagataactacattggcatagcacacgatggagatgcagatagaatggtagcaatagatgaaaagggaagattagctgattttgataagctattagctgctttctcaagatatatggttgaaaaaactggaaacaaaaagattgttacaacagttgatgcttcaatgattattgatgagtatttaaaagatttagatgttgagataataagaacaaaagttggggatgtggcggttgctgaagagatgattaaaaactctgctgtttttggtggagagccaagtggaacgtggattcatgctgatatccatctaactccagatggaattttgagtgggctgagagttttagagatgttagatttctataacaaaaaattatatgaaatattggatgaaatcccatcttatgtaaatttaagggagaagattccatgtgaagatgataaaaaagaaaaagtaatgagttatgttattgaaaatggagagagtttatttaaaacagttcctgagaccgttgatggagcaagatttaacttagagaatggatgggttttaataagaccttcgggaactgagccatacataagggttagagttgaggcaaaaaataacaaagatgctaaagagttgttagaaaaagggataaagttagttaaagaagctttaagtgctttataa

SEQ ID NO: 24730 - DNA, 1227 bp, Methanococcus jannaschii
atggatgccataatattatgtgcagggaaaggggagagattaagacctctaacagagaacagaccaaaaccaatgattcctatagctggaaagccaattttacaacatattattgaaaaagttgaggatttggtagataatatttacttaattgttaagtataaaaaagaaaagattgttgattattttaaaaaccatccaaaaatcaaatttttagagcagggagaaatagatggaactggacaggcagttttaacagccaaggattatgtagatgatgaatttttagttataaatggggatattatctttgaagatgacttagaagaatttttaaaatacaaatatgctgttgctgttaaagaggtaaaaaatccagaaaactttggagttgtagttttagatgatgaaaataatattatagaactccaagaaaagccagaaaacccaaaatcaaatttaataaatgccggaatatacaaatttgacaaaaagatttttgaattaattgaaaaaacaaagatttctgaaagaggagagagagaacttacagatgcaataaaacatcttattaaagaagaaaaagttaaaggaattaagttaaatggttattggaacgatgttggaagaccatgggacattttggaggcaaataaatatctcctggataaaataaatacagatatcaaggggaaaattgaagaaaatgttgttattaaaggagaggttataatagaagagggagcaattgttaaagcaaattcagttattgaagggcctgcaattattaaaaaaggggctgttgtggggccgttagcttatataagaccatatactgttttaatggaaaatacttttgttggaaattcatctgaagttaaggcaagtataattatgaaaaatacaaaaattccacatctatcttatgttggagatagtataattggagagaactgcaattttggttgcaatacaataactgccaacttaagatttgatgataaaccagttaaagtcaatataaagagtaaaagggttgagagcgttagaaaattgggagttataatgggagataatgttaaaacaggtattcaagtctcttttatgccaggggttaaagttggaagtaactgctggattggggcaagttgtttaattgatagagatatagaaagtaatacatttgtttataaaagagatgagctgatatttagaaaattgaaatag

SEQ ID NO: 24731 - DNA, 531 bp, Methanococcus jannaschii
atggacaaaaaatccaaattaataaacctgctaaaagaggttggttgtataagatttggagaatttatcttagcctctggtaaaaaaagtaactactacatagacataaaaaaagccaccacaaacccagaaattttaaagttagttggagaaattattgctgagcaaataaaggatgaagatgtaaaagttgctggagtagagcttggttctgtccctatagctacagctgtctcaattattgctcaaaaaccactattaattgttagaaagaaacctaaggattacggaactaaaaataagatagaaggagagctaaaagaaggagataaggttgttattgtggaggatgttactacaactggaggaagtgtgctaaaggcagttaaagagattagggaaaatggtggaattgttgataaagtttttgttgttgttgataggttagaaggagctaaagaaaacctacaaaaagagaatgttgaattaatcccattagttactgttaaggagctacaatccactcaataa

SEQ ID NO: 24732 - DNA, 888 bp, Methanococcus jannaschii
atggaatttacaaagatgcatgcccttgggaatgattacatagttattaatgaatttgacggggaaaaagttaaagaagaagaaaaagcagagttctcaagaaaaatttgtagaagaggtttttcagtaggtgctgatggagttattttcatccaaaagccaacatctgatgaatacgatgtaagatttagaatatttaacagtgacggctctgaggcagagatgtgtggtaatggaattagatgtttttcaaaatacgtttatgagagaataatgaaaaaaaatcctttaaaagtagagacaaaagggggcttaagagtatctgaaatggagatagaaggagatgaagtaaagaagattaaagtttatatgggagttccaaagtttaaattaaaagatataccaatggttgttgatggttataaagaggatgatgaatttttgaatggagagttaaaattaaagaatccatatttacctaaggtcaagttgagtgtcgttaatgttggaaatccacatgcggttatatttgttgaagataacaacatagatttagattttgttagagaacacttggatgttattgggaaagagatagaacaccatgaagcattcccagagagaattaatgtgcattttgtaaaagttttgaatcctaatgaaattaggattgttacctgggagaggggagctggatacacaactgcatgcggaacaggaacaacagcttctgtaattatggctcacaaacttggtaaaacaaataatagggttttagctcacttagatggtggagatttggagattgagattaaagatgatggagtttatatgattggagatgcagtaatggtttatgacgccaaattgataaatattggctggtaa

SEQ ID NO: 24733 - DNA, 1032 bp, Methanococcus jannaschii
atgccagcaaaagtattgataaatggatatggttcaattgggaagagagtagccgatgcagtttcaatgcaggatgatatggaagttataggagttacaaagacaaagccagattttgaggcaagattagccgttgagaagggctacaagttgtttgtagcaattccagataatgagagggttaaattatttgaagatgcaggaattccagttgaggggactatattggacattatagaagatgctgacatagttgttgatggagctcctaagaagattggaaagcaaaacttagaaaatatctacaaacctcacaaagttaaagctatattgcaagggggagaaaaagcaaaagatgttgaagataacttcaacgctttgtggagctacaacagatgctatggaaaagattatgtaagagttgtttcatgtaacacaacaggtttgtgtaggatattatatgctataaattcaattgcagatataaagaaggcaagaatcgtgttagttagaagagcggcagacccaaatgacgacaaaacagggccagtaaatgctataacaccaaacccagttacagttccttcccatcatggccctgatgttgtttcagttgtcccagagtttgagggaaagattttaacttcagctgttatcgttccaacaacattaatgcatatgcacactttaatggttgaagttgatggagatgttagcagagatgatattttagaagctatcaaaaaaactccaagaattataactgttagagctgaagatggatttagttcaacagctaaaataattgaatatggaagagatttaggcaggttaagatatgacataaacgagcttgttgtctgggaagaaagcattaatgttttagaaaatgaaatattcttaatgcaggcggttcatcaagaaagtatagttattcctgaaaatattgattgtattagggcaatgcttcagatggaagaagataacttcaaatcaattgaaaagacaaataaagctatgggtatccaataa

SEQ ID NO: 24734 - DNA, 327 bp, Methanococcus jannaschii
atggttaagttttgtccaaaatgtaacaacctaatgctaccaaaggatggaaagttaaaatgtgctgtctgtggttatgaagaagaaacaacagctgaaggaagtaaggagtatgaatacaaggaacacttagagaacaagaaagaaaaaattactgttattgaaagtgagggattagagacattaccaacaacaagaatcgaatgtccaaaatgtgggcataatgaagcttactggtggctacaacaaacaagatgtgctgatgaaccagaaacaagattctataagtgtaagaaatgcggtcatacatggagagagtatgattaa

SEQ ID NO: 24735 - DNA, 2712 bp, Methanococcus jannaschii
atggttaaagaattaaaagttgctgaagcatatcaaggagatgtagggaggggtattgcaagaatagacccctacacaatggaagaacttggtttaaaaccaggagatgttattgaaattgaaggtccaaaaggaaaagcttatgccatagtttatagaggtttcttagaagatgctggaaaaggaattataagaattgacggttatttaaggcagaatgctggagtagctattggagatagagtaaaagttaagagagtagagattaaagaagctaaaaaggttgttttagcaccaactcaaccaattagattcggcccaggatttgaggactttgttaaaaggaagatattgggacaagtgttaagtaaaggttcaaaagttactattggagttttaggaactgctttaacatttgttgttgttagtacaacaccagctggacctgttagagtaactgacttcacacacgttgagttaaaagaagagccagtcagtgaaatcaaagaaaccaaagttccagatgttacctatgaagatattggtggtttaaaagaagaggttaagaaagttagagagatgatagaacttccaatgagacatccagagttatttgaaaaattaggaattgagccacctaaaggagttttattagttggaccaccaggaactggtaagacattattggctaaagcagttgctaacgaagctggagcaaacttctatgtaattaacggtccagaaataatgagtaagtatgttggagaaacagaggagaatttaagaaagatatttgaagaagctgaagagaatgctccaagtataatattcattgatgaaattgacgctatagctccaaagagagacgaagctacaggagaagtagagagaagattagttgctcagctcttaaccttaatggatggattgaagggaagagggcaagttgtagttattggagctactaacagaccaaacgcattagacccagctttaagaagaccaggaagattcgatagagagattgttattggcgtcccagacagagaaggtagaaaagaaatcttacagatacacacaagaaacatgccattagccgaagatgttgatttagactacttggcagatgtaacacacggatttgttggagctgatttagcagctttatgtaaagaggcagcaatgagagctttaagaagagtattgccaagtattgacttagaggcagaagaaattccaaaagaagttttagataacttaaaagtcacaatggatgacttcaaagaggcattgaaagatgttgagccatcagcaatgagagaagttttagttgaagttccaaatgttaagtgggaagatattggaggattagaagaggttaagcaagaattgagagaagctgttgaatggccattaaaagctaaagaagtatttgagaagataggtgtaagaccaccaaaaggagtgttgttatttggaccaccaggaactggtaagacattattagctaaagctgtagctaacgaaagtggagcaaacttcataagcgttaaagggccagaaatcttcagcaagtgggttggggaatcagagaaggcaataagagagatattcagaaaggcaagacagtcagcaccatgtataatattcttcgatgaaatcgatgctatagcaccaaaaagaggtagagacttgagctcagcagttactgataaagttgtaaatcagctattaactgaattggatggaatggaagagccaaaggatgttgttgttattgcagcaacaaacagaccagatatcattgacccagctttattgagaccgggaagattagatagagtcatattagttccagttccagatgaaaaggcaagattggatatattcaagatacacacaagaagtatgaacttagctgaagatgttaatttagaagaattagctaagaagactgaaggatatacaggagctgacattgaggcattgtgtagagaggcagcaatgttggcagttagagagagtataggaaaaccatgggatattgaagtaaaacttagagagttaattaactacttgcagagcatttcaggaacattcagagctgctgcagtagagttaaacagcgttattaaagctacaaaagagagagaatctgctgaagcaggagagtttagtgagttaaagaatgctattggaaagataattagcgttttatctccagctaaggagaaaattgaagcagtagagaaagaaatcgacaaattccttgaagttataaacaaagaggaattaaaaccatcagagaaagatgaagcacagaagttggcaaaatacttaaaggatatattaggcaagttaaaagaaatgatagacaacatctacgaattagagaacaagttaaataccttaaaagaacaagtttcagctgaagagattgatgagataattaaaacaacacaaaacattatccaaagattcacaacatcattggatgaactcaagaatatattgaaggacattgaaagtataagattgaaagtttcaacaaaagatgttaagattaagaaagaacacttcatgaaagcccttgagaaaattaaaccatctgtaagtaaggaggatatgagagtctatgagaaattagctcaagagtatggaagagctacgtcagttgaaaagaaaaaggaagaaggtaaagaagtgatttaa

SEQ ID NO: 24736 - DNA, 1137 bp, Methanococcus jannaschii
ttggtgacattaatgaacacctatggggatatgtttagagttacagtttttggagaaagtcatggaaaggctgttggagcagttgttgatggatgtccagctaatctgcctttatctgaagaggatatccaaaaagagcttgacaggagaagaccagggcagagcatcttctcaacaccaagaaaagaagaggataaagttgaaatcttatcaggaatttttgaggggaaaactactggagctcctatttgctcaatagtctataacaaaaacatgagacctaaagattactcaaaaattaaagatacaccaagacctggacatgcagatttaacctatagattgaagtataaaaactatgattataggggaggaggaagggcaagtggtagagtaacgatagggcatgttattggaggagctattgctaaaaagcttctatcttacacatacaacataaaaattattggttataccataaagattggaaagattgaaggagatttcagctactataaaaatccagaggtttttgaaaatgaaaaatccttagagagattaatagagattattgaaagtaatccattgagatgtccatcaatgaatgagaaagagatggaggagtatgttttaaaggcaatggaaaataaagatagtgttggaggagttgttgaaattgttgcattaaatgttcctgttggagttggaaatccaatattcaataagttaaatggagaattggcaagagctttaatgagtataaatgctgttaaaggagttgagataggggctggttttaaagcggctgagatgtatggaagtgagatgaacgatgagatgtattttgatgacgacaaaaatataagattcaaaacaaacaactgcggtggcatattgggaggaattagctgtggaactccaatagttttaagaattgcagtaaagccaacaccttcaataggtaaaaagcaaaaaaccataaatttaaaaaccttagaaaatgttgaaattgaaattgaaggaagacacgacccagttatagttccaaggattgttccagtggctgaagcaatggttgctataaccttagctgatttgatgattaagggaggatttattcatccgtgtagcttataa

SEQ ID NO: 24737 - DNA, 1293 bp, Methanococcus jannaschii
atggtttttgaagaatttatttcaactgaattgaagaaagaaaagaaagcatttactgaagaatttaaagaagaaaaggaaataaacgataattctaacttaaaaaatgatttacttaaagaggaactccaagaaaaggcaagaattgcagaattagaaagtagaatcctaaaattagaattagagaaaaaagagcttgaaagagagaatttacagttaatgaaagaaaatgagattttaagaagagaattagatagaatgagagtccctccattgatagttggaactgtagttgataaagtaggagagagaaaagtagttgtcaaaagctcaacaggcccaagtttcttagttaatgtctctcactttgtaaatccagatgatttagcccctggaaagagagtctgtttaaatcagcaaacattaacagttgttgatgtattgccagaaaataaagactacagagctaaagcaatggaagttgatgaaagaccaaatgttagatatgaagatattggtggattagagaaacaaatgcaagaaattagagaagttgttgaactcccattgaaacatccagaattgtttgaaaaggttggaattgaaccaccaaaaggtattctgctttacggaccaccaggaactggaaagacattattagctaaagctgttgctacagaaacaaatgctacctttataagagttgttggttctgaattggttaagaagtttattggagagggggcttcgttagttaaagatatattcaaattggctaaagaaaaagctccttcaatcatattcatagatgagattgatgctattgcagcaaagagaacagacgctttaactggtggagatagggaagttcagagaacattaatgcagttgttggcagagatggatggattcgatgcaaggggagatgttaagataattggggccacaaacagacctgacattttagaccctgcaatattaagacctggaagatttgatagaatcatagaagtcccagctcctgatgagaagggtagattggagatattgaagattcatacaagaaagatgaatttagcggaagatgtcaatttagaagaaatagctaagatgactgaaggatgtgtaggggctgagttaaaggcaatctgcacagaggcagggatgaatgcaattagggagttaagggactatgtaacaatggatgactttagaaaggcagttgagaagattatggagaaaaagaaagttaaagttaaggaaccagcacacttggatgttctctacagataa

SEQ ID NO: 24738 - DNA, 867 bp, Methanococcus jannaschii
atgataatgtttgcattaccaaataaagggaggatttcagagccagtaatgaaagttttagagaaggcaggattaaagattacagttaagggaagaagtttatttgctaacactgtagatgacaacatcaaagtaatgtttgcaagagcaagagatattccggagtttgtggctgatggtgttgcagatataggagtaactggctatgatttagttttagagagaaatgttgaagataaagttgatttcctattagattttggttttggatttgcaaaactggttttagccgctccagagagctcaaatataaacagcatagacgatataaaagaagggatgagagtagcaacagaattcccaaacctaacaaaaaaatactttgaaaaattaaataagaaagttgagattattgaacttagtggagcaacagagatagctccattcataggaatagctgatttaattagtgatttaacatctacaggaacaactttaaggttgaataggttaaaagttatagatgaaattgtctcatcaactacaagattaatagcaaacaaaaacagcttaaaagataaagagaaaagagaaaaaataaatcaaatagttattgccataaaaagtgttttatttgctgaaacaaaaagattaattatgatgaatgccccaaaggataaagtcgaagagattagaaaattaattccaggaatggctggtccaacagtttctaaggttttatctgacgataatatggtagctattcatgccgttgttaatgaggatgagatatttaccttagttcctaagcttcatgctttaggagcgagagatatattggtggtgcctattgagaggattttataa

SEQ ID NO: 24739 - DNA, 1506 bp, Methanococcus jannaschii
atgtttaacaaagttttaattgcaaatagaggggagatagcgattagaattataagagcatgttgggagttgggaattaagacagttgcagtttattctgaggcagataagaggtctttacatgctactttggctgatgaagcttactgtataggtcctgctccagcggcaaagagttatttaaacattgatgccatattaaatgtagctgagaaagctaaggttgatgccatccatccaggatatggatttttagctgaaaatgctgaatttgcaagggctgttaaaaaagctggttttgaatttatagggcctaatccagatgctatagaagcaatgggaagtaaaattaacgctaaaaaaatcatgaaaaaagcaggagttcctttaattcctggtagtgagggggctattgaagatattgatgaagcaatagaaatagctgaagctatcggtttccctgtagttgttaaagcttcagctggcggtggcggaatgggaatgagtgttgcatatagcaaagaggagttaaaagaagttattgaatctgcaagaaacattgcaaagagtgcatttggtgacccaacagtatttattgagaaatacttagaaaatccaagacacattgaaatccaattattgggagataagcatgggaatattattcatttaggagatagagagtgttcaatacagaggagacatcagaagttgattgaagaggctccctcaccaataatgactgaagagttaagagaaagaatgggagaagcggcaatcaaagcaggaaaggcaataaattatgacagtgcaggaactgttgagtttttgtatgaaaatggcaacttttacttcttagagatgaatacaagaattcaagttgagcatacagttacagagcaagttactggaatagatttggttaaggcgatgattaaaatagctgctggagaagaattaactttaaagcaggaagatgttaaaataagagggcatgcaattgagtgcagaattaacgcagaagacccattaaatgatttcgttccatgtcctggaaagataaaactatataggtctccaggggggcctggagttaggattgacagtggtgtctatggaggggctgaaattcctccttactatgattcaatgatagctaagctaattacttatggaaatagcagagaggaggcaatagcaagaatgaaaagagctttgagggagtatgttataataggcgttaaaacaaatattccattccatagggctgttttagaggaggagaactttttaaaagggaatatctcaactcactatgtagagcagaatatgcataaattaagagagaaaatggttaaatacgcattagaatcaagagatttatacagtgttgtatcagagaaggtatttgaaaagaataaaaagatagccgccgctgttggtggtttaacaatgtatatatcccaaattatgaaagaaaatgaagtgaataacaaagaatggtaa

SEQ ID NO: 24740 - DNA, 1704 bp, Methanococcus jannaschii
atggttaagattgtagatactacttttagggatgctcagcagtcattgatagctacaagaatgagaactgaagacatgctaccaatagcggaaaagatggatgaggttggattctactctatggaggtttggggaggagctacatttgatgcatgtataagatatctaaatgaagacccatgggagaggttgagggctttaaaaaagaggattcaaaacactccattacagatgctcttaagagggcagaacttagttggttataggcactacccagatgatatcgttgaaaagtttgttataaaagcccatgagaatggaattgatatttttaggatttttgatgctttaaacgatgtaagaaatatggaaactgcaataaaaacagctaaaaaggttggggctgaagttcagggggctatatgttacactataagcccagttcatacaattgaccaatatgtggagttagcaaaaaaattagaagagatggggtgtgattcaatctgcataaaagatatggctgggcttttaaccccttatgaaggatatgagttagttaaaagattaaaagaagagatatcacttcctattgacgtacatagccattgcacaagtggtttagctccaatgacttacctaaaagttatagaagctggagctgacatggtagattgtgctatctcaccatttgccatggggacatcccaaccaccaacagagagtatcgttgttgcgttaaaaggaacaaaatatgatactggcttagatttaaagctcttaaatgagattagagattacttcatgaaagttagagaaaaatataaaatgctattctctccaatatcccaaattgtcgatgcaagggttttggtgtatcaagttcctggaggaatgctatctaacttggtctcacaacttaaagagcagggagctttggataaatttgaagaagttctacaggagattccaagagtaagaaaggatttaggatatcctccattagttacaccaacctctcaaattgttggaactcaggctgttttaaacgttttaactgaagagagatacaagattataacaaacgaagtagttaattatgtaaagggcttttatggaaagccaccagctccaattaacccagagttgttaaagagagtattggatgagggagagaaaccaattacctgcagaccagctgatttattacctccagaatgggagaaagttaagaaagaggcagaagagaagggaattgttaagaaagaagaggatatattaacctacgctttatatccacagatagctgttaagttcttaagaggagagttgaaagctgagccaataccaaaagagaaggatataggaaagattttagagattccgactgaatatattgtagaggttgatggagagaagtttgaggttaagatagagccaaagattggaacagaattgaagagaaagaaagaagttataactgcagagatggagggagctgttacttcaccatttagaggaatggtaactaagattaaagttaaagaaggagataaggttaagaagggggatgttattgttgtattagaagctatgaagatggagcatccaatagaaagcccagttgagggaactgtagagagaatattaattgatgaaggagatgctgtgaatgttggagatgtaattatgattattaaataa

SEQ ID NO: 24741 - DNA, 675 bp, Methanococcus jannaschii
atggatgtaatgaaaggaacaacaaccgttggtttaatttgtgacgatgcagtaattttagcgacagataaaagggcatcattaggtaatttagtagctgacaaagaagcaaaaaaattatataagatagatgattacatagcgatgaccattgcgggaagtgttggagacgctcaagcgatagttaggttattaattgctgaggcaaaactatacaaaatgagaactgggagaaatatccctccattggcatgtgctaccctattgagtaatatattgcattcaagtagaatgttcccttttttaactcagataattattggtgggtatgatttattggaaggagctaaattattttcattagacccattaggaggaatgaacgaagaaaaaacttttacagctactggttctggttctccaattgcctatggggttttagaagctggatatgatagagatatgtcagttgaagaagggataaaattagccctaaatgcattaaaatcagcaatggaaagagacacattttcaggaaatggtatatcattagctgttataacaaaagatggtgttaagatatttgaggatgaagagattgaaaaaatcttagatagtatgaaagctaaacctaagaaaaaaaccacaaaaagaagtagaagaaagagcaaataa

SEQ ID NO: 24742 - DNA, 885 bp, Methanococcus jannaschii
atggtgttgagggataaaatgatattattggatgagaacacaaaggcgatagttcagggaattactggaaggcagggaagttttcacacaaagaaaatgttagaatgtggaactaaaattgttggaggagtcacaccaggaaaaggagggcagaacgtccatggagttcctgtttttgatacagttaaagaggcagttaaagagacagatgccaatgcgtcagtaatttttgttccagctccatttgctaaagatgcagtttttgaggcaatagatgccggaattgagttgatagttgttattacagagcatatcccagttcatgatactatggagttcgtaaattacgctgaagatgttggagtgaagattatagggccgaatacaccaggtatagcatcaccaaaagttggcaagcttggaattataccaatggaagttttaaaagagggaagtgtagggatggtttcaagaagtggaactttaacttatgagatagctcaccaaataaaaaaggctggttttggagtttcaacttgcgtagggattggaggagacccaatagttggattaagatataaggaggttttagatttatttgagaaggatgatgagacagaagctattgttatgattggagagattggtggaggggctgaagaagaggcagctaaatttatagagaagatgaaaaaaccagttattggttatatagctggacaatcagcaccagaaggaaagagaatgggacatgctggagctattgttgagaaaggaaaaggaacagcagaaagtaagatgaaggctttagaagaggcaggtgcttatgtggcaaaaaatatatctgatattccaaagttattggcagggattttaggaaaataa

SEQ ID NO: 24743 - DNA, 1314 bp, Methanococcus jannaschii
atgcatttttcaaaaattatatatttgaaaaacacttatattttacagataaataagaaatttataaaggggataattatggcaaagaaaaaacaagctaaacaggcagaagtaaatattggaatggttggacacgttgaccatggaaaaacaagtttaacaaaagcattaacaggagtttggactgacaggcatagtgaagagttgagaagagggatttcaattagattgggttatgctgactgtgagataagaaaatgcccacaatgtggaacttacacaacaaaaccaagatgtccaaactgtttagctgaaacagagtttttgagaagggtctcttttgttgattccccagggcacgaaacattaatggctacaatgctttctggagcttctttgatggatggagcaattttggttatagccgctaatgaaccatgcccacaaccacaaacaaaagagcatttaatggctttagagattttaggaattgataaaattataattgtccaaaataaaattgatttagttgatgagaagcaggcagaagaaaattatgagcaaataaaagaatttgttaagggaactattgctgaaaacgctccaataatcccaatctcagcccaccacgaagcaaatattgatgttttgttaaaggcaatacaggactttattccaacacctaagagagaccctgatgcaacaccaagaatgtatgttgcaagaagctttgacataaacaaaccaggaactgagattaaggatttaaaaggaggggttttaggaggggcaattattcagggagtatttaaagttggggatgagattgaaataagacctggaatcaaagtaactgaaggaaacaaaacattctggaaaccattaactacaaagattgtttcattagccgctggaaataccatacttagaaaagctcatccagggggtttgattggggttgggacaacattagacccatacttaacaaaatcagatgcattaactggaagtgttgttggattgcctggaactctccctcctataagagagaagataacaataagggctaatttgttggatagggttgtaggaactaaggaggaattgaaaatagagccattaagaacaggagaggttttaatgctaaatattggaactgctacaaccgcgggggttataacctcagcaagaggagatatagcggatataaaattaaagcttccaatatgtgctgagattggagatagagtagctattagcagaagagttggctcaagatggagattaattggttatggaacaattgagggataa

SEQ ID NO: 24744 - DNA, 423 bp, Methanococcus jannaschii
atgaaagaaagaacctttgtagctttaaaaccagatgctgtaaaaagaaaactaattggaaaaatcattgaaagatttgaaaataaaggttttgagattgtggctatgaagatgattaaattagatagagagatggcagaaaaatattatgaagagcataaagggaaagaattttatgagagactaataaactttatgacatctggaagaatgatagttatggttgttgagggagaaaatgccatatctgttgtaagaaagatgattggtaaaacaaatcctgctgaagcagaaccaggaactataagaggagattttgctttaacaaccccggataatataattcatgcatcagattcaaaggaaagtgctgaaagagagataaaactattttttaaagaggatgagatatttgataaataa

SEQ ID NO: 24745 - DNA, 1119 bp, Methanococcus jannaschii
atgtttagggagaaattaagaagagagattgaaattataaagaacaacggattatatagatttttaaggaaaaaagatgatggagttttagatttctcttcaaatgattatctatgcctatcaaagcatccagaggttattgaagcagttaaagaagggctaaaatatggggctggttcaaccggctcaagattaacttctggaaatataaaccatcaaagattggaggagaagatagctgaatttaaagagacggagaggactttagtttattcatccggctatgcaacgaatgttggagttatctctgcattgtgcaaaaaaggagatttaattttgagtgataagcttaatcatgcctctatcattgatggttgcaagttgagtaaagcagatgttttaatttacaatcattgcgatgttgagcatttaaccaacttaattgaagagaattgggggaaatataacaacctctttattgtaactgatggagtttttagtatggatggggatatagctcctttgagggatttaaagaagatagctgatgaatttaatgccattttaattattgatgacgcacacggcactggagttttaggagatgggagaggaacattaaagcactttaatttaaaaccttctgacaacatagtgcaaattggaactttatctaaagcaattggtggtttaggaggctttgtctgtggaattgaggaggttgtagagtatttaataaacacttcgaggagttttatattctcaactgctctacctcctcatgtagttgagggttgcattaaggcctttgagattattgaaaaaacagatatagttaaaaagcttcaaaaaaacataaaaatagcaaataaagtttttaaaaaatatgaatttattaaagaagataacttaactccaatctatccatttatttttaaagaaaaaaccatggaaatagcagaacatttaataaaaaataatatcttttgtgtaggaattagatatccaactgttcctaagggattggagaggataagggttagcataaatgttgggcatgaaaaagaggattttgaactgttgtgtgagaggattaaagaggtttatagtagtgactga

SEQ ID NO: 24746 - DNA, 1395 bp, Methanococcus jannaschii
gtgaataaaatgaacattgataaaaatttacttgaaaaatgggataaagaatatatttggcatccatacacacagatgaaagaatatagagaatcaaaaaacttgattattgagagaggagagggcaattatttaattgacatttatggaaataagtatttggatgctgtttcatctatatggtgtaatctatttggacatagtagaaaggagataattgaagcaataaaaaatcaagctgataaaatctgccattcaacacttttaggctgtggaaacgtcccatcaattttattggcaaaaaaattggtggatataactccaaagcatttaacaaaggtattttactctgaagatggagcagaggcagttgaaatagcaattaaaatggcttatcaatattatgttttaagaggagataagggaagaactaaatttatttcagttaaagaaggctatcatggggacactgttggagcaatgagtgttggggggagtgaattattccatggggtttttaagcctttattgtttaaaggctatcatgcaaatcctccttactgctacagatgcaaataccacaactttaaagatactgatgagagaaatgaaaaaggttgtgaaatggaatgtttaaatgagatgattagtttaattgaaaaacatgctgaggaagtattttgtgttatccttgaaggaggaattatgggttctgctggaatgattccatatccagatggatatattgaaggagttgcaaaggcatgtaaggagaatgatgtaatctttatcctcgatgaggtagctactggatttggaagaactgggaagatgtttttctgtgataatgaagagctaaaaaagttggagaagccagatatcctttgtcttggaaagggattaactggaggctatttgccattagcggcaactctaacaactgatgaaatctataaccaattcttaggagagtttggagagagtaagcaactctatcatggtcatacatacactggaaaccaacttctatgctctgctgcattagcaacattagagatttttgagaaggagaatgtgatagagaatatccaaccaaaaataaagctcttccataaagaattaaggaaattaaaggaacttgagcatgttggagatgttagaggaaggggttttatggtcggaatagagcttgtaaaagataaagagactaaagaaccctacccttacggttataaagctggctacagagttgctgaaaagctgttagaaaaaggtatctacatgagaccaattggtaatgttattatcttagtcccaccattgtcaataactgagaaagagattatttatctatgcgatgcgttgtatgaagctataaaggaagctgacctgtaa

SEQ ID NO: 24747 - DNA, 1479 bp, Methanococcus jannaschii
gtgagttatatggaaagagaaagctggagctctaacttgggatttatattggcgagtgttggttcggctataggattaggaaacatttggagatttggatatatggtttatacgaatggtgggggagcttttttaattccatatattgttgctttgctctgtgttggtatcccattaatgattcttgaatttgccattggacattatacaaaaaaatctgcacccttagctttggaaaaattgcataaaggttcagaatggacagggtggtttgcagttatttcagggtttattataacaagttattatgttgttattattgcctggtgtctttactatttgataattttagttatctatgggtatccatcagaccctaatgcttatttcttccataatatacttcaaatatcatctggtgtagaggacattggtggagtttcttatggaattttagtatctaccttagctgtttggggaattgtagctttaattttaagtgcaggaattaaaaatggattggagaaagcaaataaaataatgattccttttctactgtttttaataattttgttggttttaaacgcactaactctaccaggagctttaactgggattgaatggtatttaactccagacttttcagcactctttaattataacgtgtggttaagtgcattctctcaaattttctttagcctatctttaggatttggaattttaattgcttatgcaagctatcttcccaaaaaaagtgatttaacaataaacgctgttactgtatctctcttaaattgcggtttttcatttttagctggttttgctgtatttggaacacttggatatatgagctatacaagtggcattccattagataaggctgtttcagaagggattggcttggcttttgttacctttccaaaggcactgtctttattaccatttgcaagtagattatttgggatagtattctttttagccttagtttttgctggaatatcctctgctgtttctatcgtagaggcaagtgtatctgcaattatagataagttctcattgagtaggaaaaaagctctacttgctgtattggctttatttattataatttcaccaatatttacaactggagctggattatattatttggatattattgaccactttgcctctggttatttgcttccaatagcagcaatcttagagattataatagccatatggctatttggtggagataagcttagagaacatgtaaataaactttcagagataaagttgggagtttggtggaagtatttggctggagttgtgtctccaataatattaactgctgttgtattcttagatgcctctaatgttttaacatctggttatggaggttataaaacaacctatgttatatttggggctttaatcattccattggcgtttgttgtaagtgtaattcttcaaaaaatgaaaacgattaaaggttggtaa

SEQ ID NO: 24748 - DNA, 3018 bp, Methanococcus jannaschii
atgagtatgatactaaaagaaataaggatgaataactttaaaagtcatgtgaattcaagaattaagtttgaaaaagggattgttgcaattattggagagaatggaagtggaaaatcatctatctttgaagcagtgttctttgccttgtttggggcaggcagtaattttaattacgacacaataataaccaaaggaaaaaaatccgtttatgttgaattggattttgaagtcaatggaaacaactacaaaattatcagagaatatgattctggaagagggggagctaagctctataagaatggaaagccttacgctactacaattagtgcagttaataaagcagtaaatgaaatcttaggcgttgatagaaatatgttcttaaactccatatatattaaacagggggagatagctaaatttttgagtttaaaaccctccgaaaaattggaaacagttgcgaaacttttgggaatagatgagtttgaaaaatgctatcaaaaaatgggggagattgttaaggaatatgaaaaaagattagaaagaattgaaggagagttgaattacaaagaaaattatgaaaaagaattaaaaaataaaatgagccaattagaagaaaaaaataaaaaattaatggaaattaatgataaactaaataaaataaaaaaggaatttgaagatattgaaaaattatttaatgaatgggaaaataaaaagttgttgtatgaaaaattcataaacaaacttgaagaaaggaagagagctttagagcttaaaaatcaagagcttaaaattttagaatatgatttaaatactgttgttgaagcaagagaaactctaaatagacataaagatgaatatgaaaaatataaatcattagttgatgagattaggaaaattgagagcagattaagagaattaaagagtcattatgaagattatttaaaattaacaaagcagttggagataataaaaggagacattgaaaaattgaaagaattcatcaacaaaagtaagtatagagatgatattgataatttagatactctattaaataaaataaaagatgaaattgaaagagtggaaactattaaagatttgcttgaagaacttaaaaatctaaatgaagagattgaaaaaattgaaaaatataaaagaatatgtgaagagtgcaaagaatactatgagaagtatttagaattagaagaaaaggctgtagaatacaataaactaactttagagtatataacattgcttcaggagaaaaaatccattgaaaaaaatattaacgatttagaaacaagaattaataaacttttagaagaaacaaaaaatattgacattgaaagtattgaaaattcattaaaagagatagaggaaaaaaagaaagttcttgaaaatctacaaaaagaaaagatagaactaaacaaaaaacttggggaaattaacagtgaaattaaaaggctgaaaaaaattttagatgaacttaaagaagttgaaggaaaatgcccactatgtaaaacaccaatagatgaaaataaaaagatggaattaataaatcaacataaaacccagctaaacaataaatatactgaattggaggaaataaataaaaaaattagagagattgaaaaagatatagagaaattaaagaaagaaattgataaagaagaaaatcttaagacactaaagaccttatatcttgaaaaacaaagtcagattgaagaattagaattaaaattaaagaattataaagagcagttagatgaaatcaataaaaaaatatccaactatgtaattaacggaaagccagtggatgagatattagaagacattaaaagccagctgaacaaatttaaaaacttttataaccaatacttatcagctgttagctatttaaatagtgtagatgaggaaggtattagaaatagaattaaggaaattgaaaatatcgtaagtggatggaataaagaaaaatgtagagaagagttgaacaaattaagagaggatgaaagagaaataaacagattaaaagacaaattaaatgaacttaaaaataaggaaaaagaacttatagaaattgagaataggaggtcattaaagtttgataaatataaggaatatttaggtctaactgaaaaattagaagagcttaaaaatattaaagatgggcttgaagagatttataatatatgcaactctaagattttagcaatagataacattaagaggaagtataataaagaagatattgaaatttacctaaacaacaaaattttagaggttaataaggaaattaatgatatagaagaaagaatatcctacattaaccaaaaacttgatgaaataaactacaatgaagaagaacataaaaaaataaaagagctctatgaaaataagagacaagaacttgataacgtaagagaacaaaaaacagaaattgagacaggaattgaatatttaaaaaaagatgttgaaagtttaaaagcaagattaaaagaaatgtctaatttagagaaagaaaaagagaaattaacgaagtttgttgaatatttagacaaggttaggagaatatttggtagaaatggatttcaagcatatttaagagaaaaatatgttccattaatccaaaaatatttaaatgaagcatttagtgagtttgacttgccttatagctttgtagaactcactaaagattttgaagtaagagttcatgctccaaatggagttttaaccattgacaatttaagcggtggagagcagatagcggtagctctctctttaagattagccatagctaacgctttaattggaaatagggttgagtgcattatattggatgaaccaactgtatatttagatgaaaatagaagggcaaagttagctgaaatctttaggaaggttaagagcattccacagatgataattataacccaccacagagagcttgaagatgtagcagatgtgataatcaatgttaaaaaagatgggaatgtttcaaaagttaagattaatggatag

SEQ ID NO: 24749 - DNA, 1176 bp, Methanococcus jannaschii
atgctatttttgttatctcttaagaggatttttatttttagaaaccataaatttaatattgttggtgatgttatgggaattgaagaagaaattagaaggatagaagaagaattaaaaaagacaccatataacaaagccacacagaaacacattggtaggttaaaggctaaattagctaagttgagagagcaggctcagagtagagggggaggtggaggaggaaagggctatgctgtaaagaaaagtggagacgctacagctgcctttgtaggatttccatctgttgggaaatcaaccctgctaaataaattaacaaatgctaaatcggaagttggggcttatgctttcactactttaacaattgttccaggtatattagaatataagggagctaaaattcagcttttagatgctcctggaattattgttggtgcttcatcagggaaaggtagggggacagaggttttatctgcagtaagaagtgctgatttgattttattaacagttgatatctacacattagaccacctaccagtgcttgaaaaagaactctacaatgttggaattagattagaccaaactcctccagatgttaaaatcaaagttaaggagagaggagggattaacgttagttcaaccgttccattaacccatatcgatgaagatacaattgaagcaatattaaatgaatataggatacacaacgcagatgttgttataagggaggatataaccttagagcagtttattgatgttgtagctggaaacagagtttatatcccttctttggtggtagttaataagatagacttagctgatgaggagtatctaaaatatataaaacaaaagttagaggaatttggtaaggattatatcttagtttctggtaacaaaggaattaacttggatttattgaaagagaaaatctatgagaaattgggttttataaagatttatctaaaaccacaggggaaaaagccagactttgatgaaccactaattatgagaagaggagctactgtaaaagatgtttgtgaaaaactgcataaagatttcgttagaaatttcaggtatgcccaagtttgggggaagtcagcaaagcatccagggcagagagttggattagaccataaattagaggatggagacattttaacaattgtcataaagagataa

SEQ ID NO: 24750 - DNA, 1182 bp, Methanococcus jannaschii
ttggcaatgattggtttagtagggaaaccaaacgtagggaaatcaacaatgttcaatgctttaactgaaaaaccagcagaaattggaaattatccatttacaacaatacaaccaaataaaggtatcgcttatataacaagcccctgtccttgtaaggaattgggagttaagtgtaatccaagaaattcaaaatgtatagatgggattagacatattccagttgaagttatagatgtggctggtttagtcccaggagcacatgaaggtagagggatgggaaacaagtttttggatgatttaaggcaagcagatgcatttatattggttgttgatgcctctggaaagacagatgctgaaggaaatccaacagaaaactatgacccagttgaggatgttaaattcttattaaatgagatagatatgtggatttatagcattttgacgaaaaattgggataagttggcaagaagagcccaacaagagaagaacatagttaaagctttaaaagaccaattaagtggattgaatatagatgaggatgacataaagatggctattagagatatggatgaaagcccaattaaatggactgaagaagatttgctaaacttggctaaaaagcttagaaaaatttcaaaaccaatgattatcgctgcaaataaggcagaccacccggatgcagagaagaatattgaaaggctaaagaaagagtttaaggactatatagttattccaacatctgcagagatagagttagctttaaaaagagctgaaaaggctggaattataaaaagaaaagaaaatgactttgagataattgatgaaagcaaagtgaatgaacagatgaggagagcttttgattacataaaggactttttaaagaagtatggaggaactggagtccaagaatgcataaataaagcttattttgatttgttggatatgattgttgtctatccagttgaagatgagaacaaattttcagataagcaaggaaatgtattaccagatgcatttttggttaaaaaaggaagtactgcaagagacttagcttataaggtgcatacagagttgggagagaaatttatctatgcaatagatgcaaagaagaagattagagtaggagctgattacgaattgaagcataatgatattattaaaattgtctctgccgcaaaataa

SEQ ID NO: 24751 - DNA, 852 bp, Methanococcus jannaschii
atgataagaaaggcagtaattccagtggctggttttgggactcgactattaccaataacaaaggctcaaccgaaggagatgcttccagtagttaataagccaatagtgcaatatgttgttgaagatttggtagaagcaggagtaaaggatattttatttgtaactgggaagggaaaacaggcaatagaaaaccactttgacgtaaattatgagttggagtgtaaattagagaaatctggaaaatatgaacttctaaaaattattaaagaaattgataggttagggaatatattttatgtaagacagaaagagcagaaaggtttaggagatgctattttgtatggggaggaatttgttggggaggaatactttatagcaatggttggagatacaatttactctaaaaatattgtaaaagatttaataaaagctcatgaaaaatacggctgttcagttattgcattagagagagttccaaaagaagatgtttataaatatggagtaattgatggggaagagatagaaaagggcgtttataaaataaaaaatatggtagaaaaaccaaaagttgaagaggcaccttcaaatttgattataaccggggcttatttattatctccaaagatatttgaaaaaattagagaaactcctcctggaagaggaggagagattcagattacagatgctatgaatctacttttaaaagaggaagatattataggggttgaaattaactgtaaaagatatgatattggggacgctcttggatggttaaaagcaaatgtagaaattggagctgaaagattccctgaatttagagaattcttaaaagaattcgttaaaaatttataa

SEQ ID NO: 24752 - DNA, 465 bp, Methanococcus jannaschii
atgaaaaaagatgaggttaaggttgtagttattggttcaagtgatgttggaaaaacaacattaatggaaaatttaattgataaaattggaaaagttgaatacaaaggaattacaacagctattgactatggttcattaacaataaaagataagaagatacacttctttgggactccagggcagaaaagatttgagttcatgagagaattggcattaaaagggactaattttgctttagtagtgttggatgcatcaaaaggaataactaaagaagatgaagaaataataaaattattagaatctaaaaaaatcccgtacggaatttttataaataaaacagatgttggagatatcgatacctccgaagtttataacttttgcaacccaaaattcattgttaaaggttgtgcagtgaaaaaagatggacttgacgaacttataaataaaattatgtcccacacataa

SEQ ID NO: 24753 - DNA, 876 bp, Methanococcus jannaschii
atgaaattttttggtgataagatgattgtagtatcaggaagtcaatcccaaaatttggcttttaaggtagctaagcttttaaacacaaaattaacaagagtagagtataaaagattcccagacaacgagatttatgttagaatagttgatgaaatcaacgacgatgaggcagttataataaacacacaaaaaaatcaaaatgatgcaattgtagagacaattttgctgtgtgatgctttaagggatgaaggagttaaaaaaataaccttagttgctccatacttagcttatgcaaggcaagataaaaaattcaatcctggagaggcaataagcattagagctttagcaaaaatctactcaaatattgttgataaactcattacaataaatccacacgaaacacacataaaggatttcttcacaatcccatttatttatggagatgcagttccaaagttggcagagtatgttaaagataaattaaacgacccaatagttttagctccagataaaggagctttagaatttgctaaaactgcatctaaaatcctaaatgcagaatacgactacttagaaaaaacaagactctctccaacagaaatccaaatagctccaaagacattggatgctaaagatagggatgtgtttattgttgatgatatcatctctacaggaggaacaatggctacagctgttaagttattaaaagagcagggagctaaaaaaataattgctgcatgtgtgcatcctgttttaattggagatgcattaaataagctctattcagctggagttgaggaagttgtagggactgatacatatttatcagaggttagtaaggttagtgttgcagaggttattgttgatttattataa

SEQ ID NO: 24754 - DNA, 1662 bp, Methanococcus jannaschii
gtggaagagaagatattgccaattgcattaagaaatgccataaaatacaatggaaaagctaatccaaaggcagttttagggatatttttgtcagaaaatccagaatataggagtaaagcaaaggaggtaatgccaattgttgagaaagttgttgaagaagttaataaactatcattggatgaaattaagaaaaagttggaagaattaggagaagatgttaaaaagaaagaaaaaaaggagaaaggtttagaattaccaaacgttaaagataaggtagttatgagattcgctcctaatccatcagggcctttacatatagggcatgcaagagcagcagttttaaatgactactttgttaaaaaatatggtggaaagttaattttaagattagaggatacagacccaaagagagttctgccagaagcttatgacatgattaaagaagatttggattggctgggggttaaagttgatgaagtggttatacaatcagatagaatagagctttattatgaatatggtagaaaattgattgaaatgggacatgcttatgtttgtgactgcaatccagaagaatttagggaattgagaaataaaggagttccatgtaagtgtagagatagagccattgaggataacttagagctttgggaaaagatgctgaatggagaacttgaaaatgtagctgttagattaaaaacagacataaaacacaaaaacccatcaattagggactttccaatattcagagttgaaaaaactccacatccaagaactggagataaatactgtgtatatcctttaatgaacttctctgttccagttgatgatcatcttttaggaatgactcatgttttgagaggaaaagaccacattgtaaatactgagaagcaagcttatatttacaaatactttggttgggaaatgccagaattcatccactatgggattttgaagatagaggacattgttttaagcacttcatcaatgtataaaggaattaaagaaggtctctatagtggatgggatgacgttagattaggaactttaagagctttaagaagaagagggattaaaccagaggcaatatatgagataatgaaaagaattggaattaaacaggcagatgttaagttttcttgggagaatttatatgcaataaataaggagcttattgataaagatgcaaggagattcttctttgtctggaatccaaagaaacttattatcgaaggggcagagaaaaaggtcttaaaacttagaatgcatccagatagaccagaatttggagagagggagttaatatttgatggagaggtttatgttgttggagatgagttggaagagaataagatgtatagattgatggagttatttaacatagttgttgaaaaagttgatgatatagcattagctaaatatcactcagatgactttaaaatagcaaggaagaacaaagctaagattatacactggattcctgtaaaggatagtgtaaaggttaaagttttaatgcctgatggagagataaaggaaggctttgctgaaaaagattttgctaaagtagaggttgatgatattatccaatttgagaggtttggatttgttagaatagataaaaaagataatgatggattcgtatgttgctatgcacatagataa

SEQ ID NO: 24755 - DNA, 1449 bp, Methanococcus jannaschii
atggagagtattaaaaaagtaatggtttttggttctggaccgatagttattggacaagctgcagagttcgatttttcaggttctcaagcatgtaaagctttgaaggaagagggaatttatactattttagtgaattcaaatcctgcaactattcaaacagatacagacatggcagataaggtttatttagagccattacatccaacaatcgttgagaagattattgagaaagagaggccagatgctattttaccaacaatgggaggacaaacaggtcttaacttagctttagaattacatagaagagggattttagataaatatggaattaagcttctcggctctaatattagaactattgaaatagctgaggatagagaactttttgccgaggcaatggctgaaattaatgagccagttacaaagtgtaaggccgttaattctgttgatgaagcagttgagtttgctgaggaaattggctatccagtcattgtaagacctgcatttaccttaggaggaactggaggaggaattgcccataacaaagaggagttaatagatattacctcaaaaggattaaaatattctataatcaaccaagttttgattgatgagagtgttttaggatggaaggaatttgagcttgaggttatgagagatagaaaagacacttgcatcattgtctgtggtatggagaacatagacccaatgggaatacacactggagagagtattgttgtctcacctatccaaactctaccagatgagttttatcaaaagctaagaaacgctgctataaagattataagacatttgggaattgagggaggttgtaatatacaatttgctgtaaataaggagatgactgaatatagagttattgaagtgaatccaagggtctcaagaagctctgccctggcaagtaaagctacaggttatccaatagcaaggattgccgctaaaatagccatcggtaaaacattagatgagatattaaatgatgttacaaaggaaacaccagcaagctttgagccaactttagattatgttgttgtaaaaatcccaagatggccatttgataagtttaaaacagtagataaaaaattaggaacaagtatgaagtccactggagaggttatggctataggtagaagctttgaagaagctttgcaaaaggcaattagaagtttagacattggaagattcggcataattggagatggaaaggataaagactatacggatgaagagatagaagaaatattaaagaatccaactgatgaaagaatttttgttattgctaaggcgttagagaagggttggagtgttgagaaaatagttgagctaacggatattgatgaatttttcattaagaagattaagaatattgtagatatgaagaaggaattggagaaattaaaagaagaaattaagaaattgaatgcttaa

SEQ ID NO: 24756 - DNA, 1857 bp, Methanococcus jannaschii
atggatatggaaaaattaaaggaaatattattgaaagcaaaaaaattgggattctctgataaacagatagctaatttattaggaatggatgagatagaagttagggacttgagaaagaagctcaatatcattcctttatacaaaatggtagatacctgtgctgctgagtttgaggcaaaaaccccatactattactctgcctatgagacatttgtttataaggagcaagatgaaagcaatccatcagatagaaaaaaagttataatcatcggttctgggccgataaggattggtcaggggatagaatttgattattcaagtgttcatgcagttttagctttaaaggaaatgggaattgaagctataatcataaataacaacccagagacagtttcaaccgactatgatacatcagacaagctttattttgaaccaataacctttgaagaggtattaaatattgctgaaagagaaaaggagaaaggagagcttttgggagttatagttcaatttggtgggcaaacagcaataaacttagccatgaaattaaaaaatgcgggagttaatatcttaggaaccactccagagaatataaatgctgctgaggatagagaagagttttcaaaacttttaaagaagttaaatattcctcaagctgaaggaggaacagcatatacaaaagaagaggcattggagatagctaaaagaattggttatcctgttttagttaggccttcctatgttttaggaggaagggcaatgcaaattgtttatagcgaggatgagttaattgagtatatggaagaggcagttaaagtttcagaggagcatccagtgttgattgataaatttttagaagatgctattgagttggatgttgatgctgtttgtgatggagagagtgttttaattggggcaataatggagcatattgaagaggctggagtgcatagtggagattcagcaacagttattcctcctcaaactttaccaaaggagataattgatactgttatagattacactgccaaattagcaagggctttaaacatagtggggcttttaaacgtgcagtatgcagttaaagatggagttgtttatgttttggaagcaaacccaagggcttcaagaactgttccttatgtgagtaaatcagttggaattccattggctaagttagccacaaagattatgctcggcaaaaagttggaggagttaattaaagattatgatgttgaaaaagttgctgagaaggtttggattgcaaagccgaagtatgtatcaattaaagaggcagtattcccattccaaaaattgcctggagtagaccctgttttagggcctgagatgaaatctactggagaggctattggaatagataaagactttggtagggcatactataaagctcagttatctgcaaatatggaattgccaatcgttggaaatgtctttataagtgttagagatagggataagaagcatatcgtagatgttgctaaaaagttgcatgagcttggctttacaatatacgcaacagaaggaactgctaaagtgttgagagaaaatggaattccagcaatacttgttaagaagatatctgaaagtccaaatgataacatcctaaagttaatgagagatggtaagatgcacttaataataaacacttcctctggaaagaaggcaaagtcagacgggtattatataagaagggcagcagtggatttgggtattccttatataactacaatccctggagcaaaagctgctgttaaggcaatagaagctgtaaaaactggagagttaagtgtttattcattagatgagcttgatgcaaggataaaaaataggttttaa

SEQ ID NO: 24757 - DNA, 1248 bp, Methanococcus jannaschii
atgtatgaagttagggacataaacctctggaaagaaggagagagaaaaatacaatgggcaaaacaacacatgcctgttttaaatttaattagagaaagatttaaagaagaaaagccatttaaaggaataacaataggaatggctctacacttagaagcaaaaacagctgttttagcagagacattgatggaaggaggggcagagattgctataactggatgcaatcctttatccactcaggatgatgttgccgctgcttgtgctaaaaaaggaatgcatgtttatgcatggagaggagagacagtagaggagtattatgaaaacctaaacaaggttttagaccacaaaccagatattgttatagatgatggctgtgatttaatatttttattgcatacaaagagaactgaacttttggataacataatgggaggttgtgaagaaactacaactggaatcatcagattaaaagctatggaaaaagaaggagctttaaaatttccagttatggatgtaaatgatgcatatacgaaacatctatttgacaacagatatggaactgggcaaagtgccttagatggaattctgagagctacaaacttattaattgctggaaagactgttgttgttgctggttatggatggtgtggtagaggagtagcaatgagagctaaaggcttaggagcagaggtcgtagttacagaagttaatccaattagagccttagaggcaagaatggatggatttagagtcatgaagatggagaaagctgcggagattggagatatatttataacaacaactggatgtaaggatgttattagaaaggaacatatattgaagatgaggaatggagctatcttagcaaatgctggacactttgacaatgagattaataaaaagcacttagaagagttagctaaatcaataaaagaagttagaaattgtgtaactgaatacgacttaggaaataagaaaatatatttattgggagagggtaggttggttaatttggcatgtgcagatgggcatccatgtgaggttatggacatgagttttgccaaccaagctttagcggctgaatacatcttaaaaaatcatgagaagttagagccaagggtttataacattccttacgaacaggacttaatgattgcctctctaaaattgaaagctatgggtattgaaattgatgaactaactaaagagcaaaaaaaatatttagaagattggagagaaggaacttaa

SEQ ID NO: 24758 - DNA, 1257 bp, Methanococcus jannaschii
atggaaagttacatacaaaacttatttgctgagagaattggtggaaagaagtttgggaaagaagatgtaatttacaagtttgagaaaattaagagagctaagcaagaggcaatgaaaagacaccctgatatggaattaattgatatgggtgttggagaaccagatgagatggcagacccggaggttataagagttttgtgtgaggaggctaaaaaatgggaaaacagaggatatgcggataacggaatacaggagttaaaagatgccgttcctccatacatggagaaggtttatggagttaaggatatagacccagttaatgaggttatacactcaataggttcaaaaccagctttagcttatataacatcagcatttataaaccctggagatgtttgcctaatgacagtccctggctatccagttacagcaacacacacaaaatggtatgggggagaggtttataatctcccattattagaggagaatgacttcttaccagatttagagagcattccagaagatatcaagaagagagcaaagatattatatctcaattatccaaacaaccctactggagcacaagctacaaagaaattctacaaagaggttgttgattttgcttttgaaaatgaggttatcgttgttcaagatgctgcttatggagctttggtttatgatggaaagcctctttcattcttatcagttaaagatgctaaggaggttggagttgaaatccatagcttttcaaaggcattcaacatgaccggttggagattggcatttttggttgggaatgaacttataattaaagcgtttgcaacagttaaagacaactttgatagtgggcagttcatcccaatccaaaaagctggaatttattgtttgcaacatccagaaattacagaaagagttagacagaagtatgagagaaggttaagaaagatggttaagatattaaatgaagttggatttaaagcaagaatgcctggaggaactttttatttatatgtaaaatcaccaacaaaagctaatggtattgaatttaaaacagctgaggatttctcccaatacttaattaaagaaaaacttatttcaacagttccatgggatgatgcagggcattatttaagattagcagcatgctttgttgctaaagatgagaacggcaatccaacaactgaagagaagtatgaagatatggtattagaggagtttaagagaagattggagggaatggatttagaatttgaataa

SEQ ID NO: 24759 - DNA, 450 bp, Methanococcus jannaschii
gtgattcctatggaggagttaaaagttaaaaaaattacaaatgggactgtaattgaccatatagatgctggaaaggcattaatggtttttaaggttttaaatgtcccaaaagagacatctgtgatgatagccattaatgtcccatcaaaaaagaaaggaaagaaagatattttaaaaattgaaggaattgaattaaaaaaggaggatgttgataaaatatctttaatttctccagatgtaactatcaacatcattagaaacggaaaagttgttgaaaaacttaaaccacaaattccagatgagatagaagggacattaaaatgcacaaatccaaattgcataacaaataaagaaaaagttagaggaaaatttaaaatagaaagtaaaaacccattaaaaattagatgctattattgtgagaagtttttaaatgaagtaatttttgaatga

SEQ ID NO: 24760 - DNA, 1392 bp, Methanococcus jannaschii
atgttcatagatgggaagtggataaatagggaagatatggatgttattaacccatattcattagaagttattaaaaaaatccctgcgttaagtagggaagaagctaaagaagctatagatacggctgaaaagtataaagaagttatgaaaaatctccccataactaaaagatacaacatcttaatgaatattgccaaacaaattaaagaaaagaaggaagaacttgccaaaatattggctatagatgcaggaaaaccaataaaacaggcaagagtagaggttgaaagaagtattggaacatttaaattagctgctttctatgttaaagagcatagagatgaggtaatcccttcagatgatagattaatttttacaaggagagaaccagttggaatagttggggctataacacccttcaatttccctctaaatttatcagctcataaaatagccccagctatagccactgggaatgttatagttcatcatccatcatcaaaagctcctcttgtttgtatagagttggctaaaatcatagaaaatgctttgaagaaatataatgttccactgggagtttataatttgctaactggagctggagaggttgtaggagatgagatagttgttaatgagaaggttaatatgatatccttcacaggcagttcaaaggttggagaattaattactaaaaaagctggctttaaaaaaattgccttggaattgggaggggttaatccaaatatcgttttaaaagatgctgatttaaataaagcagttaatgcattaataaaaggcagttttatatatgctggacaggtttgcatctctgtagggatgattttagttgatgagagtatagcagataagttcatagagatgtttgtaaataaggcaaaagtacttaacgtaggaaacccattagatgagaaaactgatgtaggacctttaataagtgttgaacatgcagaatgggttgaaaaagttgtagaaaaagctatagatgaaggaggtaagttattattaggaggaaagagagataaagctctattctatccaacaatattggaagttgatagagacaatattttatgcaaaactgaaacatttgccccagtaattcctataattagaactaatgaggaagagatgattgatatagccaacagcactgaatatgggttgcattcagctatattcacaaacgatataaataaatccttaaaatttgctgaaaacttggagtttgggggagtagttataaatgattcatcattgtttaggcaggataatatgccatttggaggagttaagaagagtggcttaggtagggaaggagttaaatatgcaatggaagagatgagcaatataaagacaataataatctcaaaataa

SEQ ID NO: 24761 - DNA, 3309 bp, Methanococcus jannaschii
gtgaaatttatgtgtggtatcattggctatataggtaatgataaagctccaaaaatcttattaaatggattaagaaggttggaatatagaggatatgatagctgtggaattggagttgttgataataataaactaattattaaaaagaatgtgggcaaagttgaagaggttgctaaaaaagagagatttttggatattgatggaaatattgggatagggcattgtttgcatccagatacttatgttatattgccagatggaagaatgaaaaagatttctgaaattgatgaagatgaggttttatcagttaattttgaagatttaaagctatataataaaaaaatcaaaaagtttaaacataaagcaccaaagatattatataagataaaaactgccttttctgaacttattacaactggagaacataaattgtttgttgtagagaatggaaagatagttgagaagtgtgttaaagatttgaatggaagtgagttaattggtgtagtgaggaagttaaattatagctttaatgataatgttgagtttaaggatgtatatgttgaaaggcattataagttagatgaaacaataagaaataaactaagaaaagttagagaaaaattaggactaacaagaaaagacgttgaaaaattatgtggagttaaagaaatatatattgtaaaaattgaaactggaaaattagagagtattgaagaagagagattaaagaaattatgttctctttatggtatcaactttgaagagattatatatagggataacttacattacacaaatcctgttaaatttccaaaaactcctactccagaattaatgcagattattggttatattattggagatgggcatttcccttcaaataggatgttgagattgaaggatgaaagaaaagaagttttagaggaatataatcaactatttaaaactgtctttaacttagaagggaatatcaaaaaaggagatggcaattattatatattagagataaacagcaaatacctgattgattggttcagagaaaacattccagagttatttaataaaaccggtaatgagagaactccagaatttgtatttagattaaataatgatttggttgcatcatatttaagaggaatatttgatgcagaaggttatataagagctgaggctaagcaaattggtataggaatgacttccaaatgctttataaaagagattcagttcttgttgttgagatttggaattttagcatcatattcaaaaattaaaagaaaagaggaaaattggaacaatactcataagcttcttataagtgataaaaaatcctttgaattatttaaaaaatacattggttttactgcaaaggacaaaatggagaaattagaggctatattaaacaaaatgaaaggacttaactttagatatatttcaattcctttaactaaaaaagagattagggaatttgtaggagttccattaaaaacaataaaaaatggagataactattgcaccgattacacaatagaaaagattattgaagaactaaacagtaaaggactatatgataaagcagagtatttaaaaagatttttagacgctgatatagtttggacaaaatttaaaattgaagaggttgaatctgatgttgaatatgtctatgatttagaggttgaggactatcataatttcattgggaatttaataattaatcataattcaagatgggcaacacacggaaatgtatgcaaagaaaacgctcatccccatactgactgcaaagaagagattgcagtagttcataatggaatcatctctaactacaaagagttaaaagatgaattaatgaagaaggggcataaatttaaatcagaaactgatactgaagttgtccctcacttaattgaagaagaattaaaaaaatttaaagaaattaatgaagaaaattacataaaagccgttaaaaatgcaattaaaaaattaaaaggaacttatgcattagttataataaataaaaatttcccaaacctattaattggggcaagaaatgaaagtcccctaatattgggaattaatgatgacggctattttttagggagtgatataactgcctttttagattacacaaataaagcaattccattagaggatggagatgttgttgtaattaaaaagaaagaaaatggatatgaagtaactatagaaaataatggaaatactgttgaaagagagatgatggaaatcaattgggatataagttctgctgaaaagatgggttatcctcacttcatgctaaaagaaattatggaacagccagaggttttaaaagtctctgccaaaatatccgctgaagaaattaaagaattggcaaaatgtataaaagattatgatagggtttattttgtagccatgggaacctccttacatgcggcaatggttgtagagtatttgtttgcaaagcttggaaagctggttatagcttgtgatgcatctgaatttttaaataaaggggttgttgatgataaaaccttagttatagggattacacaaagtggagaaacctacgatactttaaaggcattgagatttgctaagaaaaataaggcaaaaactggagctatagttaatgttttgggaagcacagctacaagagaggcggatataaccgttatgatgggagcagggatagagatagctgtctgtgctactaaaacttacacatcccagttaatgatactgtataggttgtttattgaatatggaaagcttttaggtagagatatgagtgaatatgagaaagagattgataaaattccgaattatataaaggaggttttagataaaaaagaaacaattaaagaaatagccaacaatctaaaagtaaataactacatattcatctctaaaggaataaatattgcaagtgcattggaaggagccttaaaatttaaagaaataacttatttacatgctgaggggatgagtgggggactgttaaagcatggaactatctccctaattgatgaaaatatggatactgtagcaatagttcctccaagggattctgcagtatttaactcaatattatcaaatatagaagaggttaaagcaagagggggaaaagttatagccataactccaactgaaatagatggagctgaaaatatattagttccagaggtaattgaagagatttctccaattgtttatgctccagccttccagttgttagcttattataaggcagttgaattgggaagagatgttgataaaccaagaggtttagctaagagcgttactgttgaataa

SEQ ID NO: 24762 - DNA, 5544 bp, Methanococcus jannaschii
ttggtgataataatggaaaaaccatgggtagagaagtatagaccaaaaacattggatgatattgttggacaggatgaaatagtaaagagattaaagaaatatgtcgaaaaaaagagcatgccgcatttattatttagcggacctccaggagttggaaagtgcttaacaggagatacaaaagttattgtaaatggagagattagagaaattggagaagttattgaagagataagcaatggaaaatttggagtaactttaaccaacaacttaaaagttttaggaattgatgaagatggaaaaattagagagtttgatgtgcagtatgtctataaggataaaaccaacacgttgataaaaataaaaaccaaaatgggtagggagctaaaagtaacaacttaccatccacttttaataaaccacaaaaatggagaaataaaatgggagaaagcagagaatttaaaggttggagataaattagcaacaccaagatacattttatttaatgaaagtgattataatgaggaattagcagaatggcttgggtatttcataggagatgggcatgcagacaaagaatcaaataaaataaccttcacaaacggtgatgaaaaacttagaaagaggtttgcagaacttactgaaaagttgtttaaggatgcaaaaataaaagagagaatacacaaagacagaacaccagatatttatgttaattcaaaagaagctgttgaatttattgacaagcttggtttaagaggaaagaaagcagataaagttagaattccaaaagaaataatgagaagtgatgcattaagggcatttttaagagcatactttgattgtgatggtggtattgaaaaacactcaatagttttatcaactgcaagtaaagaaatggcagaggatttagtttatgccttattaaggtttggaataattgcaaaattgagggaaaaagtaaataaaaacaataacaaagtatattaccatattgttatctcaaactcttcaaacttaaggacattcttggacaacattggatttagtcaagaaagaaaacttaaaaagctcttagaaatcataaaagatgaaaatccaaacttagatgttataactatcgacaaagagaaaataagatacataagagatagattaaaggttaaattaacaagagacattgaaaaagataattggagttacaacaagtgcagaaaaatcactcaagaacttttaaaagaaatatactacagattagaagagttaaaagaaattgaaaaagcattagaagaaaatatattaatcgattgggatgaagttgcagaaagaagaaaagaaattgcagaaaaaactggaataagaagtgataggattttagaatatataagaggtaaaagaaaaccaagtttaaagaactatataaaaattgccaatacccttggtaaaaatattgaaaaaatcattgatgcaatgagaatctttgctaaaaagtattcaagctatgcagagattggaaaaatgctcaatatgtggaattcaagtataaaaatttacttagagagcaatacccaagaaattgaaaaacttgaagaaattagaaaaactgaacttaaacttgtaaaagagattcttaacgatgaaaaattgatagatagcattggctatgtattattcttagcatctaacgaaatttattgggacgaaattgttgaaattgagcaattaaatggtgaattcacaatctatgacttacacgttccaagataccacaactttattggtgggaatttaccaactatactgcacaatacaaccgccgctttatgtttagcaagagatttatttggagaaaactggagagataactttttagagttaaatgcctctgtttcaaaagatacaccaatattggttaaaatagatggaaaggtaaagagaacaacctttgaagaacttgataagatatactttgaaactaacgatgaaaatgagatgtataagaaagttgataacttagaggttttaactgtagatgaaaactttagagttagatggagaaaggtttctacaataattaggcataaagttgataagattttgagaattaagtttgaaggaggatatatagagctaactggaaaccactcaattatgatgcttgatgaaaatggtttagtggcaaagaaagcaagtgatataaaggttggggattgtttcttaagctttgtagccaatattgaaggtgaaaaagataggttggatttaaaagagtttgaaccaaaggatattacttcaagggttaagataattaatgactttgacattgatgaagacactgcatggatgcttggattgtatgttgctgaaggagctgtaggctttaaggggaaaacatctggacaagttatttatacattaggtagccatgagcatgatttaattaataaattaaatgatattgttgataaaaaaggatttagcaaatatgaaaacttcactggctctggatttgatagaaaaaggttatctgcaaagcagattagaatattaaatacccaacttgcgagatttgttgaggaaaacttctatgatggtaatggaagaagagcaagaaataaaagaattccagatattatatttgaattaaaagaaaatctaagagttgaattcttaaaaggattggctgatggagatagtagtggaaattggagagaagttgttagaatatcatccaaatcagataatttattaatcgatacggtatggcttgcaagaatatctggcattgaaagttcaatatttgaaaatgaagcaagattgatttggaaaggaggaatgaagtggaagaaaagcaacttactaccggctgagccaataatcaaaatgattaaaaagttagagaataagataaatggaaactggagatatatattaagacatcaactctatgaaggtaaaaagagagtttcaaaagataaaattaagcaaattttagaaatggtcaatgttgagaaattatcagataaagaaaaagaagtttatgatttattgaaaaagttatctaaaacagagttatatgcgttggttgttaaagagattgaaattattgactacaacgactttgtttatgatgtatcagttccaaacaatgagatgttctttgctggaaatgtgccaatattattgcataattctgatgaaagagggatagatgtaattagaacaaaagtaaaagattttgcaagaacaaagccaattggggatgttccatttaagattatattcttagatgagagcgatgcattaactgcagatgcacagaacgctttaagaagaacaatggagaaatattcagatgtttgtagatttatcttgagctgtctaactggagatgcaaaaataactcttccagatgagagagagataaagatagaggactttataaaaatgtttgaagaaagaaagcttaaacatgttttaaatagaaatggagaggatttagttttagcaggggttaaatttaactcaaagatagttaatcataaggtttatagattagttttagaaagtggtagggagatagaggcaacaggagaccacaagtttttaacaagagatggatggaaggaagtttatgagctaaaagaggatgatgaagtattggtttatccagcattggaaggagttgggtttgaagttgatgaaagaaggataattggcttaaatgagttctacgaatttttaacaaactatgagattaaacttggatataaaccattaggtaaagcaaaaagctataaggaattaataacaagagataaggagaaaatattaagtagagttttggagctctcagataaatacagtaaatcagagattagaagaaagattgaggaagaatttggaataaaaatatcactaacaactataaaaaatcttataaatggaaaaattgatggatttgctttaaaatacgttaggaaaattaaggaacttggatgggatgagataacttatgatgatgaaaaagcaggaatctttgcaaggttgctgggctttataattggagacgggcatttatcaaaatcaaaagaaggaagaatattgataactgctacaataaatgaacttgaaggaattaagaaagatttagaaaaattaggcataaaagcatcaaacataattgaaaaagatattgaacataaattggatggtagagaaattaaaggcaaaacatcatttatatatataaataacaaggcattttatttattgctaaacttctggggagttgaaattggaaataaaaccataaacggatataacattccaaaatggataaaatacggaaataaatttgtcaagagagagtttttgagaggtttatttggagctgatggaactaaaccgtatatcaaaaaatacaacataaatggaattaaattagggataagagtcgaaaacataagtaaagataagacattagagttctttgaggaagttaaaaagatgttagaagagtttgaagttgaatcatatattaaagtcagtaaaattgataacaaaaacttaactgagttgatagtgaaagcaaataataaaaactatctaaaatatctatcaagaatatcctatgcctatgaaaaagacaactttgcaaggttagttggagagtatctaagaatcaaggaggcatataaggatataatcctaaaagagattgctgaaaatgcattgaaagaagcagatggtgaaaaatctctaagagaattggcaaggaaatataatgttccagttgattttataataaatcaacttaaaggaaaagacattggattaccaagaaactttatgacctttgaagagttcttaaaagaaaaggttgttgatggaaagtatgtttcagaaagaatcattaagaaagagtgtattggttatagagatgtctatgatataacctgccataaagacccttcatttatagcaaatggatttgtgtctcataactgcaactatccaagcaagatcattcctccaattcaatcaagatgtgctgtctttaggttttctccattaaagaaagaggatattgccaaaaaattaaaagagattgctgagaaagaaggtttgaatttaactgaaagtggtttagaggcaataatttatgtctctgagggagatatgagaaaggcaataaatgttttacagacagcggcagctttgagtgatgttatagatgatgagattgtttataaggtctcatcaagagcaagacctgaggaagttaagaagatgatggaattggctttagatggaaagttcatggaggcaagagatttattgtataagcttatggttgagtggggaatgagtggggaggatatattaaaccagatgtttagagagataaacagtttggatattgatgagaggaagaaggttgagttggcagatgctattggtgaaactgactttagaatagttgagggagctaatgaacgaattcaattgagtgctttattagcaaaaatggcgttaatgggaagataa

SEQ ID NO: 24763 - DNA, 1035 bp, Methanococcus jannaschii
atgattttaaaaccagaaaatgaaaaaaagttaataattgatgtcttaaaaaaatttggtgttccagaggaagatgccaaaataactgccgatgtttttgttgatgctgatttaaagggttttacttctcatggaattggaaggtttccacagtatataactgccttaaaattaggaaatataaatccaaagccagatataaagatagttaaagaaagcccagcaacggcagttatagatggagatttgggtttaggtcaagttgttggaaaaaaagccatggaattagctataaaaaaggcaaaaaatgttggagttggagttgttgctacaagaaatgctaatcactttggtatcgctggctattattcagagttagctatgaatcaagatatgattggaataacaataacaaacacagagccagctatggctccttttggtggtaaagagaaaattttaggaacaaatccaattgctatagcatttaaaggaaataagtataaattttccttagacatggctactgcttcaattgcaagaggaaagattttagaagctttaagaaaaaaaataaagattccagaaggttgtgcagtagataaagatggaaagccaacaacagaccctgctaaagcattggaaggatgtatattaccatttggaggacctaaggggtatggtttggcattagctatcgaaatgctgtcagctatcggtggggctgaggttgggactaaggttaaagggactgctaatccagaggagagatgcactaagggagatttatttatagctataaatccagaattttttatggggaaggaggagtttaaaagaaaagttgatgagttgttagatgaaattaaaaactcagagccagcagaaggttttgagatattaatccctggggaaatagaggagaggaataaaatgaaaagaaaggatggatttgaaattgataaaaacttatacaaccaattaaaagaaatttgtaatgagttgggattaaatattgaggactatattgaataa

SEQ ID NO: 24764 - DNA, 987 bp, Methanococcus jannaschii
ttgataattcaaacaccatcaaggattcacatggggcttatagatttgaatggttctattggaagagttgatggaggtattggtttggctttagaggagccaaatataaaaattgaaggaaaagaaagtgatgatatatccattgagtttgataaaaaattgattgaaaagtatggagaagattatataaaatctgttagagatagagtatataatacagctatcaaagttttagatgttattggtggagagggagttgatttaaaaatcctatcactatttccagcccattctggtcttggtagtggaacacagctatctttggctgtaggtaaattaatatcaaaaatatacaataaagaaatgaacgcctacaatattgctaaaattactggaaggggagggacttcaggcattggaataggggcttttgagtatggaggatttttaattgatggagggcatagttttggcaagggtaaggataaagaagattttagaccttcatctgcttcaaaaggagttaagccagcaccaataatatttagacatgattttgattgggaaactatcttaataattccaaaaggagaacatgtctatggaaaaaaagaagtggatatatttaaaaaatactgcccagttcctttaaatgaagttgaaaaaatctgccatttagttttaatgaagatgatgccagcagttgttgaaaaaaatttagatgattttggagaagttatcaacaagcttcaatacttaggctttaaaaaagttgaactctctttacaatcagatattgttaaagatttaattaatgaattgcataaagatgtttatgcaggactttcaagctttggcccaacaatttatgcatttggagacaaaaaattaattgttgaaaaagccaacgatatttttgataaatatggagtttatggagaaataattataactaaagcaaataatgtggggcataaaatttggtga

SEQ ID NO: 24765 - DNA, 3681 bp, Methanococcus jannaschii
atgaaaatcacattttatatgtgggcatcttattgctcaatattaaaaaaggcgttggatgagcttaaaaaagaaggagtagatgttgaatataaaatatattctaacagaaatccaattgatgatgagtttttagaggatgcaaaagattatgatttagtttttatttatagaacatcatcagatgatattgatttagagaagataaagaagttcaatgaaaacgttatagttgttgcccaagacccaaacttttggaattctgaaaaatctgctaaatgttatttatttataacttatggaggtttagataacttcaaaaatatggttttatatctaatgggtaaagataaagatgttgtaaagcatccattccaaggtatctattatagaggcaaaatttatgaagaattagaagaatttttaaaagacgttgagtttaataaaaaatatacggtggggattttattctcaaggcattatttagttaatgatgatatggatgttattgagaagctattaaatagattggacaaagaattcaatgtaattccagtattttcctatggagctaagtgtgaggatttaaatgccttaggtagtggagagagtgttttaaaatacttccttaaagatgataagccaataatagacgccttaatcaatctactgtcatttccattgggaactgtaaaagataaggctaatttaaacaaaatctctggagtagagatacttaaaaagttagatgtgccagtatttcatccaataatgagttattataaaagctatgaggattggaaaaaagatgagcaaggtttatctgcagatattggttggactatagccttgccagagtttgaaggggttatagaaccgattatcattggaactactgaaaatgagaacggcttagagaagaagtttggtattgaggaaaggatagacaaagttgttagaagaataaagagatggattgagctaaaatacaaacctaagaaagatagaaaggttatatttatattgcataacaatgcatgtgcatctgttgaggcaactgtgggaagtgctgcccatttagacagctttcaaagtgttataaacataatgaagaagttgaaggaagagggctactatgtagaaaatattccagaaaatggagaggagttagctcagctaattatgcagaagaaggcaatttcagagtttagatggactaccgtaaatgagattatagctaaaggaggatatctatacttaatggatgaagaagagtattatgaatacttcaacacactgccagagaatgtaaaaaataaaattttagaaacatggggagatttaaatggtaaagacatcccagcaggaatgatttataaagttaatggaaaaaataagatagttataactggtttaaagtttgggaatgtctatgtttgtgttcaaccaaaaagaggatgtgctggggcaagatgtgatggaagagtttgtaagatattacacgacccttattgcccaccaactcatcaatatatagcatcatataaatattttaatgacattgctgacataataatccacgttggtactcatggaactttggaatttttacctggaaaaaacgttggtttatctaacgaatgctatccagacatctgtattggagatattcctcatctctatatttataattcagataatccaccagagggaactatagcaaagagaagaagctatgcaactattattgatcacatgcaaacagttatggttgatgcattttatgaagagttggagacattagatagctatatagaggagtatttaaaggagatggatgcttcaagaaggcatcagttagagcatttgatagttgaggaagttaaaaaaaccaatttattgaaaattaaagaaaaaattgagaagattgaaaaagaagggaaaatccatgagaactttaaagagatatttgatgagctaagagatatcttagagatgataaagaactcgaagtgcaatgatggaatgcatatctttggagaacttccaagtggagagaagagagttgagtttataaagagtattttagaggcgatattcatccagaataatactatgaatagtaaaaggagaggcattgccgagcgaagcgaggcaatgcatccggggtatcccaatagggggcttccccctatggagtttgagtataaagataaaaacctaaagaagaaagtttcagatgtattaaatggaaagagtatagaagataaaaaattagaggagaagattaaggatatcaatgagagaattgaaaaatcagatgagattggctctttgttgagaggcattgatgccaaatatatagagccagggccttctgggctgataacaagaggaaactatgatatcttaccaacaggaaggaacttttactcattagacccataccgaattcctacgaaatctgcttatagagtaggggttttattagctgaaaaattaattaatagatatttagaggaggagggaaggtatcctgaaaacatagctctatattggatggcatctgatataatgtgggctgatggggaaggaatggggatgattttatatctattgggtgttaagccagtttatagaggagggagagttgttggcttagaagttattccattggaggagttgggaagaccaaggattgatgtaaccattagagttagtggaataacaagggatatgttcccaaactgcatagagcttgttgatgaggcaataatgaaagttgctaacttagatgagccattggagatgaactttgtaaagaagcatgttgttgagaacttaaataaaggcctatcatttagagaatcaacatttagaatcttctgctctcctcctggcacttatggaaatggtgttaaatatgcagtgtatgcaagtgcatgggaaaatgatgaagatttaaaagatgcatttatctactggaactcctatgcctatggaaaggatgtctatggaaagaaggcgattaatgcatttgaaaatatattaaagacagttgatttaacatttaataaagttgttacagatgagtatgatttatttggatgttgttgctactttggaacgcatggaggtttaacaaatgccgcaagggttttaaaaggagaagaggttaaggcatattatggagatacaagaaatccaaacaatgttgaagtaagaactttaaaagaagaaattgagagagttagcttaacaaaactcttaaatccaaagtggattgagggaatgaagaggcatggctacaaaggagctggagatatagccaagagaattggcagagtttatggctggagtgctacaacaaaagaggttgagaattggatatttgatgagatatttaatacgttcgtgaaaaatgaagagaatagaaagttctttaaggaacacaacatctatgccttagaagagattgcaaggagattgttggaggcttatcaaagaggattgtggaaaacaactgaagggaatatagaggagctaaaaagggcttatttagagattgagggagatattgaagaaacctatagtagtatagcagatattggtgaattccaaggaggtagtgtagatattgacatgatttggaaggaaaagcttatgagtaatgggagataa

SEQ ID NO: 24766 - DNA, 663 bp, Methanococcus jannaschii
atgatatgtttgccagtagttgaagatagtgtagaaaaagcaataaaaacagctgaaaagtatttagaaatagcagatattgttgaatttaggatagatatgcttaaagaagttagtgaagaagatatagagaaatttgctaagtatccttgcataataactgttagagcagattgggagggtggttattggaagggaaataatgaggaaagattaaacttaataaaaaaggcaattgaatgcaatgccaaatttgttgatattgaattgagagaggagaaaaataaagaacttgtaaaatttagagatgaaattggttcaaaaacaaaaattataatttcttatcatgattttgaaaaaactccttctaaggaaaaattggtagagattgttgaaaaagctcttagcattggagatatagcaaaatttgcaacaatggcaaatagtaaagaagatgtcctcaatatcttagaagtgataaataaatatcctggaaagattattggtattggaatgggcgagaaagggaaactaacaagaatcttaggggtttattttggctcaatattaacgtttgcttcatataaagggaaaagttctgcccctgggcaggttgatattgatacattaaaagaaatctggagactaatggatttaaagtaa

SEQ ID NO: 24767 - DNA, 1290 bp, Methanococcus jannaschii
atggtgactggaatgataattaaaaaaattaaagaattaacaaaggaagaagaggagaaaataattaataggaataaagcaaactttgaggaaatattgccaacagtaatggagattttgaaggatgttaaagaaaaaggggatgaagcattaaaatattatacaaaaaagttcgatggtgtagaaatagaagattttaaagttacagatgaggagatagaagaagcttataactcagttgattataaagttgttgaagctattgagagagctaaggaaaacatttatttcttccataaaaagcagatggagcaaataaaagatttaaatgttgaaaataatggaataattttaggacaggttgttagagcaatagaaaaagttggatgctatgttcctggaggaagggcattttatccttcaactgttttaatgacaacaattcctgcaaaggttgctggatgtgaagagatatatataacctccccacctacaaaagatgggaaaggaaatccagctaccttaatagcaggagatattgttggagtttcagctatttataaggttggaggagttcaagctataggggcattagcctatggaacagagactatcccaaaggttgatattattgtagggcctgggaatatatatgtaacaacagctaaaaagatggtttatggagaagttgccatagatttcttagcaggtccttcagaggttttaattattgctgatgaaacagctaatgcagagtttgttgccttagattttattgcccaagctgaacacgaccctaacgcctcttgtgtaataacaacaacatctgaaaagaaggcagaggagattaaaaacaagatatttgaagagatagaaaaagctgaaagaaaggagattattttaaaagccttagaaaactctgccatattaattggtgatttagaagagtgtattgaattctcaaataaatatgccccagaacatcttgaaatattaactaaaaatccagaggaagttttaaataaaattaaacatgctggaagtgtatttttaggagagtatagcccagttcctgttggagattatgcttctggaactaatcatgttctgccaacttcacagtttgcgagaatgagttctggtttgaatgtagagacatttttaaagaaaataacatatcaaaaattggataaggaaagcttaaaaaatattgctgatattgttatcacattagctgaagctgaaggtttgtttgggcatgctgaagctgttagaagaagattaaaataa

SEQ ID NO: 24768 - DNA, 1299 bp, Methanococcus jannaschii
atgaggaatcctataatagatgtaggggctaaagaattgagttatgaaattagggagattgtagatgtagctaaaaaaatagaagagtttggaataaacataacatgggaaaacataggagacccagtggctaaaggggaaaaaattccagattggattaaagatattatagcagagattgttaaaaacgactgttcttatgcctactgtcctactaaaggtttattagaaacacgagaatttttagccgaacaagtaaataaaagaggaggagttcagataactgctgaagacatcatattctttaacggcttaggagatgccattgcaaagatttatggtttattgaagaggcaggttagagttataaacccatccccatcatactcaacccattcttctgcagaggcatcccatgctggctctcctccagtaacttacttcttagacccttacaactactggtatccagacattgatgatttggagaagaggattaaatacaacccagcagttagtggaattttggttataaatcctgacaacccaactggagcagtatatccaaaaaaaatcttaaatgagattgttgatttagccaatgaatatgatttatttattatttgtgatgaaatatactgtaacttagtatataatgggaaaaaacagcatttactatgtgaggttatagatgatgtctgcggtttatctttaaagggtatatcaaaagaacttccatggccaggggcaagatgtggatggattgaaatttacaatgccgataaggatgaagaatttaaaaaatacgttgagagtatttataaagccaaattgatagaggtttgctccactacattgccacaaatggctattccaagaattatggggcatagaaattacaaaaaatacttagaggagaggaataggttctttgaaaaaaggtcaaacacagcctacaaaaaactaaaagatttagatggtgttatagcaaataaagccaatggagctttctatatgtctgttgtatttgaagataactatttaaatggaaacaattcaataaaaatagagaatgagaaattgaaggaatttatagaacaccaaataaaagatgcatctatagataagaaatttgtttattatctcttagcatctactggaatctgtgtagttcctctaacctcattctgctctcaacttaacggatttagagttacattgttagagagagatgacgaaaagtttgaatggatatttgacacattagctgaaaaaatagatgaatttttaaagacctaa

SEQ ID NO: 24769 - DNA, 1182 bp, Methanococcus jannaschii
ttggtgaaatttatggcaattgggacacctcttttgaaaggaagtataaaatttttgttgttaggaagtggagagttagggaaagaagttgttattgaagctcagagattgggaattgagtgtatagctgttgataggtatcaaaacgccccagctatgcaggttgctcacaagagctatgttattgatatgaaagattacgatgcattgatggcaattattgagagggaagagccagattatattgttcctgaaattgaagcaataaatacagatgcattaatagatgctgaaaaaatgggttatactgttattcctacagctgaagctacaaagataactatgaatagggagttaataagaagattggcagctgaaaaattaggattaaaaactgctaagtatgaatttgcagattctttagaagagttgagagatgccgtagaaaaacttggcttgccttgtgtagttaagccaattatgtcttcatctggaaaggggcagagtgtagttagaagtgaagaggatatagagaaagcttggaagatagctaaagaaggagcaagaggaataggaaatagggttattgttgaagaatttataaactttgattatgagataaccttattaaccgcaagaactgctgaaggaactaagttttgtgagccaataggtcatgtccaaatagatggagattatcatgaaagctggcaacctcataatatgtctgctgaattaaaagaacaagctcaagatatagctaagaaggttaccgatgctttaggtggttatggaatctttggtgttgagttgtttgttaaaggggatgaggttatatttagtgaagtttcaccaagacctcatgatacaggaatggttacaatgataactcaagaaatgagtgagtttgaaattcatgttagggctattttaggtttgccagtatcaacaaaacttattcacccaggggcaagccatgtaataaaggcagagataaataaatatgctccaaagtatcatatagaggatgctttaaaagttccaaatactaagttgagattgtttggaaagccaaatgcaaaggttggtagaagaatgggagttgctttagcttatgccgattctgtagagaaggcaagggaattggctgaaaaatgtgctcatgcagttagaattgaatga

SEQ ID NO: 24770 - DNA, 2049 bp, Methanococcus jannaschii
ttgatttcttcgtatggggatgtagatatggaattgagagatgaagacttaattttagaggaagttagggattatttaactgcctatttaagaaatattcatcaggaagatattatcttagacaatgaaagagttgtagttgatttaaatcaactctacaattacggattaatggaatttgtagaatttttaataaataatccacaaaaagggattgattttataaaagagtgctacaacgatgcttattacaccttaagaaatgaatatccaacaaacgtaataattgctgtaaaaaatctcccaaaaatttttaaaactacaagaaaagggaaaattttcacaatagaggatattaggagcaaaactttaggaaaattagttgaatttgaaggaatcattgttatggcatcaaaaataagaccaatgcttaaaaaagcttattatatatgtccaaaatgtggaagagaagttgttagagaaatagatatcttaaacactgactctgaaaaagctgtttgtgaatgtggagctgagttaaacctaattgagcataaatcaatatatactgacttccaagagattaaagttcaacagccattggatttaatggaaaatcctgaagagccgccaaaatacataactgtgttcttagaaaacagtcctggaatatatgctggaagggtgaagataactggcatcccaataaaagttaagaagagtaaaaagctaccaatctatgacatacatgttaaagccctacactgtgaggttttggatggggaagtaaaaattaaattaacaaattcagatattgaaaatattaaaaaaatagctaaaagaaaagatgttgttaatatacttgcagatagattaattccagagattaaggggcattctgcaataaagaaggctgtcttactacaacagataaagggagttaaaaaacctggaaagagggctgatattcatatattattaatcacagacccaggaattggaaaaacagtcatactaagaaagattgctgaaatcccaggaaatttatacggttctgttactaccgccactggtgttgggctaactgccgctgttgttagggagaagacagagattggtgaagatacatgggttattaagccaggtttgttagttaaagcccacaaaggaactgcatgtatagatgagctaactgttaataaagaactgcagagctatgttttggaggctatggagagtcagacaatccatattagtaaaggaggaataaatgcaaaacttccagctgaatgtgcaattttagccgcttgcaatccaagatggggaagattcaacccagaggtttctgtagctgagcagataaatattccagccccattattgagtagatttgacctaatatttccaattagagatgtttctgataaggataaggataaagatatcgctgaatacattgtagatttgcatagagcatatttagatgagaaaataaacagggagatgggtttagattaccttgaggttgatggagttaaaatagacaaggaatttataataaaatatatctactacgcaagacagaaaaagccgataattagtgaaaaggctaaggaattatttgttaattattatgtagagatgagaaaaaaacatcagataactgcaaggcagttagaggctgctataaggattgctgaagctcatgcaaaggcaaagttaaaggatgttgttgatgaggaagatgcaaaggaggcaataaatataataactgaatgcttaaaagaaattgcctatgacccagagactggaatatttgatgttgataaaattttaggggtgtctaagaaagagagagacaaattaacaaccgtctatgagataattaaggagttatctgaaaaatcagaacttgttgaacatgaagatatagctgaagaagcaaaaaagaaaggtattaaagaggatgagttggaaaatattattaaaaaattaattaaatatggagatatagatgaaccaaaaccagggaggtatagattgttataa

SEQ ID NO: 24771 - DNA, 1116 bp, Methanococcus jannaschii
atgagtaaaattggatttaatccaataaaaataaaatctttttcaaagattaaaacttacgatgatacattaccatcattaaagtacgttgtattagagcctgcgggattcccaatcagggttagtagcgagaacgttaaagtttctactgatgatcctatattattcaacatctatgcgagagaccagtggattggcgagattgttaaagagggagattacttatttgataactcaatccttccagattatgctttcaaggttatttcaacttatccaaaagagggaggaatgattacaagcgagactgtctttaaattacaaactcctaaaaaagttcttagaacacagtttaaaaaagctaagttcagcgagattattgggcaggaagaggcaaagaagaagtgtagaattattatgaagtatttagagaatccaaagctctttggagaatgggctccaaagaatgtgttgttctatggtcctccaggaactggaaagacattgatggcaagagctttagctacagagacaaactcctcatttatattggtgaaagctccagagcttattggagagcatgttggagatgcttctaaaatgattagggagttgtatcaaagagcatctgagagtgctccatgtatagtgtttattgatgaattggacgctataggattaagtagggaatatcaatcattgagaggagatgtttctgaagtagttaatgcactattaactgaattagatggaattaaagaaaatgagggagttgtaactatagcagcgacaaacaacccagcgatgttagacccagcaattagaagtaggtttgaggaagagattgagtttaagttaccaaatgatgaggagagattgaagattatggagctttatgctaaaaaaatgccacttccagttaaagctaacttgaaggagtttgtagagaaaacaaaaggatttagcggtagagatatcaaagagaaattcctaaagccagcgttacatagagcaatattggaagacagggattacgttagcaaggaagatttagaatgggcgttgaagaaaatattaggcaatagaagagaagctccacaacacctctatctctaa

SEQ ID NO: 24772 - DNA, 660 bp, Methanococcus jannaschii
atgttgatagtaattaactataaaacatacaatgaaagtataggaaatagaggtttagagatagctaaaattgctgagaaagttagtgaagaaagtggaattacaataggagtagctcctcaatttgtagatttaaggatgattgttgaaaatgtcaatattccagtttatgctcaacatatagataatataaaccctggaagtcatactggacatatattggctgaagctattaaagattgtggttgtaaaggaactctaataaaccattcggagaagagaatgctgttggctgatattgaagcagttataaataaatgcaaaaatttaggattagaaacaattgtctgcacaaataatataaacacttctaaggcagttgcagccctaagccctgattatattgctgttgaaccaccagagcttataggaactggaattccagtatcaaaggcaaatccagaggttgttgagggaactgttagggcagttaaagagataaacaaggatgtcaaagttttatgtggagctggaatttctaaaggagaagatgttaaagcagcccttgatttgggagctgagggtgttttattagcttctggagtagttaaagcaaagaatgtagaagaggctataagagaattaataaagttcatctaa

SEQ ID NO: 24773 - DNA, 1038 bp, Methanococcus jannaschii
atggcgggtattgttggttatggagcatacatcccaaaatataggataaaagttgaagaaatagcaagagtatggaacaaagacccggaatcaataaaaaaaggacttttggtatatgagaaagcagttccaagcttggatgaagacactgcaactattgcagttgaagcagcaagaaatgcattaaaaagagctgaaatagacccaaaagacattggagctgtttatgttgggagtgaaagccacccttatgcagttaaaccaactgctacaatagttgctgaggctatagatgcaactccagacttaactgcagcggatttagagtttgcttgcaaagctggaacagcaggaattcagatgtgtatgggattggttgagagcggcttaatcaaatacggattagctattggggcagatactgcccaaggagctccaggagatgctttggaatacacggcagcagctggaggagctgcctatataataggaaaatcaaacgttatagctgaattcaacggcacttattcatacacaacagacaccccagacttctggaggagagaaggaaagccatatccaagacatggaggaagatttacaggagagccagcatactttagacatgtaattaatgctgctaaaggattgatggaaaaaatgggaacaaagccagaagattatgattactgcgtattccaccaaccaaacggaaaattctatattagggtagctaagattttgggctttaaggaagagcaatataaaatagggctattaaccccttatattggaaacacttactcaggagctgttcctttagggttatcaaatgtcttagataattgtgaaggtggagagagaattttagcagtctcctatggaagtggggctggaagtgatgccttcgacataacagtaactgatagaataaataaagtcaaagacaaagctccaaaaacagcctattacttagagaggaaagaatatatcgactatgcaatatatgccaaatttagaaagaaaattaagatgtga

SEQ ID NO: 24774 - DNA, 1179 bp, Methanococcus jannaschii
atgagagatgttgccattatcggctatggacagacaaagtttggcgagctatgggaaagaagttttagaagcttgattgttgaggctggtgttaaggcagttgaagctgcaggtatagatgggaaggatatagatgagatgtatgttggaaacatgagtgctggtttgtttgttggacaggagcatatagcctctttaatagctgagcatgctggtttaaacccaattccttcaacaagggttgaagctgcttgtgcatctggtagcttagctttaagacaagctgttttaaatgtagcgagcggggcaagtgatgttgttttagttggtggagtagaaaagatgactgatgttgttgatgcaacctctgcaatatcatcagcttcagaccaagaatgggaggctttgtttggagctacttttccttcactgtatgctatgatggctcagaggtatatgtatgagtatggcttaactttagaggagttatcaatgtggagcgttatcatgcatgaaaacgcctcaaaaaatagatatgcacaattcccatttaaggttacattggagcaggttctcaactcctcaccagttgctgagcctttaagattactacattgctcaccagtttcagatggtgctgctgcccttatagtatgtgaagcagaaaaggctaaagaatttgtaaataaagatgatatcatctacatcaaagcaagtgttcaagcatcagatacaattgcattacacagcagagagagcataacaagcttaaaagctgctaaagttgcaagtgaaaaagcatataaaatggcaaatatagaaccaaaggatgtggatgtcgctgaagttcatgactgctttgctataaatggtttaatattgatggaggaacttggtttctgtaaaaagggagaggctggaaagatagtttatgataaaaagatagctattgattatgatggcttcccagcagtaaatccaagtggagggctgaaagctgctggacatgcattaggggctaccggtataaggcaggttggagagatttactggcagttaaagcaggataaggaggttaaagataggcaggtagagattaaaaatggctatggaattactgtaaatgtcggagggactggagggactgtatgcatccatatattgtctgataagagataa

SEQ ID NO: 24775 - DNA, 921 bp, Methanococcus jannaschii
atgaagcatctaatatcaatgaaggatattggaaaagaggagattttagagattttagatgaagcaagaaagatggaagagcttttaaatacaaaaagacctttaaagttattggaagggaaaatattagcaactgttttttatgaaccatcaacaaggacaagattgagttttgaaacggcaatgaagaggttaggtggagaagtaataacaatgactgatttaaaaagctcttctgttgcaaagggagagagtttaatagatacaattagagtaattagtggatatgctgatataattgttttaaggcatccaagtgaaggagctgcaagattggcaagtgaatattctcaagttccaattataaatgctggggatgggagtaatcagcatcctactcaaactcttttggatttatacacaataatgagagagattggcaggatagatgggataaagatagcgtttgttggagatttgaagtatggaaggacagttcattccttggtctatgccctatccttatttgaaaatgttgagatgtattttgtatctccaaaagaattgagactaccaaaagatattattgaagatttaaaagctaaaaatataaaattttatgaaaaagaaagtttggatgatttagatgatgatatagatgttctatatgtaacaagaatccagaaggagaggtttccagaccctaacgaatatgaaaaggttaaaggtagctataagataaagagagagtatgtcgaaggaaagaagtttataattatgcatccattaccaagagttgatgaaattgattatgatgttgatgatttacctcaagcaaagtattttaagcagagtttttatggaattccagtgagaatggccattttaaagaagctaattgaggataatgaaggtgaatag

SEQ ID NO: 24776 - DNA, 1044 bp, Methanococcus jannaschii
atgatgaaggtgtgtgttatagaaggggatggaataggaaaagaagtgattccagaggccataaaaatattaaatgagttgggagagtttgaaataataaaaggagaggcaggattagaatgtttaaaaaaatatggtaatgcacttccagaggatacaatagaaaaagctaaagaggcagatattattttgtttggggctataacctcaccaaagccaggggaagttcaaaattataaaagccctataataacgttgaggaagatgtttcatttatatgcaaatgtaagaccaataaacaactttggaattggacaattaattgggaaaattgcagattatgaattcttaaatgctaagaatattgatatagttattataagagagaatacggaagatttatatgttggtagagagagattagaaaatgatacagcaatagctgagagggttataacaagaaagggtagcgagagaataataagatttgcatttgaatatgctataaaaaataataggaaaaaggtatcttgcatccataaagctaatgttttaagaataactgatggtttattcttagaggtttttaatgaaataaaaaaacattataatatagaggcagatgattatttagttgattcaacagctatgaacttaataaaacatcctgaaaaatttgatgttattgttacaacaaacatgtttggggatattttatcagatgaggcatctgcattaattggaggacttggtttagctccttcagcaaatataggagatgataaagcattatttgagccagttcatggttcagctccagatatagctgggaaaggtatagcaaatccaatggcatctatattaagtattgctatgctttttgattatattggagagaaagaaaagggagatttgattagagaggcagtgaaatactgcttaataaacaaaaaagttactcctgacttgggaggggatttaaagacaaaagatgttggagacgaaattctaaattacattagaaagaagttaaagggatattga

SEQ ID NO: 24777 - DNA, 1011 bp, Methanococcus jannaschii
atggatataattatagtaggatttggagctataggaaaaggaattgctaaggtcttgtatgataaaaaagattatttaaaaaagaactatgaggaatttaaggttgttgctataacagatagctctggagctgcaatagatgaagatggcttagatttactaaaagcaatagaagttaaagaaaaaactggaaagattaaaaattatccagagaaaggaagagagatgagttcaatagatgttataaaagaagttgatgcggatgttgttgttgaagtaacaccatcaaacttagaaacaggagacccagctaaaactcatatattagaaagctttaaaaataaaaaacacgttgtaacagctaataaaggaccgttagctttatgttataaggagttgattgaagaggcaaaaaaacatggagttattttcagacatgaggcttcagttggaggggcaatgccaataataaacttggctaaagagacattagcaggaaatgaaattttatcaataaggggaattttaaatggaacaaccaactacatactaacaaaaatggagaaagagggtttagattttgaaactgcattaaaagaggctaaagagcttggaatagctgaaacagacccaactcaagatattgagggtttagacactgcagcaaagattgttatcttagcaaactcaattatgggcatgaataaaacaataaaagatgtaaaagttaagggaataagtagaataactccagaagctctatttttagctaataaaagaggatacacaataaaattaattggacagattaaagatggctatttaattgttgagccaatgcttgttccaatagacagcccattaaatgtcaagggaactttaaacgttgcaatgtttgaaactgatttggcaaaagaggttgtagttgttggaagaggagctggacctatagaaacagcttcagctattttaagtgatttaatccatatctacaattctactaaaaaataa

SEQ ID NO: 24778 - DNA, 1206 bp, Methanococcus jannaschii
atgctaagttatgattacgaaaacgctttaaaagttggagaaataagccttgaagatatcaataaagtagattttgcaaatgcatattcaaacttgatggagaaattggataatggagttgtaggatttagagatgttatttatgatgagaacttagataaatataaatctttaaatggatatgaaaatgttgtagttattggaatgggaggctccatattgggaacaatggctatttattatgcaatttcaccatttaacaataatgcctattttatagacaacagcgaccctgaaaaaaccctctcaatactaaaaaaagttgatttaaacgaatctataatttatattattagtaaatctggcaacacattggaaactttggttaattattatctaattaaaaaaagaattgaaaaattaaattcatttaaaggaaaacttgtttttattactaatggtgggaaattaaagagagaggcagagaaaaataactatgatatattttcaattcctgaaaatgtccctggaaggttttcagtctttactgctgttggtttagctcctttatattctttaggagttgatatatcaaaaatattagaaggagcaagagagatggacaaaatctgtcaaaatgaagatattttaaaaaatcctgcacttttaaatggggttatacactacctatatgataagagaggaaaggacatctcagttattatgagttatgttgaaagcttaaaatattttggagattggtataaacaacttattggagaaagtttgggaaaaaataagcatggaataactcctttattatcaattggagccaaagaccaacattctttattgcagttgtatatggatgggaagaaagacaagattataacattcatggttgctaaaaaatataggttagatgaagaaatagaatttgaagacataaatgatgagaaaatttcttgcagatattcagatataattaggagccaacaaaaagctacagagatagctttaacaaataatggagtcccaaatgtaagaataacccttgatgaaataaatgagatggctatgggggctttactatacatgtatgagatgcaagttggttttatgggggagctttacaatataaacgcctacaatcaaccagcagttgaagaggagaaaaaaatttgctggagattgattaaacaataa

SEQ ID NO: 24779 - DNA, 1566 bp, Methanococcus jannaschii
atgaaaatagtcatccttgctccaacaataacccctattgtctcttatggaggattaggggatgtaatgagagacttgccaaaatttttaaaaaaaggtaatgaagtagttgttctaactctaaaccattataataggtattttactcttccctatgaagatatcaaaaaaataactgttatctataaaggagctaaaattacatttgatgttttaagaacaaagcatccaacgacaggagtagatttaattgtatttagtaatgaaagtgtcaataacttaaatgtttgggaccctattaagtatgaaatttttgctgatttggttattacatatttagatgaggttaaagatattgatgtagtgtctgggcatgattggatgtgtggtttagctatagccaaatgcaacgatattttagatttaccaacaaccttaaccatacataatgaggcatttaaaggagagatgattgagtataaaggggaagttatgacatttttggagttaggaattaagtatgcagatgccgttaatacagtaagcccttctcatgctgaggaaataaaaaactacccttatataaaaaaatacttaaataataagccattctgtgggattttaaatggaattgatattgatgaatacgaccccatgaagataatagaaaggatgtgcaacctctcaaacaacaaacttgacccaagaaattatgcttatatctctccctattcagctgaagattcccataatataaaaccaaaaataaaatattcatggttttatagaggaggagtttatgaatatgtggaagattggaataagattgataaaggaatatcagctactgatgttgaggtccatggtggggtagatggagatatagaaactccattaattggttttgttggaagggcgacacatcaaaaaggttttaacaccatgtttgaagcaattccagaacttttagaaaaacatgatataagatttgtatttttaacaaagggggatagagatattgaagagagactaaaaaatcttgcaaatgaacatgatggaagaatcttggcattgataggctattccctcccactctcatctttagtatttgctgggagtgattggataattatgccttcatactgggaaccgtgtggtttagtgcaaatggaagctatggcatactgcactccagtcatagctacagaaactggaggtttaaaagataccataattcctcttcatccaaatccttatgaacatccaaattttgataaggcaacgggtgttttatttaaagttccagataaagtggggtttatgtggggggttgagcacgcattaaattggacattctataaacttaatgaaatatgtatgtttatgcagtatataagatataaatgccctaaacatccttatgatgagaactccccattatctatgatgatgaaaaactgctactatcacgtgtttagaaacttaagctggcagaactccccatctataagaaagtataagggcttatttggaggagcaatttataatcactatctacaaccataa

SEQ ID NO: 24780 - DNA, 1173 bp, Methanococcus jannaschii
atgaaaattgctatggtaacttgggaatatcccccaagaattgttggagggctggcaattcattgtaagggcttagctgagggattggttaggaatgggcatgaagtagatgttataacagttggctatgacttgcctgagtatgagaacataaatggggtgaatgtttatagagtaagaccaatatctcatccacattttttaacttgggctatgtttatggctgaagagatggaaaaaaagttaggaattttaggagtagataaatatgacgttattcattgtcatgattggatgacgcactttgttggagctaatttgaaacatatctgcagaatgccgtatgttcaatcaatacacagcactgaaattggaaggtgtggggggctttattcagatgactcaaaagctattcatgcaatggaatacctttcaacttacgaatcctgtcaagtaataaccgtaagtaaatctttaaaggaagaagtttgctctatatttaatactcccgaagataaagttaaagttatctacaatggaataaatccatgggaatttgatattaatttaagttgggaggagaagataaactttagaaggagtataggagttcaagatgatgaaaaaatgattttatttgttggaagattaacatatcaaaagggaatagagtatttaataagagcaatgccaaaaattcttgaaagacataatgcaaaattagttattgcaggttctggagatatgagggattatttggaagatttgtgctatcagcttggtgttaggcataaggtagtgtttttaggatttgttaatggagatacgttaaaaaaactctataaatctgcggatgttgttgtaattccatcagtttatgagccatttggtatagttgctttagaggcaatggctgctggcacaccagtagttgttagctcagttgggggcttaatggaaattataaagcatgaggtcaatgggatttgggtctatccaaaaaatcccgattcaattgcctggggtgtggatagggttctatcggattggggatttagagaatatatagtcaataatgccaaaaaggatgtgtatgaaaaatatagttgggataatatagctaaagagacagtaaatgtttataaaatagctatggagatgatgggacgataa

SEQ ID NO: 24781 - DNA, 1491 bp, Methanococcus jannaschii
ttgtttttaaaaaaactaattgaggcaaagaaggcatatacttttgatgatgttttattagttccaaatgcctcatgggtagagccaaaggatactgatgtttctacagacttagcgggtttaaagttaaacatccctatagtttctgcggcaatggatacagtaacagaaaaagagatggctattgctttagcaagattaggaggtttaggagttatacatagaaacatgtccatagaggaacaagttcatcaagttcaggcagttaaaaaagctgatgaagtagttattaaggatgttatcaccgtatctccagatgatactgttggagaggcaataaatgtaatggaaacatactccatcagcggattaccagttgttgataatgaagataaattagttgggattataacacacagagatgttaaagccattgaagataaaacaaagaaggttaaagatgtaatgactaaagatgtcgtttgtgctaaggaagatgttgaagaagaggaagctttagagttgatgtatgcaaatagggttgaaagattacctatagttgatgatgaaaatagactaattggtattataaccttgagagatattttaaagagaagaaagtatcctcaagctgcaagggataaaaaaggtagattgttagttgctgctgcctgcggaccacatgactttgagagggctaaggcattgattgaagcagaggttgatgccattgccattgactgtgctcatgcccacaacatgagggttgttgaaaatgtaaagaaatttaaagagatgttagaagggactgacataaaattaatagttgggaatatagcaactaaagaagcggcagaggatttaattaaagctggagcagacgttttaaaagttggaatagggccaggttcaatctgcacaacaagagttgttgctggagtaggagttcctcaattaacagccgttgctgaagtggctgatgttgctaaagaacataacgttccaattatagcagatggaggaataagatacagtggagatattgccaaagctatagcagctggagcagatgcggttatgcttggctcactgttagctggaactgatgaagctcctgggcagttaatggttatcaatggaaggaagtacaagcagtatagaggaatggggtcattaggagcaatgacaggaggagttggagctggggctgatagatacttccaagcaccagcaaaaagccacatgaaacatgtaaaattagttcctgagggtgttgagggagctgttccttataaagggcctgtaagtgaagtagtattccaattaattggtggtttgagagcttcaatgggatactgtggagctaaaaacctaaaagaaatgcaagaaaaggcaagattcgtaataataacaccaagtgggcaagttgaaagtcatcctcacgatataattataactaacgaagctccgaattatccactgggtaaataa

SEQ ID NO: 24782 - DNA, 3510 bp, Methanococcus jannaschii
atggttactttggaaaaaatagaactaaaaaactttaaatcatttaaaaaattatctttagatattccaaagggatttacagccatagttgggcctaatggtagtggaaaatctaacatagtcgatgctatattatttgtgcttggaaaaacctctgctaaaaaattgagagcaaatagattcagcggtttgataacctaccacaacggaaagagggcagattttgctgaagtttgtttatattttacaaatgagaataatgccttcaatgttaatgctgataaagtaggaattttaagaaggataaagagtagtggagagacagactattatttagtttggaaagagaacgataaggagaagagaaagaagatgactaagcatgaaattattgatttatttagaagattggggcttttaggagataatgttatttcacaaggagatttgttgaaaattatcaatatctcaccaattgagagaagaaagattatcgatgagattagtggaatagcagagtttgatgaaaaaaagaagaaggcagaggaggagttaaaaaaagccagagagttaattgagatgattgatataaggattagtgaggttgaaaacaatttaaagaagcttaaaaaagagaaagaagatgcagaaaaatatataaaattaaatgaagagctaaaagctgctaagtatgctttgatattaaaaaaagttagctacctaaatgttcttttagagaacatccaaaatgacattaaaaatttggaagagcttaaaaatgaatttttaagcaaggttagagaaattgatgtagagattgagaatttaaagcttagattaaacaacatcataaatgaactcaacgagaagggcaatgaagaagttttagagcttcataaatcaattaaagagcttgaagtagagattgagaacgataagaaggttttagatagctcaataaatgagctaaaaaaggttgaagttgaaattgaaaataagaagaaggagattaaagaaactcaaaagaagattattgaaaatagagacagcattattgagaaagaacagcagataaaagaaattgaagagaaaatcaagaatctcaactatgaaaaagagagattaaaagaggctattgctgaaagcgagagcatcatcaaacacttaaaagaatctgagatggagatagctgatgaaatagctaaaaaccagaacgaactctataggctaaaaaaagaattaaatgatttagataatttgataaacagaaagaattttgaaattgaaaaaaacaatgagatgattaaaaagttaaaggaggaacttgaaactgttgaagacgttgatactaagccattgtatttagagcttgaaaatttaaacgttgagattgagttttcaaagagggggattaaagaacttgaggaaaaaaagaaagaactacaagctaaattggatgagttacatgctgagtatgttaaagagaatgcaagaatcaaggctttaaaggagatggaagagctatctatggatagggcaattagagagatattgaatgccaacttaccgggaattatcgacattgttggtaatttaggaaagacaaaaattgagtataaaacagctatagaagtagcagctggaaataggctgaatcatatagttgttaagagaatggatgatgcagttagagctataaagtatttaaaagagagaaagcttggaagagccacgtttttgccattggatagaattgagggcagagaggcgtattatattgatgaagatggagttattggtagagctattgatttagtggagtttgatgaaaaatataggagagtttttgagtatgtgtttggaaacactgtagttgttgaaaatattgatatagctaaggagttggctaaaaaatacagaaaggtgaggtttgtaacattagatggagatgttatagagccgagtggggcgatgattggagggacttttaaaagtaaggcaaagataaaggttgatgttgatttaagtaagctgaataagatagctgatgaaattatagccattgagagtgagttgaggaagataaaagaagaaattgagagattaagtaagatagtaaagagaagttctgccaaaaaaatggagattgaaaatacattagagataattaaaaagaatgaaatgaggaagagagagattgctgaaaagaacactataaagataaaagagttggagttgaaaaataaagatattttagaggagttggaggagttgaatcttaagagggaggagattttaaataggattaatgaaattgagagtaaaataaatgagttgattgaaagaagggagaagataattaatgagctgaaggagtatgaaagtgatgaaaacttaaagagaatgaacgaaattgaaggggaattaaagattttagagaaagagaaagccaaattaaaaaatgagattgataaagggcttactttagttaaagagatattaattccaaagattgaggaactgaataagaaagtctctgagctaataaataaaaaagtcatattggagaagaatatatcgttctataaagagagtattgaaaaaaatctatctatattggaggagaagaggaagagatatgaggaattagctaaaaacctaaaagagctgaccgaaaaaaaggaacagcttgagaaagagatagaaaccttagaaagagagagaagagagatattaaggaaagttagagacattgaaaacagaataaacgaactcatggttgaaaaggcgaagtatgaaagtaagttggaggaagaggagagaaagctttatctatgcgaaaaagttgatgtaagtaaagagttggagaaaaaagacattgaagaacttgagatatatataggagagcttgagaatgagataaaaagcttagaaccagttaatatgagggctattgaagactataactatgtggcagagagatacaaggagttgatagaaaaaagaaaagagtatgagagagatgagaaaaaatatctccaattgatggaagagcttgaaaataaaaagaaagaagtctttatggaggtttttaacaaggtagctaagaactttgaggaagtatataaggagattggaggtattgggaagctgagcttagagaatgagaagaatccatttgaaggagggattttgatagatgcatctccaagaggcaaaaagcttttaagcttagatgctatgagtgggggagaaaaatcattaacagctttagcatttttatttgctattcaaaggctaaatccttcgccattctatgtattggatgaagttgatgccgctttagatgtaaaaaacgtctctttaattgctgatatgattaaaaacgcctctaaagacagccaatttatagttataagccatagagaacagatggttagtaaggcagatgttgtttatggtgtttatatggaaaacggtttaagtaaagttgttggtattagattataa

SEQ ID NO: 24783 - DNA, 2286 bp, Methanococcus jannaschii
gtggctgaaattatgacagcgttaataatctgtgaaaaaccaagtgttgccaaaaagatagcaaacgctttaggaaaagctaagaaaaaaagcattgatggagttccatactatgaattagaaagagatgggaaaaaaattatagtagcaagtgctgttgggcatctatttaccttagttgaaaaagagaataaagaatttggcttttatccagtatttgatataaaatgggtgcctgcaagtgttgataagggaaaagagtatgtaaataaatacataaaggcattaaaaaaactatcaaaagatgcagatgagttctatatagcaacagattgggacattgaaggggagctaataggttatcacgcattaaaatattgttgtggaagagaaaaggcaaagagaatgagattctcatcattaacaaaaaaagagatagttagagcatttgaaaatccggatgagattgattacggcttagttgatgcaggagagagcaggcatattttagattggtattttggtataaacctatcgagagctttgatgaacgccataagggcagtgaatagatggaaaacgatgagtgttggaagagttcaaggtcctgcattagcttttttaactgaaagagaattggaaattaaaaaatttatcccaaagccgtattgggttattgaggcactattaaaagataatttaaaggcaatacacgagaaagagaaattttggaatgaaaaagaggcaaaaaatgtttatgaaaaaataaaagatgaaaaatctgccaaagttgttgaaataaagaaaacaaaaagaaagttaaagccacttccaccttttgacttaggaactctacagagagaggcatatagttattttaaaatatctccaaaggaaacgcaagaaattgcccaaaagctttatgagaatgctctaattagctatccgagaacatccagccaaaaacttccaaaagatagaaagtatttggaagatattctaaatataataaaaaatcatccagtttatggaaaatgggcagagagaattttaaaagagaatttaaaaccagttgaaggaaagaaagaagaccctgcacatccagctatacacattgtagatattccaaaggaagaactttcagaaaaagagaaggagatttatgatttaattgcaagaagaactttagctgctttttgggataatgcagagagggaatatttaaatgtaaaaattgacattaaaggagagaagtttaagttatctggttcaaggacagtaaaagaaggatggcatgaaatttattacttcccaaaatttgatgagattgaattgcccccattaaagaaaaatgacataattaaagttgaaaagataacaataacaagaaaagaaacgcaaccaccaaaaagatacactgttgcaagcataattaaggaattagagaaaagagggctgggaacaaaagccactagggcagagatcatagacaaattaataaaaaggggctatgtcattgatgatggttctttaaaagtaactgacttaggaatttcagtaatcgagacattaaaaagattctgcccagaaattatcgatgaaaagatgacaagggatttagaggaaaagttggagaaaatacagtttagaaaaattaaaaaggatgatgttttagatgaggctgaaaaaagattaagaaaaatattggaagaatttaaaaagaaagaggaagatattggaatctaccttatcaaaaacttagatgccacaaataaaaaagcaaaaattgttggaaaatgtcctaaatgtggaggagacttaattttaataagacataaaaagggcaggtttgttggctgctctaactatcctgaatgtgatgtaaaatactccttaccagataaaggtaggataaaaattccaaacaaagtttgtgatgcatgtaaatcacctattttaaaaataggagatagagagatatgcataaatccagaatgtcctttaaaacaagtagaggttaaagaagaagataggatttgcccaaagtgcggagctaagctaattttaaagaaaggagtttatggagcattttatggttgttcaaactatccaaagtgtaaatatacagaaccaataaataaaaaagaagttgtaggaaaatgccctaaatgtggaggagatttagttgttagagaaggtaagtttggaaagtttgttggttgctctaactatccaaagtgtagatatactgaaaaactaaaactaaatgaaaaagaagaaaaataa

SEQ ID NO: 24784 - DNA, 552 bp, Methanococcus jannaschii
ttgttattagaagaaacattaaaatcatgcccaattgttaaaagaggggagtatcattactttattcatccaataagtgacggagttccagttgttgagccaaagttattgagagaggtagcaacaagaataataaagataggagactttgaaggagctaccaaattagttacagctgaagcaatgggtattcctttggtaactaccctctctttatacacagatataccttacgtgattatgaggaaaagagaatataaattaccaggagagattcctgtctttcaatctactggatatagcaaagggcaactctatctaaacggaatagagaagggagataaagttgttattatagatgatgtcatctcaactgggggaacaatgattgcaataatagatgctttaaaaagggctggagcagagataaaagacattatttgcgttattgaaagaggagaagggaaaaagatagttgaagaaaaaaccggatataagataaaaaccttggttaaaattgatgttgtagatggaaaggttgttattttataa

SEQ ID NO: 24785 - DNA, 486 bp, Methanobacterium thermoautotrophicum
atgatcataaccatcggtggtctggcaggaaccggcacaacgacagtcgccaggatactctctgagaggatgggtatcccctgtgtatctgctggagatgtcttcaggcagatggctgctgagagggaacttgacatccttgaattcagcaggattgcagaggaaaaccctgaaattgacattgaaattgacaggagacaggccagacttgcagatgaacacgaggacctcatacttgagggcagactctctgcccacttcgcaagggccgaccttaaggtgctcctcatagcgcccttcgatgtcagggcccagcgcataagtgtccgggaatcaaaggacatagagacggtcagagaggagatccggatacgtgagaggagcgaggcccagaggtacagggagattcatggaatagatgtggatgaccttgaggtatatgacattgtgataaacaccaaccgttttgacgccgaggctagctga

SEQ ID NO: 24786 - DNA, 1251 bp, Methanobacterium thermoautotrophicum
atggaaagtattattgaagatgttagagtaaggaaaattcttgacagcaggggaaacccgacggttgaggttgatgttataacctggaacggctttggaagggctgcagcccccagcggtgcaagcacaggttccagggaggttgcagccttcccatcagggggggttgatgagataataacagaggtcgaggatataatctcctcagaactcataggaatggatgcagtggacctccaggacatagacctcgtcctaaaggagatcgacgggaccgaaaatctctcatctctgggaggtaacaccgtggtggctgtttcaatggcaaccgcaaaggcagcagcatcatcctacaacatgcccctctacaggttcctcggcggaaaccttgcaacatccataccctaccccctgggtaacatgataaatgggggggcccacgcaggaaaaaacgcccctgacatacaggagttcctggttgtgcctgtgggtgctgaggacataaccgaggcggttttcgcaaatgcagccgtccataagaggataagggagctcatccagaagaaggacccgtcctttgcaggaggtaagggtgatgagggcggatgggtgcccagcctctcaaacggggacgccctggagatacaggccactgcctgtgaggaggtaacagatgaactcggtgttgaggtgagaccatcgctggaccttgcagcgagcgaattctgggaccctgagattgagaagtacgtctacaggcaggagaacgtccagaaggacacaggcgaacagatagaatttgttaaggagataattgaaacctatgacatgtactatgtcgaggaccccctccatgagggagaccttgagggtttcgccgagctgacatccctggttggtgaccgctgcatgatctgtggtgacgatatcttcgtgaccaacagggagatactcagggagggtatagagatgggtgcagccaacgccataatcatcaagcccaaccagataggcaccctcacagacacctacctcaccgtcaaactggccctcgagaacaggtacacccctgtggtttcacacaggtcaggtgagacaacagatgataccatagcccaccttgcggtggccttcggagcacccctcataaagacaggtgcaataggcggtgagaggatagccaaactcaacgaactcatacgcatacaggaagagattccatattcaaggatggctgatctgccattttaa

SEQ ID NO: 24787 - DNA, 912 bp, Methanobacterium thermoautotrophicum
ttgaagtcgtcggcatccgcacctgccaaggccattctttttggtgaacacgcagtggtctacagcaagccggcaatagcagccgccatagaccgcagggtgactgtaaccgtaagtgaatccagcagcacccatgtaaccatcccctccctgggtatacgccacagttcagagagaccatccggtggcatcctggactacatcgggaggtgcctcgagctttaccatgacgcatcaccccttgacatcagggtggagatggagatacccgccggttcaggcctaggttcatcggctgcactcaccgttgcactgataggtcccctcgacaggtaccatggaagggatcatggacccggggagacagcagccagggcccacagggtggaggttgatgtacagggagccgccagcccccttgacacagccatcagcacctatgggggccttgtataccttgacagccagaggagggtgaggcagtttgaggccgacctgggggaccttgtaatagcacaccttgactattcaggggaaacagccaggatggttgccggcgtagctgaaaggttcaggagattcccggatatcatggggaggataatggacacagttgagtccataaccaatacagcatacagggaacttctaaggaacaacacagaacccctgggggagctcatgaacctcaaccaggggctgctggactccatgggcgtttccacacgtgaactttcaatgatggtctatgaggcaaggaacgccggggcagcaggttcaaagatcacaggagccggcggcggcgggagcataatagcccactgcccgggatgtgtggatgatgttgtcacggcccttaacaggaactggaaagccatgagggcagagttttcggttaagggactcatctaa

SEQ ID NO: 24788 - DNA, 978 bp, Methanobacterium thermoautotrophicum
atgatggaagtaatggatattctaaggaagtactctgaaatggctgatgagaggataagggagtccatcagtgacataacacccgagacgttactcagagcatcagaacacctcatcacagcaggcggtaagaagataagaccatcactggccctcttaagctctgaggctgttggcggagaccccggggatgctgcgggtgttgcagcggcaatagaactgatccacacattctcactcatccacgatgatataatggatgacgatgagatcaggagaggcgaacctgccgtccatgtcctctggggggaacccatggccatactcgccggtgatgttctcttctcaaaggccttcgaggcggttatcaggaacggtgactctgaaatggtgaaggaagctcttgcagttgtcgttgactcctgcgtcaagatatgtgagggccaggcccttgacatgggattcgaggagaggctggacgtcacagaggaggaatacatggagatgatctacaagaagacagcagccctcatcgcagcagcaacaaaggccggggcgataatgggtggtggttcaccccaggagatcgccgccctcgaggactatggcagatgcattggtctcgcattccagatacacgacgactacctcgacgtggtcagtgacgaggaatcccttggcaaaccagtgggcagtgacatagcagagggaaagatgaccctcatggttgtgaaggcacttgagagggcatcagagaaggacagggagaggctgatatccatcctgggctccggggacgagaaacttgtggcagaggccatagagatatttgaacgatacggggcaacagaatatgcccatgctgtggccctggaccatgtgaggatggcaaaggaacgcctcgaggtacttgaggaatcggatgcaagggaagccctcgccatgatagccgacttcgtccttgaaagggaacactag

SEQ ID NO: 24789 - DNA, 1662 bp, Methanobacterium thermoautotrophicum
gtggtgccagtggaggaccttgtctacaggtacgcactcctgaacgctgtgaaacacaggggaagggcaaacccgggggccgtcatgggggccgtcatgagcaacgaacctgaactcaggaagatggcgccccaggttaaggaagcagttgaggccgctgttgagagggttaacagtttaagccccgaggagcagcagcaggagatggagaggctgggccttgagatcaccgagaggaaacagaagaagcggaagggtctaagggaactggccggggtgaagggtgaggtggtcctcaggttcgcccccaaccccagcggacccctccacataggccatgcaagggccgcgatcctcaaccatgaatatgcaaggaaatatgacggcaggctcatcctcaggatagaggacacggacccccgcagggttgacccggaggcctacgatatgattccagccgaccttgagtggctgggcgttgaatgggatgagacagttatccagagcgaccgcatggaaacctactatgagtacacagagaaactcatagagaggggtggtgcgtatgtatgcacatgcaggccggaggagttcagggaactcaagaacaggggagaggcctgtcactgcaggtcccttggtttcagggagaacctccagcgatggagggaaatgttcgagatgaaggagggctcagccgttgtgagggttaaaacggacctgaaccacccaaaccctgccataagagactgggtctcaatgaggatcgttgaggcagagcacccacgcaccggtacacgctacagggtctaccccatgatgaacttctcagtggcggttgatgaccacctccttggcgtgacacacgtcctgaggggtaaggaccacctggcaaacagagagaagcaggagtacctctacaggcaccttggctgggagccccccgaattcatacactacgggcgcctgaagatggacgacgttgcactcagcacctcgggggcccgtgagggcatcctcaggggtgagtattctggatgggacgacccacgcctcggaaccctgagggccattgcaaggaggggtatacgaccggaggccataagaaagttaatggttgaaatcggcgtaaagatagcagattccacaatgagctggaagaagatctacggcctcaacaggagcatcctcgaagaggaggccaggaggtacttctttgctgcagatcctgttaaacttgaagtggtgggtttacccggacctgtcagggttgaaaggcccctacacccggaccaccctgaaatcgggaacagggtacttgaactgaggggtgaggtgtacctgccgggcgatgaccttggggaaggaccgctgcgcctcatagacgcggttaacgtgatctactctgggggtgaactgaggtaccacagtgagggcatcgaggaggcccgtgaactcggcgcttcaatgatacactgggtccctgcagagtccgcccttgaggccgaggtcatcatgccggacgcctccagggtgaggggagtcatcgaggctgacgcatcagaactggaggttgatgatgttgtgcagcttgagaggttcggcttcgcccgcctggattctgcaggcccaggaatggtcttctactatgcccacaaatga

SEQ ID NO: 24790 - DNA, 1212 bp, Methanobacterium thermoautotrophicum
atgaacccccttaagaagataaaggattggatagccaggggaaaggctggatggcacctcagcgggggccgatcaagcctaaaacagggaaaatacaaagaagctcttaaagaattcaggaaagccctcaaggcgagtccaaacgacccggaaatcttgcactataatgcaatgacactactaaaactcaaaagaccagagaaagccttaaaatgttatgaaaaaatcctcaaaaacaatccaaaactagcagaagcatggaacaacaaaggagtagtccttaaagaacttaagagatatgatgaggcattggaatgctatgaaagggcactacaaatagatccacaagacgatggaacatggaacaacaaaggagcgctccttgacacaatcggtaaacctgaaaaagcaatagaatgctatgaaaaagccttagaaataaaccaaaaaaatgcaaaagcatggtataataaaggtaacggattacgcagtctcggaaaatatgaggaggcattggaatgctatgaaaaagcattacagataaacgcagaattcgtagaggcatggtacaacaaagcactaatttttgaagaacttaagagatatgatgaggcattggaatgctatggaagggcactacaaatagatccacaagacgatggaacatggaacaacaaaggagcgctccttgacacaatcggtaaacctgaaaaagcaatagaatgctatgaaaaagccttagaaataaaccaaaaaaatgcaaaagcatggaacaacaaaggagtagtccttgaagaacttaagagatatgatgaggcattggaatgctatgaaaaagccttagaaataaacctagaaaacgacgaaacatgggctaacaagggagtactcctcaggaaacttggaaaatatgaggaggcgctggaatgttttgaaaaagcccttgaaataaacccagaattcgccgatgcatgggaatggaaaggtataatcctggaagacctcaaaaaaccagaggaagccctgaaatgctacgagaaagccctcaaactaaacccccaagacaaaacactatggtacatgcaaggaaaaacactacaaaaacttggaaaacaccaaaaagccaaaaaatcctacaaaaaagccctgaaaatagacccagaatacaaaaaagccaaaaaagccctgaaagaactccaaatgaaaggctaa

SEQ ID NO: 24791 - DNA, 996 bp, Methanobacterium thermoautotrophicum
gtgaaagctatgaagatagttcttggattacccaagggtagtttaaataatgttaaccgtggaaacacatacagactattcagggatgcaggttatgaggttaagggatacgaaccaggacgcgaagagaatgaaatagagataacaaatgatcctgaaataaaggcatacctcacaaggccccagagtgcccccgtcgaactgaaccgtgagatgcttgatatagccataataggagaggactgggtccgtgaggaatccataaacagtggcaatggatccataaagaagataggcgacctcgattacggtcagacgaggctgatagtcgcagtaccccaggaggagccataccggtcccttgaggactttttcctcaaaaattccggcagggaaagaccattgctgtgcttcacagagtacccgaacctcacaagggactttttcatgaagaatcctggctacagggaactcttcggggacagcaaacccgtggtccagataagggggctgcgtgacggtgacaatgagatggtccagataataaactctgatggggccacagaggtgtacatcgccaagggcgccgacctcatagtggacaacacccagaccggcagcagcctcaggaaggccggccttaaaataattgacaccatcatggaatcaagtgcagggctctacgctggtccatcctgcacaggtgagaaacttgagaaggctgaaatgatattcaagcagctttacggtgccaccaaggcaaggaactactttgatgtcaagttcaacatagccaaccaccgtgcagatgatgtggttgagtttctggtgaggatgaagtactgttcagatgaaccaaccgtggtgcgtggaagggaattttcacaggtgaacgtcctcatagataagagcagattccctgaaatgctcgaggaaataaagggctttggtgcttcagccatagtgagggaaaacgtcaaacagtatatagaatag

SEQ ID NO: 24792 - DNA, 1455 bp, Methanobacterium thermoautotrophicum
atgtacaggaaaaaattaactgaagcagaaacaggttacacatttgatgattttcttcttcttccccaggcatcatatgtggaacccagggatgtggagaccgctggcagggtatcaaggaatatagagctcaagatacccgtaatcagctccgccatggacacggtaacagagtatgatatggccattgcaatggcacaggagggtggaatgggggttatccacaggaacatgagcatcagggaccaggtcgaacaggtgaagaaggttaaaagatccggagacatcacaataagggacgttataacaatatcacctgattcaaccctcagggaggcccatgaaatcatggaccaggaggagataagtggtctgccggttgttgaggacggtgtgctcataggtataataagccgcagggacattgaacccatcttcaactcagatgcggacaagaaggttgaccaggtcatgacaagggacgttgtcaccgtggacgaatccataacccccaacgaggcccttgacatagcctacgagaacaaggtcgaaaggctccctgttgtgaaggatggaaggatcgtcggcatgctcacaatgaaggatatactggagcgcaagaggtaccccaacgcgtccagggacagtgaaggttacctcagggtcgcagccgccacaggcccctttgatcttgaaagggccagggcactggatgaggctggcgcagatgtgctggcaatcgacagtgcccatggacacaacatgaaccttgtgaagagtgccggggcaatgaagaaggagatagaggctgacctcatagtcggcaacatagcaaccagggaggctgcagaggacctcattgcacaggacgtggacggtctaaaggtgggaatagggcccggttcaatgtgcacaacaaggatcatagcaggtgtcggtgtcccccagctcacagccatagcagaggtggctgacgtggccgcagaatatggagtgcctgtcatcgccgatggaggtataaggtactcaggggacattgcaaaggcaatagcagtgggcgccgactgtgtgatgctgggtaatctccttgcaggtacctatgaggcccccggtgatgttgtggttatgaacggacgtaaatacaaacagtaccgtggaatggggtccctcggtgcaatgacagggggtataggtgcaggcacggatcgttacttccaggaaccccgcgggcacatgaagcacaccaaggtggtgcctgagggagtggagggtgttgtcccgtacaggggcacggtaagtgaagttctcttccagctcataggcggtctgagagcatccatgggctactgcggtgccgctaacctaagtgagatgaaggaaagggcgaagctggtccggataacttcaagcgggtatcaaggagagccacccccacgacctcctcataaccaatga

SEQ ID NO: 24793 - DNA, 1773 bp, Methanobacterium thermoautotrophicum
ttgtggatcattcaatggcagtctgcagttcatggacactgccagaggagatgggcaggtgatacaatgataagggtagagaacctgacaaagacctataaactggagaatggagacgaattcagggcactttctgatgttaaccttgaggtggccgagggtgaaatactcggaattctgggcatgagtggatcaggtaagacaaccctcctgaggatactgaggggtgtggaaccctttgattcagggaggatcacccttgatgatgtaacagttgaagctgattccagccagtactatttctctaagctgaagaagaagacagccattcacctgcagaggtcctttggtctctgggcagagacagcccttgagaacgttataaggaagctctacgctacaaggtatggtgatgagtccatgacagactttgactatgcctctgatgaattcggtgaggatgcaatggagctcctgagggttgttggacttgaacacaaggctgaccacttcgccccggtactgagcgggggtgaaaaacagaggctcataatggcaaggcagcttgcaaagaaaccccgggtccttctacttgatgaaccggcaaccatgtcctgcccgaggaccaagcaggagatactggacgccataaagaacataaacagggaactcggtgtcaccgtggtccttgtatcccacctcccggaggtccatgagtacctggccgacagggtggtgctcatggatgggggccgcatagttgatgagggcgaaccctcatccattataggaaggttccttgaggacatcgaaccccctgttgaatacactccgggggccagagggaaggagatactcagggtccgtggtctcgggaagaggttcgtactcctcaagggtggagctgtcctggagatgagtgatgttaacctcgatatagctgagggggagatggtgtccataataggccccagcggagcaggtaagacagtcctcctcaggatgatagggggtctggatctacctgatgagggtacagtggagttccgcctcaacagtgaatgggtcaacatgcatgagcctggcgttaagaggatgggaataaggcgaaagatggggttcatgcaccaggagttcgccctcgtgcaccatgcaaccataaggagtcagatcgcctcaaggcttggtgttaagggagaacatgttgttgcggaggcaaagaagagggccgatgaactcggaataagtgacatggtcctcgatgtcctttaccagctcactgatcttcctgagaccgaggcacggtaccgtctggagaagctgggcctctcacctgagatacttgaggagctcttcccaagcttccctgacagtgaggttaagaggtatgctgagcccatattcagggcccttgaccttcccctgagtatacttgacaggaggtcctatgagctatcaggcggcgagagggtgagggcgacccttgcccttgtactcgcatcgaggcccgatgtactgatactggatgagcccttcggggacctggacccaatcacactgcgcatggtctccaactccctcaagaggatcaacatggagttcgggacaaccatcataatggtgagccaccatgttgacttcataagggagctcagcaccagggccgtgatggttgaggatggaaggattgtgatggatggtgaaccaggtgaactctgtgatgaatttgttgagaggagtcatgcaagataccttcagagggttaaggggtga

SEQ ID NO: 24794 - DNA, 681 bp, Methanobacterium thermoautotrophicum
atgggggagaaggtatacgaactcagaaagataaagaaaaagggaaggggaatgcccctcataggggataaattcccggagatggaggtccagacgacccatggaccgatggaactcccggatgaatttgagggcaaatggttcatcctcttcagccaccctgcagacttcacaccggtctgcacaacggagttcgtggcctttcaggaggtatacccggaactccgggaacttgactgtgaactcgtgggcctcagtgttgaccaggtattctcccacatcaagtggatcgagtggatagccgagaaccttgacacagagatagagttcccggtgatagcagataccggacgggtggcggacaccctgggactcatccacccggcaagacccacaaacaccgtcagggcagtctttgtggtggacccggaggggataataagggccatcctatactatccacaggaacttggaaggaacatcccggaaatcgtgaggatgatacgtgccttcagggtcatagatgctgagggggttgcagcaccagccaactggcccgataaccagctcatcggtgaccatgtgatagtgcctcccgcatctgatattgaaaccgcgagaaagaggaaggatgaatatgaatgctatgactggtggctatgcacccaaagtagggggtga

SEQ ID NO: 24795 - DNA, 762 bp, Methanobacterium thermoautotrophicum
gtggccgtgacacggccccctgaaagatctgcagaggctgttgaactgatagagggggcaggtggaagggccctcgtggccccgacccttgaattaaaggaggcgcacacagaatccctcagggaagtctgccggagggctgatgaatgggatcttgtaatattcacgtcacaggccgccgttgaatccctcttccagctctgcagagaatttgcagggaaaatcaggaaggactgcctggtggcagttataggtcccaggaccgccagagtggccggtgagcatggactccgggtcgatatcgtcccggaggattatactgccgagggcctcctggatgccctcaccggtctcaacattgagggctggaaggtggctctcccaaggacactctctgcaaggaaggtccttccccgaggacttgagatgatgggtgcagaggtcctcgtggccgaggcctacagatccggtttacctgaagacaccggccccgcagaggagcttatagatggtctcctggatggaaaggtggatgcagtcaccttcacaagccccctcactgttgagaacctcttcaaaatcgccggtaaccggcgtaaagagctcatagaggttctgaagagggttaaggtggctgcaataggccccataaccctcaggaagctggaggagcatggaatcaccgccgtgacacccgaaaggtacaccgtgaaggatatgatagctgcgctcgcagttagcatgggtgaagatgtggactga

SEQ ID NO: 24796 - DNA, 1773 bp, Methanobacterium thermoautotrophicum
atgtgtggcattgtggcttgtatacttaaggatgggagtgcagccccggttctcctggaatgcgtcaggagactggagtacaggggctatgactccgttggtattgcaacatcagaccccatgataaggataaagaaggacagcggcaaaatcgacgaggtggacgcggaacttgaccttgcagatctaccaggcactatggggatagcccatgttaggtgggcaacccatggtctccccacagctgagaatgcccacccacacaccgactgcagtggcgagatagcagttgtacacaacgggataatagagaactaccttgaggttaaggaggaacttgaatctgagggccacatattcaggtccgagacagacaccgaggtcataccacacctcatagagaagtacatggatgagggaatggaccttgaagccgcaacagccacagcactcaggaagctcaggggggcatatgcgattgcagcggtatcctccagggagccgggaaggatcgtgggggcgagaaaggagagccccctcatagtcggtgtcggtgaaggtgaatacttcctggcctcagatgtgccagccatcctcaaccacaccagcagggtgatatacctcgatgacggtgagatggtcatacttgatggggatctgagggtcaccgacatggagggcaacactgttgagaaggaggtccattcaatcgactggtccgctgacatggcagagaagggcggctacgaccacttcatgcttaaggagatacatgaggaaccctcagcggtgagggacaccctcacagagtgggatgaggtgcttggagtggttgaggagataggcgaggttgaaaggatctgcttcgttgcctgcggaacatcctaccacgcatcacttgttggaaagtacctctttgagagcctcctgggcataccaaccgatgtgatccttgcaagcgagttcagatactcagcaggggccctgaatgacaggacactggcgatattcataagccagtcaggtgaaacagcggataccctgaacgccctccgcgcagccaattcaagggcgaagaccctggcaatagtcaatgtacttgggagctcggcaacaagggaggcccagcatgttctatacacaagggcaggacccgagataggtgtggctgcaaccaagacctatgtgagtcagctaacagttatatacatgctcgtggctgcaatgggcgcacccgagctcatggatagacttgaaagggttcctgagttcatggagagggcccttgaggatgaggatggcatcaaggaacttgcagccacctgcagtgacgtgagtgacttcttcttcataggccgaggatttgcttatccaacggcccttgagggtgccctgaagctcaaggagataacctacatacacggtgagggctacgcagcaggggaactcaagcacggacccctggccctgatagataatggggtgccggtcgttgcgatttcaccgccaggtccgtgccatgataagaccctgagcaacgttgaggaggtcagggcaaggggtgcaagggtcataggggttggcagtatttcagacgaatccctcaggaaggaggctgatgacttcataggccttgaccctgaggtggatgatgtcatatcacccctggtctacatcgttcccctccagctcctctcctaccatgtgagtgtggaacgtggactggaccctgacaagccaaagaaccttgcaaagtgtgtgaccgttgagtga

SEQ ID NO: 24797 - DNA, 1209 bp, Methanobacterium thermoautotrophicum
gtgtatacaatggaactgagatttataaggggtggtgtctgcgctgttgacggagtcctcgctgccggctgccgtgagggcaaatatggtgttggactgatcatcaacaggggttcaaccgcagccgcggtcttcacctcaaacagggttcgagcagaaccagttaaactcacagagcgcgtaattgcagatggaagtatatcagccatcgtggcaaacagcgggaacgccaactgcttcacaggcagggaaggaatggatgacgccaggaggatggccagaaaagtggcagagtccctctccatggatgaaagtgaggttgcagtggcttcaacaggcgttataggaagaaggatgcccattgataaaatagagttcctcatccagagtgctgcagctcaactggaaaactcagaggcggcatcgggggctcttgcagaggcgataatgaccaccgacaccttccccaaggaggtggcagttgagtttgaacttgaaacaggcgaaaaggcgcgtataggtgctgttgccaagggctccgggatgatagcccccaacatggccacaatgctctcattcataacaaccgatgtcgatgcatcgtcttctgaactgacggaggccctcagggtggcagttgatgagagcttcaacatgctcatagtggatggtgatgagagcaccaatgacatggtcataatatcctcaaccaggacctcaggaaggatagattcaaacttcagggaggctctcgttgctgtgtgcagggaactcgcccgtatgatggcccgggacggtgagggggtcaccaagtccttccaggtggatgttgtaaatgcagggacacatgaggatgcaaaaatggctgcaagggccatagcaggttcatcccttgttaaaacagccatatttggagccgaccccaactgggggcgtatagttgcagctgcaggctactctggagcagagtttgaccctgaggagataagcgtcacccttgagtctgattcagaatccgtggtaatagttgaccatggtgatatcctggcatttgagggtacagaggaacttgaaactgctgagagggtcatgaccagcaaggagataaggataatcgttgacctggctgctggagatgaatcagccactgcctatggctgcgacctcacctatgattatgtaaggataaatgcagagtataccacatga

SEQ ID NO: 24798 - DNA, 882 bp, Methanobacterium thermoautotrophicum
atgaaaacagttaacatcctcgttgaggcactgccctacataaagaagtttcacagaaagaagatcatgatcaagtatggtggccatgccatgatagacgaggccgccatggactcgaccgcccgggatacggtcctgctcaagtatgtgggtatggaacccgtcgtggtccatggaggaggacccgaaatttcccgtgcaatgaacaagatgggtaaggagccgaagttcattgagggcctcagggtgactgatgaggagaccatggagatagtgaagatggtcctcgttggtaagataaacaccagcatagtctcaaagatatgctaccatggcgggagggccataggattatcaggtaaggacagcaacctcctccttgcaaggaagagggcgccccacgttgtgagggacgatgagaccggtgagaggagggagatagacttgggccttgtgggtgagatagagtccgttgaccccggcataatcaacatgctaacagataacaattacatacccgttatatcacccataggggttgacagggatgcaaatacacttaacctcaacgcagataccgttgctggtgaggttgcagcgggtataggggctgaaaaactcatagtactgacagacgtcccggggatactcgaggacccttcagaccctgataccctcataaggcggataagtgttgacgagctcagtgaccttgtaaagagcggcatagtggagggtggcatgctccccaagaccctcacctgcatacaggcaatcaatgatggggtgtcctctgcccacataatcgatggaagggttgagcactcactgctccttgaaatcttcacaaagaagggaatagggaccatgataacagagtga

SEQ ID NO: 24799 - DNA, 996 bp, Methanobacterium thermoautotrophicum
atgtacaggataacggtcatacccggtgatgggatcggagtggaggtgatggaggcagcccttcacgtcctccaggcccttgaaattgaatttgaattcacacatgcagaggcaggtaatgagtgcttcaggcgctgcggcgacacactgccggaggaaaccctgaagcttgtcaggaaggctgatgcaacactcttcggtgctgtgacgactgtgccaggacagaagagtgccataatcacattgaggcgtgagctggatctttttgcgaatttgaggccagttaagtccctgccaggtgtcccctgcctctacccggaccttgactttgttattgtgcgggagaacaccgaggacctctatgtcggtgacgaggagtacacccctgagggcgccgttgcaaaaagaatcataacaagaaccgcctccaggagaatcagccaattcgccttccagtacgcccagaaagagggcatgcaaaaggtaacagcagtccacaaggccaacgtgctcaaaaaaaccgacggaatcttcagagacgaattctataaagtggcatcagaatacccccagatggaggccaatgactactacgttgacgccacagcaatgtacctcataacccagccccaggaattccagaccatcgtcacaaccaacctattcggagacatactatcagacgaagccgcaggactcatcggaggactcggactcgcaccatcagcaaacataggagaaaaaaacgcactattcgaaccagtacacggatcagcaccccaaatcgcaggaaaaaacatagccaaccccacagccatgatactaacaaccacactaatgctaaaacacctcaacaaaaaacaagaagcccaaaaaatagaaaaagcactccaaaaaaccctcatgaggggtatcatgacaccggaccttgggggtactgccagtaccatggagatggcagaggccataaaagaggaaatagtaaaaggggagtag

SEQ ID NO: 24800 - DNA, 978 bp, Methanobacterium thermoautotrophicum
ttgaaggtaagtataattgggtcaacgggacgtgttggaagggcaacggccctctgtcttgcagaggaggaggctgtgaagaccctccacctcatctcaaggaaggagagtcttgaacagaacctcggcgaggtccttgatatgagcgacgccctcgcagccaagggtgtttcagtcaagctggaaaactctgcagacattgaaaacgtctacggttcaaggatagtggtgataactgcgggtgtccccagaacggctgatatggacagggatgatcttgcatttaagaacggcaggatcgttgcagattatgcaaggcagatcgcaagattcgccccggattcaattatactggttgttacaaaccctgtggatgtgatgacctatgttgccctcaggtattcgggttttcaccccagcagggtcttcggccttggaaaccacctggactccctgaggctcaagaactacatggcaaggcacttcaatgtccatgtgagtgaggttcacaccagggttataggtcagcacggtccctacatggtcccactcataagttcaacctccatagggggcatacccatagagcactatgcccggagggactacttctcaggttacaagaagtttgacctcaaaaagaccatagacaaggtcatccatgcagggagcaacatcataagcaggaagggggccaccgagtatggaccggcctttgcaatatccaacatagtcaccaccatcctgaatgatgaacgcaggatactcacggtttcaaccctcatggagggtgaaatcgatggtataagggatgtttgcctcggagtacctgttaaactgggtaagaacggcattgagggggttgtacctgtgctgatggatcgtgatgaaagggaggcattcagggaagccgccaaccatgttagagactccaccaggagggttatggagtttcttgatgaggaacttccactatag

SEQ ID NO: 24801 - DNA, 1278 bp, Methanobacterium thermoautotrophicum
atgaaaggattagaatttagtgagtttgatatctcaggggatataaacagggcccttgatgatatgggatttgagagcacaactccaatccaggcacttacactacctgttacacttgacggtatggacgttgttggtgaggcccagacagggaccggaaaaacagctgcattcgccatacccgtacttgagaaccttgaagccgagagggtgccccaggccctcataatctgtccgacacgcgagctctgtctccaggtctcagaggagatcaagaggataggtaaatacatgaaggtgaaggtcctcgcggtctatggtggtcagagtatcggtaaccagatagcacagctaaggaggggggttcatgtcatcgttgcaacccctggtagactgatagaccacatcgagagggggaccgttgatctgggaggtatatccaccgttgtccttgatgaggcagatgaaatgctgaacatgggattcattgatgacatagagcgtatactatcccatgtacctgagagaaggcagaccatgctcttctctgcaacggtttcaaagcccatactcaggattgcaaggaagtacatgaggaacccccaggttatgcgtgtggagaagaagcacagccccaagatagatgagttctacttcaaaaccagggaggaggataaggttgagctcctcgactggatactctcatcaaacaatatcaggatgggactcatattctgtaacaccaagagaagggtccagaggttgagaaggcagctgaaccgtatgggttactctgcagatgagatccacggtgatctttcacagtcaaagcgtgagcgtgtcatggagagattcagaaggggagatttcagtctccttgttgcaacggatgttgctgcccgtggtattcacgtacccgatgtcgaggccgttgtgaactatgacctgccctttgagaacgagtactacgttcaccgtataggccgtacagggcgagccggttcaagcgggaagtccttcaccctcgtcgttggaagtgaggttcaccgcctgagaaggatccagtcattcacaggtaagaggataaagcagagcaacatgccctcccctgaggagataaggaggggatatgagatggacctcagggagatcctcaggaggaacctggaatcaaagacttacagtgactctgaaatccttgagagccttgctggtgagggttacagtttcagggacatctcacacgcccttctggatgtactggaatcatccaaataa

SEQ ID NO: 24802 - DNA, 774 bp, Methanobacterium thermoautotrophicum
atgaccgtgctaaaaataatatcctggaacgtcaacggcctcagggcggtccacaggaaggggttccttaaatggttcatggaagagaagccagacatcctgtgccttcaggagataaaagcagcgcctgaacagctccccaggaagctcaggcacgttgagggttacagaagcttcttcacccctgcggagagaaaggggtacagcggggttgccatgtacacaaaggtacccccctcttcactgagggagggtttcggtgtggagagattcgacaccgagggtcggatacagatcgcagactttgacgacttcctcctctacaacatatacttccccaacggtaagatgtcagaggagaggctgaagtataaactggaattctatgacgcattccttgaggacgtcaaccgggagagggattcggggaggaacgtgattatatgtggggacttcaacacagcccacagggagatagaccttgcaaggccaaaggaaaacagcaacgtatcaggtttccttcccgttgagagggcctggatcgataaatttattgaaaatgggtacgtggacaccttcaggatgttcaacagtgaccccggacagtacacatggtggagctacaggacaagggcccgtgagaggaacgtcggctggagactcgactacttctttgtaaacgaggagttcaaagggaaggttaaaaggtcctggatactctcagatgtcatgggctcagaccactgtcccataggactggaaatagaactataa

SEQ ID NO: 24803 - DNA, 1677 bp, Methanobacterium thermoautotrophicum
atgtcaaaggatacctcagttctcctggaagagaaaagggtcttcaaaccccactacaccgttgtggaggaggcccacataaaaaactgggaggccgagctcgaaaagggaaaggaccatgagaactactgggccgaaaaggctgaaagattcgaatggttcagaaaatgggacagggtccttgatgagagcaacagaccattctacaggtggttcgtcaacggtaagatcaacatgacctacaacgccgttgacaggtggcttgacacagacaagagaaaccaggtcgccattctatacgtgaacgagaggggggatgaaaggaagttaacctactatgaactgtaccgtgaggttaacaggaccgctaatgccctcaaaagtcttggaatcaaaaagggcgatgcagttgccctctaccttccaatgtgccccgaacttgtaatctcaatgcttgcctgtgcaaagataggtgctgtccacagtgtcatatactccggtctcagtgtgggggccctggtggaacgcctgaacgatgcaagggcaaagatcataataacagccgacggtacctacagaaggggcggggttataaagctcaaacccatagtggacgaggccatactccagtgccccaccatagaaaccacagtggttgtaaagcacacagacatcgacattgagatgtcggatataagtggacgtgaaatgctcttcgataagctcatagagggtgaaggggaccggtgcgatgcagaggagatggatgcagaggaccccctcttcatactctacacttcggggagcaccggaaaaccaaagggtgttctacacacaacaggaggatacatggtgggggttgcatcaaccctcgagatgacctttgacatccacaacggagacctctggtggtgcacagcagacatcgggtggataacaggtcacagctatgttgtctatggcccgctgctacttggaaccacaacactcctctatgagggggcacctgattaccctgaccccggtgtgtggtggagtatcgttgagaaatacggtgtcaccaagttctacacggcaccaaccgcaataaggcacctcatgaggttcggtgacaagcacccaaaacgctacaaccttgaatccctcaagatacttggtacggtcggtgaacccataaaccctgaggcatggatgtggtactacaggaacattggaagggagaagtgcccgataattgacacctggtggcagaccgagacagggatgcacctcatagcacccctacctgtgacaccccttaaaccgggttcagtgacaaagcccctcccgggcatagaggccgacgtggttgacgagaatggcgaccccgtgcccctgggtaagggtggttttcttgtgatcagaaagccatggccagccatgttcaggaccctcttcaacgacgagcagaggtacatcgatgtttactggaagcagatccccggcggagtgtacaccgcaggtgacatggccaggaaggacgaggacggatacttctggatccagggaagatccgatgacgtcctgaacatagcagggcacaggataggtactgcagaggttgaatcagtctttgtcgcacaccctgcagttgcagaagccgcggttataggcaaggcctaccccatcaaggggtag

SEQ ID NO: 24804 - DNA, 1659 bp, Methanobacterium thermoautotrophicum
ttgcatgctatttatttaagaggtgatttaatggcacagggacagcagcccatattcatattaccacaggatacaagccgttacgttggaagggaagcacagagaatcaacatccttgcgggtaaggttcttgcagagactgtgaggacaacccttggacccaagggtatggacaagatgcttgttgactcccttggagacatcgtgattacaaatgatggagttacgatcctcagggaaatggacatctcacaccccgcagcaaaaatgctggtggaggttgcaaagacccaggaagacgaggtgggggacggtacaaccactgcagtcataatagcaggtgaactgctcaaggaagctgaaaaactcattgaaatgggtgtgcacccaacaatcatagcacttggttacaggaatgcagcactgaaggcccaggagatacttgaagagatatcaatggaagcaagcgacagggacaccctcatgaaggtcgcaataactgcaatgacaggaaagggttcagagagggccaaggaaaaacttgctgaactcgttgttgacgcagtaatgcaggtcgaagaggacggtgaaatcgacaaggacaacattaacatacagaggatacagggcgcatcagtgaacgagtcaagaatcgtgaacggcatagtaattgacaagtcaagggcagacacctcaatgccaaagagaatcgaaaaagccaggatagccctcctcaagtatccgatagaggttaaggaccttgaaaccgatgccaagataaggctaacagacccatcacagatgcaggccttcatagaacaggaagagcagatgatccgcgacatggttgagaagataaagagctcaggcgccaacgtcgtgttctgccagaagggtatcgatgaccttgcactccactacctctcacgtgagggaataatggccctcaagagggtcaagaagtcagacatcaaacgtattgagaaggccacaggcgcaagactcgtcaccaacatagatgacctcacagcagaagatctgggagaggccggtgttatctacgagaagaagatctttgatgaggtcctcacattcattgaggaatgcagggaccccaaggcaatctccataatactgaggggaagcacgaagcatgttgcagaggaaatggagcgtgcccttgaggatgcaataggagtcgttgcatcaacacttgaggacagggaggttgttgcaggcggaggagcgcctgaggttgaaatcgccaggaaactgcgtgagtatgctgacaccataagcggcagggagcagctggcagtatccgcctttgcagacgccctcgaaatcgtgccaaagacccttgcagagaacgcaggtcttgacagcatcgacgtcctcgttgacctcagggcagcccatgaggaatcaccctacatgggaatcgatgtcttcgatggtaacatcgtcgacatgaaggaggccggagtaatcgaaccccagagggtcaagaaacaggccatccagtctgcagctgaggcagctgagatgatcctccgtatagatgacatgatagccgccaggggctttgatgtctcatccaaggacgaggaggatatggaaggaatgggtggaatgggtggaatgccccccatgatgtaa

SEQ ID NO: 24805 - DNA, 1281 bp, Methanobacterium thermoautotrophicum
atgctgatgaagataacagaatttgattacagacggatttctgaactcgttgaaagagcaaggcttgacgtcgatgatgtccttggacccgtggcagacatcatatccatggtgagggatggaggtgacgatgccctcagggaactcacagggagattcgatggagtgaccgttgagaacttcagggtcagcagggaggagatagaggaggcccacaaaaaccttgaacccggggtgaaggaggcactcagggaagccgccagcaacattgaggaattccacaggatgcagatgccctcaggctggatgtctgaggttagacccggggtcatggccggccagctggtgcgccccattgacagtgtgggctgctacataccgggtggaagggctgtgtacccctcaacgatactcatgaccgtgatacctgcaaggatagcaggtgttgagaggatagtatgctgcaccccgccggcacaggacggctcggtacccgacgcggttcttgtggcagccgacatggcaggggccagtgaaatataccgtgttgggggagcacaggccgttgcagcgatggcctacggcacagagaccatcaggcccgttgataaaatcgttggacctggcaacatatttgtaaccgctgcaaagaaactggtctacggtgaagtggacatagacttccctgcaggaccctcagaggtccttataatcgccgatgaaactgccagtccagagtacatcgccctcgaaatacttgcacaggcagaacacgacccccaggctgcaagcgtccttgtcacagactccagggaccttgcccttgaggtgaaggagatggtccatgaaaacattaaatacatggaaagggccaatatcataagggagtcccttgaaaggtacgggatgatagttttaacagctgatattgatgaggctgtggacttcagcaatgcatacgcccccgagcaccttgttataatgacggattctccagaagaaacattggagggcatccgtaacgcgggatccatattcctgggggaactgtcccctgtggctgcaggggattacggttcaggcacaaaccatgtgctgccaacctcgggatgcgcaaggatgtactcgggtctctccacagaatccttcatcaaaaaaccaacagtccagaggataaccaaggagggcctcagaaacctccagggcaccgtcctgaaacttgcagagtacgagggcctccatgcccatgctgaatccttcaggaggaggctgagggactga

SEQ ID NO: 24806 - DNA, 1263 bp, Methanobacterium thermoautotrophicum
atgaagtcagaggaactcttcagaagggccagtaacgtcctcccggggggtgtgagttcacctgtgaggaggttcgacccccacccattctttgcagcggggggcagcggatgcctgcttgaaagcgtggatggtgaaagctacattgactactgtctggcctatggccccctcatactgggacacgcccacccacgtgtagttgaggctgtgaatgagcagataaaaagggggacaacctacggtgttcccacagagggggagatagaacttgcagaggccatcatcgagagggtgccatgcgctgagatggtgaggttcacaaattcagggactgaggccaccatggccgctgtgaggcttgccagggccttcacagggagggacaggatagttaaatttgagggatcctatcacggtgcccacgactacgtccttgtgaggccgggttcaggggcggccacagcacctgattcacctggaataccagtggatactgtcagaaacaccctgacggtaccattcaaccatgaggaggcaatggctgaactcatcgagggggcgggtgaggatatagcgtgcatactggtggaacctgtcatgggaaacatagggtgcatagaacctgaaaatggttacctgcagttcctgagggacataacacgtgaaaatgatatcatcctcatatttgatgaggtgataaccggattcaggcttgcaccagggggtgcccaggagtactacagggttgaacccgaccttgtaacccttggaaagatagttggaggcggcttcccaatgggggcactggcaggcagaagggagataatggaaaatatatcacctgcaggtaacgtctaccaggcaggtaccttcaacgggaaccctgtatctgtaactgcaggtcgtgagaccctcagactccttgatgggaggatgtattctgaccttgagaggaaggggtcgacgctgagggctggtctcagggacctcctctctgacctggaccttgaataccaggtcaccgggccagcatcaatgttccagttatacttcacaggggaggaggtcaggaactatggggatgctaaaaaatccgatacagtgctcttcatggagtacttccatggcctgcttgagaggggggtattcataccaccgtcccagtttgagtgctgcttcatatcggctgcccatgaatcagagcacatagaggcgacccttgaagctgccgaggaggttctcagcggccttaaaaattaa

SEQ ID NO: 24807 - DNA, 3966 bp, Methanobacterium thermoautotrophicum
gtgaattatgataaaagtcaaggaggtgaaaacatgaagaggtttctgttaattgcattgatcctgctactgatttcagtcccatcggtatctgcagcagacaacaacacaacatccaacaccacagaatcaaagatgctgaaggatactgagatggttgtgctactgacaggctgcgttgtgggcacggtcgaccccataatgaatgaagcctaccgtaatgacctcctgcccgctggctacaacttcacactgaagatctacaccatggacaccttcaacatcaactcaacggcatccacccagttcaaaaacgaccttaaaactgtggacatattctttatcttcacaagacccgggtatccaacgaccggtatgagttacgggacagaattcgatgctctggttgacctgcaggccatcgcagccagcctaaaaccaggagcgcggatattcgtcctgggacctgtgaaacccaatatcacgggtgttaacgtgacgaaccttccagcctacgggccggtggctgcgcctgcactctcccgtgagaacataaagaggacgctccttgaggttctcaggctcagcggagccgtgaacctgacggctaatgatacaaaacttgtgcccgggatgcaggacttcctctaccatccgctggcaccgcaggtctacacagacagggcaccctacatggactggtacatgaacaccaccctctacaggccaggggccccatgggtgggtgtggcaatactgaaccggtactacctgtctggcaacatggacgtctatgagaccctcatccagaagcttgaatcccgtggactcaacgtgataccctacttctactgctcagaccccatcggggcatcaaggcgcttcttcatggtcaacaacacttcagtcatcgatgcgcttgttgcatgtgtccagttcgggtactggccagacaaccagaccataaccttcttcacggacctcaacgtaccggtacagggaccactccctgtcttcctccagacatccctcgacgattacataaacagcacacgacagcagggactcaggggccttgaatactactggctttcaatgtttgagatgcagggacgtatagagcccatcctcataggcggaagccgcatatcaggtcctgatccactgacaggtgtcaccatcaaggagtacgtggcctatgaaccgggtatagaccagctcgttaaccgcacactcgcctgggtgaacctcaggaagaaggcgaacagtgacaagaagctggctatggtctactttgacagcacccatgatgagggaatgcctgcaaccaacggcctcaacctctacaggagtctcagcaacatactcctcgccatgagggccgcaggtcacagcaccggcaacggaaacctgaccgaggaatacatctatgaactcataaacagggcaggcaggaaccccaggaacatgacacagacagaactcagaaaactcgtggatgcaggctgcataaccataccggtatcagagtacctcaaatggtattctggactgccagcatcactcagaggacaggtggaagcactctggggacccgcaccaggaaacatcatgatatacaataacagcatagtcatccccggcatcatgatgggcaacatactcttggcgccccagccggtctggaagtggaacggtacactcaacaacggcacactgccaccgacacaccagttcatagccttctacctctacctgcagaagggattcggggctgacgccgtcgtccacataggacagcacgggacactggaactccttccgggacacgtgaatgcaatgacagaggacgactggccaaacaccctgatcggttcgattccaaacatacacctgctcaaaatggaggaccctctggaggcggtcataaaccccaccaagagaagggcatatgctgtcacgatctcctacctcatcccaccggtcatgaggacagagctttacggtgtctaccaggaactctcagatctcatgggatcctacagcacagcagaggcatcaggagacactgacagaatgaacagcctggagtccctcatcagggatggtgtgacgagggccggacttgaggtaaggctcggtgtgaacagctccacagccttcagtgtcctcagagacaggctccatgagtacctcgaggaactttcagggatactgacaccctacggccttcacaccttcggagaactgccagacagtgaaacccttgagaaattcatagacgcaataatatccttcgaccctgcaaacaggacagccagaagggatgagataaggaaccttctgattatgagcgccagtaatgagatgaactcactcctgagggcacttaacggtgaattcatacagccagtatcagcaagaagcccggtcatcaacctggagacccttccaacgggccgcaacatgtacacctttgacccctcatcaatccctgaccccgcagcagtggtcataggatcaagggctgccgaggagatgctgaagcgctacaggaattccagcggtggaaggtaccctgagacagtggccgtggatataggtgatgtgatatcaactggcggtcagagcatagcagcgatattctacttcctgggagtcagacccatctatgagagcggagccctcataggtacagagatcatacccctcagtgaacttggaagaccgaggatagacgttgtgataagtgacttccacaacttccgtggagcaatccctgccaccatggacgtaatcgacaatacaataaagaggatagtgaacctcaacgagtcatctgagatgaactatgtgaggaagcactacctcgcaatgaaagcaggcatctacgctgaacttgtcgcagcagggatgaacacttccgaagcggatgcaaatgcggatagacttgcaaggacaaggatcttcggacttccacccggtgccgacccccatggagcaggtgttgacaggatactctggtcaagggacgactggactccagagcagcttgctgagacatacctcagctactactcctatgcctatggaagagatttaaatggagtccagagcccgaaactcctggagtcactcctgcgcacagttgacaccaccatggtcataagtccctacagggcacccggtgagggcacctgcctctacagggtctcagtcaccgtgaacttcatggtgaactacctcacagggaggaacataaacagctacattgcaaggacagcctacggtacacccctgataaggacactgcaggagtcaacctacgatgaccttgcggtgacactgctcaacccggtctgggtacagggcaaactccgtgaggggccatctggaagtgcttcaatagcactgcaggtgagggacctgttcaccagcgacgccctggtggatgtggcatcccctgatgtctggaggagaatagcagacactttcctctttgacagctctgtaaggtcacagtttgatccatcagccctccagatgattgcaaggtatgtgaggcaggcccataccaggggtcttgtatccctttcacaggaggaacttgtagccatctcagagatgctcggtgagaaatccggctctgatggaaatgaccagggaaccaccacaacaccacatggcggtacaaccggcggttcagccacatcaggcggaagaacaggcactgggtccccagggctatctccaggtgtatcaggtgccatatccatggattcacagtccagcggagcagcatcagcttctccgggtgagggacaggagagggcaggacgctcctatgagatatcaacacccacggctgcgaaatcatcaggcacccagctatacgccattgcaggcataatcgggctattctgtctcctcggagtgggctactacttcggtcccatgagaaaataa

SEQ ID NO: 24808 - DNA, 966 bp, Methanobacterium thermoautotrophicum
gtgatcattatgaacggaccttgggtagagaagtacagaccacagaaacttgatgatatagtaggccaggaacacataataccacgtctaaagcggtacgtcgaagagaaaagcatgccaaacctcatgttcacgggtccagctggtgtcggtaaaacaacagcagcccttgcccttgcaagggagatcctcggtgagtactggaggcagaacttccttgaactcaacgcatcagacgccaggggtatagacaccgtgaggaccagcataaagaacttctgccgcctaaaacccgtgggcgcccccttcaggataatattcctcgacgaagtggacaacatgacaaaggacgcccagcacgccctcaggagggagatggagatgtacacaaagacatcctccttcatactctcctgtaactactcctcaaagataatagatccgatccagtcaaggtgcgccatattcaggttcctccccctcaagggccaccagataatcaaacgcctggagtacattgcagagaaggagaaccttgaatacgaggcccatgcccttgagacaatagtctacttcgctgagggggatctcaggaaggccataaacctcctccagtcagccgcatccctcggtgagaagataacagagtcaagcatctacgatgtcgtgtcaagggcccggccaaaggatgtgaggaagatgataaagaccatccttgatggtaagttcatggaggccagggacatgctgagggagatcatggttctccagggtataagcggggaggacatggtcacccagatctatcaggagctctcaaggctggcaatggagggcgaggttgatggtgataggtacgtgggcctcatcgatgccatcggcgaatacgacttcaggataagggagggcgccaatcccaggatacagcttgaggccctccttgcaaggttccttgaacacgcctaa

SEQ ID NO: 24809 - DNA, 783 bp, Methanobacterium thermoautotrophicum
atgcacaacgcggcgttcaggagccttggtatggactggatatacgtaccattccctgtgaagccagagaacctgaaagcagcggttgagggcctgagggcccttggggttgagggtgtgaatgtgacaataccccacaaggaggccgtcctggagtacattgatgatatccatgggacagcggccctgataggtgccgttaacactctgaaattcgatgacgggaccgtcaggggatacaataccgatgcctcagggtgcttaagggcccttgaagaggtgacatccgttgagggttcatccgtccttatactgggggcgggtggggctgcaagggcctgtgcattccagcttgcagagaagggggcctcggatataaccatactgaacaggacccctgaaaaggcccgcctccttgcagaggatatggctgataaactgggctttgaggcatcatacgggggctatgaacttatccaggggtctgtgaaatcggctgatatcctcatagacaccacgccggtgggcatgcatccccacacagatgacaggccactggtgggggctgaactcatgcatgagggtctggtggtccatgacctcgtgtacaaccctcaaaggacggtcctcctgagagaggctgagagggcgtcagccatcccggtttcagggatccgtatgctcctctatcagggcgttgaggccttcaggatctggaccgggagggacccgcccctggatgtcatggaagacgccctgaaaagggtccttaacagggattaa

SEQ ID NO: 24810 - DNA, 456 bp, Methanobacterium thermoautotrophicum
atgatggaaaaaagctttgtaatgttaaaacctgacgcagtaaaaaggcgcctcgcaggaaggataatagccaggttcgaggacaggggactcaagatagtcgcctttaagatgctgcagatcccggaagaccttgcaatggagcactaccaggaacacagggaaaagcccttcttcagggacctggtggactacataacatcagcacctgtcattgcaatggtcattgagggtaaggactgcatatccctcataaggaagatggttggcgcaaccaaccctgcagaggcagacctcgggacaatcaggggagacttcgcccttgaaacaggtagaaacataatacacgcttcagattctccagaatcagccgaaagggagattaaacttttctttgatgaatcggaaatttgcagttacgagatgcctgatagagaaatgatatacgaggaataa

SEQ ID NO: 24811 - DNA, 1785 bp, Methanobacterium thermoautotrophicum
atgaagatcagatcacccatcgtctcagtactcggacacgtggatcacgggaaaaccacacttcttgaccatataaggggcagcgcagttgcctcaagggaggcaggtggtataacccagcacataggggccacagagatacccatggatgtcattgaggggatctgcggagacttcctcaaaaaattctcgatcagggaaacactaccaggactcttcttcattgatacaccaggacatgaggcgttcacaaccctcagaaaacgtggaggggcccttgcggatcttgcaatactcatagtcgatataaatgagggattcaagccccagacacaggaggccctcaacatcctcaggatgtacaggacacccttcgtggtggctgcaaacaagatagacaggatccatggatggagggtccacgagggacgccccttcatggagaccttcagcaaacaggacatccaggtccagcagaaactggacacaaaggtctatgaacttgtgggcaaactccatgaggagggctttgaatcagagagattcgacagggtcacagacttcgcctcacaggtcagcataatacccataagtgccataacaggcgagggtatacctgaactcctcacaatgctcatgggactggcacagcagtacctcagggagcagctcaaaatcgaggaggattcccctgccaggggcaccatcctggaggtcaaggaggagacaggcctcggcatgaccatagacgctgtaatatatgatggaatactcagaaaggacgacaccatagccatgatgacatcaaaggatgtcatatccaccaggataagatcactcctcaaaccaaggcccctcgaggagatgagggaatccaggaagaagttccagaaggtcgatgaggtcgttgcagcagccggtataaagatcgtggcaccgggcatcgatgacgtcatggccggctcacccctcagggttgtaacagaccccgagaaggtgagggaggagatactcagcgaaatcgaggacatcaagatagacaccgatgaggcaggcgtcgttgtgaaggcagacaccctcggatcactggaggcggtggtcaagatcctcagggacatgtatgtccccataaaggtggcagacataggtgacgtctcaaggagggacgtggtgaatgcaggtatagccctccaggaggacagggtctatggggccataatagccttcaatgttaaggtgataccctcagcagcccaggaactcaaaaactcagacataaagctcttccagggcaacgtcatctacaggctcatggaggaatatgaggaatgggtcaggggcattgaggaagagaagaaaaagaaatggatggaagccatcataaaacctgcaagcataagactcatacccaaactggtcttcagacagagcaagccagccattggaggagttgaggtcctcacaggcgtcatcaggcagggctaccccctcatgaatgatgatggggagacggtgggtaccgtggagagcatgcaggacaagggtgaaaacctcaaatcagcatcacgcggccagaaggttgcaatggccataaaggatgctgtttatggtaagacgatccatgagggagatacactctacgttgacatacccgaaaaccactaccacatccttaaagaacagctctcaggggatctgacagacgaggaacttgatctcatggataagatagctgaaatcaagaggaagaagaatcctgactggggaatgaaggcaccattttaa

SEQ ID NO: 24812 - DNA, 1227 bp, Methanobacterium thermoautotrophicum
gtgaaaaatcaatccgaaataaacattggtcttgtggggcacgtggaccatggtaaaacaacccttacaaaggcactttcaggtgtctggaccgacacacacagtgaggaaaccaagaggggcatctccatacgtctgggctatgccgacataaccttcaggaagtgcccgcagtgcgaagccccaatgtgctatacaacggcagagatatgtgagaggtgcggcacagagacagagctcctcaggaaggtttcctttgtggatgccccgggccatgaaaccctcatggctaccatgctctctggagcagccctcatggacggcgccatactcgtgatagctgcaaacgaaccatgcccccagccccagacaaaggagcacctcatggcccttgatgttataggggtgaaggatgtcatcgtcgtccagaacaagatagatatcgtttcgaaggagagggcgcttgaaagctacagggagatcaaggagttcgtgaagggtacctgcgctgaggatgcacctataataccggtatctgctcaacagggcgccaacattgatatcctcattgaaaccattgaggagagaatcaaaacccccaagagggacgttgataaacctgccaggatgtacgtggccaggtcctttgacataaacaaacctggcgcagaccccgaacacctcgcaggaggagttatagggggctcactggtccagggcaggctcagggttggagacgagatagagataagaccgggcatacaggtcaaaaaggacggtaagcagacctggatgagtctgcactccacaatcacgggcctggtggccggtggagaggagatggaagaagttggacccggcggactcgtgggtgtcgggacactcctggatccagccctcaccaaggcggactcactttcagggtcagttgccggggaaccaggcacactgccacctgtaaggcactcattcaccatggagacacacctcctggagagggttgtcggtaccaaggaggagaccaaggtcgaacccataaagacaggggaacccctgatgataaacgtcggtaccacaaccacggtgggtgttgtcaaatctgccagggcagatgatgccgacgtggtcctcaaactccctgcatgcgcagaggagggtcagaggatagccctctccaggcgtgtcggtgcaagatggaggctgataggatatggtatcatcaaatag

SEQ ID NO: 24813 - DNA, 1407 bp, Methanobacterium thermoautotrophicum
ttgaacctgagggctggcagattgaatagcgggatggaggatgaggccgcggagttcacatcatccctcacatttgatcaccacatatttgaggccgacattgagtgtaacatggcacatacacgcatgctggcccatgagggcataatccctgaggaagtggccgctaaaatcatagatgcccttgaaagcctcagggaggagggtatagaggcccttgacatggacccatcggtggaggatatccatatggccgttgagaactatgtaacggccaggatcggagaggaagcagggttcatgcacacaggcaaatccaggaacgatcaggtcgcaaccgatctcagactggccctcagggagaggataaggacaataagccgtgaactccttgattttattgacagtatctcagaccttgccctcgatcacaccgaaaccgtcatggtgggctacacccaccttcagcatgcccagccaacaaccctaggccaccacctcatggcctacgccagctccctcaggagggactatgagaggctccaggatacccttaagagggttgaccagaaccccctgggatccgctgccatgacaacaaccagcttccccataaacagggaactcacgacccggctcctcgggttctcagattacatgaaaaattccatggacgccgtcagtgcaagggacttcatagcagagacggtattcgacctctcaatgctggcagtgaacctcagcaggatctcagaggagatgatactctggagcacccacgagtttggtatcgtggagatacctgatgaattctcatcaacatcatccatcatgccccagaagaagaaccctgatgtggctgagatagcccgtgcaaagacatccaccgtccagggagaacttgtaaccatccttggaatcatgaaggcactcccctacacctacaacagggacctgcaggaggtaacaccccacctctggagggccgtcgacacggtactctcaatgatcagggttgtcaggggaatgctcctcggcatcagggttaacaggaaccgggcccttgaacttgcaggtgccaacttcgcaacagccacagaccttgcagacatcatagtacgtgagcgggggatacccttcagggtggcccacaggatagtgggaaggcttgttacaagggccattgaggacggcctcgcacccggtgacgtggattcagtttaccttgacgaggtcagcctggaggtcaccggacggaaacttgaacttgaccctgaacttgttgagaaggcccttgatccccttgagaacgtcaggatgaggaggatacctggaggacccgcccctgagatggtcagggttgcggttgaggagatgaagtccttcattgaatctgagaggaaatga

SEQ ID NO: 24814 - DNA, 1194 bp, Methanobacterium thermoautotrophicum
gtgatcatcatggtgactgaagtggatgtacttgtaatcggagccggaccagccggttcaaccgcagcaaaacatgcagcccttggaggagccgatgtactccttatagacaagaaatcagagataggagccccgaagaggtgtgctgagggcgtgtccatagggggccttgaatccctgggtatagagccaaacccccgctggatcacaaagaaactcgacggtgtccgcatggtttcaccaaacggcaccgatgtatggttaacatccgataaggtcgagctccctgaggcaggttacatccttgagaggaaggtcttcgacaaattcatggccatggacgctgcaagggccggctccaggataatggtgaagaccattgcaaccggaatggagaggaccgatgacggctaccttgtaagtgcagagtgcatgggagagaaatttgagataaaggccaggatagtcatcgctgcagatggacccgaatcaagggttgcaaggtgggccggcctcaacacagccacaaggccgaaggatatggagtcagcggcccagtttgagatggtcggtgttgagatggaggacaacaactgtatagagttctactttggaagcgttgctcctggcggttatgccctggatattcccgaaggcgatgacatcgccaatgttggccttggggttctttcaacagagaccgataagagcgcctatgagcacctccttgagttcgttgaatcatgccctgccaccaggaacgcgcagccggttgaactcaacattggaggtgacccggttggtggcatgccaaagaaactggtggccgacagcctcatggttgtgggtgacgccgcaggtcaggtcaaccccctcacaggtggaggtataataagcggtatgaaggggggtatgctcgcaggccaggttgcagctgcagctgtctctgagggtgatgtaactgccaggcggctcggtgagtatgagaggctctgccgtgaagagatcggggatgagatatcaaagtatctcaaggtcaaggagtacctgcttacactcagtgacagtgagctcgactcaattgcagaggccttccaggacgttgaatttgagaaggtgagcaccaccgagcttgtgaagaagctcataaaggtttcgccaaaggctctgctcaaactcggaaaactcttctaa

SEQ ID NO: 24815 - DNA, 2481 bp, Methanobacterium thermoautotrophicum
gtgtggggctggctgcaggataacaccacactctacaatacagggaaacttccaccgacccacaacctgctcgcattctactggtggatgaggaaggtctaccgtgcagacgccatactatcagtgttcagtctcgtgcccctgatgccgggaaaacaggagggcctatcaagcaaggactggggcgctgttttactccaggacatgcccataatccacgtgctccccatggacgcccccgcaatctttgacaagcgaagggcaaacatgctgatcataaacttcatgacacccgtacttataccctccggactctacggaaacctctccgaactctatgataacatcagactatacatggaaaccgttgatgacaccctgaagaatgcttaccgtgataaaatcataaaccagagccggacagtgggattcaactacacaggcgacagtttcgatgaattcctcgcagatgtcacagcataccttgatgatatcagaaaaagctacataccctatggaccacatgtccttggaagagcacccgaaggcgaagaactcatacagctattaattgcgatgctgcccccaatcaatgggacagctacagagagtctgctgagggaggtcgtgctgaacaacctcacacccgaagaggctcagatcagaaccactggtagcttaaatgctaccataacaggctacctccagcttgccattgagtatacacagagaatccgtaactgcaccagcgagataacagccatactcacagcccttgaaggtggatacataacacccggtcccagaggtgaccctataaggaaccctgatgctctcccaacaggaagaaacccatatccactggattcaaggacaattccaaccagaactgcatgggaaactgcagtgaaactcgttgacagcttccttgaggattacctgagtaaacatggaacctatcccacaaaggttgcattcgtcctgtgggcctcagagaccatgaggcaccagggagtaatggaggcagagatactctacctcatgggtgttaaacctgtatgggactcaaagggcagggtcaaggacgttgaactcataacaaaccttacaaggcctcgcatcgacattacagtggttacctcaggactctacagggaccttcacatggatataataaccctcattgacagggcagttaaactcgctgctggagccagcgacacccccaaccatatcaggaacaactcagaaaccatctacctgaaactactgggagaaggtttcagtgagaccgatgcaaggagattatcccttctcaggatattctctgaggaaccgggcgcctattcaccgggcctccaggaggcaatacctgcaagtgaaacctggaataacagtgatcagctagccagtttctaccttgagagggtctcatcggcctacggtgaaaatatcactggattgaaggttccctccatcttcagggagaaccttatggatgtgactgtggccatgttcagcaggagctcaaacctctacggtgcccttgaacacccaatggtagcagcctacttcggaggcctcagccttgcagtggagagagtttcaggttcaaaaccagagatgtacataaataacctccgcagtgatgcaaagatagaaacgatgagccagttcctcacaagggacctcctgacaagatacctcaaccccagatggattgagggtatgatgaaaggcggctatgacggtgcaaggtatattgattcctttgtggagaacctctggatgtggcaggttacaaatccagaactggtatctgaatcgacatgggatatggtgaacagcatctacgtgagggacagttatgacatgggtctgaatgaattcttcagcaaatcaaatccctatgcaagggcttcaattattgcaaggctcatcgaaacagtgcgtaagggctactggagcccatcagaccaggttaaggcttcccttgccaatgagtatatcaacatggtgaatcagtatggtgttgtctgctgccatcatacatgcgccaacatagtgctgaatcagtggatagtcagcctctcaacattgaacagtgccgcgattgagaagttcaaacatacaatggctgccgcatggggagagaatcttccagctactgatacagataaaccctcaaacgagggcaatggagaacattcagtgtcagatggttcatcacgaggtgaatccgatgccatgagtgcagcgacatcttcaggaacctcaggttcggcaggagtttcacaatctacctcagcatcctcatcacccactgaaaatggtgatgtaaaggcttatgaggtagcagcatcaacagagggtacttcagagacaacacagatgccagtttacgccctcattggcatcattgcaatagtgggtctcatgggtgcaggttacctcctcagtggacgtagaaagataaaataa

SEQ ID NO: 24816 - DNA, 1203 bp, Methanobacterium thermoautotrophicum
atgtggagaggaggtcaaaacccctccttcagatggctggagacacgtagagtacatgttgaagaggaagatctgatgagaatagcatttgtttatgatggtgcctatccatggatcaagggcggtgtggaaaagagggtctatgagattggaagaaggctcgctgagaggggacatgatgtccactggtactgtgtggggtggtggctgccagataatggggaaagaaccattgagattgatggtataaaataccatgcagtctgtgaaccacttgaaatatatgtgaatggcagaagatcaataaaggcagccatcaaattttccataagtctaacaagacctcttttaagggagaaatttgatatcatagactgtcagcagtttccatatttttcatgtttttctgcaaaattggcttcattagttaataaatcctccctcatcataacagttctggagtactggggggactactggtatgagtatcttggcaaggttgggatttttggtaaaatcgtagagaggttgactttcaatttaacatcagattacataactatatcctcccatgttaggaactatctgagcttttgtaaggattccatacacattgtgcctgatggagttcccttcaataaaataagaaaaattaaaccttcttctgagaaagcaaatttgatctttgttggacgtctaattaagcacaaaaacgtggatgtgctcttaaaggcacttcatttactcagagacgacggatttaagctaacgtgtattataattggtgatggtcctgaaaaggaaaacctgatgaaaatcacgagagatcttggtcttgaagcccaggtcaagttcatgggtagagttccctctgatgatgaagtatataagtatatgaaatcttgtaatatctttgtttttccatcttcaagagaaggggctggtttggtcaccttagaagcaaatgccgctggattacctgtgataacaactaaccataaacttaatgctagccgagaacttatcaacggaaaaaatggtgttctatttaatctagatcctcatgatctgaaggaaaagataattttaataatgaatgaacatgaaaaattaagaaaagactgtataaaattcgcagagagttatagctgggataaaattgctgatttaactgaaaatgtttatttagaggttttaaaatga

SEQ ID NO: 24817 - DNA, 1047 bp, Methanobacterium thermoautotrophicum
atgaagagtgctttgattacaggaataactggtcaggatggggcttatctggcaaaatttctcttggaaaagggctatgaggtttatggaatttacagaaggctttcaactcctaatttctggagacttcagtaccttgaaatatttgatagaattaatctcgtacccgcagatctgactgatgagttctcacttctagaatcacttaaaatatctgatgcagatgaagtataccatcttgctgcacagagctttgttggaacatcattcgaacagcctacgagtacagcacatgttaccggtgttgctgttacaagcatgcttgaagcaataagacattataatccccatataagattctatcaagcctcaagcagtgagatatatggggatggtcacaccacaatccttaatgaaaactctccatttaagccatcgagtccctatgcagctgcaaaactttatgggtactggatgaccagaatctacagagaaggatacgacatttttgcttgtaatggaatactctttaaccatgaaagtccgctacgtggccttgagtttgtcacaaggaaaatttcgaataccgctgcaaaaatagcccttggacttgaagatgagctccttctcggaaatcttgatgcgaagagggactggggttatgcacctgattatgttgaggctatgcacatgatgctccagcacaaagagcctgatgacttcgtaatagctacagcagagactcatactgttagggagttctgtgaaaaaagtttcgaggaacttggtctcgactggcaggattatgttaaagtggacaagagatttttcagacctcttgatgttaattatctctgtggtgattactcaaaggccagagaaaaccttggttggcaacctaaaaccaaatttgaagaacttgtgaagatcatggttagagaggatcttgaaagatgggaaaggtggcagaacggagaaaaattcccctgggacgcgtcaaattatcctgatgaaacaaaattgataacgagggcactgagatcatga

SEQ ID NO: 24818 - DNA, 4686 bp, Methanobacterium thermoautotrophicum
atggaaggcatcagagtaatacttatggcagtgttcctggtctttgtcctgccgggaacggtgagtgcagagaacacagcagacaacgggacagtggatgttcttgtgatacactccattgagggtaccagggtcgtgaatgatgcagcccaccgggtcctcgaggagtaccctgacaggaacatcacagtgagggtcagaagctcaccccagatagttaactccacaccggaggagatagaggccctcctcaactcatccgacgttataatatgcaactacctggggacagatgactatacaaagatactgagggtcctgacagataaaccagagatcctgaatggcaaatttttcgcactctttgacggtgcaagcggaatcgagcttgtgaggatgagcaggataaatgatacgcaggttttcagtggcgtccctgacaccgtggtgactgcggtgagcagggccctgagggtcctcgagccactcccattcctcgaaggctacgtaaaccagtacccccagatagccatctgggcccagggtgaaggatactactgctacaggaacgtggagagctacaggaaccagatactatgggctgccgatacatgggcacgtacaaggaacatcacactgaacgtgacctatggtcctccaagggccgtttcaagggaactgctctaccgtgacggaaaactctacgataacctcactgattacctcagggactaccccatcgacccatcaagaccaacggtcggcctgatagaggcagaaagtaacatgctcggaggtggcgcagcgcacatagacatgctcatagacagactgaaggacaccctcaacataatctcggtggttgcaaggtacggtgataacgcctactctgcaatggtgaggttcttcaccacggcaccgaatattgctgcattcgaggcaaacaggaccctctacacatcacgtgtggaggccattgtatcattcagcacctacctcctcggggggacatcatcagagaaggttaacagcctcctcaagttcatgaacgtcccggtactgaggggggtcgtggtgaacacaaggaccgttgatgactggctcgtctccagtgatggtgtcacaccatggagcagggatgacataatgggacaggcaggcttcccggagacccagggcctcatagaacccataatcatcgctgcagcagaattccaggccgataacatcacaggggcatacacatactcctactcaccattacctgacagaatagagaaactggcgcagagactcataaactgggtcaacctgagaataaaaccagaatcagagaagaagatagccataatctactacaactaccccccaggaaaatcagagatcggtgcaagctacctcaacgtaccagagagcatatatgaaatccttctgaacctccgggccagcggctacagcgcaggtaacatctcaggcgcagctgaactcataggcctcatggttgagagggggataaacattgcaaactgggcccccggcgaactcgagagactggcagataccccgggtgtcgtactgtgggatgcagaggaatatcaggcatggttccagaccctcaaccccatcgcaaggagatacgtcacagagggccccacggcatacattgaggagctggtgaagctggccctcagcagaggtaccagcgcagtcacactgatgaagacagtggacacatggtacgctgagatgaaggacaacataaaatcatctgagaaacaggtggagggacttcagctccttgaggtcatgtacaccgcactcaggggagtaataaatggcaactccagcatgtggaccacattcagggcggccagggagtcattcatgttacttgccatacccggactctgcgggtggggtgaggcccctggcaacgtcatgacggttacaaggaacggccggaagtacatcgtcatacccggattcatccttggaaacgtcttcatagggccccagccccagcgtggatgggaggccgaccctgaaatgctgtacagtgttggcatactgcctccacaccaccagtacctcgcatactatgcatggataaacagggtcttcaatgccagtgcaatgatacacatgggtacaatgggaagctacgagtggctgcccgggaaggaggtgatgctatcagaatatgacttcccggacattgtcgtcgatacaacaccatccatatacatataccgcgttgataacgccgccgatggacttgcagcaaagaggaggggccttgcagttataatagaccacctgacacctgcaatgaaatcaacgaccctgtacggcgaactcctccagctcaaaaacctcataacaggctacaagaatgcagcggatgatccgctcaggaaccagtaccttgcagagataagaacagcggcactcaaagcaaagctcggggatgaactgggcctcaacattgaaaacacgacagccgatgcactcatacctgcaatatcatcatatctcctgaagattgagggcaccctcataccctacggtttacacacctttggaagggaatggagccatgaggccattacctacatggtggcctcaatgatctcaaccggtgacacatccatctaccgcttactggcagcagattatggatggatctacgaggaaatcacagttgatcagcgaatgatactggagaacaggacacttgaaatgatccaggccctcttaaacggctcgaaaccagagaacatcacgtcctcaccggacatcattgcagtgctccggagcgcagcagagtacattgaactcatcaggaacagcaccaggatggagatgtcatccctcctcaacgcactcgcagggggctacgtggagccgggactcggtaaggagcccctgatgaacccatcagcactgcccacagggaggaacttctacacaatagatccaagcatagtgcccacatcagcggcctacagtctgggagcagagatagtgaggaaggtcctcgccacctacaccgagcctccagagaagcttgcagtggtaatctggggagtggacacagcaagggacgacggggccatggtcggattcgtcctgaacctcctcggtgtgaagccgatatggagcagctcaggacaggtgacaggcgtgacactgataccgctgagtgaactcggaagaccaagaatagacgccgtggtcacagtgagcggactcttcagggacgtctatggacaggcagccgtaacaatggacagggccttccgcctggctcttgcggcatcctaccgcacagtactcacagagcaccccgaggtttcagaggcccttgaggcagccgtcaaacccctcagagctgttaaactcttccaggagggaaatgaccccatccagatgaacagggtggcagggcactggcttgaacttgtcctcaaatacatgaacgccggtatgaatgcatcaacagcaggtaaccttgcaatatacaggatattcgctccacccatgggatcatatggtacaggggtcaaggaggcaggtgagatgtcctggacctacaataacacggatgaactcgcagatcttttcataagccgcatgggcacatcatattccgagacgggatggggtgttaagaacgtcgacctcttcgcggacctcctgaaaggtgtatcagcggtctaccagggaagaagcacatacctcgttggtgtggcagagaacgatgacatggcagactaccttggaggattatcactggccataaagaaactcacaggaactgcgccatcagtcaacatcataacaacagcagcaggaaacccccagttaatgtcactgcaggaggcactggcccttgatatgaggtcaaggtaccttaaccctgaatatgtgagatcactcatctctgagggctatgctggtgccaacagattatcaaccgcagtgcgatccatatggttatggcagaccacggcacccggaagtgttccctcatggacatgggatgcgctcgccgacacatacataagggatgttaatgggctgggtgtcagggactggctttcaggcaggaactcctatgcactgataagcataaccggtacaatgctcacagctgcatatgagggccactggaatcctgatgaggccaccctgcgactgcttgcatcaacatgggcatcactgacagccgagaacggtgtagcctgctgtgactgcagctgcggtaacatagcaatgatgcagtggaccatgcagtacctcaacccggatcttctctcaagggtcagggagaaactctacgctgccaccaggagctcagcattcgcaccagcctcagatggaggatccacaccaggagtcccatcaaatccaggaacagtgactccaggaacatcagagaaccatgatggaggatcagcacactccacaggatcctcaaggagagccacaagccccgaaacagaaacagagtcgtcagacacttctccaggtgagacaggtaccggcagcgcctatgaggtcactgagaagggaggaactgtgcaggcgaaaacaggtctcccggtagcagccatactgggtgttgttgtcctcgttgcccttgtgggtgttggatacttcattggagggaaggggaggatctga

SEQ ID NO: 24819 - DNA, 966 bp, Methanobacterium thermoautotrophicum
atgatggtcacggtcattggagcagggagcttcggaacagcgatagcacaggtcctatcatggaatgctgagatggtccgcctcatggcccggagatccgaagttgtggagaacatcaacaggacgcgcgaaaacagcgcttatcatcctggagtgaaactgagggataacatagaggcgacactcatggacggttccgtgctggaggaatccgagtacgtattcatggccgtgccatcagggaacctcaggagcatcgtaaggtcaatgaacagcagccttgaggataagaagatagtatcctgtataaagggaatagagcacccaggcctcaaaaccatgagctctgttataagggaggaaacagggtccaggacagtattcagcatatccggtcccaacttcgccgacgaactcataaggggcatgacgtccgggataacagtgggtgccagcaccagatatgcgagggaaattgcagggcttctgaagtctccccgcataatcctcgaccactcagagaacgttgagggtgttgaattctgcgggatactcaagaacgtctacgccgtggccatgggtatactcgacggacagataacaggcgagaatcaccgccactccctcctgaccctatgcttcagggagatgaacctgatactcaatgagatggggtacggtgaactccatgacaggttctgtggatttggagactttctcctcacatcaacaaccgataagagccgtaaccgcaccctggggctcatgctgggtaagaagatgagactcagcgaggactccaccataaccatagagagcctcaggtccataagggccataagggagctgacagagggtcttgagctgccggtccttgaaatggtataccagaccatgcaggaacctgaaaacgtcaacctctacataagggaattccaggagaggatatccagacccgaattttag

SEQ ID NO: 24820 - DNA, 1188 bp, Methanobacterium thermoautotrophicum
ttggtaaccgggccccggaaaaggaggtttataggattgaggatacttcatgtaacaccatacttcaaaccctcatgggaggcaggtggtcctccccgttcagtctatgacctggcatcgaggcaggtgtctgctggacatgaggtcacggtctacacaacagatgggttcaagaggcgacttgacgtcgaggttaacaggcccctcgatgttgatggcataaggacctactatttcaggaacctttcaatgtacctggcagggaatatgaacctcccggtaccacttaaactcccctatgttgcctggagggagatccgggaatttgatgttgttcatatccatgagcacagaaccttccttgcagccgttgtagccacactggcatcacgtgcaggtgtaccctacattgtacagccccacggctccgtcccgaccatgtcgagggctaccctcaaggaagtattcgatttcattgcaggtaaccggataatgtacggggcgtcccggatagtagcaacatccactgtggagtcaggtttctaccggaaggtttaccctaaactcgacgctgaggccatagtgaaggtacctaacccggtcgatatccctcacagaccatccagggggctcttcaggaagaaatggggtcttgaagatgcgcggatcatactctacctgggcaggatccatgaaagaaagggtctcgacatactcctcagggccttcagggacatggatgaagacacagttctggtcataacgggacctgatgaccactacctggaaaggctcatgggcctcatagatgaactgggaatcggtgaaagggttctcctgacaggtcccctctatgaaatggataaacttgaggcctatgtggacgccgatgtgtttgtgctgccatcggcatcaaagtatgaatcctttgggaactccgctgcagaggccattgcctgcggcaccccggttgtcgtaacttcaagttgcgggatatctgagtggatggatcccggtgatggcatcatagcgaggccctcagccagggacctgagggatgccataatcagggtcctgaaggaacgcgactccttcaatccatcggcagagaagttcgaccctgaatcaatatcagagacatttgaggacatttacctggaggtcacccataaggcttccagacactga

SEQ ID NO: 24821 - DNA, 1005 bp, Methanobacterium thermoautotrophicum
atgttaccaggaaaacccttattcttacaagggaaatcatccaaaatagggagtgatgctaatatggaaactcagagaatactcgtgaccggtggcgccggattcataggtacaaaccttgtcaatgaactgaggaacaggggccatgaggtccttgcggttgacctcatgcacacagaacgcgaggactacatgagggccgatgtcagggagtacaggcaggttgagaggatctttgaggaagataaattcgactacgtataccacctggccgcagagtacgggagatggaacggtgaggactactatgagaacctctggaagaccaacgtcataggtacaaagcacatgctgaggatgcaggagaagcttggcttcaggatgatattcttctcctcagcagaggtctacggggactacagtggtttgatgagtgaggatgtgatggtcaaaaaccccataagcgacacctaccagatgaatgactacgccataaccaagtgggccggtgaactcatgtgcatgaactctgcagagatgttcggcacagagactgtccgtgtgaggccggtgaactgttacggcccccatgagaagtactcaccctacaagggcttcatacccatattcatctaccatgcactacacaggaagccctacaccgtctataagggccataagaggataatcgactacgtggaggactccgtgaggaccttcgccaatatcgtggataacttcatccccggggaggtctacaatgtcggcgggcgaaccgagtgggagcatgacatcaaggagtactcagacatggtccttgaggctgtggggatagatgactccatagtcacctacagggagtcagagcccttcaccacaaaggtgaagaccatggacttctcaaaggccataagggacctcaaacatgacccacaggtaccccccgaggagggtatcaggcgtacagtcgagtggatgaagtggtactacaggatagaggactga

SEQ ID NO: 24822 - DNA, 999 bp, Methanobacterium thermoautotrophicum
ttgattatggatgaattcagggcttatgatggtaaatgtgttcttgtaacaggtggagctggatgcgttggaagcaatctcacagggaaccttgcaaaggcaggggccaatgtgatcatactggataatctctcatcaagctatgagtggaacatcccggaatatgagaacatagaattcgttaagggcgacatactcgacgatgaggtccttaaacgggtattcaaggagaggccggactacgtcttccacctcgcagcccactttgcaaaccagaacagtgttgacaacccggagaaggacctcctggtcaacgggctgggcatactgaaggtccttgagtatgcacagcttgtgggtgttgagcgcttcgtttactcatcatcagggtgcggtgtctacggcctggactcaaagataccctttgaggaacacgacatctcaatatcactgcacaccccctaccaggtcaccaagctcctcggtgaactgtacaccaactacttccacaacctctacgagatgcccatagtcaatgcaaggttcttcaacgtcttcggcccgggtgaggtcccagggaagtaccgtaacgtcatccccaacttcttctactgggccatgaaccagcaaccattacccataaccggggacggctcagagaccagggactggaccttcgtggaggacatagtcaggggcctcatggccatgggtgtcagaagggaggccataggcgaggccatcaaccttggctcagggaccgagcaccaggtcatagagatggcgggtatcataaacgagctcacagaaaaccctgcaggcgtggtctacaggccgaggagggactgggacgccaagacaaggctcctgtcatcaatcgataaggccagaagactcctggactacgagccacaggtatccttcagggagggacttgagaggacccacaggtggttcacagagaactgggagctcataaggaagagcgcagagttctaa

SEQ ID NO: 24823 - DNA, 897 bp, Methanobacterium thermoautotrophicum
atgaggttcgatgcggtgggccttggagccctcaacatggaccagctccacatggttgagaggatagcaggcccggatgaggagaccttcgtgagggggctcgtggaatcctgtgggggctcagcagccaacaccatgataggcctctcaaggctcggtctcaggacagcccacataggtaaggtcgccgatgacagggaggggggactcctcaggagtaacctctcatctgagggggtcacggatttcaccgtcgtagcggatacaggtagaagcggccgtgtgatgggcttcgttgaccctgacggtaacagggccctctacgttgaccctggagtcaacgacacactcagggtggatgaggtggctgatgaggcccttaacacagaactgctgcacctcacatccttcgcaggtgatggcataaatgtccaggtggaagtcattgaggcactggatgaatccgtgaccgtcagcctggatccaggacacatctacgcctcaaggggagtatctgagctgtcagatatcctcgagcgcaccgacatcctcctcacaaaccagagggaacttgagctgatgacagggtccgctgaccctgaggaggcagcatcactcctgggaatcggggtggttgtggttaagatgggcgcccgaggcgtcagggcatgggacggtgagtctgtgatggtggatgcactgagcaccgaatgtgttgatacgacgggggccggtgacgccttcaatgctggcttcatatatgcctggctcgagggctttggccttgaggtttcatgccgttttggaaactacatagcatcacggtgtatcggaggatacggtgccacagaatccctccccgggaccggccctggatgtcctcaggaggtacgctga

SEQ ID NO: 24824 - DNA, 1023 bp, Methanobacterium thermoautotrophicum
gtgagggttatgaggatatgtcttgttggactgggagctgttggtcagggattcctcagggccgttcagatgaagggcgagtatctgagggaaaggtatggcctcgatataaggttcacgggagtcgcggattcatcaggagccctccacgacccggatggccttgacatcaggggggtacttgagcacaagaagcgggccggcctggggtcacatccctcaggatacgaggggatgaccggagatgaactccttgatgaggcagaatatgactgcctggtggaggcaacaccaacaaatatagaggacggcgaacccggcaggtcactggtcctgaaggccatgggtgacgggaagcacgttgtaacatcaaacaaggggcacctggcccttttctactctgaactcatggaggcggcctctgaggcaggtgttgagttcatgttcgaggcatctgtggggggtgccatgcccataataaaccttgcaagggagaccctagcatcatgcaccatagaatctgtgatcggtatcctgaacggtaccaccaacttcatactctccaggatggcctctgagggatcatcctacaggcaggccctcattgaggcccaggagctgggcattgcagagacaaatcccgcccaggacgttgaaggtactgatgcggcctgcaaggctgtgataatcgccaattcaatcctcggaaggccatgcaccctcagggatgtcagggtcgaggggatcaccggtataacccagggggccattgaactggcagcccaggaggggtacctcataaaactcattgcagagatctcaggggacaggctggaggtcggacccaggctggtgaggatggggtcaccctacgccgtggacgggacactgaacatggccaccctcaggacagaccttgcaggtgaggtgacagctgttggacgtggcgcaggatcccttgagacggcctcggccatgctcacagacaccatcaccatatggaggaagtctggagggcgttaa

SEQ ID NO: 24825 - DNA, 1776 bp, Methanobacterium thermoautotrophicum
ttggataatcattacttcccattcacagccatcgttggacaggaactcctcaagaaggccctcatcctcaacgccataaacccatcaataggcggcgtcctgatcaggggcgataaggggacaggtaaatcaactgcagtgagatcactgagggatgtactccctgataggaaaatggtggagggctgcaggttcggatgcgaccctgatggagcagaaatatgcatggagtgccgcagaaaacttgaggaacagggtagcctgccatcaagacaggtcaggatggaggtggtcgacctccctgtatccgcaaccgaggatatggttgtgggttcactggacataaagagggccctcagggatggaataaaggcccttgagccaggcatacttgcacgtgccaacggcaacatcctctacatcgatgaggtcaacctccttgatgactacatagtgaacgtcctcctcgatgcagcagccatgggcgtgaatatcattgaaagggagggcatatccatccagcatccatcaaggttcatacttgcaggtacaatgaaccctgaggagggtgatctcagaccccagatacttgacagattcggcctcagtgttgatgtggaggcaataaaggaccctgatgaaagaattgaagtcataaagcgtgcaatgaagttccaggaggatccagagtccttccactcaaggttccggaggaaacaggaggagctcagggagaaaatcatcagggcacggagtttacttgagatggtcgagttggatgatgagaccctgggcctcatagttgagatagcagcagcccttggcatcaggacccacagggccgatatcataactgcaaggaccgcgagggcactggcggcattcaacggcaggaggagggtcacaggggatgatgtgatggaggctgcgctccttgccatgaagcacagacttagacagctaccattccagaggcaacaggaactcagccaggagattatagaggacatcatgaatggcgaattcgaggatgactcagagattgacagggaacggaggctgaggcgtgacctgaagatccctgacctgaagggatccctccagggtcagagcagttcaacggtaaccgggaggaggggtaagtatgtccgcgcccgggagaaccctgaaccatccagcgtggccgttgatgcaaccctgaggaaggctgcttcagctggaaccggaaccatagaacccgaacacctcatggagaaggttcggatcgggaaatccagggcactctacataatcgtccttgacacctcgtcatcaatgagacttgagaggaagataaaatttgcaaagacggtctcatggctgctcctgagggactcctatgaaaagaggaacaggatagccctcatagccttcaggggatatgaggcaaacctggtggttgagcccacatcgaatcttgagaccgttgaggaggcccttgagggtctcaggtcaggcgggaggacacccctcacaccggcactcagactggcagctgaggttgcatcatcatccagcgatgaggcatgcacagccgttgtaatatcagacggccgctgcaacgtattcatcaactccaacctcgaggaggacatgaatatgcttgaaactgaactgaggaacctgaaccttttattcgttaatgcagaacccgagaagaggagcctgggtatacttgaggacatggcgtcacgctttggctctgaaatcttctaccttgatgatatactgatctag

SEQ ID NO: 24826 - DNA, 2580 bp, Methanobacterium thermoautotrophicum
atggagatagttcttggcataacactccctgaacttgacggaggctttgaaccggtattcacggcgggtatgaggactctcaatgaccccgacctgggggaggtgagggttgttgacgtggtgccagagcgcatggacagattcgctgcaaggatactcaactggctgaagctgaggacaatggagaaccatgagaagaggatagggataatcctctatgactaccctccgggggaggccaaccttggaaacgcgggctaccttgacgtatttgaaagcctggaggttttcctcaggaggctgagggagaggggatacagtgtgaggatacctgatgaacccatcaaggatattctcatgagggagggactcatcaacagtccatcctaccatgaatatggcggccagaggatccccctcagtgattacctggaatttttcagtcgtctgccagagaggatccaggatgatgtgagggcaaggtggggcgaaccaccgggggagctgatggttgatggtgatgacatcatcatcccggtgactgaactgggctcggtctacctgtgcatacagccctcccgcgggatcatggagaccgacagctaccatagcagggataatccaccccaccaccagtacctggccttctacgcctacctcaattcactgggacttgacgccatcatccacttcgggatgcacgggacccttgagtttctgcccggaagggagaccgccctgggggctgaatgctaccctgacctgctcctgggggagctccccaacatatacctttactgggcaggtaacacctcagagtcgaccatagcaagaagaagaacctacgccctcccggtggcacatgcgtcaccacctgtgaggcagtctgacctctacggtgactacctggtactggaagaactcatcgaccagtggcatggggaccctgatgatgggttgagggatgaaataattgagagggcctcacagcttaacctgaggggggatatccctgagattgagtctgaactcttcaggatgaaaaggcgactgataccaaggggccttcacataatggactcagagtgggaccccaatgacatggtcagctacctcctcggtgtactcagatttgacagggaatacccctccatccattcaatggtggcagagaagcttggactggattacaggggttcaatggatacagccacaggatgggagattgagaggcacgcggctgaggctttgaagaggatactaacagggaagtcagtggatcttccccctgaatacgttgaatgggtgcgtagcttatctgagcgttgtgacttcaggggtgaaagcaggggcctccttgaggcacttgagggaaggtatgtgaacccctccaggggcggagacccaatcagggaccctgaggtatacccgacaggctactccatgcacgcctttgaccccatgaagataccggcacccctggccgaatcaaggggcaggcttgcagccagaaaactccttgaggactacctggaggaaaatgggaggtaccccgagaccgttgcagtggttctatggggattcgaaacccttaaaacaggtggagataccatttcaatgatcctggaactcctgggggtgcgcataaacaggaagtatggtccatgggcaaagaacatagatgtcatacccctcaatgagcttggaagacccagggttgatgtcctggtgaacatctgcggcatattcagggacacactcggatcccagattgagatacttaacagggccttcaaaactgttgcaggtcttgacgaggaccctgaggataattacatcctgaaacacaaccttgaggatggagaggtgaaggtccccccgaggatattcggacctggaccagcggagtatgccagcagcatccctgatatcataggaggtggtgcctgggatcaggaggatgaactggcagcagcctacctgggggagatgtgttacgcctatctcccggattctgtgagagaggcaccggatgaattcaggaggaacctccagagggttgagctcgtggcccaggagagggataacgtggagtatgaggtgacagaccttgaccattactatgaattcatgggcggcctcacctcctcggtgcggaacctggggggttcctgcagcgtcagggtcgtggattcaactgaggatgaaatctacgttgagggccttgatgaggttatagggagggctgcaaggtgcagaatcctcaatccggtctggctggatgggatgctcgcccatgaccaccatggtgccaagaacatcaaggaccgggtggaacacctcctgggattctctgcaacgaccggtgcagtggataactgggtctatgatgatgtcgcagaaaccctgatacttgatgatgagatgaggaggaggatctcagagaacaacccctatgcggctgtgaggatgggtgagatactccttgaaacagctgagaggggttactgggatgcccccgatgagacccttaacaggatcagggaggtttttcttggccttgaatatgagcttgaatag

SEQ ID NO: 24827 - DNA, 1242 bp, Methanobacterium thermoautotrophicum
atgcagattctgaggggtattggtgcgggtgcaggcaggagcagtggaagggtccgcataataaggaacctcgaggacgcgaggaaccttgaatggggagaggtggctgttttcaggaagatatcccgggacatgctaccggagatccggagggcaggcgctgtcatagcaaactacggcggcctcacaagtcacgccgcgataaccctccgggagcttggcataccctgtgtccttggaacagaggttgccactgaggtcctccgtgaaggtatgatagtaactgttgatggaaaaacaggggggatctaccgcggggtgatggactgggtgaaggctgaggatacccccggtttccatgagacagccaccgatgtcatggtaaacctcaactttccctggctggcaccaaaggtggctgaattcgcagacggtgtcggctcagtaaggatagaaaatatggtgatagagaccgggaaacacccccacctcctcctgaaagagggaaaactggcaggagtccttgagaaggggctcagggagatacttgaggcctttcaccctaaacccgtcatattcaggaccttcgatatccctgttgatgagctcacaaatctcaggggctccttcgaagcctctgagaggaacccgttccttgggatgagggccataacaagggacctgatggaacctgagatcctgatggctgaatttgaggccctggggaacctcctggattctggttacaggaacctccagcttaagttcccatttctcagggacgtggatgagtacgtgactgcagttgaactcctggaggagtcaggaatcacgccccacagggatatagtggtcggggcatcagtggagacaccatcggtggccctccagattgatgaactcctggccgctggcgctgatttcatatcccttggcatgagtgacctcacaatgtgcagccttgcagttgaccgcagaagcacccgcgtggccggcctctttaacctctcacaccatgcagtgcttggactggtggaagatgttataggcgcctgtcatgagggtggtgtgaatgtctacgccgctggatacgctgcaaccagctacatgctagtcaggagacttgttgagatgggtgttgacggtatatccacaagcccggataagatcctgaggatgaagtacttcatagccaggatagaaaggtccctgatgctcaggggcgctggaagggtggaatag

SEQ ID NO: 24828 - DNA, 2751 bp, Methanobacterium thermoautotrophicum
atgacgggttcactctgcaggaagggcgaggcatgtacagagaagcagaagatggctgttaagaagacggaggggccgctggtagttgtggcgggaccaggtgccgggaagacccgcgtactcgttgaaagggtcgcatacctcgtcaagagaaagggtgtcagcccggagaacatactcgtcataaccttcacagagaaggcagccggtgaactgaaggcgaggctcataaactgtgtgggactggacgccgagctcatgcagatatccaccatacactcattctgcagcaaggtgctgagtgaccaccccgaggaacacgaattcggggctggattcgagatcctggacgaggaatcccagctcattttcctcaggacggtcttctacaaaataggattggaccgctacatgaagatgggggaggtgcacagggccatcgaattcttcaacagatgcaccgaaaactgcattgaacctgaagagctcataaacgccctcagaaggaaatatcctgacagggaagaataccagggcatcgccgtgtgctatgcccgctaccttgaactcctcagggagcagaagaagatagacttccctggccttgaaaaggaggtctacctcctcctgaactccagcgagagggtactcgaatccgtaaggaagaagtacaggtacataatgatagacgagtaccaggatacaagccccatacaggagttgatattaagggagatagcagggaagaactccagcatctgcgtggtgggggatgaggaccagagcatctacggcttcaggggagccacaccagagaacttcataaggttccgtgaagagtacgacgcagaggtggtcaccctggaggacaacttcaggtcccgggcagggatagtcctgactgcagacagcttcatgaggggcgagagacactacgagaaaaccatcaaaccggtaagggatggcgggaccgacgttgttatactgaagagcagggacgttaactcagaggccaggaacatagtatcactaataaagaaactgaagtcctccggcaagatacctgaatacggatacgtcgcactcctattcaggagcgtccgcaaccacgcagacaaggtccttgcagagctcaggagggagggcataccctacatagtgcgaggagacggctccttcctcaaaaggtatgaggtgaggagcatgctctacttcctcgcctacgtggatccaccggactatggaggaagattcaggaagtgggatggctggtggaacatatccagattcaggggcgaattcctggacctcaccggtgaaaccctccgggccctcgaatcccttgacagaaactgcaggctctcggacttcacatcaaggagggaacttgaggaaatcggtgtacacggggaggatgcagagaagatccttggtctcaacaggatacgccatgaagttgggaagggatcactgacagttctcagcacattctacagtatacttgaggttacagggtacctcaggaggctcatagaggacgggagcgacagtagcagggctaaaatattcaacctcgcaaagttaagttcactgatagacagatacgaggccataaagcccggagcaaggatacaggaccttttatggtacctctacctcctacccacccacctccaccacgacgaggcagccctggaggacccggcgtcggtgaagatcatgacggttcaccaggcaaagggcctcgagttccctgttgtcttcatctgttcggtcataaacggcaggttccctgttaaaaggcgtaaggagagggacaccatacccatacccggggaactcctgctatcacccggggaggtacctgatgaggaccggcgcctcttctacgttgcaatgaccagggcccaggacgccctcatcatatcaacagccccccgtatcaacaccaggaaggtgggtgtgtcaccgttcatcacagacctcagggagaagtgcggcatctatgagtgtgactgcacatccgtcagcagatgccttgaaagggagtggagtgaggagcccctcaggatcaacttctcggccctcttcacctacgaggagtgtcccttcaggtacatgctcatataccactacggcttcgtctaccctgagaccttcatgcagcgctatgggatcatactgcacaggtgccttgaggagctccacctggccatgaagaactcagaggagataaacggggccctcataaggagaatcgttgaaaggtgctggatacccatggggagagacgataaggttaaaaagaggcgccttgagagggaactcctcaactactaccatgacacaagggaccatacaggggaggtggtatcggttgaggagcccttctccatacccgacactgatataataatagaggggaggacagacctgataatcagaaccagggacggtgaacttgaacttgtcgacttcaaggcccgtgagcatggcggtgttgagaggatggcccttgagtaccagctccggacctatgaatacgcactaagggagaggtacaggttcgacagtctatccgcctacgctataaaggactccatgaggatatcctttgactccgaccctgaattcagggttaaggagaggatcgctgaaaccgtcgcgaggataagggaggaatgcttcgaacccaggaagaaccccttctgcagcaggtgcgtgttcaggaccttctgtggcgcagggtga

SEQ ID NO: 24829 - DNA, 1662 bp, Methanobacterium thermoautotrophicum
atggctgacttcaggtgcactgtatgcaactacatattccatgaggaggctgatggggaattcgattcactccctgctgactggcgatgccctgtctgcaatgcgccacgcacagcctttgtgagggttccatccactcttgaggagggcggcaggacggtttctgaggtcttcatctcccagctggcagcttggggtcttaaatacgttttcggcatcccgggcacatccaccctgggactcgttgatgccctcagaaggaacgatgagataaggtacatacaggtgcgtcatgaggctgcagcggccttcatggcctccagctacggtaaacttactggtcagcccgcggtctgcatggctgtggccggcccccgggcatcgaaccttataacagggctccttgacgcggcccttgaccgggccccggttcttgcagtcacaggacatgtcgaaacctacaggataggtacaggtgcaagccaggagatagatcagcatagcctctttgagtctttctcggtctacaacatgacccttgtgagcccggatgaggcagctgagattgccagggaggctgtgaagcacgccatccttgagcggggtgtttcacatgttgacgtcccccgggatgtccagaccatggagtgcacagccccggtgaagcccctcaggggcatgatggcggaggctgcagtcacaccccccaggaatcgtctgagggctgcagctgatctgataaacagagcagagcggcccgtgataatagcaggcttcggtgccctggaagcagctgacagtgttgttgaacttgcggagaggataggggcagccatcgtatccaccttcaggggtaagggcatcgttgataatgactaccccctctacctgggctgtcatggtagcctgggctcggctgctgcggccgaggctgttaggaaagcagatcttctcctggttatcgggtcatcattctctgacctcacccggatcccgcctcggaggaccctccaggtcgacatcgaccccatgatggtagcgaggcgccacccggttgagcagggcctcacaggaaggtcctccctcatagttcaggaacttatatccatggtggaggagaaggaaagggggccctacctggcagaactgggggaactcagggatgaatggctgggactccttgaatcagaggctgatccttcactgaggcccatcaggccccagtacatcatatcagtcctgaacagggaactggatgatgatgccatcataacccttgatgttggtgagaacggatggtggttcggccggaacttccagatgaagagcaccagaggcttctcttttcaggttacctgggggtccatgggtttcggtcttccggcggccatcgcagcacagcttgaattcccggatagacaggtcgtttgcatcaacaacaggaaccttgcaatgataatgcaggagcagcgtgttgaaggattccctgtatggcagacagagctccaggactgtgacttcgcaggttttgcagagaactgcgggggccggggcctgagggtggatgatcccggtgaactggaggactccgtgagggaggccctgggaactgatggtccggtcctcgtggacattgaaacagatccacggcgcttcatctga

SEQ ID NO: 24830 - DNA, 2052 bp, Methanobacterium thermoautotrophicum
gtgccattcatgacaggggagattcagctcacagatgaacagcgcagagcagttgaacacttcaccggacccctcctcgttgttgcagggccgggggccgggaagaccaggatcatagtggagagggtcgcccacctcatagatgagaggggtgctgaaccatcatccctggtcgtgataaccttcaccaggaaggccgcagatgaactcaaggagaggataatcagacgtgtgggtggaagggcagaggagatgcagatatcaaccatacactccttctgcaaccgcatactccgcatgtaccccgaccaccacaccctcggctcaaacttccatgtcctggatgaggaaaaccagctcatgttcatatacgaacacagggaacagctgggacttggcaatgtacagagggagaggttccccctcatccagggcttcttcagcgagtgccaggagaacatggtcgaccccgagaccctgatccagcactacagaaataagggtgcagggaggttcgagatgaccgttgcagaggcctaccagaggtacctcaacctcatggatgagaacggcctgcttgactttgcagggatgcagtggagggtcgtcagactccttgaaaacgacagtaagatcctggatgacctcaggtcaaggtacaggttcctcatggtggacgagtaccaggacaccaaccagatacaggagaggttccttgaactcctggcaggggaggaatgcaacatcttcgctgttggagacgaggaccagagcatctacggtttcaggggatccacccccgaaaacttcctgggcttccagaagaagtacggtgccgaggttgtcatgcttgagaagaacttcaggtccgtccccagcatagttgacgtcacccagcggttcatggatggttacagagagtaccccaaggacataaggcccgtgagggactcagagaacagggtattcatcctggacaaccccacacaccaggatgaaccatccaatgtggtgggaataataagggccctcgttgaccacggtgtaataccccaccagggctacgtgaccctcctcttcagaagcgtgaagcacgatgcagtggagataatgaatgaactacgcagggagggcatacccttcaatgtatacggtgagggaggcttctttgaccgggaggaaatactctacatcatgcacctcctccaccacacccggaatgagaggaggaagataatcagaaaactgaaatacgaacaccttgagggcgagttcatggacctgacccccggcagcgtcaaccgcatcctggacatggatgaggaggaattaaggggcctcagggagcacagggaattcaggggggcaggattcacagaccccgatgacatcaggaaacttgtggccctcaacagactcatcgacagcgacctcggagtacttgagaggtactatgagatccttgaactgacagagtacccccacaggctccttgagaggggtgatgatgagtcaagggagaagctctacaacctggcaaggttcagctcactcataaaggactacgagcgcatatccctggagccaggcgtggagggcctcatggagttcataaggatggccatgtcgggtagaatcaaaaagtacgaccagatactccttgataacccctactcagtcaacataatgacaatgcacagggccaagggcctcgagtttccggtggtcataatatgctctgtattcaacgggaaattccccaggaaggtccgggagaggagtgaactcgaattacccgaggaactccgtaggagcaccatgaggactgatgagatcgaggagaggcgcctcttctatgtggggatgacccgggcccaggacatgctcatagtatcagcaaccaaaaaccacaggggccggatcggttactcggagttcatagaggatctcatcaaaacttcaaggataaccagtgacaggctggggaggatagacccagaggatgccaggatagagatcataaagaacagctgccaggttggaggacattga

SEQ ID NO: 24831 - DNA, 3138 bp, Methanobacterium thermoautotrophicum
atggtgaagtacatccagtacctcatgggtgagaccacatccaacccagtggagaacggccagggcccggttatggcagcccctgactggggactataccaccctgaccgtggcgtcatgagcgtcgcagcaagcagggagcagataagaacctggatagagggcaacccgggactcatcccaccctatgacagcctcaggtggatagaccagaacttctcatcatgggcagaaaaccagcgaaacgatgtctacagagaatttgagaactggtacagtgcaaacaagaacatcacaggacccttcatcgtcgttgtaagctacaacccatcaaacaccgtggatgccataatccgggaggctgagaggcagggaagggcagcattcaacctctaccagggtgccaccagccccgcagtgagttccctcctcgaggagctcacactgggtgtcaacggtaaggggcccctgaaccgtaacataagcgccgtcatatccctctactcctggtccctcaactacgcgaacctgccatccggcggggccctcagcgaacttgagaggatcaatctgcccgtactgaaggctgtgcagctctacagcaactcaagcctgacaaaccccctgggtgcacagtacgagtggacctggcaggtcacaatacccggatttgagggcgtgttctcacccgtggttgtatcatacaccgattcatcacagaatgaggtcgtgattcagtcaggggtccggaagatggtcgaactggcgaatgcatgggccagactcagggaacttgaaaattcagagaagaaaattgcggtgatactctacagctaccctccgggtaaggatggattcacggcatcataccttgacgtcttcaggagcctccatgaactccttgtgaagctcaatgaaagcggctacagggttgagaggataccatcacctgaggagctctacaccatcgtctcagagttcggtaataagggcacctgggcccagccacttcttgagaggtatgtgtcagagcacaggagggagctggaagccagaggtcagctgctcgacatccagaggtaccttgaatggttcaacgccctccctgagaagctgcgctcagaggtcatatcaaggtggggccagcccccaggcaacataatgacggttaacgggtccatcgtcatccctggtctgatgctggggaacatcttcataactgtccagccggcccgtggctgggatgaggtcacagactaccataacccatatctgccaccccaccaccagtacctggccttctaccgctggatcgatgaggtcctaggcgccgatgccatggtccacctggggacccatggaaccctcgagttcctcccgggaaggatgatcggcctcatggaggatgactggcccttccagctcaccagtctgcccaacatatacccatacatagtctcaaaccctggtgagggaatggtggcaaaggaccgcagcggtgcactcatcatagaccacatgacacctgcaatggtccagagtggcctctacggtgcactcattgagatccacgacctcatccaccagtacgagaacgcccttaaggtcggtaacaaccagatactccctgcactggaatcccggataaagactgaggcctcagagatgggcttcaacatgaccggtaacttcacagaggcccttgagagactccacctcagtctacatgagatagagtcagacataatacccctgggactccacagcctcggcagggtccttgagggtgacgagctcctggaggaggttctcaccatagcatcatcaaggtcagatctcctcgagaatatcaggaaacagctctatccgggtctgccagcctacactgagatgctgaaggacccactgcgctacagtgacgagatagcctcagtgaagaaccttgcacgtctatggataggcagcatcataaacggtactgtgccctccgggataaatgccacggaccttgagttcatcaatgacaccatcatgaagatacgtggaaacaccgaatggcagagcatcctcgcagcgctctcaggtggattcataagacctggacttgcaggggaccctgcctggtgtgacgtacttccaacaggcgccaacttctactcaacaaaccccaggaagatgcccacaagggctgcatgggagaccgcagtgaggatagttgattcgatgcttgcagagtactaccagaagcatggcagcttccctgaactcatcggtatggttatgtggggcactgaactcctgaggaccgacgggatagccattgcagagttcctataccttctcggagttaaaccccagtggaacagtaacggtgacgtcaacccagccccggtcctcatgaatgcatcagaactcatgataacagtgaacggtacccggataccaaggccacgtatagacgtatttgtaacagcagtcacaggtaaccagctctggatagacctcatgaataaggccgttgaacttgcagcttcagccagtgacaccgagaactatgtgaaaaaacattacagtgaatgcggatcccttgaccgtgtattcggtctcaggggactcgtactcgagggtactggtgtatctgatatgacacctgcaacctcaaggtggaacaccagcagtgaactcgcagacgtctacctgtcaagggtatcctatgcctggaggtccaccccaggaggcgtggatatacagcagaaccggggcacgttccagtacctcctgggtaaggtgaacctggtgacacagaacctggacagcacatggaggctgatggacaccgacgactactatgactggttcggtggaatggtcctcgcatcaaggcacctgggaggtaaccccgatacagctcttatagatataaggaacaggaacacggttacagtgagaacggtggccgaggagattgaacttgagatcagatcccagctcctcaaccccaagtacatggattccctcctcaatcacccagcgggtggcttgaatatgcttcaaggtacaaaaatgtctttggaattgcagttacaaccggcagcgtcagcaatgaactctgggaccagctcgcaaggaaccttctga

SEQ ID NO: 24832 - DNA, 510 bp, Methanobacterium thermoautotrophicum
gtgatgtgtttgagcagatatgagaaggcgaccttcggggccggatgcttctggggggtcgaggacgccttcagaaaggttgatggtgttgtatcaacccgtgtgggatacatggggggtcaccttgagaaccccacatatgaggatgtctgcaccggtcttacaggacacgcagaggtggttgaggtaacctttgaccctgatgttgtgggttacagcgacctccttgatgtgttctggagcatacatgacccgacgaccctcaacaggcagggcccggatgtgggagagcagtaccgctcggtcatattctaccacagcgatgagcagcgaagggctgccattgagtcaagaaggagacttgaggagtctggaaggttcagagacaggatagttacagccattgaaccagcagggaccttttatgaggccgaggagtaccaccagcagtaccttgagaagaacccccggaggagatgctacctcatgagactactctcaacgaggtga

SEQ ID NO: 24833 - DNA, 1275 bp, Methanobacterium thermoautotrophicum
atgaaacccaatctgaggagggaactcggtctcttcgacgcggtgaacctggtggtggggaccatcgtgggggccgacatatacatagtggctgcctatggcgccggtagccttggcccggcatcgatactcgcctggctgctcgccggactcatggccctcataatcgcccttgtattctctgaggcctcagccatgctccccaggacagggggcccctacgtctatgcaggcgaggccctcgggaggttcacgggtttcatcaccggctggtccctctgggtctcatcatgggttgccatagctgttttcccccttgccttcatctactaccttgaatacttcatcccccttgacccccctgctgaggccgtgataaaggtcctcttcatcctctcactcaccatcataaacattgcaggggtcgggagggccggtaaggtcaacgatatcctcacaatcctaaaggtcgccccggtgctcctcttcgcggtcctgggcgccatacaccttgcactgaaccccgggctcctggtatcaaattacactccagctgcacccatgggcctcggggccctgggtactgtgactgtcctggtattctgggcctatgttggctttgagcttgtgacagtccccgcggatgaggtcagggaccctgagaggacaatacccctctccataacactggggatgatctttgtcaccctattctacatcctcaccaacgctgttatccttggccttgtaccctggagggtccttgcatcctcaaccgcgcccctcacggtggccggttacagcctcatggggggcatcggggccctcatactcacagcgggtgctgtgttctccattgccggttcagaggaggcaggtatgctcacaactgcaaggcttctctttgccatgtcagaggatgggttcctcccgggcttcctctccagggtccacaggaggttcggcaccccacacatgagcatcctggtccagaacctcacagccctcttagcggcacttacaggcaccgtttcgggcctcatcgagctctctgtggttaccctgctcctcccctacgctgtgacatgcatctcactggccatcctgaggaggagggatggttcaggcatcccccttaagagtgttctgggtgtactggtctgcatctacctcctcatgaacaccacaccatccaccactgcctggggactcctcctgatcctttcaggggcacccctctatctgatattcggatttaaaaggctgcgccgctga

SEQ ID NO: 24834 - DNA, 1188 bp, Methanobacterium thermoautotrophicum
atgaagaaccttatttttccattcacagccatagtaggacaggaaaaggttaaaaaggcccttatactcaacgcaataaacccggggataggtggtgtcctcatcaagggtgataagggcacaggtaagacaacggcggtgagggccctggcggaccttctaccatccctgaggacggttaagggctgccccttcaactgcgacccggatgaacctgagggggcatgtgacatgtgccgtggaggtgacgtggatgttgaataccgcaagatgcgggttgttgaactcccactgggggccacagaggaccgtgttgttggatcacttgacatcagtaaggccctcacagagggtataaaggcccttgagcccgggatactcgcagaggccaacaggaacatactctacgtggatgagataaacctcctggatgaccacctggtcgacgtgctcctggatgcagcggcctacggtgtcaacacagtggagagggagggcatatccctccagcacccctcaaggttcatactcgttgggaccatgaaccctgcagagggcgaactgaggccccagctctcagacaggataggtatacacataaacgtggagaccgtgaccgacataaagcagcgggtcctcataatgaagaggagggacgaattcgaggacgacccggagggcttcgttgagaggtttgctgaaagccagagcagtctccgcgacaggataatggctgccaggaagcttctccctgcggtgacaatcgacgatgacctccttgagctgatagcaagggtctgtgttgatgccggtgttgacggccaccggtctgacattgcaatagtgaggacatcaaaggccatagcagccttcaatggaagaagaagggtccgtgaggaggacgttgaggatgcaatagtccttgtacttggtgagagaatacccggcaggagctacaaccgcgagaacacaaggagggagatgcagagggcccgtgaggagatggaacgtgagagagaatctgaggaggatcagggcaactcagacagctcttcagggggtgaaggttccgggggttctgaaggtgaagagtcaggccaggagtcaggggcttcatctaggggtgaggcttcaggctcaggggcttcagcttccctggccggtctatcggcagaaggctcactatga

SEQ ID NO: 24835 - DNA, 1194 bp, Methanobacterium thermoautotrophicum
atgtcaatcatggatgacctcatggagggaaggatcaagctctatgagattgaaaggcacgtcccggtggatgaggccgtcaggataagaagggaattcattgagaggacctgcggggttaaacttgaacacgtctcaaactacagcattgacatggagcgggcctcaaggaggaacatcgagaaccccataggtgtggtacagatccccctgggagttgcagggccactgagggtgaggggtgaacatgcagacggagagtactatgtgcccctggcaacctctgagggcgccctcgttgcatcggtgaacaggggatgctcggtgatcacacgggccggcggcgccaccgtcagggtgacaggtgactccatgacccgcgcaccagtcataaggacggggtccgtggttgaggccctacagctgagggaatggatctacgagaacatggatgccctcagggaggaggcagaatccacaaccagacacgggaagctcgtgaagatagaccccattatcgtggctggatcatatgtatacccccgcttcgtctacacaaccggtgacagcatggggatgaacatggtcaccattgcaaccgagagggcccttgaactcctcaccagggagaccggggcccatgtgatagcactgagcggtaacctctgcaccgacaagaagcccgccgccgttaacctcatagaggggaggggtaagagtataacagccgagatcacggtacccggcgagatggtcgagtctgtccttaaaacaacgcctgaggccgttgtcgaggttaacacagccaagaacctcatcggttcagcagcagcaggtagcatgggcttcaatgcacattacgccaacataataggggccatattccttgcaacaggacaggacgaggcccacatagtcgagggaagtctgggggttaccattgcagaggagagaaaaggggacctctacttcgcggtgaacctccccgatgtcccgttggcaaccgttggcggaggcaccggacttgaaacagcatctgagtgccttgatatcatgggtgtcaggggaggcggcagggtccatgcctttgcagagatagtcggaggggccgtccttgctggtgagctgtccctgatgggggcccttgcagcgggtcaccttgcacgtgcacacagtgaactcggccgtggttga

SEQ ID NO: 24836 - DNA, 882 bp, Methanobacterium thermoautotrophicum
atgaggggatcaatcatgatactgcttgatgaggataccaggtgccttgttcagggcataacaggtaaacagggatcattccacaccagacagatgctcgaatatggaaccaggatagtggcgggtgttacacccggcaagggtggtcaggagttccttggcgtggatgtctacaactctgtggaggaggtcaccgaggagatggatgttaatgcatccataatctttgtaccggcacccttcgccaaggacgcggcctttgaatcaataaaacacctcgaccttgtggttataataaccgagcacatacctgtccatgactccatgcagataatggagtacgcatcgaggatggggaagacggttataggccccaacaccccggggataatcactccgggcataggaaaactgggtataatgcccacccacatattcactgagggaactataggcatagtctcaaggagcggcacactgacctatgaattcgcagcccagctcacagaggcaggattcggccagagcacctgcgttggtatcgggggagaccctgtaaccgggctcggatttgtggatgtccttgaaagatttgaggatgaccccgggacagacgccgtcgtcctgataggtgagataggtggagacgcagaggagagggctgccagttacatagagcagatgtcaaagcctgtattcgccttcatctcaggtgcaactgcaccccccggtaagagaatgggacatgccggggcaataattgagggcggaacaggtaccgccagtagcaagagggaggccctggaggcggccggggccgtggttgttgacaggccatcagccatagtcgatgagataagggcccagctgggggtgcgctga

SEQ ID NO: 24837 - DNA, 666 bp, Methanobacterium thermoautotrophicum
atgaacacaaagatctgtgtccctgtatttgagaagacagccccggaggttactgagtcagccgggagggccattgatgcaggtgcggatatccttgaaataagaattgatggcctccagaatcctggagaagttaatatcagggaactcatagaggatatagggttccctgtgattgcaaccaaccgatcacctgtcgagggtggtcatttcagtggcagcgaggatgaaagaataaagctgctgatggctgccgctgaggtcgccgacttcgtggatattgaactcagcagtgcccgtgaggacatagagcgggtcacaggtagtgccaggagaagcatcgtatcctaccataacttcagggagacgccctcactggaggccctcctgaggatcgtcaggatggctaaggagatgggtgacatcgccaaggtagctgtgatgccagagaacctggcagacaccctggtggtactccagctcctcacatttgaggaggacactgtggcaatatccatgggggaactcggtaaatacacgagggttgcagccgccctctttggctcacccatcaccttcgcatcaatggggagggggacagccccgggacagatggatgttgatgtaacccggaaaatgattggagaactcatgccggaggattga

SEQ ID NO: 24838 - DNA, 972 bp, Methanobacterium thermoautotrophicum
atgatgcccatgttcgaaccggcaacaccccttgagaggaagaggtactaccgtgaggagtggaatgtcagggaccttcctgacttcatagctgataacctccatatgagggaattcgggttcgaccacaatggcaggggacccagtgacaggtacagggtcttcagggatgagaggagtctggcaaggttcatgagggtccgttacccattcgcagcatactcctcggtggcgttctacagggaaccctggaagaggaaggggtggcagcggtccgaactcatattcgatgttgatgccaaggacctccctgtgagatcatgtgagtgtgacggtgtatgccccacatgccttgatgaggcaagggaactggtcctcatgatggttgacaccctgaagggggacctgggcctgggcgacatccatgtcatatactcagggaggggctaccatgttagggtcctcgaccccgaggtcatggagctcggctcggaggtgagggctgagatactgcggtacaccgcaggtgcaagggagccgcggaggaagtttaccgatggggtatcatcctatgaaatggagcacttctccataccactgggatatcacagggtattcactgagagggcaaggcatgtgcttcttcacctgaggggtgatgaggatatcgaggatgtcactgcaaggacagttaagactgcagtcaggaacaggaacctcatccttgaggacaggtggggggagttcaggtcagtgatcggtcccagggtttacccgagacttgttaaggggatatcgaagattaacatgaggatgcttgatgccaaggtgaccattgacctcaagaggatactgagactcccaacatcactgcactcaaaggtcagcatgatctgcatggaagttaaaaatcctgagacctttgacccccttaagagcgctgtccccaggtttgtggatgagagggaatag

SEQ ID NO: 24839 - DNA, 1023 bp, Methanobacterium thermoautotrophicum
atgacatgcaccgttttagttggaggaggatggggtgacgaaggtaaaggcaaatgtatcacatatctctgttacaatgacaagccatcaataatcgcaagggcaggtgtgggaccaaacgcgggccattccgttgagttcaggggagataagtacgggctcaggttaaccccatcaggtttcttccatgaggatgcaaggctcctgataggggcgggggtcctggtcgaccccgaggtcttcctccatgagatggagtacctctcaaagtacagtgtcgctgacaggacaggggttgactacaggtgcgccataatagagaggaagcacaaggagcaggaccagtcctccagttacctctccaagaagatagggagcacaggcaccgggtgcggcccggccaatgctgagcgcgtgatgaggactgcgaagctcgcccgtgaagtggaggaacttggggacttcctgactgacgtcccccttgaggtcaatgaggcactcgatgagggcgaggacgtatttgttgagggctcacagggcttcggcctctccctctactacgggacctacccctacgttacgagtaaggacacaactgcaagcactgcggctgcagatgtcggcataggacccacaagggttgatgaggtcatagctgtcttcaaatcctacattacaagggtgggtgagggcccattcccaaccgagatcagccaggaggaggctgaggagatgggccttgaggagtacggtaccgttacaggtagaaggaggaggataggtctctttgacatggagatggcccgtgaatcatgcatgatcaatggagccacgcagatcgctgtaacctgtgtcgacaggctttaccctgaatgtgaacgtgtcagggagtactctgacctttccgctgaggttaaacgtttcattgaggatatagaatccgcgacgggggtcccggttaccataatatccacggggccatcacttgaggatacgattgacctcagggatgaactcctctag

SEQ ID NO: 24840 - DNA, 858 bp, Methanobacterium thermoautotrophicum
atgaaggcagttataccagcagctggccttgggacccgttttctgcctgcaaccaaggcacagcccaaggagatgctaccggtctttgacaagccaacaatacagtacgttgttgaggaggcagtagcctcgggtatagatgatatactcataataacaggtaagggtaagaggtcgattgaggaccactttgaccgttcatttgaacttgaatacttcctgagaaagaataacaagatgaattaccttgacgaggttgaggcgatttcagaccttgcagacatctacttcgtgagacagaaggagcagaagggcctcggggatgcaatatactgtgcaaggaaacatatagacggtgaggacgccttcgctgttctccttggggacaccataacatcatcaggggtcccctgcacgcgccagttaatggatatatatgagaggtacggggcatctgcaattgcagtggaggaggtccccagggataaggtggagcgatacggtatcatagatggtgaagaggtctcagagggaatctacagcataagggatatggttgagaagccacctgtaactgaggcgccttcaaaccttgccataatgggcaggtacgtccttgagagtgaaatatttgaccacataagggaggtaccacctggatttggtggcgagatacagctcacagatgccatgaggtgcctcgaggaggtctatggttgcgttttcaggggacggacctatgatattggtaacagggttgactggcttaaaacatcccttgagtttgcaatgaacgatgatgagataaggcccgagttaattgaatatctgaagaatctcattgatggttaccggtag

SEQ ID NO: 24841 - DNA, 2112 bp, Methanobacterium thermoautotrophicum
atgatcagtttaagcacaacagccctgaaggtgcttgaggagagataccttctcaggggtgagggtggtgaggttgtagagacaccagaggagatgttcaggagggttgcgcgggccgttgcatctgcagatgaggcctacggtgatgaccctgcagttgcggaggaggccttctactcggttatgggtaaccttgagttcctcccaaattccccgaccctcatgaatgcaggcacgcccatcaaccagctctccgcctgttttgtactccctgttgaggactcaattgatagtatattcagctccctgagggatatggccatcatccacaaatccggtgggggtgttggcttctcattttcaaggttaagacccagaggggacatcgtcgcgtccacaatgggtgttgcctcggggccggtgtccttcatgaggatattcgatgttgcggttgacgttataaagcagggcgggcgaagaaggggcgccaatatgggtgtcctccatgtgagccaccccgacatattcagcttcatagacgccaagtcaagggagggtcccctgcggaacttcaacctctcagtcgccgtacctgatgagttcatggatgaccgcccggtggatctgataaaccccaggaacggtgaggtggttgactcggtagaatccagggtgatacttaagaggatcgtggaggcagcctggaggtctggagatcccgggatcctctttgaggaccgtataaaccgctacaaccccactccacaactcgggaggatagaggcaaccaacccctgtgtatccggtgacaccattgtaatgacatccgggggtccgcggacagtggctgaactggagggcaagcccttcaccgcacttatcaggggctcagggtacccctgcccctcaggtttcttcaggacctgtgaacgggacgtatatgatcttagaaccagggagggtcattgcttaaggttgacccatgatcacagggtccttgtaatggatggtggtctggaatggcgtgccgccggtgaacttgaaaggggagaccgccttgtgatggatgatgctgcaggggagtttccggcacttgcaaccttcagaggcctcaggggcgccggccgccaggatgtctatgacgccactgtctacggtgccagtgcattcacagccaatggattcatagtccacaactgtggggagcagccactcctcacccatgaatcatgcaatctggggtcagttaatctcagcctcatggtaggcccctccggtattaactgggagaagctccggaggaccatccatgtggcagtgcacttccttgacaatgtgatagacgttaacagctaccccctccgtcccgtggaggagatgacactgagaacccgtaagatagggctgggtgtcatgggctttgctgatatgctgataaaacttggaataccctacaattcagtggctgcccttgaggtggccggaagggtaatgtcattcatatcatctgaggccaggagggcctccatggaacttgccagagagaggggatcattccctgaatttaagggcagcatatgggatatccagggatttgagtgcatgaggaacgccacattaaccaccatagccccaactggttccctgagtataatagcaggcaccagcagtggaattgagcccctatttgccgtgtccttcacaaggaacatcctgggaaggagcttccatgagctgcaccccctctttaagacgatggcgggaagacttgataagagatcccttgaggccatagaatcccgggggagtctgaggggtgtccccggggtgcctgcgaggataaggaggctctttgtgactgcacatgaaatagaccctgtattccatgttaaaatgcaggccgccttccagcggtacgtggacaatgctgtatcaaaaacagtgaatctgccagctgattcatcacctgctgacgttgaaagggtgttcagggccgcccatgagcttggctgcaaaggtgttactgtttacaggtatggcagtaaggtggatgaggtcctgaggttccctgaatatgcgggttcatgccgtgatatgacctgtcctaattaa

SEQ ID NO: 24842 - DNA, 1647 bp, Methanobacterium thermoautotrophicum
atggttttcactgaagatacaataggggaattcttcgagaaacaggttgaaaggtacgctgataaggaattcatagtataccccgacagggacctgcgtttcacctacagagaattcaatgaaagggtcaacctccttgcgaagggcctcctatctattggcatcgggaagggggaccacgttggtatctgggcaaccaatgtacctgactggctcaccttcctgttcgcaactgcaaagataggggcggtccttgtaacggtcaacacagcatataagagtcatgaactggaatacgtcatgaaacagtccgatatgaaggccctagccataatagacggcttcagggatgttgactatgtacagacactctatgaactggtacctgaactcaagacccatgagaggggccacctcaggagtgaaaggttccctgaacttcgaagcgtaatatacatcggtgctcagaagcacaggggtatgtacaacaccaatgaactgatgctcctcggaaaacacgtccctgacaccgagctaaggacggtgatgtcaaccctcaaaaacaccgatgttatcaacatgcagtacacctcaggcaccacaggattccccaagggggtaatgctcacccacaggaacatactcaacaacggttactacataggggaaagacagaggttcacagaggaggacaggctatgcctgccggtacccctctttcactgcttcggcatagtcctgggtgtccttgccctcctcacccacgggggcacactggtgatgatagagctcttcgaccccctcctcgtccttgcagctgttgaaaaggagaggtgcaccgcactctacggagttccaacaatgttcatagcagagttcacccacccaatgtttgacatgttcgacctctcctcactgcgcacgggtatcatggcagggtcaccctgcccgatagaggccatgaagcgtgtcatgaatgacatgaacatgaaggaggtcacaatagcctacggcctcacagaggcatcacctgtcttcacacagaccagtgtggacgaccccatcgagaagcgcgtcgagaccgttgggacacccctcccccacattgaggtcaagatagtcgaccctgaaacaggagaggaactcggacccggagaacccggtgagatatgctgccgcggctacaacgtcatgaagggatactacaagatgcctgagatgacagcagaggccatcgatgaggatggatggctccacagcggtgacctggcggttatggatgaggacggctactactccatcgtgggcagaataaaggacatgatcataaggggaggtgagaacatctaccccagggagatcgaggagttcctccacacaatgccgggtgtaaaggacgtgcaggtggtgggtatacccgacgagaagtacggggagatagtaggagccttcatcataagggaggacggtgcagatatcctggaggaggacgtgagggactatgccatccagagaatagcaagatacaaggttccaaagcacgtcttctttgtggacgagttccccctcactgcaagcgggaaggtccagaagttcaaattgagggagatggcggttgagctcctcaagaagaaggagcagccctga

SEQ ID NO: 24843 - DNA, 5127 bp, Methanobacterium thermoautotrophicum
atggatattgaaaaattcaaaggaggtgaaaagatcatgagaaaacatctgattacagtaacagcagttcttctcatgttaatgttctgccagagcgtggcagcagcagacaacagcacggaggataattcaactactgtactggttatagggtcatctacagccacaaagagttacaatgaagttgcatacactgtaatgaacctcacaaacagggatgcgaagagggtgaatttccagataagatccaccacacagataggtaacatgacaggcgatgagatactgtcactcatcaacagttccagtattataattgctgaatggggcacacagctcgccggtaacggttcctttgaagctgttataagagcccatccatcaatattagaaaacaaactgttttttgcatttgaaagcggaccaactctcgtcaaattgagcagaataaacaatacagaggtcttcactggtgttaacgacagtgatattggaacatacgatagaccaggtactttaataggcgcatgtcacgacggagaccttacatctcttatagcatataaacagaaataccctggaaacacagcactgcatcagtggatagattgcgccctgtactatgcagcagcgggcaaaacaaaccttgaaaatcagttcaaactcgcactaaagatgtactataacatgcgcggaataccatggaacagcagctgggagcctgcgactgttgaaccagcttctccattgtcatcagaattcctctaccgtgatggtcagaggtttacaaaggaggattacttcacaagatatcctctggatccagctaaacccacagtggctgtcctgagctatgttggatccacaggggaggtcacctacgctgatgcgatgcagcagataatcgatgcactcgtctcaaggggactcaacgtcataccagttataggtacatggtcaaattatgtcatcctcaaccagactggtatgcagaacattatccagacgctatgcatgccaaaccagacctacaacataactgccatcaggggaatagggaactacactgacctcacatcaatccttggtgttaccagcgtctcaagtgcgaatgtttatgaggttcagatacttgataatggtaacctaataaggagtctcaagatcagcacagtacagccggtgaacgtatattcagccctagtaaagtttctcacagatgcatcaaacgttgttcagtacgaggccaaccctgaaaaataccctgtcaaggcaaacgttatcatagatatgctgacgtttataaccgggtcaacaacatccggtgccagtgttaccaagttctttgatagatcaaatatccctgttctgagggcaatgataaccagttctacatacagaacaattggtcagtggattgtctcagaggagggattcagctggatgtcagtttactggcagtgtgcacagccagagatgcagggtcagatagaaccacttgccataggtgtgggtgagataggttcagatcctgaaacaggtgcacagtgggacataacagtgaccattccagagaggatagagaaacttgtcagcagggccttcaactggatcagactccagaccatggcaaatagtgacaaaaaggtggcaattgtatactacaactacccgccgggtaagcagaacataggtgcaagttaccttaatgtccccgaaagtatcattgagatactcaagcgcatgaaggcagagggctacagtgttggtgaaataccgcaggacgctgatgcactggttgagatgatgatcaaaaacggtataaatgttgccaactgggcccccggtgaacttgagaaacttgcaaacagttcaaatgcaatactgtggccatacgaggactaccttgcatggttcaatacacttgatcctgttgcccgcaaggagatggttgaaggtcccgttggatacatagaggaactcacaagggttgcggtgcagtgtatcaatgaaggagactgcagggtcagggatgaaatgctcaagacactcaaccgctggacccaggagatgatctcaaatgcgaatacacaccctcagatcgcaggaacagcaattgatcttataaacaaaatgagcgctgccctgacagcagtcatctggaacacatccaacacaacggcatgggatctcttctacatctacaaaaaccagttcatggccctcaatgtttcagggatgactggctggggtgaaccaccaggaaacgtcatggttgtaacaagaaatggaaggaagtacgtagtgatcccggggctcatgtttggaaatgtcttcataggcccggaaccacagaggggatgggaagccgacgctgcaaacctctaccacagcacaatagttccaccacctcactgctaccttgcatggtatgcatgggtaaacacggttttcggtgcaaatgcgcagatacacgttggaagacacgcaacctacgagtggacaccaaggaaacagtatgccctctcatcctttgattaccctgatatatgcataggagatacaccatcactatacatctacataatggatggtgttggagagggtctgcaagccaagagaagaggacttgcagtgatcatagatcatttaacaccaccgctgacaagaacaaagctctacggtgaccttcaggaacttgcagggctcgtgtcaagttacgaggctacaccaactggaaaccccatgagagacgaatatgcaaagcagatcagggaaaccataatcaaacttgaccttgcaagggatcttgggattaacgcaaccaacatgacggacgatgacatagacagggtgcatgactaccttctgagcattaccagtacactgatgccctatggacttgacacatttggtctcaactggactgacagtgaagtggccctcatggtatcagggatgctctcaccagacagcgacgtggacccatcactacagagactcatatctatgatgaatggatggaatttcagcaacctcacctttgaacaggctgaagcacttaacaatgccactgtagagatgataatggaacttttaaggggaacatcgatcgacacactacttgaaaacatcacggatccatctctcaaggcaacactccactcaaagcttgagctggcactccagtatgcatcactccttaaggacagtccttccagtgaaatggatgcacttatggagggtctatccggacactacataactcctgcaaagggaggagatccagttaaggccccatacgcccttccaacaggaagaaacttctatgcccaggacgacaacacactaccaacaaaggtggcgtgggatcttggtaagaggctcgcagatatggccctggcccagctcgatacaattcctgaaaagatggctgcggtggtctggtgcgttgagacggcaagagacgacggtgcaatggtttcattcgtcctgagaatgctgggtgtgcagccaaagatggacgataagacctggctcggaggcggaaaactatcctacatagttccaacaaatttaacagagcttctatcagacctcaataatgtgagaagcagcatgggcctttcaaacctcacatcaaggccaaggattgatgtcatagtaaccaccagtggcctcttcagggatctattccccaaccttctggccaaaatggacgtagcatacagggttgcactcggagcatcatactcaaagatccttcaagcttaccccgaactcaagacacagcttgaccttgccctagatccactgctcacaggacagttcaaacaggctaagacaatggcagatcttcttaaaatcatagacaaaaatgattcacttaacgtcaattacattgcaaagcactgggtagagctggtactcgcaggttatgacggtgatactgccataacacgtatattcgctccacctgtcggtgactatggcgcaggggttaaccatggtgttgaagaggcatggacatgggataacaggtcagaacttgccgatgtatacctcagaaggatgagtcacgcatactcaaacacgcgctggggagcatcaatggaaggtctctttgagaatctcctgaagggtgtaacagtggcataccacagcaggagcaccaacctttatggtgtaattgacaacgatgactactacgactactatgggggcctctcaatggcaattgagaaggtcaacggtggggtggcaccttcactcaatgtgctctactacgccaacccatcaaggcctgaagttgtctcactgcaggagttcatgagacgtgaaatgaggacacgctactacaaccctgaatggataaagtcaatgatgaacgagggatatagcggtgcaaggaccatctcaaacaagttcgtcgcatacctctggggatggcaggttaccgcaccacagcttgttgatgactatgactggaatgagatcacagacatatacattaaagacaaatacaatctaggtgtgaacagatggctctccacaggtaacagggcatattctatgatcagtataacagggacgctattaacagcagcacataagggcttctggaaggctgatgaggccactctgaggctggttgcaaatacatgggcaagcactgttgctgagtacggtgtggcatgctgtgactgcagctgcggcaaccttgcaatgatggagtgggcaatgcagtatgttaaccctgatctacttgccagggttaagtcaaagatatacgaagccacaggggccgcagcctttgcaccatctgagaacccaaaccagggtggagaatcaggttcaacacccggagggcagcctcatgatggaagtagtggaacctcaggaggatctgaaggtgtttcagcggcaagtccaggtactcagagctcctcacagaatgtgggagcaggctctgaatcatcacagggtgcaggaaaatcatatgaggttacagcatctggttcctccggttcatcagatactggaatgcctgtgtacgccatattgggtgtcatagcactggttgccctggttggagtgggctacttcatgggacctggaaggaaataa

SEQ ID NO: 24844 - DNA, 747 bp, Methanobacterium thermoautotrophicum
atgcaaccacttcagagtgcaggatatgatagggccatcacagtattcagcccggatggcagactattccaggtggaatatgcaagggaagctgttaaaagaggaaccacttctcttggagtaaaatcaaaggaaggaatagttcttgttgtggacaagaggcccacaagcaagctggttgaaccgaaatccatagagaagatcttccagatagatgaacacatcggggctgcaacatccggactggtggcggatgcacgtgcaataattgagaaggcaaggcttgaggcccagataaacaggataacctacaacgaaccaataagggttgaaagcctggccaagaagatatgtgacatgaaacagatgtacacccagcatggaggtgtcagaccctttggaacggccctcataattggtggtgtcaatggcaggggttgcagactctttgaaaccgacccgagcggtgccctcatagagtacaaggccacggccataggggctggaaggccggcggcgatggaggaatttgagaagaagtacagcgacgacatgaacctcaaccaggccatagaactggcacttgacgcggtttatgaggccactgagggtaaaacaacacctgaaagtgttgagatagctgttatagaagccgcagataagaaatacagaaggcttcctgatgatgagatcagggaccatgttgaggagctcctgatcaggaaggaaaaggaggaagaggagtaa

SEQ ID NO: 24845 - DNA, 1278 bp, Methanobacterium thermoautotrophicum
atgactgctctcatcaacgaattcgtgaaccgtgttgaatttgattcatacgaggatttccgtgacaacttcagaataaatgtccccgaaaacttcaacttcgcatacgatgtggttgacagatacgctgaaattgaacctgataaggtggccctggtctggtgcaacgaccatggcgaggagaaaaggataaccttcggtgaactccgggacctatccagcagggccgcgaatttcttcaccaaggagggtatacagaagggtgacacagtcatgctgaccctcaaggcaaggtatgacttctggtacgccctcctggggctccacaggataggggccatagcaatcccggccacacacatgctcaaggagaaggacatcgtctaccgtataagggaggcggacataaagatggttgtctgcatagcagaggacggtgtccctgaagtatttgagggagccatcgctgaactgggctcagatacccggagggtcctggttggtgacactgatagggacggctggataaatctcagaaaagaaatcatgaaacttccagccgacttcgaaaggccagaggcctgtgccggtggggatgacaccctcatcgtctacttctcatcgggcacaacaggaatgcccaagatgatagaacacgaccacacctatcccctgggccatataataacagcgaagtactggcagaacgtcagggaggacggcctccactacacggttgcagacaccggctgggcaaaggccatgtggggtcagatctacggtcagtggatagctggaagcgctgtcttcgtctatgactatgaccgctttgaccctgagaagatgctggagaaacttgaaaaatacgagataaccacattctgcgcccctccaacgatatacaggtttctcataaaggaggacctgtcaagatatgacctctcaggaatcgaatatgctgttacagctggggagcccctgaaccccgaggtatttgagaggttccgggaacacaccggcctccagctaatggagggattcgggcagacagaatgcgttgtgtgcatagcaaacttcccgtggatggagccaaaacctggttcaatgggcaagccatcccccggctaccctgttgaactggtggacaggaacggtgaccctgtggacgtcggtgaggagggtgagatagtcataagaaccgctgagggcaaacccctcggtctcttcaacggatactacaggaaccctgagaagacctcagaggtatggcacgactga

SEQ ID NO: 24846 - DNA, 5364 bp, Methanobacterium thermoautotrophicum
ttgacatataatgtcaccgcgctggttggaaatgcaggtaatcaagatactagtggggttagggttgattttgttgataatggtgtgagggttggtagttataccatcccattacttaggagtggtgagacaactacggtagtgtttaattggactccaatgactgtgggctcccacacactacaactcataatagacccagaaaaccacatccaggagaccaatgagacaaacaataggataatattgaatgtgacagttaatcaggctcttcccgatcttatatgcaaaagtacggaattagttgctgatcttatagttaatgagacatacacattcactgcgaggatatcgaatattggtccggccaatgctagtggggttagggttgattttgttgataatggtgtgagggttggtagttataccatcccattacttaggagtggtgagacaactacggtagtgtttaattggactccaatgactgtgggctcccacacactacaactcataatagacccagaaaaccacatccaggaaatcaataaaacaaataataaatttaacagattctgcaccgttaagaaaagtggtaacgttctagtatttattataagtgatgaaggacaaacgatagttattaacgaggcagttcatgatgcaaacgttcttggatacgcccctgtaagggaaaaggtccagatacagatcagaagctgtgaacagttaaccaagatgtcagataacgaactcctgcaagtcctatcagcctgtgacatatttcttggagaatacttaagtgacagcgcatctcaacgcctacaaaaactgctctcaacaaacccaggaataactaacaaaacaggtggcatattcctcatactagaacctgcaatagtctataatccagcatatacaagtctcatgagatactcaaacatcaaaggagaatacatcctctccaacatacaagatgagctcctaatagactactatcaaaataccaaaaaaggcgccaatttcgaacacgtgttaaattacatctcatcatctaatattactggcatattctcactagagtacaacatggcggtactctacaaagacatcaataataataatgcgtttgtaaaccagatcgtctgggccctcaatcttattggggttccaaacactggatactggaaacctccaatatgggcaaccagcggcgaaaaaccatatgggatttaccgtcacggatggtataaccttacagaatacatcaataaatacttcagggcgaacgccacgggttgtatagggctccttgaaagtaaaatgtacgtggacaatcaaaaactacaaccatactatgctattatcgatgcattagaggctagaggatttaatgttataccagtagtggcatatggggccacgcccgaacaattaaaggttatggtggaatcattcactgatgcacccgacgttgaaagcttcttcgcaaacccatccaagtataaggtttatgttgatgctatagtgagcatgccagcctatggtttgggcggtgatcttttcacgaatgttacaaaattctttgaactcataaatgtaccagtatttaaggctttacattctgattatcttcttgcggagcagtgggatctcagcaccctaggattaaggcaacttacaggtgacagatggtggcacatagccgtttcagaatcccaggggattatagattcgacaattgtggccacgaactctgaaccgatcacagaccctgatactggattatcttatagtctctacgagataatacctgcgaatattgagcatcttgccgatgagataaaaggttgggttaaactgaaaagattgtcgaacaatgagaaaaaagtggcgttaatctactataattatccgccaggaaaggataatatcggttcaagctaccttgacgttataacaagcatctataatctccttaacatcctcaaagataatgggtacactgtagagaacataccagccaatacaacaatactccatgatatgataatccagaagggtattaatgtcgccccatgggctcctggagaacttgaaaaacttgctaaaaatgcaatactctatccagtggacaagtacatggaatggttctctaagcttgacgagatcacaaagatccaagttatagaggggcctgttggatatattggagaattatgcaaaagggcggtaggattgaattatacaactggtatgggagatcgtatagactcctggtacgatggtataatatccttattgccggaaaacaagacaaatgtggccatatcagtattggataagatagttgcggctctcaagaattatattttaactggggatcaaagatactataatgaattcttgggatataagaggcagttctttgcccttaatattagtggtttatctggttggggccagccccccggggatataatgactgtggaaaagaatggtacaaaatattttgtaatcccagggatgtggtttggtaacatcttcatttgtccagagcctcagcgtggatgggaaggagatattaacaagctttatcatagcatggtggtggctccgccacatcagtatcttgcagtttatgcttacttgcaggagaacactgatgcgatggtccatcttggaagacacgctacttatgagtggctccctggtaaagaggttctattggcatcctctgacttccccaaggtcgtgactggtgccactccacagatctattattatatagtggatggactcgcagagggcatccaggccaagaggaggggatcagcagttatcatagaccatttaacaccaccattaacattcacggcattatatggtggatacgcttctttagcaactctggtgggtcaatatgatggtgctgacaattcaacaaaaacagagataatcagtaagataaggaagacaatacaggataataatctcacacaacttatagaaatggcaatgggagtatcactcaacaaactatatggggataagctagtccagacaatagaagattacctggggcaggtgcaggatacattgtatcctcatggtttacatgccattggtaaaaattggacagaggaggaagtggcgatgctagtctcttcgatactatcagtgccattccaagtttctaccactgaggagacaacattacaggatgaggtggccctcctattctatagaaaatcttatgggaaccttaccagtatacaaaaggagaaagtgcaagaaaattgcatagggatcgtgaagagtgtcatcactaatggagtgaatgcgacgcttaacaatttaactagcatgccaacggctgggctgaaaaaggcattagagttggctcgtgaatatgcgatgaaagtatatgagagtatggatgctgaggtagaagctctactagatgctttgaattgtggttatattccaccgggggctggtaacgatctggtgagcaaccctgatgcgctgccaacgggtaggaatttcttccaggatcaagcagcggagatacctacaagaagttcatttgaatatggtaagagtttagcattattaacactccaaaaccttaatgctactgtggagaaaatagctgttggtatattctgcacagaaacggcacgtgatgatgcagcactagtatcaatggtgctggcattgcttggaatggaacctgactggtctgattctccaagtgctggtgtgggaggtgctaaacttaaagaaatgccgaaatatgtagaactcaaggatcttgtgcgaccagagggctgggagaaaaagaggattgacgttgtgattataacaacgggcttattcagggatctttacagcaggcaagccggcctacttgacaaggcgttcagagtagcccttgcaagatcctactatacaatattagatgatacgaggcttaaacaaaaatatggggacaagatagaaaaggccctaaattatgtggtagggcctgttggattctatggtatcggtgacgagtcattagattacaattatgttgctaaacattgggttgaagactttgaatattacatgtcccttaatatgaccccagagattgctggggaatatgcaatttcaaagatattcgccccaccagagaatgattatggagctgggatatccaagagcatccagttaagctggacatgggatgacagaatggagcttgcggacttctaccttaacaggatgggtaacatatactcaagcacccaatggggatcatcaaatccactagtcttcaaaagggcgcttaatggtgtcaagacagtatttacaagtagaaacacaaatctctatggggtcttggataatgatgacttctttgattactggggtggactttcagttgccatagaaagggtgaatggtgaagcaccaacaatgtatgttctgagttatgggaacagaggctccccccgggcattgacacttgaaagctttatgagtctggaggcaacaactcgctacttcaaccctgaatggatcagggccatgatgcaaagcgaccccacaggtagatacatcagcaggaaatttatttctaacctcatagcatggacaattctaagagacagttatacccatgacgaggtcttttcgagcacattttatagtaacctctggcagacagcgtataatgtatatctccaagacagccttcaaacaggggttacagattggctttccagcggtaacagggcttatgcgatgataagtataacagggaccatgttgaacgtcatctatatgggttactggaaaactgatgagaccatcaccaggaacattgctaacagatgggctaaaatgattgctgagcatggagtggcatgctgtgactgcagttgtggtaatcttgctatgatagaatgggctatgcagtatgtgaatcctgatctcattgaaaaggttaaggcgaagatatacgctgccacgaaaaatgcaaacttcgcacctgccgaagatcatggggagggcggtgaatcaggttcaacaccacgtacacaagagggaactgggaccggtagtgccggttcaagcgcaagagattcatcagttagatctgcaggaacaacagcatccctagatgaggtcgggttacagaggggtacaggagaacctggcaaagcaggtgaaggtaaatcttatgagatcactagaagaggttcacagggattttcaagtacaggaatttcattttatgctattatgggggtcttgattctcgtggtccttatggcaattggttactttagggcatctagaaaagagtattaa

SEQ ID NO: 24847 - DNA, 1128 bp, Methanobacterium thermoautotrophicum
atgactgattacgatgttctcataatgggggccgggcctgccggttcaacccttgcaaggctcacagccactaaaggattcagggttggcctctttgagaggaagaagataatcggtctgccacttcagtgtgcaggactcgtatcacacagaataatggaggttaacgtgctccctgatgaatttatactgaacagtgtgaggggcgctgttctccattcaccatcaggcataaaactcagggtttctaaggacagaccagaggcccatgtaattgacaggacagcctatgaccagcatcttgcagaactcgcgatggaagcaggcgcagagttgacgaagggaactgcggtgagggatttcaatgagaaaacaggtcatgtcagggtaaatggcgatgaactcagtgcggatgttcttgtggatgcaagggggcagtccgccgcacccagcaggtaccctgcgagacagtaccttgtgaggttcagggacagtgagatggacactgacttcgtggacctcaaggttgactcccgcctctctccgggctttatgtggaggatacccatagatgaacagacggcgagggtgggtgtcttcggaccccagcagaacctgaaggaattccttaaaggcttcatctcagacctcagcagcgactttgagatccttgagtcccaccatgggttcatccccagaccagaccttgatttgagactcgtaagggggagatgcattcttcttggagatgctgccgggcaggttaaacccacaactggtgggggcatagttctggcttcccgtgctgcaggggtggcggcagaggtcatccagggggtccttgagggggatgcagacctcaaagaatatgaggatgcctgcaggaagatccacatgtcagagatgaagaaccagatgagggttcagaggaccttcagactactctcagacaaggaccttgaccacatattccttaagatgaaggagtacggtgcagaggatataatatcagaatacggggacatggacagacagacacccctcatcagggagttcctgaagaggggaatcctgttcaggataataccatccatcctcacgtctaaggtggcaggaatatggaaatga

SEQ ID NO: 24848 - DNA, 1233 bp, Methanobacterium thermoautotrophicum
atggaaaataactcccagaatgtattaaaaaagattgaggacctcaaaaaagaagttagaatgcttaaagaggaaaactccaagacaaaaagaaatctgatgtggaaaatcagaaaacttgagaaggacaaacttttaattgaaaatgagaggacaaggcttgacagggaagttaaatcccttcgtggtgaaatcgaaaggttcagaacccctccactggtcatagccacagtaacagaggttcttgatgatcacagggtcgcagttaagagtacaaccggaccccacttcgtaataaattattcaagattcatagatagaaagcagctggagcccggtgcaagggttgcactgaaccagcagaccttcagcatagtggatgtacttccatctgagaaggaccccgttgtgacgggcatggaagtcgaggaaaaaccagatgtctcctatgagcagataggtggccttgaggaacaggtacgcgaggtcaaggagacagttgaattaccgctcaaaaaaccggaactctttgaaaagataggtatagagccacccaagggcgtactcctctatggaccacctggtacaggtaaaacactcctggcaaaggccgtcgcccatgagaccaatgcaacattcataaagatagttgcatcagagttcgtcaggaaatacataggtgagggcgcaaggctcgtgaggggagtctttgagctggccaaggagaaatccccgagcataatattcatagacgaaattgacgccgtggcagccaagaggcttaagagttcaacaagcggtgacagggaggttcagaggacactcatgcagctccttgcagagcttgatggattcgaatcaaggggtaatgtcggtatagttgcagcaaccaacagaccagacatacttgacccggcactcctccgtccaggaagatttgacaggttcattgaggtacctctaccaaatgaggatggtagaagggagatactcaagatacacacctcaggaatggcccttgcagaggaggtcgatattgaactccttgcaaggataaccgatggggcatcaggcgcagacctcaaggcaatatgtaccgaggcaggtatgtttgcaatcagggatgagcgtgatgaggtcacaatggctgacttcatggatgccgttgataagataatgggtgttgagaaggaggaggaatacaaacaggaaaccggcgtgatgttcggttaa

SEQ ID NO: 24849 - DNA, 981 bp, Methanobacterium thermoautotrophicum
gtgagtgataatatggagtttcccacaaaaaggatgcgaaggttacgtaagagtccacagataaggaatatccttagagaaacacggctgcacccatcggatctcatataccccatgtttgtgagtgaaaaacttggaaggggtgatgtggaggccatagatacaatgccaggccagttcaggtactctgtggatgatgcggtttccgaggcatccagacttgaggatgagggactatcatccgtactcatattcggaatgccatcagccaaggatgagctcgcctcagcagcccatgacccccacggtgttgtgcagaggactgtgaggaggctcaaggaggaaacagaccttgtggtcatgactgatgtctgcctatgccagtacaccagccatgggcactgcggtatcgtcgtggatggcgaaatcgtcaacgatgagaccctggaggtcctttcaaggatagccctatcccatgccgaggccggggcagacgtggtggccccatcggatatgatggatggtagggtggcagccataaggaggagccttgatgatgcaggcttccaggacaccctgataatgtcctacgcggttaaatatgcttcagcattctatgcaccattccggggcgccgtatcatcggcccctgccttcggtgacaggagatcctatcagatggaccctgccaacattgacgaggccctcattgaggctgaactggacctcagggagggtgctgatatactcatggtgaaaccggccctggcataccttgatgttataggtaaggtcagggagaggttcagcgtgccacttgcagcatacaacgtcagtggcgagtactcaatgctgaaggcggccataaagagcggatacctcactgatgaggccatatatgaatccatattatcaataaaacgtgcaggtgcagatcttataatatcacacttcgcacctgatctcctgggggtgatctag

SEQ ID NO: 24850 - DNA, 1125 bp, Methanobacterium thermoautotrophicum
ttgatactgtgtggtgattcggtggccgggaacagtaccggtgaaatgttcagagtaacgaccttcggatccagccatggtcctgcagtgggtgccgttatcgacggctgccccgcaggtctcgagctgagtgaggatgacatacagcaggaacttaacaggagaagacctggaaccggcgccctgaccactccacgggctgaatccgacagggtcgagatactctcaggtatattcaggggaagaacagatggcactccaatagctggaatcgtcagaaacctggacgccgactcaaaaagttacagcaacattaagaatacaccaaggccggggcacggcgactacacctggagggcgaggttcaggaactacgactaccgtggcggtggccgtggaagtggaagggttaccattgggcacgtaatcggtggggccgttgcaaagaaactcatcggtaattatggtttgaccgtaacaggccacgttgtacaggtgggtgatgttaaggcagacactgtaagccttaaaaggataggcgagtatgctgagagcaatcctgttcgctgtgcagatcccagggcggccagacagatggagaaggttatacttgatgcccgcagcaggggagactccgttggcggggttgttgaggttgttgtcctgggtgcgccccctggactcggcgatccggtattcagtaaactcgatgcagatatggccagggccctcatgggtatcgggtctgtgaagggtgttgagatcgggatgggattcgaggttgcagaacaccgtgcaagtgagataaacgatgagttctacctggatgatgatggtaaggtgaggacaacaacaaacacctctggaggcatacttggaggaatatcaagcggcatgccaataactgcaaggatagcagtaaagcccacaccatccatatcagtcccccagaagaccgttgaccttgaaaggatggaggaaacaaccattgaggtccgtggaagacatgatccctgcatctgccccagggttgtgcctgttgcagaggctgcggttgcaatcgtccttgccgaccatatgataagggccggcttcatccaccccacatacattggaaacgaatga

SEQ ID NO: 24851 - DNA, 1260 bp, Methanobacterium thermoautotrophicum
atggatctcacagttgaaaaatcaggtaaccttgaaggaaccgttaaggcacccccatcgaagagctacacccaccgggcagtcataatcgcagcactggcagagggggtatcagagatcagggacccactcatagccgaggacaccctttcgtccctgaacgcctgcagggccttcggcataagggttgatgagggggatgcctggaccgtgcatggaagcggaggggaacttgaaacccctgatgacgttatctatctggggaactctggcacaaccctccgcctcatgacctctgtggctggccttgcagaaaactacacggtactcacaggggacgaatccctcagaacaaggccaatgcagccactccttgatgccctgagacccctcggtgtcgaggcactgtcatcacggatgaatggacttccaccgattatcgtaaggggtggtttaaggggtggcagtacatccatcaggggggatgtcagttcacagttcatatcatccatcctcatcgcagcacccctcaccgagggtgttgaagtgatggtggagggcgacttcatctcaaggccctacgttgacatgacagttgatgtgatggagaggttctctgtccccgttgattactccgaaggcaccttccgggttgaaccagcagtttacaggggactggactacacggttgagggtgactactcatcagcatcctaccttgcaggggcggtggctgctgcaggtggggatgtcctcatcgaaaacctcttcagggattcgaggcagggagaccgcatcatactggacataatcagtgatatgggggccgaggtaaggaggggggaggaccacgtcaggatagcctccaccggtgagctctctggggtctccgtcaacctccacgacgcccccgacctcctgccaacggtggctgtcctcggggcccttgcaactggccggaccgagataggcggtgttgaacatgcaaggtacaaggaaacagacaggataagcacatgcgctgctgaactcagaagacttggagtggatgtcaccgaacttcccgatgggatgatcatagagggaggtgcctccggggggactgtctggtcccatggtgaccacagacttgcaatggccttcacactcataggcctcagggagggtataactataagggatgcagaggttttcagcgtatcattccctgatttcccagagaggatgatgcagattggttgcagaatgaatttatcctaa

SEQ ID NO: 24852 - DNA, 858 bp, Methanobacterium thermoautotrophicum
atgataataggttgttcagcatcacagaaacttgctgcctcagttgcagatttactagatgaacctttatgccccgttgaaacccgtaaattccctgatggggaacgttacatcagggttaaggaggaagtggagggagaggtgaccgttgtgcagtcaacgggttacccccaggatgaaaacctcatggaactccttttcatgatagagaaccttaaagatctgggggcggattatgtgcgtgcagccataccctactttggatacgggaggcaggagaggcgtttcaagagcggtgaagctgtatcggcgaaaatagtcgcccacctccttgaggccgccggtgcagatgaaattgtaaccgtgaacctccatgagaactgcctgagtgagttcttccgtgtacctgtgagggagctctctgcaatgcccctcatcgctgaacacatctcattccttgatgacccggtaatcatcgccccggataagggtgccctaggtcatgcccgggaggtcagtgatatacttggatgtgaatgtgactacatggagaaggtccgcatatcccctgaggtggttgagacccgtgtgagtgaccttgatgttgaaggaaaggatgctgtggttgttgatgacatcataagcaccggtgggaccatagtaaacgccgccgggattttagggaaatgtggagcctcaagcataactgtttgctgtgtccacccggtccttgtggaggacgccctcctgaagatattctcagccggtgttgagagggtcattgcaacggacacccttaaatctgatgttagcgagatctcagttgcaccgcttattgcagatgtcatgaaagattaa

SEQ ID NO: 24853 - DNA, 1050 bp, Methanobacterium thermoautotrophicum
gtgatactcatggctggaatagtcggatatggagtttacattccatcatacagaataaaggttgaagaaatcgcgagggtctggggagacgacccccaggccatatcaagggggctggttgtggaggaaaaatcggtccctggtcctgatgaggacacagcaacaatctcagttgaagctgcccgtaatgccctcagaaggagccagatagatccctcagagataggagctgtctatgtgggatcagaatcccacccctacgctgttaagccaacagcaacaatcgttgcagaggctgttgaggcaacacccgagatgacagcagctgaccttgagttcgcatgtaaggcaggtaccgcaggtatacaggcctgcatgggacttgttgactcaggcataatcaagtacggccttgcagtcggtgctgacacagcccagggagcccccggtgacgcccttgagtacactgcatcagcaggaggggcagcctatgttataggtggaaagaactgccttgcagatataaaggaaacctacagcttcacaacagacacccccgacttctacaggagggagggaatgccctacccccggcacgggggaagattcaccggtgaacccgcctacttcaagcatgtcctgggagccgcgaggggtatgatggagaagaccggtctcagcgcagatgacttcgactacgcggtcttccaccagccaaacgggaagttctacctgaaggccgctcgcaaactgggatttgaaagcgaacaggttaaaccgggacttttgacgcctgtgatagggaacacctactcaggtgcaacaccagtaggccttgcagcaacccttgacgttgcagaaccaggcgcaaggatactggcagtgtcctatggttcaggtgccgggagcgacgccttcataatagaggtgaatgatctcatagaggagaggcgtgaccttgcaccatccgtggccgagatcatcaaaaataagaggtacgtcgactatgccttatacgccaaattcaagggcaaactcaggatggcttaa

SEQ ID NO: 24854 - DNA, 1152 bp, Methanobacterium thermoautotrophicum
atgagggatgtagcagttattggagtttcacagacaaaatttggagaactctgggatgtctccttcagggacatgataaccgaggccggacttggggccatagaggacgcaggagtggagggcgcagaccttgatgcgatgtacgttggtaacatgtcagccggtctcttcataaaacaggagcatatatcctcgctcatcgcggaccatgctggcctgacacccataccctccacaagggttgaggccgcctgtgcatcaggggggctcgccctcaggagcggcataatggcggtggcatcaggataccatgacatcgtgatagctgcaggtgttgagaagatgaccgacgttgttgacccaacaccggcaattgcaacagcatccgaccaggagtgggaggcccagcagggtgtcacattcccatcactgtatgccatgatggccaggaggcacatgtatgagtacggtacaaccagggagcagctcgccatggtctcagtgataaaccatgagaacgcctcaaacaacccccgggcccagtttccgatgaaggtcacggttgaacaggtcatgaactccaccatggtagcggatcccctcaggctcctcgactgttcaccgatatctgatggggccgcagcggttatactatgccctgcagacatggcgagggagtacacagacacacctgtctatgtgaaggcgtctgcacaggcctcaggtaccattgcacttcatgacaggagggacataacaaggattgatgcaaccgtcaatgcagccagaaatgccttcaagatggccaagctgactccaggggacatagaccttgttgaggtccatgactgtttcagtataaacggtatactggctgttgaggaccttggattcgtcgagaagggtgaaggtggaagggcctttgaggatggtatgacaaggattgatggtgacataccggttaacccatcaggtgggctcaaggcacgtggccatccccttggagccaccggtatagcccaggcagctgaggtggtatggcagctgcgtggtgaagccggtaagagacaggtggaaggtgctgaaatcggcatgacccacaacatcggtggaaccggtggaacagcggcggtccacatattttcaaggtga

SEQ ID NO: 24855 - DNA, 1617 bp, Methanobacterium thermoautotrophicum
atggcacagggacagcagccaattcttgtactgcccgaaggtacaagcaggtatcttggaagagacgcacagaggatgaacatccttgcgggtaaaatactcgcagagaccgtgagaacaacccttggacctaagggtatggacaagatgcttgttgactcccttggagacattgttgtaaccaacgacggtgtcacaatactcaaggaaatggacatagagcacccagcagcaaaaatgctcgtcgaggttgcaaagacccaggaagacgaggtaggggacggtacaaccacagcagtcataatagcaggggaactactcaaaaaggctgaaaatctccttgaaatggagatccacccaacaataatagcaatgggttacaggcaggccgctgaaaaggcccaggaaatactcgacgacattgcaatcgacgccagcgacagggacaccctcatgaaggttgcaatgaccgcaatgacaggaaaaggaacagaaaaggcaagggaaccactggcagagctcatagtggatgcggtcaagcaggttgaagaggatggcgaagtcgagaaggaccacataaagatagagaagaaggaaggcgcagcagtggatgactcaacactcgtgcagggtgttataatcgacaaggaaagggtccacccaggaatgccaaagaaggttgaaaacgccaaaatagcactcctcaactgcccgatcgaagttaaagagacagaggttgacgcagagatcaggataacagacccatcacagatgcaggccttcatcgaacaggaagagcagatgatccgcgacatggtcaactcaatagttgatacaggcgcaaacgtcctcttctgtcagaagggcatcgatgacctcgcacagcactacctggccaaggcaggagtccttgcagtgagaagggtcaagaagtcagacatggagaaactctccaaggccacaggagcaaacatagtcacaaacatcgaggacctcagcccagaggacctgggtgaagcaggagtcgtatcagagaagaagatctcaggcgaagaaatgatcttcgttgaagagtgcaaggaaccaaaggcagtgacaatactcgtcaggggatcaaccgaacacgttgtaagcgaagttgaaagggcaatcgaagacgcaataggcgtagtcgctgcaacagttgaggatggtaaggtcgttgcaggaggcggagcacctgaaatagaaatcgcaaagaggctcaaggactatgctgactcaataagcggcagggagcagctggcagtatcagccttcgcagaggcccttgaaatcgtgccaaagacccttgcagagaacgcaggtcttgacagcatcgacgtcctagttgacctcagggcagcccatgaggaatcaacatacatgggaatcgacgtcttcgatggtaaaatcgtcgacatgaaggaagcaggagtaattgaaccccacagggtcaagaaacaggccatccagtctgcagctgaagcagctgagatgatactgcgcatagacgacgtcatagccgcatcatcatccggttccagcgaggaaggaatggaggaaatgggcggcatgggcggaatgcctccaatgtaa

SEQ ID NO: 24856 - DNA, 1044 bp, Methanobacterium thermoautotrophicum
atggttaatgtgggtgttctgggagcaacaggaatggttggacagcggttcattcagatgcttgataaacatcctgaatttgagcttacaaccctggcggcttcttcacgatccgccgggaaaccctacggggaggtggcaaactggtaccttgactgtgagatgccagaatctgtgagggacatggaggtcgttgaaacggatccctcagctgttggggacgttgatatactcttctcagccctccctgcagacgtggcgaggaaggttgaaccaaaatttgcagagaaatacatagtggcatcaaatgccagtgcaatgaggatggaaccggatgtccccctcgtgatacctgaggtcaaccctgagttccttgacctcatagaggtgcagcagaggaggagggggtgggacgggttcattgtcaccaaccccaactgctcaacaatagccctgaccctcacactcaagcccatctacgacgcctacacaataaaaagggtctatgtatcaaccatgcaggcggtttccggtgccggttacaatggagtcccctcaatggccatacttgataacctggtgcccttcatcggcggtgaggaggaaaagattgaaacagagaccctccacctgctgggagaactcgatgaaggcgttgtgaaaccagccagctttggcgtgagtgcatcatgtcaccgcgtacccgtcgttgacggtcataccgaggcggtcttcattgaactggatgatgaatttgatattgatgatgtcagggaggcaatggataaattcaggggactcccacagaagctgggtctccactccgcccctgaaaaacctgtggtggtgagggatgaggaaaacagaccccagccaaggatggacagggacatggacggtggaatggctgttaccgtcggaaggctcagagaggacgctgcattcaaaaacagtttaaggtacgtccttgtgggtcataacaccgtgaggggtgcggcgggggcatcgattctgaatgcagaactcataaatgagatactctag

SEQ ID NO: 24857 - DNA, 822 bp, Methanobacterium thermoautotrophicum
ttgataagggttgcagttacaggcgcatgcgggcgcatgggatcagggataataaggagggtccttgaagaggaggacatggaactggtggcagcaattgaggctcccggcacacccctcaggggcagggacataggagagttcacaggaagaggcagtgttggagttgaggtaactgatgcatcaaatcttgcagatacccttgcagagacagaacccgacgtccttgttgacttcacagtcgcatctgcagcagtcgaaacaataaagacttcaaccgaggccggtgttaaccttgtggttggcacaacaggtttttcagaggaggagatgcagacagtaagggactgcatagaaaggtcaggtgtgagggccgtaatcgcaccgaacatggcagtgggggtcaacgtgttcttcaaggtcctcagggatcttgcaccgatcctctctgactatgacgttgagatcattgaggcacaccacagacacaagaaggacgcaccatcaggtacagctgtacgtgcactggaggtcatctcagaggccacaggcagaagggccagtgaggtcgcagtccatggccgatccggactcacaggcgagaggagcagggatgagataggtgtccatgcagttaggggtggtgacatcgtcggggaccacattgtcctatttgcaggtgacggtgagcgccttgagatagttcacagggctcacagcagggatgccttcataggtggagtcataagggctataagattcattgaggatgcagaacccggaaggataatggatatgggggatgttctgggaataaactga

SEQ ID NO: 24858 - DNA, 852 bp, Methanobacterium thermoautotrophicum
atgaagattgaaggcacagttgtggccatggttactccattcacagaggacgatgtggtggatgaggccgggctgcgggagaacataaactaccttatagagaacggggttgatggcctgctggttgccggaacaaccggtgaatcagcgacaataacccacgaagagcagaggagaatgatcgatatactggtggatgaggtcaacggtcgcgtcaggacagttgcaggggcaggtagcaattcatccagggaggccatgggacttgtggagtacgcagaggacgccggtgcagacgcggccctcgtcataaccccctactacaacaagccccagccccatggactcattgaacactacaccatgctggaggaagccgctgacataccactcataatatacaatgtcccctcaaggacaggcacagatatagacgttgacacggtcgccgaactagcaaagctcgacgggataattgggataaaggaggccagccccgacctggacaaggtatccatgctcaggtcaaggctcatggacctgggccttgatgacttcacagtcctctcaggtaacgataacctgactctccccatgatctccatgggtgccgagggtgtgatatcggtggttgcaaatgtcgacccggctcgtatgagccgacttgttaacgaggccctctcaggggacttcgagtctgcaatgaaaacacactatgaactctacagtctcatgaaggtccttttcattgagagcaaccccgtacctgtcaaggaggcccttaacatgatgggcaaggcccgcgggtcatgtgaggatgcccctggcacccctgcaggatgcaaaccgtga

SEQ ID NO: 24859 - DNA, 1221 bp, Methanobacterium thermoautotrophicum
atggagttaatagttgctaaatttggcggtacatcaataggaaatggtaggcgaattaagaaggcggcccgttcagttgtgaaggagtacatgaagggcaggaaggtcgttgtcgttgtatctgccataaataagacaaccgatgaactcctccagatagtggacgaggcaatggaagacgctgtcacagagaagcagctggctgaaatagtatccatgggtgaaatgaccagtgtcaggatattctcatccgcgatagaggcactcggagttaaatcagaatatatagacccattcatggatgaatggccaataataaccgacagcaaccttttaaatgctaaggtggattttgaggcaactgaggagaaatcaagggaactgcttaaactccttgatcagggaataatacctgtggtttgcggcttccttggaagggaccccaacggctacataaccaccctggggaggggtggaagtgacataacagcattcctccttggtcactgcctgaaggcagatgaggttataatcgtaacagacgttggaggtgtcatgtccacggaccccaacaaacttcagggtgccaagaaacttgataaaatatccgttgaggagatgagggaccttgcaacccatggggcccaggtactccacccccacgccctaaaatacaaggaccctgatataaaggcaaagataataggatttgagcacggggacctatctgcaccaggaaccgagataatcggaccatcaaagaataagatggttaagacaacaaccctcaacccggatccaatatccgtggttgctgttgtgggtgaaaagatactgaacaagccaggtatactggcccggttaacatcaaggcttgcagagaactccataaatatcataggaatttcaaccggccagaactcggtcacaatcttcgtggataagaaggacgccgatgaggcccacaggctcctccacgatgtggtcattgcagacgatgacctcagttcactctcccttgggagggacatcgcaatgataacaatatccagcccggatttcatagatacacccggcataatatctgaaatcaccaagcccctgagggataatgaccttaacatagttgaaatttcatcctcacagacatctgtggttatttttgttgactggaatgatggtaaaaaggcatatgaacttgtaaggggtgttcttgaatga

SEQ ID NO: 24860 - DNA, 654 bp, Methanobacterium thermoautotrophicum
atgatggatgagagaaggagaatggttcaggacctcatggagaggggatacataaaatctgaggccgtcaggagggccatggagagggtgcccagggaggagtttgtccctgaggatgagatgcacagggcctacatggacatgccgctccccataggtgagggtcagaccatatcggcaccccacatggttgccatgatagctgagatccttgacctggaacccgggatgaaggtccttgagataggtaccggctgcggctacaatgcagctgttatagctgaaatcataggacccgagggacacctctacaccgttgaaaggataggaatcctctatgaaagggcccgcaaaaaactcagaagcctcggatacgataacataacggtcatacacggcgatggcagccagggattcgctgatgaggcaccctacagcaggatatacgtgactgcagcggcaccatacatcccggatcccctcatgaagcagctggagatagggggaaaacttttaatacctgtgggttctgataaattctatcaggaactggttctgattgagaggacctccgccgacgactacaggtccagaaatctcggcggggttgccttcgtcccgctgatagggaaacatggatggaaattccactga

SEQ ID NO: 24861 - DNA, 1296 bp, Methanobacterium thermoautotrophicum
atggatgatcagaggatagcagtatttggtcttgggcacataggtcttccaacagcggcactatttgcaagggccggctttaaggtcacaggggttgacataaaccctgaaacagtggagaaggttaacataggaaggtcacccgtccttgaaccgggtcttgatgaactggtggcagaggtcgttgggaccggtaatctgggggccaccatggacggtgaaagggctgcagcagaatcagaggtcatgataatcgttgtgccaacaccggtcaacagtgaaaacacatccgatctatctgcagtgatatctgcagccgaaacaatctccaggggccttaaaaagggggaccttgtgatagtggagagcacagtacccccgggtgcctgtcagaacgtggtactccctatactggagaaaacaggtcttaaggtctcagaggactttggactcgcctacacgccggagagggcactgcctaacaacacactccatgaaatgcagaacaatgcaagggtaatagggggcgctgaccctgaaagcgcccggagggctgctgcactctacaggaggataacatccggtgaggtaatagttgtggatgacctcatgacagccgagatggttaaactgatggagaacacctacagggacaccaacatagcccttgccaatgagcttgcggttatatgtgaggcccttggcatagacgccataaacgccatcgaggcagcaaaccaccatccgagggtgaacatacacacaccgggtccgggtgttggcggccactgcctctcaatagacccctacttcatagtggagatggcggagaggaagggcgtgcctgcaaggctaataaggacggccagggaggtaaatgagtccatgcccctgcacgtccttgaaatcgtgagggaaacccttgaatcccggggtaagaccctaaagggttcaaatgtggggattctcggggttgcctacaagggtgatgtggctgatgcaagggagacgccaacaaggccactggtcgcagcccttctctctgagggagccagggtcctggtgaacgacccccatgtcagcccagaaattataagggggatgggtgttgaaccggtttcccttgaggaggccctcaactctgactgcgtggtcctcatgacagaccacacagagtaccttgaaataacacccgagatgatcccgggcgggatattcatatgcacaaggcccgtcatggaccctgagaggttcaggacaaggggtataacattcaggggcgtgggccgtccttga

SEQ ID NO: 24862 - DNA, 1149 bp, Methanobacterium thermoautotrophicum
gtgggaggcgtaccgccgtcacaggtgattagaggtggccgccagcacggattatcatatcagttaaggcatctaaaccataacaccttattaaatcagttcaccaaagtaattatcacagtcaagtcaattaaggtgatcaagatgataagtgtgggtattatcggagccagtggatacactggaggtgaactgctgcgactcctcgagaaccacagggaggtggaggtggtctcagccacatcgaggcagtacagtggtgttcccgtgtcgagggtgcatccacacctccaggacactgacctgaagtttgaagacgtcggtgccggtgaaatagacgcggaccttgtcttcacagccaccccccacggggcctcaatgaagatcgtcccccagcttatagagaggggtataagggtggtggacctcagcggtgactaccgctttgatgacactgaaacctatgaggaatggtatggaatcaaacacgaaagccccctcgaagcggtttatggtcttcctgagatacacagggaggaaatagcctccgcagatcttgtggcaaatcctggctgtttcccgacgggtgcaatacttgcatgtctccccctggtatatgagaagattgcagatacattcataatcgattcgaagacaggggtgagtggtgcgggtgttaagccaacagccctgacccattaccctcactgcagtgataatgtaattccctacaatgtaacaggccacaggcatacaccggagataaggcaggaactctcaaggctgaatcctgtgaggctcagcttcacaccacacctcgtcccggtgacaaggggcatccttacaacagcccacaccttcctccttgaggacctggagcagggcgaaatcgcagacatattcatgggattctatgatggagaaccctttgtaagggttgttgagggtatccctgggctcagtgcagtcaggggctccaacttctgccagatcggatgctttgaggttgatgataatcagagggctgttatagtatcagccatagacaaccttgtgaagggcgcatccggtcaggccatccagaacatgaacataatgttcgggttcagggaggtcgagggtcttgatttccccgggatgtacccatag

SEQ ID NO: 24863 - DNA, 525 bp, Methanobacterium thermoautotrophicum
gtgaaggggaataggggatgtcccttccccattcaacgtcagataataagagggatggatatgaagaaaccctttgaactgagggtcaaaccaataaagaacggaacagttatcgatcatataaccgcaaacagatctctgaatgtcctcaacatccttgggctccctgatgggcgcagcaaggtgaccgttgccatgaatatggattcctcccagcttggatccaaggacatagttaaaatagagaacagggaactcaaaccctcggaggttgaccagatagccctcatagcccccagagctacaataaacattgtgagggattataagattgttgagaaggccaaggtgaggctcatggatgaggtgaggggcatcctcagatgtcccaaccccaactgcatcacaaacagtgacgagggtgttgagaaccgtttctatgtcatctcagaggaacccgttctcctacgctgctactactgtgagcgcctcattgaggctgatgagatagagtcacagttctag

SEQ ID NO: 24864 - DNA, 1005 bp, Methanobacterium thermoautotrophicum
atgaagtatgggatgttcaatgaactcatggagcagccagagtctcttaggaggaccctgaagtctgaaggggacagaatggcacgtatatccaatgaaatactggaatgcagacgtatataccttgttgggtgtggcagctcactttcaacctgttacagtgcaagggatgcaatcgccatgaactatgaggtcaacatggatgttatgactggctatgagttctactatcacagacagattgattacagtgactctgcagtcatattcacctcacagtcgggtgagaccgcggataccctcgcagcactcaggagggcgaatgaactcggactcagaaccgttaccataaccaatgaacccggcagcaccatggcatctgaatccatggagaccatagtgacccgatgcggacgtgaggaggcaatacttggcaccaagacctacatgacacagctcctggccctctacaggatactcttcgggatgtacagtgatgaaaaatcggatgagataatgggagaacttgagaaactacccggtgaggttgaggatctgctgaggagaacagaggttgagtgcagggatcttgcagaggaatattccggtgaggatatattctactgtatggggagcggtcctaactatggactggcctacaaactcgcaatgacgatgctcatggagggtgccctgaagcattcctgtccactctattctggagaattcagacacggactcattgaaagggttgaggagggggtcccggttatattccttgaatctgggctgccaggtgatgagctgacagagagggccctgcgtttctgtgagaagctgggcgctgagaaccttgtattccggatgtcagattactctgaccttaacgggctcatgtcaccctttgtacttgcagttcccctcgaatggttcgtgtactacctcgcccatttcaacggggaggacccaggcagtaccaggcacataggtaaggtgagatactag

SEQ ID NO: 24865 - DNA, 861 bp, Methanobacterium thermoautotrophicum
ttgcttatccacacccatgagcccctcaaatttgctttttccaccacagaccatgaaaggatcccggaactctcctttggaataatgggggtcccctttgattccacgacaagctatgtgccgggggcacgtttcggaccaatggctgtcagggaggcatcatacagctttgaagcatacaacctgcgtttttcagagaatgtgaaggttaaaagttttgattttggagaccttgaggtttcccctggcaacttcatgaagacagcgggtttcataggggactctgtgtctgaagtcctggatatgggccttaaaccactcataattggcggtgagcatacggtcaccctccccgtgatcgagaatctgcctgaacatgattccctgacagtggttcacctggatgcccacatggacctggcagatacctacgccggagaaaggtactcacatgccaccgtcatgaggagggtccatgagcttggagccgagataatacagataggtattagatcagcatcatcggaggaggcggaatttgcaggggaggagggtgtcaggttctgcatggcccatgaggtcatgggggaccctgccggtgccattgaactcatagatggtatccggggcccggtctacatttcggtggacatggatgtccttgaccctgcctatgctccatctgtgggtaacccggcacctgccggactcacaccccacatcatggaggaacttgtcctcgcactctcaggtaaggatgtggtgggccttgatgtggttgaggtcgcatcgggtggcatggctgacccaacatctgtaaacgcagccaaaataatctacgacattctaacactcctctga

SEQ ID NO: 24866 - DNA, 870 bp, Methanobacterium thermoautotrophicum
ttgatagccggaacaagggggagtcgcctggcgctggtccagacgaaccatgtcatcgagatgctcagtgaagtctgcaaagagaaaatcgagaagaagatcataaagacaaagggcgacaggataagggattcccagctctacagcatggactcaaggggtctattcacaagggaactcgacatggcggtcctgaatgaggaggtggacctcgcagtccacagcctgaaggacgtccccagcgaccttgaccctgaccttgccatcgcagccgtgcccccaagggaatcacctgcagaggtcctggtatcccgccttgactgggaagatctcccccagggttccaaacttggaaccagcagtctacgcagggaagcattctgcaaccatcaccaaaaaaattttaagatggagcccctaagaggaaacatagatacaaggataaggaaggttatggatggcgaggtccatgcaaccataatggccgaggcaggattaaaacgtctcggactggaggagcacataaaaagaaggttccctgtggaatacttcacacctgccgccggtcagggagccctcgcagttataaccagggctgacagtgaattgataagctccattgggaggataacccaccatccctccctgcaggaggtcaccgctgagaagactctcctcagagagctcggtgcaggttgccagtgccccctgggtgtcataggaagggccactggaaaccagctaaccctctacgctgttcttctaaccagagaaggtgaaatgctcaggaaggtaaccgttagggggcctcttgctgaagcagaggatataggtaaaaaagctgccaaagaaatggaggattatatttga

SEQ ID NO: 24867 - DNA, 933 bp, Methanobacterium thermoautotrophicum
atgaggtctgatgtttctgaaatagagaaggaaacaaaatgccctgagtgcggctccgatgaccttaggggcgactacgaaagggctgaaatagtctgtggaaaatgtggtcttgtcatagacgataacctggttgatatgggtccagagtggagggcctttgaccacgaacagagggataagaggacaagggtaggagcacccataacctacaccatacacgacaagggtctatcaacaatgatagactggagaaacaaggacatatatggaagggacatacctgcaaggaacagggcccagtggtaccgtctgaggaagtggcagaggaagataaggatatcaggcgccaccgagaggaaccttgcatttgccctcagcgagcttgaccgtgactcatcaaggctggggctccccaggagtgtgagggaagcggcctccatggtatacaggagagccgttgagaacaaactcatcaggggaaggagcattgagggagtggtggcagcatcactctacgctgcatgcaggaaatgcaacgttccaaggacccttgacgagattgcagaggtttcaagggtgagcaagaaggaggttggaaggacctacaggttcctgacaagggaactcaacataaagttacctccaacatccccggtggattacgtgccaaggtttgcaagtgaactgggcctatcaggtgaggtacagtccaaggccattgagataattgagatggcaatggagaacggcctcacatcaggaagaggtccaactggggttgcagcagcggccctctacatagcatcggtcctcctcggggaacacaagacccagagagacgttgcagaggttgcaggtgtaacagaggtaaccataaggaacaggtacaaggagctcacagagcagcttgatcttggcgtgactctctag

SEQ ID NO: 24868 - DNA, 5007 bp, Methanobacterium thermoautotrophicum
gtgaaaatgattagaaaacgaagtgttactctactgataacagtggttttcgttttcatgctacagggatcaagcatggctgcagagattgatggaggtgaaggaggaaccccattcaacatcacagacagcgaggggagattcgcatttgaaaatgtgactggcgacagtcatgttgtctgggttgatggccggacactacctgaaaggcacagattcgatgacatgctcagggtaacagtgtcagcatcatcaaatgcatctgcaagaagcggaaaaatgattcttgaagcatccctcagtgattcgaagataacagggaggctctatgcagatttaaacgacaacaccatctttgatgatggagacgagccactggccggtgtcagtatctttgatccgccggagatacggtttttaataatatcctggccaacagaggcagggcagctcatccagccagtgaaaaacataatgcagaagcaccctgagataaccataaaggtgagaaacactgaccagacgaggatgaacctcacagagacagaacagctcatagaatgggctgatatagtctacataagcaacgtacagacaacaaacggtccaagcggtcctgtacctgacctgctgatgtcaatgaagagtcagggaaaacttaatggtaaggtgatagcggcctaccccaatccatatcactgttttccggttacaaggctcacaaacataaacaatacgaggttcgttgatgccaatggcacggaactaacagacagtcagctccaggcaatctttgattcagtttcaagggcagtgccaccaaagacaccgctaatggtgctgagggagctgcagcagcagtaccctgcaatggcatcctaccttaaattccaggaatacaagacatcagacacagcatcacctgagaacagggagcagggtctcatgtacctcctggcactggcattccctggaagaggctacaacttcacagaaccggtaatagttccgaagtatgccctctaccgcaacggcagactttactacaacttcacagactatgagcagttcttaacgcctggaagacccacggtgggtataacctcatggatggcactcacatgggagcgcggtgacctcctcatgctcgacagactcatcagtgaaatggagtcaaggggcataaatgtcatagcaactatagctcagggtaaccctgttgacggaacaccggtcataaatgcaatgaggagctacttctttgactctcaaaacaggacaaggattcaggggctcataacgctccagtcatttaagattggaggcgccaccgctgcaatcgctgaaaggatgattatggacaacaatatactggtcttcagatcacttgtggtctccgacagtgaggaaacatggtacatctcagattcagggatggactttacaagcataacaagccagatcgtgctcccggagttccagggccagatactcacaatggtaacagcatcgacccgtaagaccatagataccgtaaccggtctggaggttgaatgctatcagcccattgatgagcgcgtagaaacctttgcagacagggtatactcctggctgaggttaaggttcctctcaaatgcagataagaaggttgccctaatctactacaactatccaccagggaagcagaaccttgcaggtgcaagttacctggatggtccctcatcaatacttgagatactgggccttctgcaggaaaacaactacaccgtcagaggagcaccttcatgtgttgatgatctcctcacagagatgatggcgaggggactcaacattgcaaactgggctcccggtgaacttgagaggcttgcaaattcaaccatactatgggacgtagagaggtacatggaatggtacagcagactacctgagcttgcaaggagagaaatcgaggagggacccttcggctacatcgaagcactcttcaggtactccactgaaaacccgaaactcctcgaaacactggacaggtggcagagttcactgataacaacgatagatgacatgcagatcagcaacggatcagaggcaaagaaccaggttaacagggcctacaatgccctcaagaatatttacagtggactgaatcagtgggatgttttctacagtgcaaaatcagcattcctggccctcagggtcccgggactctgtggatggggagcaccaccaggaaacataatgacggttgagaggaacggtaagaggtaccttgttatacctggcatgttctatggaaacgtctttgtgggtcctcagccacagcgaggatgggaaggcgacgtggataaactctaccacagccagatagtgccaccccaccaccagtaccttgccttctatgcataccttcagacagagttcggcgcagatgcaatgatacacctcggacggcatggcacctatgagtggctcccaaggaaggaatcagcactatccggtgcagattaccctgacatatgccttggaggcattccaagcatctacatctacatcatggatggtgtcggggaggtcatacacgccaagagaaggggtcttgctgtgagcataagccacctgacaccaccactcgaggcaacagaaatctacggggacattgcctcactcaagacgctcatagaccagtaccatgcagctccaggcaacaggtcagaggagataaggctcataagggagaaggcagtccagctccaccttgataccatcattgacctcaaccttgacccggatgaactggttgatagaatcgacgactacataagggaacttgagggcacaatgatgccacttggtctctacgtatttggaagggacctgaaccagacacagcttaccatcatggtaaaatcaatggccagtgttccaaggataagcgccggtaacaacaccttcctctcggtgacacaggcactctcaggaataaacaggaccgtggaagatcttatactagaattttacagtggaaagtcacttcagaccctcatggcggagctccaggcagttctcggaagaaacctcacagcaacagagataacagccctgaatatgaccctcaatgatgtcctgaacatcaagggctcaggggcaagggagaggcagatgctccttcaggcccttgcaggtggctacataccacccatagctgggggagacccaatcaggaacccagcagcggttccaacgggaggaaacctctacggtgaggatccttcacttcttccaacacaggccgcatggataaggggctccatgcttgctgatgaggcgctcagagcatacaatgcaacacccgaacagctcggtgttgtcatatgggcgactgagacacagaacgataagggtgctacggttgccttcatcctgaggctcatgggactcgaaccaatctatggcttcggaggttcagtcatgggtgtgagggcaacaccactgacagtcctcaacaggtcaagggtcgatgtcctcatgaccacatcagggatattcagggaaaccttcccgctgctgggagtcctcctggacagggcatcaagggtggcgctggcagcatcattcaataccctgatggctgccataaaccaggaatcagcagagaacaggaccatgctcctcgcagcactcaacgcctcggtctcaagtatacagaaggcaggtttgttcataccgggaagtgatccccttgacaggaaccccattgcaaggcactggctatatgatgttaaggagctcattaaactcggcatgaaaccagaggatgcaggaattgcagccatatccaggctctttgggccatcactgggtaactacggtacaaggcttcctgaggcagtccagcaggactggacctgggaggaaaggacagagcttggaagactgtacattgacagcatgaagtatgccctcagtgaggatggctggggagtgagccttgaggaggtcctcactatgagactcagggacgttgagggtgtgtaccactcaagatcaaccaacctctacggggtcgtggacgtggaccataactttgagttcctgggtggcttcaggcttgcagttgaggcggcaggcggcagggtccctggtatgtacataataaaccaggtgaatccctcaaatgccagaatagagacactgaaccagttcctctacagggagctccagtcacgctactacaacccaagatggatacaggcaatgatgcagagtggatacgcaggtgcaagggagatctcaaacaacttcgtggccaacctctggggctggaatgtaatgagccccgagacaatctcggactggatgtgggaggagacagtggacatatacataagggatagatatggacttggagttaaggactggttatcccagggtaggaacagctatgcaatgataagcatgacagggacgatgctcacagcgatacaccgaggatactggaaccccgatgatgccacaaagcgtctcatagccaccacgtgggcccaggcaatagcagagaatggtgtggcatgctgtgactgcagttgcggcaacatcgccatgatggaatgggccatgcagtacctgaacccggaccttctctcaagggtcagggagaagctttacgctgccacaaagagctcagcattcgcaccatcctccgatggaggatccacacccacagcaccatcaaatccaggacagccacaggcaccgggtacatcagcagacaacggggagccacatcacgaggaatcacaggattcagatgtttcaacatcagcacctggagtggaggcagcaactcattcctcagcgggcgaaaaccagggtaaggcctatgaggtcagcagcgcctcaggttcagctaacccggagaccgggctacctgtctatgccatagttggtatagtggcgatagtgggccttctaggtctggggtacttctttggacctggaagaacagattaa

SEQ ID NO: 24869 - DNA, 642 bp, Methanobacterium thermoautotrophicum
atggcacaggaaatgattgaggggatcaaccccacaaggatggagctcctgaaactcaagcagcgtgagaaactcgctgtcaagggttacagtctcctcaaggagaagaggaacgcccttatcatggagttcttcaacatccttgagagggttaagggttcccgtgaaaaggtggaggagcacctcaaggaggccttctctgacctcacagaggcccaggtactcatgggcgacactgcagttgagagggctgcaatgtctgtgagggagtccgtggaggtcgacatagactcaaggagtataatgggtgtcgttgtaccggtggtcgatgcccgggcaacccagaggaccgtggttgaacgtggatacggccttgtggacacatcagtaaaactcgacgaggcagccagaaaattcgaggagtccctggcactcataatagaactcggtgagatcgagaagaccataaggcttctcgccggtgagatagaatcaaccaagcgaagggttaacgccctcgaacacatcataatcccgaggctcaagaacaccgtcaagtacattgagatgaggctcgaggagatggagagggagaacttcgtcaggttgaagatgatcaaaaaatccatggagatggagtga

SEQ ID NO: 24870 - DNA, 1398 bp, Methanobacterium thermoautotrophicum
gtgaagatgaacgttaacatcaaaacccgtgaatacaccaccgtcacagaggtctcaggtcctctaatgatcgttgagggtgttgaaggggttgcctacagtgagatagtggagattgaaacacccacaggtgagaagagaaggggacaggtactggaagtcagggaggaccttgcagtcgtacaggtctttgagggtaccagtgacctcaacacagagacaacaaagataaggttcacaggtgaaacagcgaagatcggcgtatccctggacatgatgggccgaatattcgacggtacaggtaaacccatagacggtggccctgagatcatacccgagaaggagctcgacatcaacggtagccccatgaaccccgctgcaagggagttccctgccgagttcatacagaccggtatatcaaccattgacgggatgaacaccctggtgaggggtcagaagctgcctatattctcaggttcagggcttccacacaacgaactggcagcccagatcgcaaggcaggccaaggtgcttgcagaggagagcgaattcgcggttatcttcgcggccatgggtatcacccacgaagaggcaaactacttcatgagggacttcgagaggacaggggcccttgagcgtgttacggtcttcatgaacctggcagacgaccctgccattgagcgtatcatcaccccgaggatggccctcacaacagcagagtactttgccttcgagcacgacatgcacgtcctggtcatactcacagacctcacaaactactgtgaggccctaagggagatctcagctgcaagggaggaggtcccgggacgaaggggttacccggggtacatgtacactgaccttgcaagcctctatgagagggcagggcgtatagtcggcaaggaggggtcaatcacacagatgcccatactggtgatgccacaggacgacatcacacaccccatacctgacctgacaggttacatcaccgagggccagatagtgctgagccgtgacctccaccgtaagggtatatacccaccggtggacgtgctcccatcactctccaggctcatgagtggtggtatcggtgagggaaggacacgtgaggaccacagcggtgtctcagaccagctatacagtgcctacgccgagggacgtgacctcagggacctcatggcggttgtgggtgaggaggccctcacagagagggaccgcaagttcctaaaattcgctgatgaatttgagaaacgcttcatcacccaggcacgtgacgaggaccgctccatagaggagaccctcaacctcggatgggaactgctatcactcctcccgaggtccgaactcaagagggtccgcgaggagcacatacccaagtacctcccgggtgccgaataa

SEQ ID NO: 24871 - DNA, 1755 bp, Methanobacterium thermoautotrophicum
atgacacaggaaggaaggattataaaaatagcgggtcctgttatcatcgccgaggggatgagaggatcccagatgtatgaaatggttaaggtgggtgaagacaagctcataggagagatcattgaacttgagggtgacacagcaacaatccaggtctacgaggaaaccgcaggcataaagcctggagagaccgttgaaagaacaggcggtccactatcagtggaactgggacctggaatactgggttcaatcttcgacggtatccagagacccctcgagaacatcaaggcactcaccggagactacatagagaggggagtggacgtaccatccctcccaaaggataagaaatggaccttcaagcccacagcccgggagggccagatggttaagggaggggacataatcggtgaggttgaggagacatcctcaataacccacaggataatgatcccaccaaacgttgaaggtaaactcacaatgatagccccccagggcgaatacaccgtccttgatgatatagctgaggttgaaaccgagagcggaacagaaaagatccagatgctccagaagtggcctgtcaggaagggccgaccctacaagaagaaactcgaccctgacgtccccctcgtaacaggtcagagggcgcaggacacattcttctcagtcgccaagggaggtacagcagccataccgggacccttcggttcaggtaaaacggttacccagcagcagctcgcaaagtgggctgacgcagacataatcgtctatgttggatgcggtgagaggggtaacgagatgaccgaggtcctcaaggagttccctgaactcgaggaccccaagacaggtaaccccctcatggacaggaccgtgctcatagcaaacacttcaaacatgcctgtggctgcaagggaagcctgtgtgtacacaggtataaccatagcagagtacttcagggacatgggctacgacgtcgccctcatggcagactcaacctcaaggtgggccgaggcaatgagggagatctcaggaaggctggaggagatgccaggtgaagagggataccctgcatacctcgcatcaaggctcgcacagttctatgagcgtgcaggaagggtcacaaccattggatcagaggataagatagcctcagtatcagttgtgggtgcggtttcaccaccaggtggggacctctcagagcccgtcacacagaacaccctaaggatatgtaaggtgttctgggccctggacgcatcactggcagacaagcgtcacttcccttccattgactggctccagagctactcactctacattgacagtgtccaggaatggtgggccagcaacgtggaccctgaatggaggaaatttagggacgaggcaatggccctcctccagaaggaggcagagctccaggagatagtccagctcgtcggacccgacgcacttccagacagggagaggataaccctggagacaaccaggatgataagggaggacttcctccagcagaacgcctaccatgaggtggacacctactgctcaccatcaaagcagttcgagatgctcaggacaatcataatgttccacaggaacgcaacagcggcccttgagaagggcgcacctgcagctgacataatatccctccctgttaaggaggatatcgggcgtatgaagtacatacctgaagaggaattccctgcaaggatcaaggagatccaggaaaggatcgtcaaggaatgtagtgaggtgtga

SEQ ID NO: 24872 - DNA, 321 bp, Methanobacterium thermoautotrophicum
atgagttcaaatattgcagtggttggtgacagggacactgtaacagggttcagactcggaggcgtcagggaaggctacgtggttgaaacacctgacgaggcagaggaaaccataaggaaccttatacgtgatggcttctccataataatcgtcacagaaaagattggtgatgaactgagggaatttatagaggaaaccacaagttcaagcgcattgccaatgataatagagataccagacaagacaggcccctcagaacgtgaaacagatccactgagggaccttattaaaagagttattggggttgagatggtaaaatga

SEQ ID NO: 24873 - DNA, 621 bp, Methanobacterium thermoautotrophicum
atgagctccggagccgaaaaaattgtctccagtataatgtcagaggctcaggcaaaggcggacgccataatcagggaagctgaagatgaagctgcaggtatagtggatgaaggtgaaaaaagggccaggatggccagtgaacgcatactcgagtcagccagaaaacaggctgacatgaggtaccagcagataatctcagaggccaagatgaatgcaaggcgtgcagaactggaggcaagggaagaggtaatacaggaggccttcaaaaaggcggaagaggaacttaaaaacctggcatccacctcccaggaggaatacgtcagcgccctcaggggcatgataaaggaggccgccgttgagataggcggcggtgacctggttgtcagcatgagggaggacgacaggtcccttgacctcggactcgataaaatcgcggctgaagtggaagcagaaacaggcaaaaaaacaaccctgaaggttggagacagcatcagaaccattggaggagcagtggtaaggacagaggatggtctgatagaggttaacaacacaatagaggccaggatgtcccgtttcaggaaggctctacgttcagaggtggccagggttcttttcgaataa

SEQ ID NO: 24874 - DNA, 1977 bp, Methanobacterium thermoautotrophicum
gtgagtgacatgtttctaccggcaaggatgcgaaaacttaagatcataaccctggatcagtactcggattcggtggttcgttccttgcatgaggagggtgtaacccagatcgatgatatctcagagcgcatccagcaggatgcagagtggcgccagatactgaaaccatcaagggcaacaccatacacaggaagggtgtcatctctcctcatgaaaaccagcggtatcctggacttccttggctcagtcgcagccgaggagaagggtctcagggataccataagggagttcataaaccccccgatattcgagaagcgggaggttgaggaactggacacagaatccctcatcgaaagggctgaggagaccctggggagggtcgagtcagagaccagggttatggaggaaaaattgaatgagcttgattcagaaaggtccgctgttgaatcaagcctctctgttgcagagaaactgaaggattttgatattgatttttctgatctccaggattcagagtacataacaggaatcgcaggaaggataacagccgagaacctccctgaactcagggataaactcgcagatatcacagatgaactggtcatatcagacagagagggagagaacaaggctgaaaggatcctgatcattgtaacactgaagaaacatgcagacagcatagcctcagtcctcagaaggatggaattcgagagatttgagatcagcgaactccagggtagaccatcagagatcatatcctcctcaaagacacgccttgaggagatcagcagggaaaggaaggagatcatctcaaaattaagggatataaacgctgaatgggaggacgaactcctggtcctcagggaacagcttgaaatagagaaggagaggaatgaggtattctcactcttcggcgaaaccaggaagacggtgatgctggaggcatgggtccccctcaaggaagctgacagggtcatcgccgtggttgaggagtcatctgagggcactgcgttgacggacctggaggacccggatcctgaggaggtaccggtgctcctggacaacccgaggtttgcaaagccctacgagaccttcgtggagatgtactctcccctgaagtacaacgagatcgaccccacaattttcatggcctttgtgttcccgttcttcttcgggttctgcctgacagatgcaggttacggtataatcgacgccctgataggcttcatactctacaggggcctgggtaaggtcaacaacttcatgaggaacttcggtatcatcatgatgtcctgtggtgtgtgggcattcatcctcgggatggtcaccaacgggttcataggggacttcttcccacggttcttcaacataaccctgccaacggttataccggcaatagacgcctttgtgaacccccagaacatactgataatggcactcaccgtgggtgttctccacataaactttggtctgatactcggtgcaaggaacaacataaggctcgggaacatgagggaggcccttggatcccagatcgtctggctgatccttgaactgggtataatcctctacctggttgggggcatgattttcggggctcctctgataatcctggcatttgcaatgctactatattacaatggcctctttggcctcatggatgtatcagggttcctcggtaccctcctgtcatatgcaaggctgcttgcactctgtctctcaacgggtggtatagccatgaccgtgaacatcctcacgggtctcagctatgagatgatacccgtcatcggagtggtactcgccccgataatcttcgtcttcgggcacatcgccaacaacgccttccagagccttggtgcctttataaactcacttcgtctacactatgttgaattcttcgcccagttctacatgggcggaaaaaacaaattcaatgcatttcgtgctgaaagaaactttactaagataaggaggtaa

SEQ ID NO: 24875 - DNA, 1368 bp, Methanobacterium thermoautotrophicum
atggagatgattattgatggcgagggggtgagtggagagaaaatcttcaccgtcaggaaccccttcaacggggatgaggtggatagggtcccacttgcaggtcgaagtgatgttgagagggccataagggcggcccaccgggccagggatgcaatggcggacctatcagccaggaagatatctgagaaactctatgacgttgcagacgaactgaagacagaactggatgaatttgcaaggctgataacccttgagtcaggaaaaccaataaggttctcacgtgacgaggtgaagaggtcagttgaaactgcaaggctttctgcagaggaggcaggaaggctctacggtgaatcaatccccatggacgcgggtataggcgggaagggtctcactggcttcacagtcagaatccccctcggggttgttgcggcaataacccccttcaactatcccctcaaccttgcaatacacaaggttggcccggcccttgcagccggtaacaccacgatccttaagccatccctcgaggccccactatctgcactgaagctggcatggatcctcagtgagcacttcccggccggcgctgttaacgctgtaaccgggaggggctcagaggtgggggatgttatcattgacagccccctcgttgataagataaccttcactggaagtgttgaggtcgggaggtacatatctgccagggcctccatgaagaagatcacccttgaactgggaggcaacgaccccctcattgtcatggatgacgcggacatcgactctgcagtggaggctgctgtgaggggatcctacctctactctggacaggtctgcatagccgttaagaggatgatagtccatgaggacgtggccgatgaattcgcagataaactcgtgaacataacagggagtttaagggccggggacccaatggatgtaagaacagatgttgggcccttgataaatgaggatgccgccattgaggttgagagggtaatcggggcggcggttgaggatggtgctgaactcctctgtggcggttcaaggaggggtaactttgttgaacccacggtgcttgaccatgtggtgcccggcatggaggttattgaaagggaaacctttggcccggtctccccaataataaggtttaatggtgctgatgaggccataagaattgccaacgggacctgctatgcacttcaggcaggggtcttcacagagaacataaggacggccctcaggatggccagggaaattgaggcaggcacagtgcttgtaaacaagcagtccacattcagggtggaccacatgcccttcggggattcaggtgcagtggaatgggtaaggagggtgtcaagtacgccataa

SEQ ID NO: 24876 - DNA, 1026 bp, Methanobacterium thermoautotrophicum
gtgaccgacagggggttaatgaagactggattcgttgaggatgtcagctcctcccttgaggaggagggcctcgaatatgtcatctttgatgatgtgacgcccaacccccgtgaccatgaggtcatggagggtgctgaggtcttcgatgccgaggaatgcaacatgatagttgccctgggtggtggaagccccattgactgtgcaaaggccatgggtgctgttgtatccaacaggatgcacgtacttgactttgagggtgttgatatgatcccgaccccctcggttcccataatatgcatccccacaactgcagggacaggagcggacgtctcccagtttgcaatcatcctcgacacccggaggatggtgaagatagccatcataagcaaggccatgatacccgacgcatcactcatagaccctgagaccaccgtcaccatggaccgggaactgacagcttcaacaggtatggatgcccttgcccattccatcgaagcctatgtatccaatgcaagcttccatctgactgacctcaacgccctggacgccatcagaatcataagcaggtgcctcccatctgccgttgatgaacccgagaacatggagtaccgtgagggtatgatgcttgcaagcctcgaggctggccttgcattctcaaatgccagtctgggacttgtccatgcaatggcccacagccttggaggcaaacttgacatggcccacggtgaggccaatgcactgctacttgaacacgtgatagaattcaactaccctggagccactgaacggtaccatgaaatcgcacgggcaatgggcctcaggggctcggggcccgccgagctcattgattacatccgggaattcaggtccagcatagggatcgacatgaccctggaggatctcggcgtcggggaggacgacatacctgaacttgcagaggcctcaatgaaggacccctgcattgtaacaaaccctgtacggccctcaattgaagatgttgaggccatattcaggagggccctctga

SEQ ID NO: 24877 - DNA, 2487 bp, Methanobacterium thermoautotrophicum
atggagaacatcgaccccatgggcatacacacaggtgaaagcgtggtggttgcacctgcccagaccctcagcgacgaggacaaccagaggctgagggatgcggccataaagatcataagggccctcaagatagagggtggctgtaacatacagttcgctgtccacccggagaccggcgaatacaaggtcatagaggtgaacccgagggtcagcaggagcagtgcgctggcatccaaggccacgggttaccccatagccaagatagcggccaagatagccgtcggcatgaccctcgatgagatacagaacgacatcaccaaggagacaccagcgtccttcgagcccacaatagattacgtggtcacaaagatcccccgctggccctttgacaagttcaaggggataagcagggagataggggttcagatgaagtccacgggggaggtcatggccatagggagaacccttgaggagtccctcaacaaggccataaggtccctggacatcggtgcagacggattcactgagacaccatacaccagggcggaccttgagaatccaacggaccagaggctctttcaggtctacaccgccctcagggatggtatgagcatagaggagatacatggcctgacacagatagaccccttcttcctccagaagataagcaacatagctgaatttgaatcatccatcaccagggaatcactggaggacccccgcatactgctcaaggccaagcggatgggcttttcagattcgagattagcatccctcacaggtatggatgaatccagtatcagggccctgaggcttgagaacaacataaaacctgtctacaagatggttgatacatgcgcagccgagtttgaggccaggacaccctactactatggttgctatgaccttgaagatgaggtggaggtatcagaccgtagaaaggtcctcatcataggttcaggtccaataaggataggtcaggggatagagttcgactactgctgcgtccacgcagccatggccctcactgaggatggatatgagaccataatggtcaacaacaacccggagacagtgagtacagattatgacatctcagataagctctacttcgagcccctcacccttgaggacgtcctcgccatcatcgagaaggagaaaccagagggtgttgttgtccagttcggtggccagacatccataaacctggcggtccccctggcagaggctggtgtgaggatactcggaacaccacatgagagcatagacagggtagaggaccgtgaaagattcactgaggtgctgaataaactgggaataccccaggcaccctacggaatcgcaaagtcctttgaggatgcaagggccgtggctgaacgcataggctaccctgtactcgtaaggccctcctatgtcctgggtggaagggcgatggagatagtctatgatgatgtggagcttgaggagtacatgagggaggctgtccgtgtatcccccgaacaccccatactggtggacaagttccttgaggatgccatagaggtcgacgtggatgcactctgcgacggcaccgacgtctacataggaggtataatggagcacatcgaggaggcaggagtccactcaggggattcagcgtgcgtgataccaccacagagcatcccggaggatataattgataccataaaggagtacacaaggaaactggcccttgaacttgaggtggtgggcctcataaacatacagtacgctgtaaagccagactcagatccatcagtctacatactcgaggcaaacccgagggcaagccgtacagtaccctttgtcagcaaggcgacaggggtcccccttgccaagatggctgcaaggctcatgatgggcgcgaagctcagggaccttggtctcacagaggagaaggatatagaacacgtcgctgtgaaggagtctgtattcccattcataaagctccctggagcagattcggtcctgggccctgagatgaaatcaacaggcgaggccatgggaatagatgaaaactttggcatagcctactacaagtcccagctctcagccagcatggacctcctcaatgaggggaaggtcttcataagtgtcagggaccaggacaaggataagatagccgatatcgttaaaaaggccgatgaactcggcttcaggatcatggcaacccggggaacagccagggcagtcagtgacattgcagatatagaggtcgtgaggaaggtgagccaggggtcaccaaacatcagggacgcaattctggatggtgaagttggtctcataataaacacaccatccgggaagcagtcagccgatgacggctacctcataaggaggatggccgttgaacttggaataccctacgtcacgacacttgcaggggccagggcggcccttaatgccattgaagcagttcgcatgggaaaaataacagtgaagtcccttgatgaataccatggtatgtga

SEQ ID NO: 24878 - DNA, 693 bp, Methanobacterium thermoautotrophicum
atgccgcgggatgaaagcatcaataaggtacttatcataggttctggccctatacagatagggcaggcagctgaattcgactactctggctctcaggcatgtaaatcactcagggaggagggaatagagacagtacttgtgaactcgaaccctgcaaccatacagaccgacatggaaatggctgacagggtctacgtcgaacccctcacacccgaaatcgttgccaagataatccagaaggagaaacctgacgcagtactcccaacgatgggcggccagacaggcctcaacgttgcaacgggccttgcagagatgggcgccctggagggagtccgtgttataggttcatcaattgaaaccataaggaacgtggaggaccgcgacctctttgacagcttcatgaagaagctcaacgaaccagtaccagcagccagggccgtcagttcagttgaggaggcccttgaggcggttgaggagataggctaccctgtgatcgtgaggcccgccttcaccctggggggaacagggggcggggtggcccacagccgggacgaactcattgagatagcaacaaggggcctcgagatgagcttcatcaaccaggtcctaattgaccagtcagtcctgggctggaaggaattcgagtacgaggttatgagggaccggaatgacacctgtataatcgttctgtaa

SEQ ID NO: 24879 - DNA, 1125 bp, Methanobacterium thermoautotrophicum
atgaatatcgaccagtctaatccaatcaaaggaaatcaggatcatggtggtgaaatgtttaaggaagcaaaactcgccttggaagacggtaccataatcagaggagaagcattcggatctgaaactgtgaaaacaggggaagttgtctttgcaacgggtatgacaggatatgttgagtccctcacagatccatcatacaggggccagatactgatgccaacctaccccttacagggcaattacggcgtcaccgaggagtggtaccagtcagatgggataaaggccgagggtctcatcgtcagggaaatgtgccctgcaccctcacacagcctgtcagaaaagactctcccggagttcctggaggaatatgggattcctgggatagctggagtggatacacgcgccctgacaataaagataagggataagggtaccatgaagggtgcccttgcaaccgaggagattgatgatgatgaactgcttgaaatggcagtgaaacagccagacataacagaaatcgaccttgtggatatggtttgtgtaagggaacctgtaatcctgaatgaggatgcatcagggagggttgttatagttgactgcgggatcaagaggaacagcatagatgccctccttgagaaggatctgggggtcgtgatcgtaccctacaccacatcacccgccgagatcatggattacgagcccgacggtctcctcatatcaagcggaccaggggaccccacacgtgtgagggatgccatagacacagttaaagcactatccgaacgtctgcccatattcgggatatgcctcggacagcagataatcgcactggccttcggggcccgcatatacaagatgaagtttggtcacaggggcgtaaatcagcctgtgaaggacctgaggagtgggacggtttcaataacctcccagaaccatggattcacggttgaccctgattcagtgaagggcaccgacatagagataacacagctgaacctcaacgacggaacaccggagggtatagagcacagggaactcccggtgttcagtgtccagtatcaccctgaagcgggtccagggccacatgacacggtgaacatctttgaccgcttgtggatgttttaa

SEQ ID NO: 24880 - DNA, 2535 bp, Methanobacterium thermoautotrophicum
gtgtttaaaatgaaatgggctgatatgagtttagatgaagttttaaaggaacttaaaacgtccaggaagggtttaagccaggacgaggcatcgaggagacttgagaaatacgggaagaacgaactcgttgaggagaagaaggctggcccggtgaagctattcctcagccagttcatggacatactcataatactcctcatactggctgccgttgcatcctacttcgtgggtgacgtccttgactctgcagtcatcctctttgttgtggttgtaaacgccaccgttggattcatccaggagtaccgggccgagcgtgccatggagaaactcaagggtctggtatcgacagaagctgtcgtcataagggacggtgagaccctgaggatccctgcatccgagctaaccctgggagacatggtgatcatagaggagggagataatgtacccgccgacctccggttgatagaaacctatgatctccggatagacgaatcagccctcaccggggaatcaatacccgtcaggaagacacatgaaaatcctgaagatgaaagggatgttattgcattcatggactctaacgttgtctcagggcgcggcaagggggctgtgatagccaccggcatggagacctccatgggtaaaatcgccaggatgatacaggaggatgagggtaaaacacccctccaggagaagataatctccctagggaagaacctcggcctcatagcagtggtggtatgtgcccttgtatttgcaatacagttcctccgcggcctgccactggtggacacattcatgacagcagtttcccttgccgtcgcatctgtacctgagggactgccagcaatactcacactgacccttgcccttggaatgcagaggatggccaggagcaacgccatagtgaggagactccttgcagtggagacactcggttcctgctctgtgatctgcacagacaagacaggtacactgacccacaaccggatgaccgtgagggaatcagagctcacatcacctgaaatggccctcctggtatgcgcactctgcaacaacgccacatcatctgaggggggtgtgataggtgaccccacagatgctgccatactgagcttcgcagctgagaagggctacctgcgggatgaactcgaaaggaagtacccccgtctggcagagataccccttgacagtacaagaaagaggatgagcaccataaaccagctggaggacggaaggtacctcctcgtgaagggagcccccgagataatactcagaagatgccgttacatcgacagcggtgatggtgttaaggaactgactgatgaagaagtggaaaggtggctctccagactcaatgatatgacctcaagggccctccgggtgcttgcactggcctacagaaaactccctgacggtgacgatgaggagaaggacctggtgtttgtcggacttgttggtatgatggatccgccaagaagggaggctgctgatgccatagaaacctgtaagagggccggtataaaggttgttatgattacaggggatcacagggacaccgctgttgccatagcacatgaactgggactcatggacaacgggatggccctcacaggcagggagcttgatgagctcagtgacgaggagttccatgaaatcgttgaggatgtgagggtctatgcacgtgtttttcccgagcagaaggtcaggatagttgaggccctccagggcaggggccatgtggtcgccatgaccggcgacggggtgaacgatgccccggccctcaagaaggccgccatcggtgtggctatgggcagcggtacagatgtggccagggaatcctccgacatggtcctccaggatgataacttcgcaaccatcgtcagggcggttaaggagggcagaactatattcgataatataaggcgttttgttaagttccagctctcaacaaacgtgggggccatcctgacaattgtgtcagcatccctcatcaacctcccggtccccttcaacccgatacagatactctggatcaacataataatggatggaccacctgcacagtccctgggtgttgagccccctgagtcagatataatgctccgcggacctgaaagggagaatatactcccagggaggaacctcctgaggataatccttgcaggtgctgtgatggccgccggtaccctggggctctacatgtacatgctatcatcaggagcggggattgagagggccatgacagtggccttcacggtgttcgtcgtcttccagatattcaacgtcttcaactgcaagtcacggactggcctgtcaaacagggcgctgatccttgccgttgtggcctcactggccctgcagatcctcgtgatctacctttcaccccttgagggcatattcaggactgtgccactatcagtggtggactgggtgctgatagtcctggtggcatcactgatactcatcctcgaggctgtcctgagattctctgatgggagaaataaagtaaaggagaaccgtgcaaacccctga

SEQ ID NO: 24881 - DNA, 1014 bp, Methanobacterium thermoautotrophicum
atgatatctgtagccattaacgggtatgggacaataggaaagagagttgctgatgctgtagctgcccaggacgacatgaaggtcgctggtgtcagcaaaacaaaacctgattttgaggcgagggttgcaatcgagaagggatacgacctctacgtcagcatccctgaacgtgagaagctcttcggcgaagccggcatacctgtgagcggtaccgtggaggatatgctggaggaagcagatatagtggttgatgcaacacctgagggtataggtgcaaagaaccttgaaatgtacagggagaagggcataaaggccatattccagggcggtgaaaaacacgacgccataggattatccttcaactcatttgcaaactacgatgaatcccttggagccgactatacccgtgtggtttcatgcaacacaacaggactctgcagaaccctcaaacccatcgatgacctctgcggcataaagaaggtgagggctgttatggtgaggaggggtgccgaccccgtacaggtcaaaaagggaccgataaacgccatagtacctaaccctccaaccgtgccatcacaccacggccccgacctcaagaccgtcatgaagggcgttaacatccacacggtggccctcctggtcccaacaacactgatgcaccagcacaacataatggttgaacttgaggatcccgttgaggccgatgagataaaggcccggctcgatgagaccacgagggtcatgcttgtcagggcctctgagggtctcgcatcaacggctgagataatggagtacgccaaggaacttggaaggtcaaggaacgacctcttcgagatacctgtatgggaggagtcaataaacgttgttgacggggaactcttctatatgcaggccgtccaccaggagtcagatgctgtgcccgagagtgtggatgccataagggcactcctggagctcgaggaggacaacatgaagtccatcatgaagaccaacagggccatgggcatcctctaa

SEQ ID NO: 24882 - DNA, 1119 bp, Methanobacterium thermoautotrophicum
gtggtgaaattcaacaatataatctatgacccccaggtatccgataaaaagtttccagtgcaggcatcagaccctgaaagggaggctaaacttgttgtgctgcagccagttggatacccctttgtatgcaacctcatggaggctccgaggatagacgctgttaacaaggagctctttgagatatacgccagggaccagtgggagggtttcagggcagctgagggttcatacctctttgaccagaagctgctccctgactatgccttcaagataataagggcccatcctgacggttcaaagataaccaggaacacctcaataatactcctggagaatgatcgggaggaattccatgaggtcaggagcagcatcaccatggatgacgttattgggcaggaggacgccaagataaagtgcaggataatcatgaagtaccttgaagatccggaccgcttcagggactgggcccccaggaacgttctcttccatggaagcccggggacaggtaagacgatgcttgcaaagtcccttgcaaatgaactgaaggtccccctctacctcataaaggccacgagcctcataggggaacatgttggtgatggcgcaaggcagatacatgaactctatgaactcgcatcaaagacagccccctcagtcatattcatagatgaaatggatgccattggccttgacaggagataccagtccctccgtggagacgtctcagaggtcgtcaacgccctcctcacagagatggatggtataaaccagaactggggtgttgtaacaataggagccaccaacaaccctgaactgcttgataaggccataaggagccgttttgaggaggaaattgagttcaagctgcctgatgatgaggagagaaaactgatgcttgagaagtacattgaaaccatgcccctcaaggtggatttccctgttgacaaacttgtcaagctcaccagggaaatgtcaggaagggatataaaggacagggttcttaagacagccctccaccgggccatagcagaggacagcgaatctgttagagccgaacacatagagtacgcccttaaggagcgtaaggtctcaggcgaacccaaacacatgtttgcctga

SEQ ID NO: 24883 - DNA, 1209 bp, Methanobacterium thermoautotrophicum
gtgttgcaggtgattctcaacataaggctggaccacaagacatccgatgtgaagaccatggagtcctcacatgagaggatggaggccattgtggctgaacttgagtccagtggaactgtgatggagaaggtcccaataaggacctgcaaccgcatcgaatactacctttcagtccaggagatacccccgggctttgagttcgatggattcacggttgaaggggatgaggatgccctcagacatatcctgagactcgcatccggtcttgaatccatgataataggggaggaccagatactcggccagataaaggctgcaagggttcaggccctgcgtgaagggacctgcggcccggtcctggacatggtgttcaccaaggcagtccatgtggggcagaccgtcaggaggaagacccagataaacaggggctctgtttccatagggtcagcagcggttgaccttgcagaatccatacacggagatctgaagtgcaggaaggtccttgccataggggcaggtaagatggggaccctcgttgcaagggcacttgcagagaagcacctcagcgccataatggtggccaacaggacctatgagagggcctaccagctggcatgtgaactcggtggagatgctatacactttgacaggctcaacagggccctcagggacgcagacgttgttatcagtgccacaggctcaccccactacattctgacccgtgaacgtgtcagggacgcaatacctccggagaggagatccgctgtggtcatggtggacatagccaacccacgtgacatagaggagtcggtaagagaacttggcatcagactcttcacaatcgatgatctgaggggagtggcggaagagaaccggagaaggagggaggcagaggcgagggaggctgaaagaattgttgaaggtgaacttaagctcctcctgaggtccctcaaacacatggaggttgaacccctccttgcagaggtgaggggcaatatggagtcactccgcaggcgcgaggcagaaagggccctcaataagatcatgaactcctctgaccctgagggggttattgaggccctcagcaggtccatcgtggataagatattccatgatatagccatcagcatccggcaggcggctgagaggggcgatgaggaatttctgagcatgtgcgcaaagctctttaactgcaaagatctaaaatga

SEQ ID NO: 24884 - DNA, 621 bp, Methanobacterium thermoautotrophicum
atgaaggttcttggtattgatgaggccgggaggggaccggtgataggccccctggttgtggcgggtgtgatgatccctgagaggaagttctccatactccgcaagatgggtgtgaaggactccaagaagctcacacccgagaggagacggttccttgcaaggaagataagaagaatcgccagggtattcacggttaagatctcggcctctgacattgacagaatgcgtgaaaggggcttcaacctgaatgagatagagaagatagccataaagaggataataccagaggcccagccagaccgtgtgatcattgactcggtggatgttaagccagagaggcttgaggaggagatcaggtcacacttcggggaaattgaggtcactgcagagcacggtgcagatacaaggtactaccctgtggccgcagcatccataatagccaaggttgaaagggaccttgaaatagagagcatacagaagaagaacaggaaactcggggatattgggtccggttacccctctgacccacgtacccgggaatttcttgaatcattcacctatgatgaactgccagactttgtcaggaggtcatgggcaaccgttcagaagaagaagcagtga

SEQ ID NO: 24885 - DNA, 1098 bp, Methanobacterium thermoautotrophicum
atgaagttctatgagtacagcgccaaggagatattccgggctgagggtataagcaccccccgtggaggtgttgcagagacccctgaagaagctgaaaggatagctgcggaactggggtgtgatgttgcagttaaatcccaggtccttacaggtggaaggggaaaggccggtggtataaggttcgcatccccctcaggtgtcgctgaagttaccggggacctcctttcctcagaggtccgtggtgaaaccgttgagaaggtcctcatagaggagaagatacccatagaccgggagctctacgtgagtgctgtcattgaccggacagcgaagatgcccctcataatggccagtgccgagggaggggttgatatagaggaactggcagccagatcccccgaaaagatcgtgcgctaccacatcaaccccctcgatgagtttcttccctatgaggccagggagattgcaaggaagatgggtcttgaaagtgaactgataccctctgtcggtggagtgatctggaagttatatcagctcttcaggaagtacgatgccaggcttgcagagataaaccccctggtcatctcaggggacagtgtcatcgcagcagacgcaaagcttgaggtggatgacgactccatttaccgccacagggaatttatggaaatggaggagtatgaacccgaggagtttgcctttgtgaagctcgacggagatattgcggttataggtaacggtgccgggttaaccctcaccgcaatggacctcataaaactgaacggggaacccgccacattcctcgacatcggtggcggtgcctcagaggacgtcataaggagggcccttgacctcgtcatatcccatccctcagtccgggttgtattcctcaacgtccttggcggtataaccagggccgatgatgttgccaggggtgttgtgaacgccctgagggatgccagaagagacgtgccccttgtgatacgccttaccggaaccaatgaggaggagggtcagaggatcctgcgggaggcaggaatcccctttgagacgtcccttgagagggctgctgagaaggccgttgagatagcaaaaaacctctaa

SEQ ID NO: 24886 - DNA, 1236 bp, Methanobacterium thermoautotrophicum
ttgatggtgatcccggtgtcctttaaatttaaaaccatggatgacattgaagtcacaggaaagacagtccttgtccgcgtggacataaattcgcctgtggaccccaatgatgggacaatactcgatgatacaaggatgaggctccatgcagagaccataagggaactctcagataggggtgccaggacagttgtgatggcccaccagagcagacccgggaagaatgacttcacaacactggagcagcatgccagggcgctctccgggatactcaggaggcccgttaagtacgttgaggatatattcggatccgctgcaagggagaacatctcaggactgggtgatggtgagataatcctccttgagaacgtccgcttctactccgaggaggtgctcaagcgagaccctgaggaacaggcggagacacaccttgttaggaagctggcgcccctcctggactacttcatcaacgacgccttcgcggcagcccacaggtcccagccctcccttgttggcttcgccctgagggtaccgtcagctgcgggtcgtgtgatggagagggaacttcgaacacttcagggtgcccttgagaatgttgaaaggccctgtgtctatgttctcggcggggtgaaggttgatgactccatcatggtcatgaagaacgtccttgaaaacggtagcgcagaccttgtactgacaacgggccttgttgccaacatattcctggcgggatgcggggttaagatcggtaaggtgaacatggacttcatcaagagcaggggatactgtgacttcatcaaggtggcgaagaaactgaagaagcgcttccctgaaaggatagttgtacccgttgatgttgcagtatgcagggacggcaagagggttgatgttcctgtgaaaaagatacccaaccatccgatacaggatatcggaatggaaaccataaagctctacgccaggaggatacgtgaggcaaggaccctctttgccaatggaccggcaggcgtatttgagaaccctgatttcagcataggaaccgaggacatactgaatgcaatatcctcttcagaaggtttctcaataatcggcgggggtcaccttgctgctgcagcagtgaagatgggctttgaggacagcataaaccatatcagcagtggaggcggtgccagcataagcctccttgcaggtgaggagcttcccgcagtcagggtgcttgaggaatccaggcacccataa

SEQ ID NO: 24887 - DNA, 1812 bp, Methanobacterium thermoautotrophicum
gtgagtaaaaccaaaatttacattaacgggaagcttataggaacctgtgaaaaccctgaagaatttgttgaggagatgcggaaaaagaggagatccggagaagtctcccctgaaatgaacataacccattaccctgaaaaccatgagatttacatattcacagaccctggaagggccaggaggcccctgatcatagttgaggacggagaacctctcctcacagaagaacaccttgaaaagcttgaaacaggggaaatgtcatgggacgacctcatagccgctggaataatagagtacttggacgcagaggaggaggaaaacgcctacatagccatgagccctgatgaaatcaatgacgaacacacccacctcgaaatagatccctccacgatgctcggtatctgcgcaggtatcatcccctttgcaaaccacaactcatcaccgaggaacaccatggaggcggggatgaccaagcaggccctgggtctatacgcatcaaactatgacttgaggacagatacacgtgcacatctcctccaccacccccaggtccccatagtcaagacaaggataatagatgtgacaggctacgatgaaagaccatcaggtcagaacttcgttgttgcggtaatgtcctatgagggctacaacatggaggacgccctcatactcaacaaggcatcccttgagaggggccttgcaagatcatcattcttcagatcctatgaggccgccgagaggagataccccggtggtcaggaggaccgcttcgagataccagagaagggtgtcaggggctacaggtcagagagcgactacaggcacctcgatgaggacggtataataaaccctgaggcagaggtctcatccggtgacgtcctgataggtaaaacatcaccaccacgtttccttgaagagatagatgaattcgggaccgtggcagagcgaagaagggaaacatcagtaaccgtgcggcatggtgaaaagggtatagtggacgccgttctccttacagaaaccgtcgagggcagcagactcgccaagatcagggtcagagaacagaggcagcccgagctaggtgataaattcgcctcaagacacggtcagaagggggttgtcggcctcatagtatcccaggaggacatgcccttcaccgaggacggaatagtgcccgacctcatagtcaacccccacgccataccatcaaggatgtctgtgggacaggtcctcgagatgctcgcaggtaaggctgcatgcatggagggccgccgggttgatggaacacccttcacaggagaggacgaggatgacataaaggaggccctcagggccaacggatttgaaactgcaggtgttgaatcactctacaacggcataaccggtgagaggatagaggcagagatattcattggagtggcctactaccagaaactgcaccacatgacaacagacaaggtgtatgcaagatccaggggtccggtccaggtcctcacaagacagccgacagaggggagggccagggaaggaggtctcagattcggtgaaatggaaagagactgccttatcgcacatggagcagccctcgcccttaaggaaaggctccttgatgaatcagacaagtatgaggcactcgtatgtgcagactgtggtatgatagcagtctatgacaagataagggacaagaaatactgtcctatatgtgaggactcagaatcattccctgtggaagtatcatacgccttcaaattactcctcgacgaactcaagagtctctgtatcttcccgaaactcatactggaagataaggcatga

SEQ ID NO: 24888 - DNA, 1242 bp, Methanobacterium thermoautotrophicum
atggctaaagaaaaagaacacatgaacctggcgtttattggacacgtagaccacggaaaatccacactagtgggacacctgctcctgcaggccggagcaatcgccgagcagcagttagctgaaggtgaggacaagttcaggtttgtcatggacaggctctccgaggaaagggaaaggggagttacaatcgaccttgcacacgccaaattcgaaacagacaagtacgagttcacaatcgtggactgccctggacaccgtgacttcgttaaaaacatgatcacaggtgcgtcccaggcagacgcagcagtccttgttgtcgcagttgacgacggtgtaatgcctcagaccaaggaacacgtgttcctatcaaggacacttggtataaaccagctcatagtcgcaatcaacaagatggacctcgtcaactacgacgaagagaaattcaacgccctcaaggatgaggttgcagccctcatcaaaaccgtgggttacaagccaagcgacgttgaattcatcccactctccgcctttgaaggggacaacataacatcaaagagcgaaaacaccccatggtacaagggtaaaacactcgttgaagccctcgacgaccttgaagcacctgaaaaacctgtggaccttccactgaggatacctatacaggacgtctactccatcacaggtgtcggtacagttccagtgggacgtgtcgagaccggtgtcctcaagaagggtgaaaacgtcatattcgaaccagcaggtgtaagtggagaggttaaatcaatcgaaatgcaccacgaaatgatcgaacaggcagaacccggtgacaacataggtttcaacgtcaggggtgtcggtaaaaacgacatcagaaggggagacgttgcaggacaccttgacaacccaccaaaggttgccaaggagttcacagcacagatcgttgttctccagcaccctggtgtcataacagtgggttacacacctgtattccactgccacacagcacaggttgcctgtaccttccttgaactggtgcagaaaatgaaccctgccacaggtcaggtggaagaggaaaaccctgacttcctgaaaacaggtaacgctgctgttgtgaaggtcaaaccaaccaagccactggtcatcgagaagataaaggacatcccacacatgggaagattcgccataagggacatgggacagacagtggctgctggaatgtgcatagacctcgtaccagcaaaataa

SEQ ID NO: 24889 - DNA, 939 bp, Methanobacterium thermoautotrophicum
atggatcacataatcgagacagaggatataaaaaagaagtatgatgaattccttgcggttaagggggtgaacctcagggtaccggagggatccatctacggggtcctgggacccaacggggcaggtaaaacaacactgatctccatgctgtgcacaatactacgccccacagggggcaggggtaccgtcaacggctacgacatagtcagggatgcgaggaaggtccgggaatccatagggatagtcttccagtcaagggccctcgacgatatactcacagggagggagcacctggagatgcacgccgccctctacggcgtaccccgcgatgtaagggataggaggatagaggaggtacttgaactcatagccctcggggacaaggcagacgagtacgtgaagacctactccgggggtatgaagaggcgcctggagatagggcggggcctcatacaccacccaagggtgctcttcctggacgagccaaccctgggactcgacccccagacaagggagagcatatggaggtacatagagaagctcaacagggaggaggacgtcacagtgctcctgacaacccattacatggaggaggcagataagctctgcgacgaggtggccataatgagccacggtgagataataaaggccgacagtccagggaacctcaaaagggagctcggcgctgacaccataaccgtcagggttgacagggccaggggattccatgaaatccttgagaaacaggactacgtcaaggaggcatacctgatggatgatgaggttaaggtgctggttgagaggggggagaacctggtccctgagatagttaacctggcagccaggaacaactactatgtgagggcagtggaactcgaacaccccacccttgaggacgtattcataaagtacacaggcaggggaataagtgaggcgtga

SEQ ID NO: 24890 - DNA, 1707 bp, Methanobacterium thermoautotrophicum
atgaaagggataaaggtcgttgaaacagcattcagggatgcgcaccagtcacttcttgcaacacgcctccgtacccgtgacatgacacccatcgcagaggaaatggaccgggtgggtttcttctcactggaggcatggggcggtgcaaccttcgatacctgcatacgctacctgaatgaggatccatgggagaggctacgggaacttaaggaacacgtgaaaaggacgccgatacagatgctcctcaggggccagaaccttgtggggtacaagcactaccccgatgacatagtgaggaagttcattgagaagtcctatgaaaacggcgttgatgtcttcaggatattcgacgccctcaatgacataaggaacatggagtacgccataaaggtcgccagggaacaggaagcccatgtgcagggagtcatctgctacaccatcagcccttatcacacccttgagagttatgtggactttgcaagggaactggaggcccttgaatgtgactccgttgcaataaaggacatggcaggcctaatatctccacatgatgcctacgaactcgtgagggccctcaaggaagagaccgacctcatggtgaaccttcactgccactgcacaagtggaatgacacccatgagctactatgccgcctgtgaggccggcgttgatatacttgataccgccatatcacccctatcctggggtgcctcccagccacccacagagagcattgtggctgcactccgggacacaccctacgacacgggccttgaccttgagatcctgaagaacatcaagaagtacttcgaggagatccggaagaagtacagcagcatcctcgaccccatagccgagcagatcgacacagacgtcctcatataccagatacccgggggtatgctgtcaaaccttgttgcgcagctcaaggagcagaacgccctggaccgctatgaggaggtcctcgaggagatgccccgggtgaggaaggatatgggttaccctccccttgtaaccccaaccagtcagatagtcggtatacaggccgttatgaacgtcctgagcggtgagaggtacagcatggtcaccaatgaggtgaaggactacttccggggactctacggcagaccccctgccccattaaatgaggaggtcgcaaggaaggtcatcggagatgagaaacccatcgactgcagaccagcggacatcctcaaaccccagtatgatgagtgcaggaggaagggtgaggagatgggcataatagagaaggaggaggacatactgaccctcgccctctaccctgccattgcacctaaattcctgaggggtgaaatcgaggaggagcccctggagcccccggcagaggagatggccccgacaggtgaggtgccaaccgtcttccacgtggaggtcgatggtgacgagttcgaggtcaaggtggtccccacaggctacatgaccatcgaggaagctgaacccgaaccggtggatgttgagggtgcagttaagtccaccatgcagggcatggttgtgaagctcaaggtcagtgagggcgaccaggtgaatgccggggacgttgtcgcggttgttgaagccatgaagatggagaacgatatccagacaccccacggtggtgttgttgagaagatatacaccgctgagggtgaaaaggttgagaccggcgacataatcatggtcataaaataa

SEQ ID NO: 24891 - DNA, 2055 bp, Methanobacterium thermoautotrophicum
ttgacaggggcgaggaactggttaaataaacctctaatttttttcaaattcaataatcatcacacagctagtccaggggataaaatggttaagtatgtggcgttttttgaggaactcggtaaggatgatgtgggaatagccggtggaaagggggccaacctgggtgaactgacacaggcaggcatacccgtccccccgggttttgttgtaacagcggcgacctatgacaagttcatgacagacaccggactgcagccggtggtcatggagatgcttgaaaaccttgatgtcaacgatacaaaggaactccagagggtttcagccgagataaaggacataataacatcaactgaggtaccggaggacatacagaccctcataatagagtcctacaatgcactatgtcagaggataggaaaggatgatgtttacgtagccatacgttcctcagccacggcagaggacctccccgaagcatcctttgcgggtcagcaggacaccttcctgaacatcaggggcgccgaggatgtcctggattatgtaaggaggtgctgggcatccctctttgaggccagggccatattctacagggaggagaacaacttcgaccactcaaaggtttacatagcagtcgttgtccaggagatggtggacgccgagaaggcaggggtcatgttcacggtccacccatcaacaggtgaggacaggatactaatagaggggtcatggggccttggtgaggccgttgtatcaggctcagtcacccctgacacctactgggttgataagggaacagggaagctccttgaatttactgttggtgagaagaacataatgttcacccgggaggatggcagaaccgtgaagaaggaggtcccccctgaactccggaacaaacgtgttctctctgacggggagatcgcggcccttgcagagatgggcaggaggatacaggaccactacggctcaccacaggacacagaatgggccataatggatggtgacgtttacatgctccagtcaagacccataacaaccctgggagaggcaaccgaggagacagaggtcaaatccagggagatactggttaagggcctcggtgcaagcccgggccttgcctcaggtagggtcaagataatcagggagatccatgaacttgacaagatacagatcggagatattctcgtcacggtcatgacaacccccgacatggtgccagccatgaagagggccagcggcataataaccgatgagggtggtgtcacatgccatgcagccatagtgtcccgtgaacttggaataccctgcgttgttggtaccgggaacgcaactgaggtcctcaaggagaaccaggtcgtcagcatagacggtaacaggggactcgtctatgagggcagtgtaattgagggggagaagaaggaggctgaggccgagaccgtcaccgtggagtcaccccttctgacagtcacagaggtcaaggtcaacgtcagcatgccagaggctgcaaggaaggccgccgccacaggggccgacggggttggacttttaaggacagagcacatgatgttaaccacgggcgtgcaccccaggaagttcattgaggagggcagggaggacgaactcgtcaatacccttgcagagaacatccttaaggttgcagatgagttctatccacgccccgtatggtacaggaccctggatgcgcccacagacgaattcaaaacccttgagggcggtgaaaatgagccctacgagcacaacccgatgcttggatggaggggtatacgcagggaactcgatgaacccgagatcctgagggccgagttccgggcgataaagaaactccatgagcagggttacactaacataggcataatgataccactggtccagcaccctgatgaactcagaaaggccaagatgatcgctgaggaggctggccttaaaccccacagggacgttgaattcggtataatggtcgaaacacctgcagcggccctgataatcgaggacttcatagaggagggaattgactttgtgagattggaaccatga

SEQ ID NO: 24892 - DNA, 633 bp, Methanobacterium thermoautotrophicum
atgaacgataaaaacacgctgaaaggcaccacaactgttggcataacatgcaaggatggagttgtttttgccacagagagaagggccagtatgggcaacctcatagcccataaggctacagacaagatttttaaaatagatgaacacatagccgcgaccattgcaggttcagtggcggatgcccagagcctcatgaagtacctcaaggctgaggctgcactttaccgcatgagaaactcagaaaagataagcatagaggccgctgctgcactcgcagctaatatactacactcatcacgtttctatccattcatagtacagacactccttggaggcgtcgacgagaacggtgcaaagatctactcccttgacccgtcaggggggatgataccagacaagttcgtctcaacgggttccggttcaccggttgcctacggggtccttgaggacagatacagtgatgaactgtacgtggacgaggcagtggatgtggccataagggccataaaatccgccatggagagggacacctactcaggtaacggaatccttgtggcgaccgtcacagaggaggaaggtttcaggatgcttagtgaagaggaaatccagaaaaggattgaaaacctcaactga

SEQ ID NO: 24893 - DNA, 1026 bp, Methanobacterium thermoautotrophicum
atgaggataagccctgaagaggaagttaaaatcataaaggaaatactcaccgccatgaatgttccggaggagagctcagatatagttgcagacgtcacactggacgctgacctgaagggattcagctcacatggaatcggcaggttcccccagtacgttgatgggttgaggcatggaacaataagggcagatggtgacataaccattgagcgggaaaccgagtcaacggccctcataaatggtaaccacatattcggacacgttgttgcctacagggccatggagcttgccattgagaaggccaggaatacgggtgttggccttgtcggtgtccatgactccaaccatttcggggtcgccggctactactctgatatggccgtcatgaatgacatgataggtgttgttatagcaaacaccgagccggccgtcgcacccatcgggggcaggaaacccatccttggaacaaacccggtggccattggcatcccatcaaacaggtactacgtctccgtggacatggcaacctctgcatcggccaggggaaaactcctggaggccgccaggaaaggcgagagcatacctgaaaatgtggccctggatgcagagggtaaacccaccaccgaccctgaaatggcccttaagggctccatcctccccttcggtggacacaagggatacgccctctcattcatgatagagatacttgcagggcccctcgttggtgctgccttcggaaccgctgtcacgggaacagcgaaccctgaggagatgtgcaccaagggagacctcatgatggccatcgacccatcaaagatggttgaccccgatgagttcagggcccaggttgatgaattcattgaggaggttaaatcaagcggtgacgtcctcatacccggggacattgagagcatgaacataaagagaaggcgtgctgagggtatcgaactggatgaaaagctccttgagaggattcttggaatagccagagaacttgatataaatctcgaaattaaggagttatga

SEQ ID NO: 24894 - DNA, 912 bp, Methanobacterium thermoautotrophicum
gtgtttttcatgcttgagaccagcatatgtaatattgaactccggaacccgaccatactggctgcaggggtcatgggtagcatggcatcgtcccttaacaggatttaccgtgggggtgcaggggctgttgtgaccaagtccttctcactcaggcccaacccgggatacagaaatcccacaaccgtggaggtcacaggcggggtcataaacgcaattggactctcaaacccaggtgttgaggcattcagggaggagctgaagctggtggatgaggaggtacctctgatagcatcagtctatggagcctcacccgaggaatttgcctcagcagcggcttcagtggaggaatacgctgacatgattgaactgaacgtctcctgcccccacgccatggcaggatgcggagcctcaatcggacaggaccctgaactgaccttcagggttgtttctgctgttaaggatgcagtggacgtcccgatatccacgaagctcacaccaaacgtcacagacatcgttgagatagcagggagcgctgaggaggctggttcagacgcccttaccctcataaactcccttggccccgggatgaagatcgatataaagaccgcaaggcccatactctccaatgccttcggaggcatgtcaggcccggcaataaaacccgtcgcggtcagatgcgtctatgacgtttaccgcagcgtggatatccccataatgggtgtgggaggtgtcagggacttccaggatgcagtcgagttcctctttgcaggtgcaagggctgttcaggttggaacagccataatgtatgatggccccgaggttttcatgaagatatgcaggggccttgaggccttcatgatggccgaaggattctcatcggtggatgagatggtggggctggcacatgattag

SEQ ID NO: 24895 - DNA, 1272 bp, Methanobacterium thermoautotrophicum
gtgaacattggactcataggatttggaacaataggggcaggtgtggtggaaatattcaacaccaaccctgatatcataatgaaaaagacagggatggagctcaggctcaggagggtggttgaccttgacattgaaaccgaccgtggcgttgaaatagatccggggatcctgtcaaccgacgcagatgacattctcgaggatcctgaaatagacatcgtcatagaactcataggtggctatgaaccggcgcgtagcttcatcctgaaggccatagaaaatggtaaacatgttgtaacagccaacaaggcactccttgcaaggcactgggatgagataatggatgctgccagggagcatggcgtgagggttgcatttgaggccagtgttggtggtggtatacccgtcctcagggccctcaacgagtccctcgcagccaacagaatagaatccatatatggaataataaacggtaccgccaattacatactgaccaggatggcctcagagggcatggaatttgatgatgttctgcgggaggcccagaggctcggatatgctgaaagggatcccaccttcgacatagagggccatgacaccgcacagaagctaataatactcacactgcttggttttggtgtccatgtaccggaggatgaactccatgttgagggtataagcagtataaggagggatgacattgaatatgccactgcagagcttggatgcagtgtgaagctccttgcaacagccaggctcaatgatggtgaactggagctgggtgttacaccaacccttgtaccacaccatcacctcctctcctctgtgaacggtgtcttcaacgggatatacatcacaggggacttcacagggccagtcatgttctatgggaagggtgcaggcaggagggccactgcaagtgcagttgtcgcagactgcatggatattgcagttaaccctgagggatcaatgcccacaggtccgggcatcagggttgttgagtcagtgcgggacttctccaggacatcctcaaggtactacataaggcttgatgccgtagacagggcaggggtgctccatgaaatagccggagccttcagcaggcacggtataagtatagaatcagtgacccagaagggcgcccatgagggtgaaactgtgccgatctacatcgtaacccatgaggcaagtgagggggccatccagggggccctctctgagatatcagagatcaggtgggtgaggggtgaacccctgcgcctccggatactctga

SEQ ID NO: 24896 - DNA, 1200 bp, Methanobacterium thermoautotrophicum
ttgaaggtgattgctgtggataaagtggttcttgctttcagtggaggccttgacacatcagtatgtatcaaactcctcgaggaaaagtataacatggaggtaataacggcctgtgtggatgttggtcagccgcgggatgaaattgaaagaccggccatggttgccaaggaactcggaaactacagacactacacagtagatgcaaggcgggagttcgcagaggactacatatttccagccataaaggccaatgcggtttacgagggttaccccctcagcaccgcccttgcaaggcccttgatagctaaaaagatagttgaagtggccgagaaggagggtgcatctgccatagcccatggatgcaccggtaagggtaacgaccagttccgtttcgaggccgttataaggtcaacgacggacctggatgtcatcgcccccataagggacctcaacctcacaaggacagaggagatggagtacgccaggtcctgtgggataccgctcccctcagacaagctctacagtatcgatgagaacctctggggacgtgcaatagagggggacatccttgaagaccccatggttgagccccctgaggatgcctttgaatggacaaagcccatccacgagacccctgaggatcctgaggtcattgaaatcggtttccacggcggggtcccggttgcattgaatggtgaggaactggagccagttgaactcataggccttgcaaatgaggtggcaggaaaacacggtatcggtagggttgacataatggaggaccgtataataggtatgaaaagccgcgaaatctatgagacacctgcagccttcctgctcctggaggcccacaggggcctggagcagctcacactcacaaggagtgagctcaggtttgctgacataataagcagcacctatgctgaactggtgtacagtgggctgtggcatgaccccctccgtgaggaccttgacatggcagtaaaccacatgcagaggcgtgtcaccggtacagtcagggttaaactccacaggggcagcatgcgcgtcattggaagggagtcaccctacagcctgtacagtgaggagatagtttcatttgaggataaaaccctcgatcagagggagatggccgggatggtcaaaaactatgccctccaggctgcgatatacagcagggtgtgcaggaaggagaactga

SEQ ID NO: 24897 - DNA, 291 bp, Methanobacterium thermoautotrophicum
atggtagatgagggaattttaagggaagtataccgtgtgcttgaggatcggagggacagacccattgattcatacacttcacgcctcatgagggatgatgataaaatggcagaggataagatccttgagaaaataggggaggaggccgcagaggtcataatagcatcaaagaatgatgagaacctcgtggaggaggcagccgacctcatattccacactctgctcctgctggtatacaagggcgtgccccttgacagcctcctggaggagtttgctgcaagaagaaaatag

SEQ ID NO: 24898 - DNA, 1791 bp, Methanobacterium thermoautotrophicum
atggcaaagaaagaaaaaattctcggtattgaccttggaacaagtaactctgcagccgcagttctcataggcggtaaaccaaccatcatacccagtgcagagggtgcatcacagtacggtaaatcattcccaagctgcgtggcattcacagaggacggacagatgctggtgggtgaacctgcaaggcgccaggcagtcacaaacccagagaacaccataacagccataaaaaggagtatgggtacagacaggaaggttaaggtccatggcaaggagtacacaccacaggagatctcagcattcatcctccagaagatcaaaaaggatgccgaggccttcctgggagaggagataaagaaggcagtgatcactgtacctgcctactttgacgacaaccagaggacagccacaaaggacgccgggaccatcgccggtcttgacgttgtgaggctcgtcaacgagccaacagccgcaagccttgcctacgggcttgacaaggaagacgaggacatggtcataatggtcttcgacctcggtggaggtacactggacgttacaataatggagttcggtggaggggtcttcgaggtcagatcaaccagtggtgacacccagctcggtggaaccgacatggacaatgcgataatgaactaccttgccgaagaattcaaaatggagaccggtatagacctcatggaggacgaccaggcggtccagaggttgagggaggccgctgagaaggccaagatagagctatcaacaaccctgacaaccgaggtgaacctcccatacatcacagtggcccaggatggaccaaaacacctcataaagacaataacaagggccaaactggaggaactcgttgaccccatagtccagaaatgtgcaggacccatggaacaggcactcagggacgccgggatgaccagggaggacgttgacaagataatacttgtcggcggacccacaaggatgcccatcgtccagaaattcgttgaggacttcataggaaaacccgtcgagaggggaatagaccccatggagtgcgttgccatgggtgcagccatacagggaggtgtccttgccggtgagataaaggacctggtacttctcgatgtaacaccactatcactgggtatagagaccctcggaggggtcttcaccaagctaatagaaaggaacaccaccatacccaccaggaagagccagatattctcaactgcagcggacaaccagacatcagtggatatccacgtcctccagggtgagaggccaatggccgcagacaacacaagccttggaagattccagctcgtgggcataccaccagcgccccgtggagtgccccagattgaggtgaccttcgacattgacgcaaacggtatactgaatgtatcagcaaaggaccttggaacgggtaaggaacaggccataacaataacagctccaaacaagctctccgaggaggagataaaacagaagatagaggaggccaagaaacacgcagaggaggacaggcggaaacaggaggaaatcgaaataaggaacaacgcagattcaatgatctacactgcagaaaagaccctggatgaactcggagacaaagtgccagccgagaagaaggaagaggttgagaaacaggtcagggaactcagggaactcatagcaggagacgacatccaggcaataaaatcaaagacagaggagctcacaaagactgtccaggagatcggagtcagttatataccagcaggcagcacagcaacaagcagcacagcagcaggcaggtag

SEQ ID NO: 24899 - DNA, 1131 bp, Methanobacterium thermoautotrophicum
atggctaaacgtgactactatgagatcctcggtgtagataggggtgcggataagaaggagataaagaaggcctacaggaggctcgccagaaagtatcaccctgacgtcagtgatgaccctgatgcagctgaaaagttcaaggaaataagcgaagcctacgcagtcctctctgatgatgagaagagggcgaggtacgaccgcttcggccatgctggtatggatggcttcagtcaggaggatatattcaacaacataaactttgaggacatcttcagcggcctgggatttgacattggaaacatatttgacatgttcggatttggtgggggaagaaggcacgggccacagaggggcgctgatataagctacaccctggatataagccttgaagatgcctacaatggtcttgaaaccgatataagggttccacatacaaagaagtgtccggtgtgccatggcagcagggctgagccaggcaccggtacaaggacctgccagacctgcggtggcagcggacaggtgcggcaggtgaggaacaccatcctggggcagatgatgaacataacaacgtgccccgactgtcagggcgagggtacagtagtcgagaaaccctgcagtaactgtaacggtaaaggcgttgtcaggaagaccagcaccatccatgtgaaggtccctgcaggtgttgagacaggatcccggctcagggtccccggtgagggggagatgggtcttcgtggtggagaaccaggggatctctacgtggttatcaaggtcaagccccacagcattttcaggagggagggcgccaacctgtacaccgagaagcccataagcttcgtccaggcagccctgggtgacaccgtcgaggttccgacccttgacaggccagtgaaactgaggatacccgcagggacccagagcggtacaaccttccgtgttaagggtcacgggatgccccatctcaagtggaacggctacgggaacctctacgtaaaggtcaaggttgtgacaccaagaaagctgagccccaggcagaaggaactcctcagggaatttgcaagtatcagtggggatgagatccacgaggataagggcttcttcgataaggtgaaggatgccataatccactga

SEQ ID NO: 24900 - DNA, 735 bp, Methanobacterium thermoautotrophicum
atgttcaaggcagaattgaatgaccctaacattttaaggacgagcttcgatgccatatcatccatcgttgacgaggttcagatacagcttagcgccgaaggcctgcgcctggacgcccttgacaggtcccacatcacatacgtgcacctcgaactgaaggccgagcttttcgatgagtacgtctgtgatgaaccagagaggatcaacgtggacacagaggaactcatgaaggtcctcaagagggcaaaggcaaatgacagggtcatactctcaaccgacgagggaaacctgataatccagtttgaaggggaagcagtaaggacattcaagataaggcttatcgacatcgaatatgaaaccccaagtcctcctgaaattgagtatgagaatgagttcgaggtgccattccagctcctcaaggactcaatagctgacatagacatattctcagataagataaccttccgtgtagatgaggaccgtttcatagcctcagctgagggagaatttggagacgcccagattgaatacctccacggcgaaaggatagataaacctgcaaggagcatatactcccttgataagatcaaggagatgctcaaggcagacaagttcagtgagacagcaataatcaacctgggagatgacatgcccctcaaactgaccctgaagatggcaagcaaagagggtgaactcagcttcctccttgctccaagaatagaggcagaggaataa

SEQ ID NO: 24901 - DNA, 411 bp, Methanobacterium thermoautotrophicum
atgaccttcagtcacaatcaaaattattataaatgtccttgtagaaaaactttagaaatcaaaaaggtttcagtttctctgaccaggaggaagaagatggagttttgtcctaagtgcggagctgtaatgtttccatccgagggaaaatttaagtgtcagtgtggctatgagaaggatatcacagataagctcaaagacaagtaccgcgtctcagaggaagttgaggcaaaggagaccataatattcacaggtgatgatgtaaataccctcccaacaacgagggttgaatgcccgaaatgtggtaacatggaggccttctggtggctgcagcagacaaggagggctgatgaatcagagacacggttcttcagatgtacccgctgcaagcacacctggagggaatatgactga

SEQ ID NO: 24902 - DNA, 591 bp, Methanobacterium thermoautotrophicum
gtgatcgaaatgcttgataaactcaaggaaagcctcagaaattcacctgtgattaagaagggagagtatgactactttgtaaaccctgtaaccgatggcatacccctcaccgaacccgaactcctggaggaggttgcagaggagatagtgaggaggttcagacctgaagcggataagataatctgcatagaggccatgggcatacaccatgcaacggttctatcactgaagactggaatacccttcgtcgtggtgaggaagagaaggtacggccttcccggcgaggttgccgtccatcagatgacaggatacagtgaaggggaactctacataaatggtgttgatagtggagacagggtcgttgtcattgacgacgttgtgagcactggggggaccctcctggcggtcctggaggccctcagggagatggatgttgatgtcagggatgttataacagtcatagataagggtgagggatccagggtcgtgagggaaaggacaggtttcactgtgaagagcctcgtgaaggttgatgttatcgatggcagagttaaggttgaggatatccctgccggggggccgcatgattaa

SEQ ID NO: 24903 - DNA, 870 bp, Methanobacterium thermoautotrophicum
atgacgaggatgatactcttttccaagatgcatgggcttggaaacgactatgtggttatagatgagagcgcccaggagtgcatacctgaggataagaagccagagtttgtaagggaggtatgcaccaggggattctctgtgggtgcggatggtgttatatttgtccagcctgcatccggcgaaggggatatccgcttcaggatattcaatgctgatggaagcgaggcagagatgtgcggaaacggtataaggtgcttctcaaagtttgtatatgacaatgccatagtgaggaagaggagactggaggtggaaaccctcgcaggtatcaagaccgtggaactggaggtcgaggatggtgcagtggtctcatcaagggttgatatgggcaccgcaacattcaaaacagaccagatacccatggatgttgaggaatacgagttcatagacaggttcctgcctgtggagggtgaggacattaagctcacagcactaagcgtcgggaatccacacgccataatattcgttgatgatgcggagggcgtggaccttgacaggcttggaccggcaatagagaaccatcccctctttcctgagaggataaatgtccactttgttgaggtcgtgagcccctctgagataatcatggtgacctgggagaggggtgctggacccacaatggcctgcggcaccggggccacagccagtgtaattgcgggtgttaaacttgaaaaactggatgacagtgtcctggtgcaccttccaggaggggaacttaaaatagacgtctaccaggacggcacagaactaggggcctacatggagggcgatgccgtcatggtatttgatggtatactgctccgtgatccataa

SEQ ID NO: 24904 - DNA, 1287 bp, Methanobacterium thermoautotrophicum
atgtttcctgatattgaggttaacgataaaggacatcttctgattggcggtgcagatgcagtggaactggcagatgaatacggcaccccactctatgtcatcgatgagatgaggataagggagaactaccggaggctctacagggcattctcaggtgaatactcgcggttccaggtattctatgcatgcaaggccaacaccaaccttgcggtcatgaggatactggaggaggaggggagcggaattgacgctgtatctcctggagagatctacacagctctcatggcaggctttgaccctgacaggatactttacaccggtaacaacgtcagggacgatgaactgcagtttgccctagattcaggtgtcaggatcaatgtggattcaaggtcacagctcctgcggctttcagagatcgcccctgagggtctcaggatatccttcagggtgaaccccctggtgggggcagggcaccatgagcactgcatcaccggcggagagatgagcaagttcggtgtaatggagagagaggcacctgaggtctacaggatggccatggaccttggatttgagccagtggggatacacgcccacataggctcaggtatactggaccctgagccattcatgctggccgttgaaaccctgatggacatagccggcagggttcatgaggccacaggggttgaatttgagttcatagactttggaggcggacttggaataccatacacgcctgaagaggaaccactggacattgatgaattcgcatcaaagataacaggactcttcaaggataaactctcagagtacggtcttggaagacccatgatgtgcctggagcctggaaggtacatagttggggatgcatcctacctcctcacaagggtcaacaccataaaggagagctacagaaaatttgcaggtgttgacgcaggcttcaacaccctcctgagacctgccatgtatggatcctaccaccacatactcgtggctgaaagacccctggatgaaccatctgagaagatggatgtggctggaaacgtgtgtgaatcaggggatctctttgcaagggacaggcagctccctgaaattaatgagggcgatgtccttgccatcatgaacgcaggggcctactccttctcaatgtcctcccagtacaactccaggccaagacccgctgaggtccttgtgagggaaggcaaggttgatgttgtcagggagagggagaccttctctgacctcctgaggggacagaatgtacctgcaagacttctgaagaggtag

SEQ ID NO: 24905 - DNA, 1173 bp, Methanobacterium thermoautotrophicum
atggattcagaggaaataattgaacttgaaaggaaattcatcatgcagacctatacccggcagcccattgtactgtcccatgggaagggggcaactgtatgggacattgagggcaactcctacatagactgctttgcaggggtcgctgttaacagcatcggccacgcccacccaaaggtcgccctggcaatctgtcaccaggcacagaggctcatacattcatccaacatctactatacccgggagcaggttgaactcgcaaagcttctaacggccatatccccacacgacagggttttctttgcaaacagcggtgcagaggccaatgagggagccataaaacttgcaaggaaattcacgggcaaatctgagataatagctgctgagaactccttccacgggaggacacttgcaacggtaactgcgactggccagaagaagtacagtgaacccttcaggccactaccagagggttttaaacatgtcccctacggcgacatcggggcaatggcggatgcagtaggtgatgaaactgcagccataattctggaaccggtacagggggagggtggagtcataattccaccagagggatacttgaaggatgtccaggaacttgcaaggcagaatgacgtgctactgatcctcgatgaggtccagacaggatttggaagaaccggagcaatgttcgcatcccagctattcggtgtagagccagatataactaccgtggcaaaggccatgggcggcgggtatccaataggagctgtgcttgcaaatgagagggttgcaatggcatttgaaccgggtgaccatggatccaccttcgggggaaacccctggggatgtgctgcagccatagccaccatcgaagttctgatggacgagaagctacctgagagggcagctaagatgggttcctacttccttggaaggctgaggcaggtcctccatggatgtgatgccgtcagggacatacgcggtgtcggcctcatgatcggaattgagatcgatggtgaatgtgcaggggtggttgacgctgcaagggagatgggggtgctgataaactgcacagccggcaaggtcataaggattgtcccgcccctggtaataaagaaggaggagattgatgcggctgtggatgtactgggtcatgtgatctcagacctctga

SEQ ID NO: 24906 - DNA, 939 bp, Methanobacterium thermoautotrophicum
atgaggatacccgtgggggactttgaccttgagatgacccagaggagtggacagacctcccagccaccctggagggaggttgagggggccttcagggaacttctcatcatcgagggggtaccctgtccggttgaggtcaggaatgaggcaggggtgctcagggtcagaccctacgtggatgtacctcagaaaactctcagggagaagattgaatacatattcgacctgaaatttgatattgaagatttctacacattcctggaggataaaaacttatcatacaccctggattcatcgagggggctgcggctgttccttgcaaaggacccatttgagtgtgtgatatcctcaatagcatcagccaactgttcggttgtgagatggacaaggtccatagaggacataaggaggctctggggccaggccaacaccttcaatggcgagaccttccacacgttcccctctccacacgtcctgacaggcgtggctgagggctcccttgaggacctgcagagggccgaggataacctcccctcggacttcagtttcaatgacctcagatcctgtggcgtcggctacagggcgccctacatccgggagacatcgaggatactcgcagaggagatggatatcaggaggatcgatgggatggactatgacgatgcaagggagctcctccttgaactctcgggtgtgggtcccaaggttgctgactgcatactcctctatggtttcaggaagacagaggcctttcctgttgatgtatggatcaggaggatcatgaaccacatccaccctggcaggaatttcaatgacaggtcgatggtggaattcgcacggagggagtacggggagatggccgactatgtgcagctttacctcttcaaccatgccagaagatcggggctacttgataggctcaggcagggcactggataa

SEQ ID NO: 24907 - DNA, 906 bp, Methanobacterium thermoautotrophicum
atgtcttccgggttatttcaaatgagaaggaatatgttttatgtagattcagacacctcagagttgttgatggcgattgaaatgcttgcaaagaggataataccatgtcttgactgtgacctccaggttccaaatggccgggtcgtgaagggagttgaattcaaacagataagatacgcaggggaccctgtagaacttgcaacaaggtactatgaggatggtgccgatgagatagtcttcctcgacataacagcatcacatgagagacgggagaccatgacccatgtgatagaggccaccacagagaacgtcttcgtacccatatgtgtcggtgggggtataaggaagccagaggactattttaagatgcttaaggcgggggcagacaagtgctccaccaatacggccgcaataaagaaccctgaactcatcaatgaggcatcagacctcgtcgggtcccaggcatgcgtagtggcaatagatgccaagaggagatacatcgaaaacccccgtgaatcagatgaaaggttcataatagaggttgatgatggatactgctggtacgagtgcagcatctatggtggaagagaattcacaggtattgacgcggtgaaatgggcaatggaatgccaggatagaggtgcaggtgaaattctcctcacatcaatggaccgtgacggtacaaagatgggctacgacattcccctcacaaggaccatgagcgagaaccttgacatacctgtgatcgcatcagggggtgtaggggaacctgaacacatctatgaggcattcacagatggtaaggcagacgctgcacttgctgcaagcatattccacttcaatgaataccctgtccctgcagtgaaggagtacctcagatcaaggggagttcccataagattgtag

SEQ ID NO: 24908 - DNA, 3990 bp, Methanobacterium thermoautotrophicum
ttgaggacatcagttattccagtgattctactcatgacaatcatgcttgcgggaggtgtttcagcggctgataacagcagcaacgtcacagagggtgcgattcagcagaattcttcccattacagtattctcataatcacagggtcaacttcgagtacaaaggcaatagtggaaggctataaacttgcaggacgggacggctacagattcaatctttcaatgttcacaaacgatgaacttctaaggaacgatcctcagatagacatggcggcactggaggcgggtagaaaggctgacgtgattctcattcagatgataagttctccaaacaccctggcgaaggtcaatccaatccttaatgttacgggggccagcaaaataattgccataggaaccggcaacacattcaaggatgatccccgtgtgggtgcggacaacgcaacagtgaagtacatctgggatcagggaggccccgagaacttccggagaatgatgctcctccttctgagggatgctggaatgcagctaaaaaatgaggagaatgtaacagccattcccgcggtgaaatcatttgtatatcaccccgacgccggcgaacagttcacagcatgggaccgttactactcctggtatgttcagagcggccactacagggcaggaaaaccatgggtgggcataatcacattcgatacatactaccgtggaagcgacatgagaatgcacaccgccatacttgagagccttgagagaaagggttacaatgtgatccttggctttgcagctgacacagctacaaagcggaaccttattgagaacttcttcctggatggtaacaggactcccaggatcagcggtctcataacatgcatgggcttcaatttatacagcggtgatcccctgaactccacagcaatcctcacggaacttgatttacccgcaattgctgcggtctatgcatcaaatctcagggcatggaacgagagcatatcaggactttcatctgaggtgtactggcagatagcacttccagagatcgacggaaggatagagccagtcatgatcggcggcggagttgaggagacagaccctcagacagggctgcgttatacatactatgttccgattcctgaaaggatagagaggctcacagagagattgatcaactggataaagttaagggaacttccaaatgcggagaagaagatagcccttatatactacaacattggtgggggtaaggatggtatcagtgcgagttacctcaacgtaccagagagcatcagcaacatactgagggcgctaaggagtgctggctacaatgttgaggaaaaatccactgcagaggtgataaacatactcctcgggccgggcctgaatgtgggttcatgggctccgggtgaacttgagaaggttgtcagggccggcgcagtaacagttccagtatctgaataccttaactggttcagtctactgccagaaaccctgagaaataacataacagcgacatggggacctgcccctggaaacgtcatggtctacaatggcagcatagtgatcccgggtgttatgcttggcaacgtattcctcggcccccagccaatgcgcggattcggcgaggatgcagctgacctcatacattcaacaacactcccaccgcaccaccagtaccttgcattctatctctggcttcagaaaaacttcaacgcagttatacatcttggtacacacggaaccctcgaatggttaccagggaaatcagttggtctatcatcccttgactggcccgacgtgatgataggtgacctgccacatatctacccctacatcgtaaacaacccgggtgaggggactcaggcaaagaggcgtgggtacgcggtcctcataaaccataacatcccccctatggtggtaagtgaactttacggggatctatctgaacttgaacacaaaattaacctttaccatacgtctgaggatccccagagaaagctgataatcgctgaggaaatcagaaatctcacggttaaactggaccttcacagggaacttaacattgacctcaatgcttcctttgaagaggcccttgatcgaattgagcacaggcttgatgagctatcagcaacactgataccctacgggttacatgtcttcggggaaccccttagcggggagctccttgatgcaatggtggaggcaattgtgagctttgacccagcatcgaggaataacacagagttccggaatgccgtaagagagaaacttgccactgaccaggagatcacaaaccttctgagggcccttgagggacgttttgttgaaccgggtcggggggctgatcccataaggatacccgacctcctgccgacgggaaggaattcctattcctttgaccccagacttgcacctgatagggctgcatgggagatcggtaagaagatggcagatgacctcattgcagattacctttcaaggaatggcagatatcccgaatctgttggggtggttctctgggcaattgagaccatgaggaccagtggtcagacaatagcaatggttctgagactcatcggagctgaaccggtatgggataaatcaggaagattcacaggaataagtgtaacacccctggaagtgcttggaaggcccagaatcgatgttctggtcactatcagtggactgttcagagacacatttgcctacagtatcgacaggatggatgaggcgataaggcttgtcatgaaactggatgaaccggtggaaggcaactacctcaggaaacattaccttgcagacctggcgaattatactgccaggggtttacaggcagcggagacacttgccggtgcaaggatatttggcagtgcccctggaagttacggtaccgggctacctgaagtggttgaatcaactgcaaagtgggataatcagtcacagctccttgaaacctacctgaatcatatgggattcatctatggaaaggacatatacgccattgatgcaaaggaggtcttcatgaagcagctatcaaatgtggatgcaacagtacaggtcagggacagtgtttacggtgttcttgacaacgacgacgtttaccagtaccttgggggtctcacgatggctgcaaggaccatttcaggaaggaatgttgcctcatacatcgccaatacaaggttcacaccacgaatggagacactggcagatttcattgcagcagaactcagaacaaggacctacaacccgaaatggattgagggaatgctgaatcagggattctcaggtgctcatcagatatccaaggagataggacatctattcggctggagtgcagtcacccctgatctggtccaggactggatgtggcagaaggttgcagagacctatgtctttgatcctcaggtaagcagcagatttaagagtcttcagccctactcctatgcctcaacggtagcctggctccttgaggccagccgcaggggcctctggagcacagattcagctacactgcagaggcttgccgatgagtacatcgcggcggttaatgagtatggtgttgtctgctgtcaccacacatgtgccaacatggtcttcaacagctgggtggtgaagctatcatccctcaaccaggcggccctcagaaaatttgcggctgcaatggctgcagccacagggaagtccattgatgttcctggctctggggattcacagccgggctcagtgaatggggatggaatcggtgagacaggtgaaccttcttcaggttccgcagggaatgcaggcggagcatcaggttcatcgtcagatgaggctttagagtcatcagaggtttcagaaaactctggagcttctgaaggttctggaaaggcctatgaggttgcagcatcaaccaacagcacctcttcaagcactcagactcccatatatgctataattggtgttataagccttgtgtgtctccttggagtgggttacttcttccagggaagatactga

SEQ ID NO: 24909 - DNA, 960 bp, Methanobacterium thermoautotrophicum
atggatgaacatgatatctctacgagggacccatgtggtccgggaggctccatgatagaggttgaatctgtgagtaaaagttttgggaggatcagggcccttgataacctgagcttcagtgtggctgagggtgagctcatgggtatcatcggccacaacggggccggtaagaccacggccatacgtataatagctggcatacttcaccctgactccgggaccgtcagggtggggggccatgacgtcacagaggaccccctcagtgtcaagtccatgataggttaccttccagaggagcccaacctctacgagcgcttcagggcaggggacctcctccgatactttggtgaactctacggtgtccccagggatgtgcttgatgacaggatagctgagctccttgaactggttggtatgaccgatagggccatggaccccatcaacaccttctccaagggcctcaggcagaggataggtatagccagggccctgatacatgacccccccatcataatattcgatgaaccaaccatgggacttgatcctgcaaccgcattctcaataagggagttcataagggacctgaagggatcaaagaccatgatactatgcacccactacatggaggaggctgagtacctctgtgaccgggttgcaataataaaccagggccggatactggatattggaacacctgatgaactgaaatcaaagatccggggggacctggtccttgaggtgaaggtgagggacatttcctctgtaggtgagggcgatctcatgatgatccctggtgtaaaatccgttgaagttgatggcagcacactcagggtgtcccttgaaaaccggggagccatatcgggtgttataatggaactcggggccaacgtatcaggggttaacacccgggaggccacactaaacgatgtttttatagagagcctcagggggtcaggatga

SEQ ID NO: 24910 - DNA, 936 bp, Methanobacterium thermoautotrophicum
atggttgaactggaagatctaccaaatgtaggggctaaaacagcacagaaattaagggacgcaggtttcggtgacatgatgcgtcttgcaacagccacagccaaggaactctctgtgaaggcagagattggtgagggcgtggctgaaaaggtgatagaggctgccagaagggctgagaagatagactttgaaacagccttcgatgtcatggagagacggaaggatgtggggaggatcacaacggggagcaaggccctcgatgaactgataggtggcggaatcgagacacaggcaataaccgaggttttcggagaattcgggtcaggtaagagtcagctgtcccatgaacttgcagtcacggttcagctgccagaggagaggggaggactggatgctgaggctgttttcatagacacagagaacacattccgtcctgagaggattgagcagatagcaaatgcctttgaacttgaccttgaggaggttctgaataagatacacattgcaagggccttcaattccagccaccagatcctcatggcagagaaggtcaatgagctcatccaggagggtaagaacatacgccttgtgattgtggactccctcaccgcccacttcagggcagagtatgtgggtagggaggcccttgcaacaaggcagcagaaactcaaccagcaccttcacacccttcagaacatagcaaacacctataacgccgcggtatttgtcacaaaccaggtccaggccagaccggatgcgttcttcggaagccccaccaaggccataggtggacacgtgcttggtcacgccgcaacctaccgtatctggctcaagaaggggcttgcaggtaagaggatagccaggctggttgacagtccccacctgcccgagggtgagtgtgtcttcaagataacaaccgcgggtatcgttgattaa

SEQ ID NO: 24911 - DNA, 1260 bp, Methanobacterium thermoautotrophicum
atgtctatgactgtttctgagaagatacttgccagggcttcaggtaaggatagggtggaagccggtgaaatagttatggcggatatagatgttgcgatgacccatgacctcacaggtcccctgtcggttgagtccttcagggccataggtgaggatagggtctgggaccctgaaaaaatcgttgtgatattcgatcaccaggtccctgcagactccattgaagccgcccagaaccacatgataatgagggacttcgtagaggagcagggaatacggaacttctatgacgttcgtgaaggcgtctgtcaccaggtgctccctgagaagggccatgttgtgcccggtgaggtcgtggtgggtacagactcccacacctgcacccacggggccctcggagccttcgcaacgggtataggttcaacagatatggccatggtatttgcaactgggaaactttggttcagggtccctgaaaccctgagatttgatgtgaggggaaaactcagggagcacgtctatgcaaaggacgtcatactgaacataatagggagggttggtgccgatggcgcaacctacatggcctgtgaatttgcaggtgaaaccgttgcagaaatgagtgtatccgaccgtatggtcctctcaaatatggcaatagagatgggtggtaagacaggaatcgtggaacctgacgaaaaaaccctgaactatgtcaggaggaggtcaggtaaaccctggagggtcttcaaaacagaccctgacgctccatccctcagtgtcatggaggtcgacgtgagtgaccttgaaccccaggtcgcctgtccacacaatgtggacaatgtgaaacccgtcaccgaggtggaggggacagagatagaccaggtcttccttggttcatgcacaaatggaaggctcagtgacctcagggacgctgccgccatactgaagaacaggaaggtctcagacagtgtcaggatgctcgtcatacctgcctccagggaggtctaccgcagggcccttgacgagggactgattgagatattcgtggatgcaggagccctggtatgcaacccctgctgcggcccctgcctcggaggacacgttggactggtcggaccaggggaggtgagcctctcaacctcaaacaggaacttcagggggaggcagggaagccccgaagcagaggtctacctctcctcagcagccgtggcagccgcatctgcagtgaagggcagcataacccaccctgggagtctgaagtag

SEQ ID NO: 24912 - DNA, 990 bp, Methanobacterium thermoautotrophicum
gtgaaatcaatgaagatagcagtcatacccggtgatggaatcggagtggaggtgatggaggcagccctccacatcctgaacaccctcgaccttgaccttgaattcatacatgcagatgccggtgatgcctgccttaaaaggacagggacggcactgccagaggagacccttgaagccgtgggtgaagccagggcaaccctcttcggggctgcgggtgaaagcgcagctgacgttatagtccgcctgaggcgtgaatttgatctttttgcgaatttgaggcctgttaagtccctgccaggtgtcccctgcctctacccggaccttgactttgtgattgtgcgggagaacaccgaggacctctatgtcggtgacgaggagtacacccctgagggcgccgttgcaaaaagaatcataacaagaaccgcctccaggagaatcagccaattcgccttccagtacgcccagaaagagggcatgcaaaaggtaacagcagtccacaaggccaacgtactcaaaaaaaccgacggaatcttcagagacgaattctataaagtggcatcagaatacccccagatggaggccaccgactactacgtggacgccacagcaatgtacctcataacccagccccaggaattccagaccatcgtcacaaccaacctattcggagacatactatcagacgaagccgcaggactcatcggaggactcggactcgcaccatcagcaaacataggagaaaaaaacgcactattcgaaccagtgcacggatcagcaccccaaatcgcaggaaaaaacatagccaaccccacagccatgatactaacaaccacactaatgctaaaacacctcaacaaaaaacaagaagcccaaaaaatagaaaaagcactccaaaaaacccttgcagagggtcttgtgacaccggacctcggtgggaagcttggcaccatggagatggctgccgagatagccagacacctggaggattga

SEQ ID NO: 24913 - DNA, 939 bp, Methanobacterium thermoautotrophicum
atgtttgaaaacgttatctcaataaaggattttaagagggaggatatcgagttcatcctcagggaagccgagaagatggagccatttgcatcgggagaaaaatcctccagcgccctcagaggaaagatacttggcatgatgttctatgagccatccacaaggacacgtctatcctttgaaactgccatgaagcgtctgggaggggacgttgttggatttgcagatacgggggcgacatctgccgttaagggtgagagcctggctgacaccgccatgatgctttcagcctactctgacgccatagttataaggcacaacctggagggtgcagcacgttacatatcagatgttgtggatgttccagtgataaatgcaggggatggtgccgggcagcacccaacacagaccctcctggacctctacaccatgaagaggttcttcgggaggataggttcccttagggttgcactggttggtgacctcaagtacgggaggactgtccactcactggcctatgccctggctgttttcggtgccagtatgagcttcgtatcaccacccgtcctcagaatgcctgataacatcatacatgatctgaggagggctggtgttgaagttaaagagacagaaaggcttgatgatgtcatagatgaggtggatgtcctctacgttacaaggatacagaaggaacgtttccctgaccctgaggagtattcaaggataaggggagcctaccacatagatggatccactgtggctgatagggacctgattgtgatgcatccactcccaaggatagatgagatatccccagaggtggattccctcccacaggccatgtacttcagacaggcgttctatggtgtgccggtccggatggccctcctgaggctgctgataagtgagaggagaggatctgaaaaccagaagatagtttga

SEQ ID NO: 24914 - DNA, 2217 bp, Methanobacterium thermoautotrophicum
atggcaaggtacatagagcaccccctcataaagccagagaaaatagaggcaaggacctatcagcagctgctggcagcagatgtcatcagaaagggcaactcaatgatagtcgcccccacagccctcggaaagacggttgtggctgtccttgtggctgcagagagactcaggaaatacaggggctcaaaggtactcatcctatcacccagcaaacccctggccatacagcatgaggagagcttcagggagttcatgcttgcaacctgcacatcccttacaggtagcataaaacctgaagagagaaaagaacggtggattaaatcccagataatatccgccacgccccagacagttgaatcagacatcctggctggaagatacgacctcagggacgtctcactcatcgtattcgatgaatgccaccgcgcagttggatcatactcatacgtcttccttgcatctaattatatacagaacgccaggcaccccctcatactgggactcacagcgtctccgggtgcagatgaggataagataaaaactgtctgtgagaacctcttcatgaatgaggttgtggtgaaaacagagggggaccctgatgtgcgcccctacctcaagcccataaaaatagaatgggtaaaggtcaggatgacaccggagcttgaggatataagggaactccttaggaaggtccttaaaaatcgcttgaagatgcttaaaaacctcggtgttatagacaccatcagtgtgggtaagaaggaccttctgaaggcaaggggccgtgtccagaacaggatagcgcgatcaacgagccctccaagggcatgctacagggccatatcactccttgcatcctgtataaacgtggaacacgcccttgaacttcttgaaacacagggcataagaccactccaccagtaccttctccggctaaaggagaagaaaacaaaggctgctaagggtctcctggcagatccagactttacaagggccatgcacctcacaagaagggccatgatgtcaggggtggaacaccctaaacttgacaggctaatggagatactgaaaagggaacttaaaggagatgaagcaaggataatagtgttcacacagttccgcgacacccttgaggagatataccagagatgcaaacgtgaaggtatcaacgcagttaaattttatggacagaacagcaggagcggagagaagggcctcacccagaaacagcagagggatataataaaatcatttcgcatggggaaccatgacgtgctcctatcaaccagtgtcgctgaggaaggtatagatatcccctcggtggaccttgtggtgatgtatgaacctgttccctctgagataaggatgatacagagacgtggaaggaccgggaggaagaggaagggccgcatggttgtcctcataacagagaagacccgcgacgaggcatactactactcaagtatcaggaaggagagatccatgaaggagaacctcaggggcgggtcagttaacgtggaggttaaccccataatggaaccctcaggggagggacccttcatctatgctgattcccgggaggtcaactcaagggtcctcagggaactcaaaaagataggagtggattttgaactcaaaccccttgcagttggtgactatcagataagcgaggatactataattgagaggaagacaacacaggactttattggttcaattatagataaaagactgtataaacaggcaagggagatggtcaaaaacttcaaaaggcctgttatgatcatagagggggatgacctctattcaggattcataaacccggacgccgtgaggggtgcccttgcagctgttgctgtggactttggaatacctgtaatccccacgaggtcagccgaggataccgctgcaatgataaggaggatagccataagggagcagagggaaggcaggcctgatatgcgtgttcgcacggataagaagccactgaccctcagggagaagcagctcttcatcgtggaatccctgccaaatatcggttcaaagtacgctgaaaggctcctggaagccttcggatcagttgaaggtgttatgaacgcctcagagaaggaactccgtagcgtggagggtataggtgcaaagagggcttcggaaatcaggagggtcattgaggcagaatttaagggacccgatgaagccacatatcaattcaaggagtaa

SEQ ID NO: 24915 - DNA, 906 bp, Methanobacterium thermoautotrophicum
atgaagcaccttctatctgtatgtgacatggataacgtggtggacctccttgacctcgcagatgactacaaggaggggaagatcagggaaaagatcctcaggggtaaaacacttgccatgatctttgagaagtcatcaacaaggaccagggtatcctttgaggttggggcattccagatgggggctcagcccctctacctctctgcatcggaccttcagcttggaaggggcgaaccaatagcggatacagcaaggaccctcagcagatacgttgatggaataatgataagggccataagtcactccgacgtggttgaacttgcaggcgaggcatctgtcccggtcatcaatggtctgacagacctggaacatccatgccaggccctggccgatatgcagaccatcagggagaagctggggggattcgatggaaggctggtttttgtgggtgatggtaacaatgtctgccactctctcctcctcataacagccaccctggggatggacatggatgttgcctgcccccccggctatgaacctgaccccggcatcagggagatggcagggaaaatagcagatgagacaggttcacggataagggtaattcatgatccctccgaggctgtcaggggggccgacgtggtttacaccgatgtctgggtgagcatgggatatgaagacgaggctgaggaccgtttagaggtcttcagaccataccaggtgaatatggagctcatggaacttgcagctcccgaagccatattcatgcactgcctgccggctgtgaggggccaggagacaacagccgaggttattgacggtccccattcggttgtctgggatcaggcagaaaacaggctccatgcccagaaggccataatgcactggctcatgggggatatatga

SEQ ID NO: 24916 - DNA, 1395 bp, Pyrococcus abyssi
atgatagacatggaagttggaatcgtcggaggtggtctcgctgggcttgtcgcagctatctcattggtcgaaaagggcgttgatgtttcaataataggaccaaagtcaaaggattcgaactcctatctagcccaggctggaatagcctttcctttggtggaaggtgattccataaggattcacgtcctcgacacaataagggctggcaagtacataaatgacgaggaagttgtttggaacgtcatttcaaaatctaccgaggcatattcatttctagtatcgcacggcgtaacctttacgggcaacgagctcgagggagggcattcacatccgagggttttcacgataaagagcgaaactggaaagcacgtgattccaattcttgagaagcatgccagggaacttggagtgaacttcgtgaggggattcgttgaggagattggaataaaaaatggaaagctcgctggagttttcctaaacggcgagttgctaaagtttgatgctgtagtcgtagctacgggaggtttctctggattgtataggtttacggcaggtgtaaaggagaacattgggcttttgataggtgatctagccctcaagggagttcccctcagagacatggagttcgtccagtttcatccaacgggctttataggtaggagaacctacctgattaccgaggccgtaaggggggctggcgcaaagttagttactggggatggggagaggttcgtaaacgagctcgaaactagggatgtcgttgctagagctatttacctaaaaatgctcgagggaaagggagttttcctggatgctaggggaatagaagacttcaaggatcgctttccttacgtttattctgtgttgaagaaggaaggtatagaccctgggaaagatttgatcccggtaactccagtggctcattacacgatgggcgggataagcgttgacatcttctatagaaccaggataaggggattgtacgctattggagaggccgcatcgaacggctttcacggggcaaataggttggcaagcaattcccttctggagtgcgtggtctctggattggaagttgctagaacgattctcagggaagagcccaagagaggagctaacgatgctccttataacttcgatgagcttggagatgtagattccataagggagataatgtggaatcatgcaggaatagttagagataagagctctcttcttgagggtttaaagaagctggagggagttgaagcagaccagaggttaaaagttgttgcaaaggccgtcctaactttagcactcgagagggaagagagtaggggttcccactataggagggatttcccattcatgaggaaggagttcgagaggccgagctttttccacctcaatgtttaa

SEQ ID NO: 24917 - DNA, 1653 bp, Pyrococcus abyssi
atggcccagttagctggtcaaccaatcctaattctacccgaaggaactcagagatatgttggtagagatgcccagaggatgaacattctcgccgcaaggataatagcagagacggttaggacgaccctaggtccaaagggtatggacaagatgctcgttgacagccttggtgacatagtaatcacgaacgatggtgcaacgatcctcgacgagatggacatccagcacccagccgctaagatgatggttgaggttgccaagacccaggacaaggaggccggtgatggaacgacaactgcagttgtcatcgccggtgagcttctcaagaaggctgaagaattgctcgaccagaacatccacccaagcatagtcatcaagggttacatgttggctgcagagaaggcccaggagatcctcgacagcatagccaaggaagtcaaaccagatgacgaggaggttctcctcaaggctgcaatgaccgcaataaccggtaaggccgcagaggaggagagagaatacttagctaagttagctgttgaggccgttaagctcgttgcagaggagaaggacggtaagttcaaggttgacatcgacaacatcaagttcgagaagaaggaaggtggagcagttagcgacaccaagctcatcaggggtgtagttatcgacaaggaagtcgttcacccaggaatgcctaagagggttgagaaggctaagatagccctaattaacgatgcactagaggttaaggagaccgagaccgatgctgagataaggatcaccagcccagagcagctacaggccttcctcgagcaggaggagaagatgctcaaggaaatggtcgacaagatcaaggaggttggagctaacgtagtcttcgtccagaagggtatcgatgaccttgcacagcactacttagccaagtacggaatcctagcggtaaggagagtcaagaagagcgacatggagaagctcgcaaaggctactggagctaagatcgttaccaacataagggacctaaccccagaggacctcggtgaggccgagctcgtcgaggagaggaaggtagctggagagaacatgatcttcgtcgagggctgcaagaaccccaaggccgtaacgatcctcatcagaggtggaaccgagcacgtagttgacgaggtagagagggccctcgaggatgccgtcaaggtagtcaaggacatccttgaggatggaaagatcatcgctggcggtggagccgctgagatcgagctaagcatcaagctcgacgagtacgctaaggaagtcggtggtaaggagcagttagcaattgaggccttcgcagaggccctcaaggtcataccaaggaccttggcagagaacgctggactagacccaattgagaccctagttaaggtcatagccgcccacaaggagaagggaccaaccatcggaattgacgtctacgagggcgagccagccgacatgatggagaggggagtcattgagccagtaagggttaagaagcaggccatcaagagcgccagcgaggcagctataatgatcctaagaattgacgatgtcatcgcagcacagaagcttgagaaggagaaggaaggagagaagggcggaggaggaagcgaggacttcagcagcagtagcgacctagactga

SEQ ID NO: 24918 - DNA, 840 bp, Pyrococcus abyssi
atggtgtggaagatggcaaaggtttccgattttaagagaattggcgatgataaagtaaccgcgattggcatgggcacctggggtattggtgggaaggagttccctgattactcgaaagatagggagagcatagaggcccttagatacggactcgagcttgggataaacctgatagataccgccgaattctatggagcaggtcacagcgaagaactagttgggaaggctatagagggtttcaatagggaagagatattcatagtcagcaaggtttggcctactcactttggttacgagtcggctaaaaaagcggctagggctagtgcgaagaggttaggaacttatatagacctctaccttctccactggccaggcgatacttggaagaaaatcgaggagacacttcacgctctagaggagcttgtcgatgaggggttaataaggtacatcggggttagtaacttcgaccttgagttactcaggagaagtcaagaggctatgagaaagtacgagatagtggttaatcaggttaagtactccttgatggataggactccagaggaaactgggcttctcgattacatgaagagggagggaatcacgttgatggcctacactcccctcgagaagggcatcctagcgaggaataagtgtttggccgagatagggaagaggtatggaaaaacttcagctcaagttgccctcaactacctaatatgggaggagaacgtcgttgcaattccaaaggcctccaacaaggatcacataaaggaaaactttggagccatgggctggaggctttcacgtgaagatagagaaagagcgaagctttgcgtttag

SEQ ID NO: 24919 - DNA, 990 bp, Pyrococcus abyssi
atgcttaaacccgtgaggttttcaactcatcacgggggagctagaagaaatgaaattaagctgatagatttctcagcctctgtcaatccttatccgcccgaatgggttgatgagatgttcaagagagcccgggagataagcttcagctatccatactatgaggagcttgaagatgagctttcagagcttttgaacgaggaaatcactataaccgctgggataaccgaggggttatacctactaggaatactcgcgctccggggaaggaaggtgataatccctaggcacacctatggcgagtacgagagggttgcaaggatcttcaacgctaagataattaagggatcgaatgaaccagagaagttggctgagctcgtcgagaataattcagttgtcttcttctgcaacccgaacaatccagatggaaggtactacacgccaagggaattgaagccgctcatcgatgcggtcgaagataggaaagcactcctagtcctagatgaggcattcatcgacttcgtcaaggatgcaaagagcccagaaggagagaatatcgtgaagctcagaactttcacgaagagctacggcttacctgggataagggttggttacataataggatttagggatgcatttaggagcgttagaatgccctggagcataggctcaaccggagtagctttcctcgagttcctaatcgaggataacttcgagcacttaaggaagacgatgcctctaatctggcaagagaaggaaaggattgaaaaagcgcttaacgtcaaaagcgatgcgaacttcttcattaaatacgttggagatgccaaaaaagccgtcgaggagcttaaaaagaggggaattttagttagggattgcacgagcttcggcttacctggatacataagattctcagttagaagggcagaagaaaatgaaaggttagttcaagcgttaaaagatttaagccccgaacttctcgctcctgttcattag

SEQ ID NO: 24920 - DNA, 993 bp, Pyrococcus abyssi
atgcatccaaaggttgatgcccttctttcgagatttccaaggataactttaattccctgggaaaccccaatccagtaccttcccagaataagtagggagctaggtgttgacgtttatgttaagagagatgacttaactggtcttggaatagggggaaataagataaggaagcttgagttcctcctaggggatgcattgtccagaggttgcgacacggtaataacgataggtgccgtccattcaaatcatgcctttgtgacggctttagcggctaaaaaacttggactgggtgcggtcctaatccttagaggtgaagaagtcctaaagggtaactatctccttgacaagctgatgggaattgaaacgaggatatacgaggcagataacagctgggagctaatgaaagttgctgaggaagttgccgaagaacttaagggggaaggaaagaagccatacataataccccctggtggggcatccccagttggaaccctcggttacattaggggagtaggtgagctgtacactcaggtaaagaagctaggacttaggattgacaccgtagttgatgcggttggaagcgggggaacgtacgctgggcttctcttggggtccgctatagttaatgcagagtggagcgtagttggaatagacgttagtagtgccaccgagaaagcgaaggagagggttaagaatttggttgaaaaaacaaaggaactcctgggaattaatgtgaaagttcaggaaccgaggatatacgattacggctttggagcttacgggaagatagttaaagaagttgcaaagctcataaaatccgttgggactatggagggcttgctgctggatcccgtttatactggaaaggcattctacggcctgatggatcttgcgaagaaaggagatctcggagagagcgttctctttatacacacgggtggtctcccagggatattccactatggtgaggaaatgcttgaattgttggtatga

SEQ ID NO: 24921 - DNA, 1314 bp, Pyrococcus abyssi
atgaaggtgttattgcttggatttgagtttcttccggttaaagtgggaggccttgctgaggcccttacggcgatatctgaggctttagcatccctcggtcatgaggttctggtatttacaccttcacatggaaggtttcagggtgaggaaataggtaagattagagtctttggggaagaagtccaggtaaaggtaagttacgaggagagagggaacctaaggatatatagaatagggggaggtcttctcgattccgaagatgtttacggcccaggatgggatggtttaattagaaaagctgtaacttttggaagggcaagtgttttgctattgaacgatcttcttagggaggaaccccttccagatgtcgttcacttccatgactggcatacggtatttgcgggggcattaataaagaagtacttcaagatccccgcggttttcacaatacatagactgaacaaatcaaaattgccggctttctacttccatgaagcgggattgtctgagttggctccttatccagatatagatccagagcacactgggggatacatagctgatatcgtgacaaccgtaagtaggggatacctaattgacgaatggggtttctttagaaacttcgagggcaaaataacttacgtcttcaatgggattgattgtagcttttggaacgagtcatatttaacgggaagtagggatgagaggaagaaatccctgctctcaaagtttggaatggacgaaggagtaacattcatgttcattggaaggttcgataggggccaaaagggcgttgatgttctattgaaggcaattgaaattctgtcatctaagaaagaattccaggaaatgagatttataataattggaaagggagatcctgaacttgaaggttgggctagaagccttgaggagaagcatggaaatgtgaaagttatcacggagatgctatcaagggaattcgttagggaactttacggctctgtggatttcgttattataccatcttactttgaaccattcggtttagtggctttagaggcaatgtgtttgggggcgatccctatagcttcagcagttggagggcttagggatatcataacgaacgaaacgggaatcctcgtgaaggctggcgatcctggagaattggcaaatgctatcttaaaggcccttgaactttctaggagcgatctaagtaaattcagggaaaactgcaaaaagagagcaatgtcattttcctgggaaaaatcggcggagagatacgtaaaagcatatacaggaagtatagatagggcgtttgacttcatcctatga

SEQ ID NO: 24922 - DNA, 852 bp, Pyrococcus abyssi
atgctactgtacacttatcgctcgttcgacatggagctgccaactgttagcatagaggaggctgattacgttataatgggactgcccttcgatggcaccacgagctataagccaggagctaggtttggaccggttttaataaggcaggctactttaaaccttgaaagttacatcctcgactacgacgtggatatagctgagctaaagatagcagacgctggagatgtagcattaccggtaaacgttgaggatgcaataaaggtgggcattgaagccataaaggagctaagatcggtgaatcggaaggccctacccatattcctcggaggagaacactcaatgacgtacccgccagtagcggttcttaaaccgaaaagctacgtcgtcttcgatgcacaccttgacttaagggactcctaccaaggatcaaggttcaatcatgcttgcgttgctagaagaatacacgaaaatggcgttgaagttgctatctttggcgttaggagtggaaccagggaagaagtaaagtacgctacggaaaacggcattgaatgggttcatgcaagggattataatttcgacgcattcgttgatctagttgccagtctatcagagccaatctacgtctcaattgacatagacgtttttgatatccccctcgtcccagaaactggaacacctgagcctggaggattaagattttgggatgtggtgaatgcgttggagtggcttacggagagaaagaatgtcgttggattcgatataatggaagtttcgggagataaactgggtaacgttacttcaataaccgctgcaaagcttctatttcacatcttaggaatgagctcaaggtga

SEQ ID NO: 24923 - DNA, 2460 bp, Pyrococcus abyssi
atggcatataggttcattaagtggttcgaagagctgagaaaagaggatgttcctcttgttggtggtaaaggggctaaccttggagaaatgacaaatgcaggaattccagtgcctccaggattctgtgttacagctgaggcctacaagtattttgttgagaacgttaagatttctaaggaagatgttaagagaatccttggagagaaagcaaacaagggaaccatagctgaggttcttgctcaagctccagacgagccaaggccactccaggaatggataatggacataatcaataggactaacgttgatgacagcaagcaactccaggagaacactgccgtaattagggagctaatcaagtcacttgacatgccagccgagattgcagacgagattaagcaggcctacaaggagctcagccagaggtttggaaaggatgaaatttacgtcgcagtaagatcatcagctacagctgaagacctcccagaggcttcattcgccggacagcaggaaacttaccttgatgttctaggtgctgatgacgttatagacaaggtcaagagatgctgggcctcgctctggactgcaagagctacgttctacagggctaagcaaggattcgatcacagcaaggtctacctctcagcggttgttcagaagatggttaacagtgagaagagcggtgtcatgtttaccgccaacccagttacaaacaacaggaacgagataatgattaacgcgagctggggtctaggtgaggccgtagttagcggtgctgtcactccagatgagtacattgtcgagaagggaacctggaagattaaggagaaggtgattgcaaagaaagaggtaatggtcatcaggaacccagagacagggaagggaaccgttaccgttaaagtcgctgagtacctgggcccagagtgggttgagaagcaagttctcacagacgagcagataattgaagtggctaagatgggtcagaagattgaagagcactacggctggcctcaggacatagagtgggcctacgacaaggacgacggaaagctctacatcgttcagagcaggccagtaacaacactcaaggagaccaccacagaggaagttgaagaggtcgaagaggctgaagtcatactcaagggtctcggtgcctcaccaggtataggcgcaggtagggtagttgtcatcttcgatgccagcgagatagacaaggtcaaggaaggagacgttctagtaacgacgatgactaacccagacatggttccagcgatgaagagggctgcagctataatcacagatgagggtggaagaacaagccacgcggcaatagtctcaagagagcttggtatacccgctgtagtcggtacgaaggaagctaccaagaagctcaagaccggtgactacgtaaccgttgatggaacgagaggtttagtgtacaagggaatagtcaagagcttagttgaaaagaagaagaaagaggaggcagctgcagctccaggagcagcggtagctgcggcaccactagtcacgggaacccttgttaaggttaacgtttcaatgccagaggttgcagagagggcagcggctactggagctgatggggtaggtctactaagggccgagcacatgatcctaagcatcggacagcacccagtcaagttcatcaaggagggcaaggaggaagagctcgtagagaagctcgcagagggaattgagaaggttgcggcagcgttctatccaaggccagtctggtacagaacgctagacgctccaaccaacgagttcagagagatgccaggaggagaggacgagcccgaagagaggaacccaatgcttggatggagaggtatcagaagaggcctcgaccagccagagctcctaagggcagagttcaaggcaattaagaaggtcgtcgagaagggatacaacaacatcggtgtaatgctaccactcgttagccacccagagcaaataaggaaggccaaggagatagctagaagcgtcggtctcgagccacacaaagacgttgcatggggaataatgatcgaggttccagctgcagcaataatcatcgaggacctaatcaaggagggaattgacttcgtcagcttcggaaccaacgacctaacccagtacacccttgcaattgatagagacaacgagagggttgcaaagctctacgacgagacacacccagctgtgctcaagttaatcaagcacgtaatcaaggtatgtaagaggtacggcgttgagacaagcatctgcggacaggctggaagcgatcctaagatggccagaatactcgtcaggcttggaattgacagcatctcagctaacccagatgcagtgcaactaataaggcaagtggttgcccaggaagagaggaagctcatgcttgaggccgcaagaaagaggctcttcgaggaggaagaggaagaagaggagttcctcttctga

SEQ ID NO: 24924 - DNA, 4314 bp, Pyrococcus abyssi
gtgcgtgacatggaggaagtgagggaagttaaagttcttgaaaagccctgggttgagaagtacagacctcagaaattagaggagatagtcggccaagagcacattgttaagaggttgaagcattacgtgaaaacgggttcaatgccccaccttctcttcgctgggcccccaggagttggaaagtgcctcacgggagatgcaaaagttatagccaacggtgagctaaccaccataggcgagctcgtcgagaggataagcaacggtaagctcggcccaacgcccgttagaggtctcaccgttctcggaattgacgaagatggtaagctcgttgagttgccagttgagtacgtttacaaggacaagacgagtgagctcgttaagataagaactaggttaggtagagagctcaaggtaaccccataccacccactcctcgttaacaggaggaacggaaagatagagtgggttaaggctgaagagctcaaacctggggacaggttggcgattccaagctttttaccggcgatgctcaacgataatccattggcagaatggctcggttacttctttggcaacggttacacggattctgaggaaagagttgtctttgaaagtaaaagcaaagagcttaggaagagattcatggagctaaccaggaagttgttccaggatgctgaaattaaagaagattcgggcaaagtttacgtgagctcgagcgaagttaaaagactcgtcaagagtctcaacaaggattcaataccagagcaagcctggaaagggttgcgctcattcttgagggcttacttcgactgcaacgctgaaataaaagacaagataattgtttcaacggctggcaaggagattgcggagcaaatatcctatgcactggctggacttggaatagttgccgaggttgatgataaaggtagcgtaattatctccgaccccgagaacgtttcccgcttcttagatgagattggcttctccgttgaggaaaagaaagaggaagctaaggccttaataaagaaatcaaccctaaacttgggcatctacgttgataaagagctaatatcctacgttagggagaaactcaagctcagcttttacgagaacgaaacaatgtggagccccgaaaaggcgagggaaatagcttggaagctaatgaaagaaatctactaccgcctcgacgagttagaaaggttcaaaaaagccctatccaagagtgtaatcatagactggagcgaggttgagaagaagaaggaagaaatatcggaaaagactggaattagtgtcaatgaaattctcgagtacgccaagggtaagagaaagccaagcctagaggagtacgttaagatcgcaaaggccctaggagttgagcttaaggaaactctcgaagcaatattcacctttggaaagaagtacttaggttatgtgattagcgatgagatagaaaccctcgaggaagtaaggaaggaggagttaaagcgtttgaaagaacttctcaacgatgaaaagctcaagaagggagtagcttacctaatcttcctcgcacagaacgagctcctatgggatgagataattgaggtcgagaagcttaagggggacttcgtgatatatgacctccacgttcctaagtatcataacttcattggtggcaaccttccaacggttctccacaacacaaccgccgctctggcccttgcaagggaattattcggcgaaaactggcgccataactttttagaacttaacgcgagcgatgagagaggcataaacgtcattagggagaaggtaaaggagtttgcaaggacaaagccaataggaggggccagtttcaagataatattccttgatgaggctgatgctttgacccaggatgctcaacaagccctgagaagaacgatggaaatgttctcaagcaacgtaaggtttattttaagctgtgttacaggagacacaaaggtatatacgccggacgagagggaagtcaagataagagacttcatgaactattttgaaaatggattaattaaagaggttagtaataggattggcagagataccgtcattgcagctgtttcctttaattccagaatagttggccatcctgtttacagactaaccctagaaagtggaagaataatagaagcaacgggagatcacatgtttcttaccccagaaggctggaaacaaacttatgatatcaaggaaggctcagaagttctcgtaaagcccacccttgaggggacaccttatgagccagacccaagagtaataatagacattaaggagttctataatttccttgaaaaaattgaaagagagcataatctcaagccccttaaagaagcaaaaacctttagagaacttataactaaggacaaggaaaaaattctaagaagagccctcgaactcagggcagagatagaaaatggcctaaccaagagggaggctgagatattagaactaattagtgccgatacctggataccaagagccgaactagagaagaaagctagaatttcgcgtacaagattaaaccaaatcctccaaagacttgagaaaaagggatacatagagaggagaattgagggaagaaaacaattcgtaaggaaaatccgcaatggaaagatactaaggaacgcaatggacatcaagcgtatcctagaagaagaattcggaataaagataagctacaccaccgtgaagaaactcctctcaggaaatgtcgatggaatggcttacaggatactcaaagaagttaaggagaagtggcttgtccgctatgacgatgagaaagccggaatccttgcaagagtcgtaggctttatccttggggatggacatctagctaggaatggcagaatttggttcaattcaagcaaagaagaactggaaatgcttgctaatgatctcagaaagctaggtttaaagccctcagaaataatagagcgtgattcgagttcagagatccaaggaagaaaagttaaaggaagaatttatatgctctacgttgacaatgcggcattccatgccctgctccgcttctggaaagttgaggtaggtaacaaaactaaaaaaggttacacagttccagagtggattaagaaaggaaatctatttgttaaaagagaattcctgcgtggcctcttcggtgcagatggaactaaaccgtgcggaaaacgctataacttcaatggaataaagctcgagatacgtgcaaagaaagagagtctcgaaaggactgtggagtttcttaacgatgtggccgacttactcagggaattcgacgtggattcaaagatcacagtctcacctactaaagagggattcataattaggctgatagtaacgccaaatgatgccaactatctcaacttcctcaccagagttggttacgcctatgctaaagatacctacgctaggctcgttggagaatatataagaataaaacttgcctacaagaatataatcctcccagggattgcagagaaagctatagagcttgcaactgtaactaactcaacttatgcagccaaagtactcggagttagtagggacttcgtagtaaacagactcaaaggtacacaaattggcatcacaagagatttcatgaccttcgaggagtttatgaaggagagagtactaaatggttatgtcattgagaaagtgataaagaaggaaaagctcggctacctcgacgtttacgatgtgacatgtgcaagggatcacagttttatttcaaatggtcttgttagtcacaattgcaactattcgtcaaagattatcgaaccaattcagtcaagatgtgcgatatttaggttcagaccattgaacgatgaggacatagcaaagaggctaaggtacatagccgagaacgaggggcttgagctaactgaggaagggcttcaggcaatactatacatagccgaaggagatatgaggagagcaataaacattttacaagctgccgcagccctagataggaagataacggatgaaaatgtattcctcgttgctagcagggcaaggcccgaggatataagggagatgatgctcctagccctcaagggcaacttcctgaaggccagggaaaagctcagagagattctcctgaagcagggattgagcggtgaagacgttttagtccagatgcacagggaagtgttcaacctacccatagacgaacccatgaaagtttacctagcggataagataggagaatacaacttcagactcgttgaaggtgcaaacgaaatgattcagctggaagcattactggcccaattcacactaatcggaaagaagaaataa

SEQ ID NO: 24925 - DNA, 720 bp, Pyrococcus abyssi
atgagggcttcgaagtatgaggctaagggcatgacactaacgacaggagttaaggggttggacgagctactcgggggaggcgttgctagaggggttatactgcaagtttacggcccttttgccacgggaaagactacctttgcaatgcaagttggccttttaaatgagggaaaggttgcctacgtggatactgaaggtggattttcgcccgagaggcttaagcagatggctgagtccaggggcttagaccccgagaaggccctttcaaagttcataattttcgagcccatggatttaaacgagcagaggaggattatatctaagcttaaaaccgtggtaagcgacaagttttcactcgttgtagttgactccttgacagctcactacagggccgagggtagtagagatcacgtagagttggccaagcagctacaagttcttcaatggttggctagaaagaagaacgttgccgttattgtggttaatcaggtgtactatgactcgaacactaacactctgaggcctatcgctgagcatactttggggtatagaacgaaggatatacttaggttcgagaagttcagggttggtgttagactggccgttcttgaaaggcataggtttaggccggagggtggaatagtttactttaagataacggacaagggaattgaggacgttcttaaggccaaaccagaaaatggagaagagaacatctaa

SEQ ID NO: 24926 - DNA, 1401 bp, Pyrococcus abyssi
gtgattaacatgacaaaatgggatgaaattaaaaaatatacttcaaaaaaagtagatgaaaatttgaagatcgttgaactagacgaggaatacttaccaagggccatcggattcaagtactaccctctcgtgattgaaagggcgaaaggttcaagggtttgggataaggatgggaacgaatacatagacttccttacaagcgccgccgtattcaacgttggtcatgcacatccaaaagtcgttgaggccataaaggaacaagtggacaagttcctcaactacacgataggttacctatacacggaacctccagtgaggcttgcagagcttctcagtgaaatgactccgggtgatttcgagaagaaagttacattcggcttttcaggttctgacgctgtagattcctcaataaaggcctcgagagcatatacaaagaaggtgcacataataagctttaggcattcctaccatggaatgacgtatggagccctttcagtaactggaatagttgacgagaaggtgaagtcaatagtgcaaccaatgagcaacgttcacatagttgattatccagacccttacagaaatccgtggaacattgatggttatgaaaatccctctgaattggcaaacagggcattagacgaagttgagaagaaaataaaggaactcaatggggatgtcgctgggataatacttgaacctattcaaggagatgctggagtcgtaataccacctctcgaattcattaagggtctcaaaaagctaacggatgaatatgggatggtattcattgatgaagaagttcaaactggaatgggaagaacggggaagtggtgggccatagaacattttgaagttgttccagatcttcttgtatctgcaaaggccttgggaggaggaatgccgatctcagcggttgttggaagagctgagatcatggacagcgttccatctccactcttcgtgttcactcacgtcggccatgctgttaatgcctcggcagcaatcgcaacgatcaaggtgattaaggaagagaagctcgttgaaagggcaaaagaattaggtgattatgcccttaagagattcagagagcttcaggaagaatacccaatcattggagatgtcagaggaaaaggactaatgataggcgttgatatagtcaaagagggaactaaagatcctaatagagagctagctcagaagatatgctggagggcttgggagaagggattgataataataacctttggaaagcatggaaatgtcctcagaatagcaccaccactcacaatttcaaaggaagactttgataggggaatagaaattatagaggaggcaataaaagatgcgataaatggtaaagtgccagatgatgtcattaaattcctaagagcctggtga

SEQ ID NO: 24927 - DNA, 1182 bp, Pyrococcus abyssi
atgaagtacgatgtagttgtcgtcggttccggcgtcgccgggcctacagttgctagggacgttgctaaggctggcttctcggttttactcgtcgataagaaggccgcaataggaaccccaaaacagtgtgcagagggcataacgattgaagttttcaaggagttcgacattccctacgataagaggttcataaacagggaaatatacggtgcgaagatatactctccaagtggctacactgccgagctcaggtacaagcacgttagtggagtaatacttgagaggaaggtattcgataagatgctcgcctactatgcagctaaagccggcgctgaagttctagctagaactgaggtcgttgacgtaataaggaggaatgggaaaatagttggagttagggcgaagcacgaaggtgagcccctggaaatagaggcgaaggtcatagttgcggccgatggggttgagagcacgatagctaggaaagctggaataaacacttacgctcctccccatgagtttgactctggttatgaatacgagatgctgatcgaaggttacgatccagatctaattcacctgttctttgggaacgaagttgcccctaggggatacgtctggatattccctaaagatgaagacagggcaaacgttgggataggcatagcttcagatcatccacaaacggcgaagtactacttggataagtggttgaaggagaacaacatcccgatgaggaagatacttgaggtcaacgttggtctagttcccgtgggaggcttcgtgaaggagctagtcaaggacaacgttctagttgttggagatgcggcgaggcaagtgaacccagttcacggtgggggaatgaaagaagcaatgaaagcggcatcaatagctgcaaagtggataattaaagctcttgaagaagagaatcttgagttactcaagaactacagcgaagaatggtggaggaccgaagggcccaggatggagaagttacttaagctaaggaaagctatggaaaagctcaccgacgaggatcttgacgttttcgtccaacttgtcagcggaacggacttggaaaagcttgccggaggcaactacttggaagtagtgaaggccttaatgaagcatccaaaagttttaatgagcaggaggaggcttgagatcctcaaggccctgctatga

SEQ ID NO: 24928 - DNA, 1395 bp, Pyrococcus horikoshii
atgatggagatgagggttggtatcgtaggaggtggtctcgctggattgactgctgcgatagctctagctgaaaagggattcgatgtttcaataattggacctaggtcaactgattcaaactcctacttagctcaggccggaatagcacttcccctattagagggagattcaataaggatccacgtccttgacacgataaaggctgggaagtacataaacgatgaggagatcgtttggaatgtaatctccaaatccagcgaggctcatgacttcttaacatctcatggtgtaactttcactggaaacgaacttgaaggtggtcattcttaccccaggatattcacgattaaaagcgaaacaggaaagcatatcattcctattctggaaaagcatgccagggaactcgacgttaacttcataaggggttttgttgaggaaatagggataaacaatgggaagcttgctggagttttccttcagggagagttgcttaaatttgacgctgttgtaatagctgccggcggattttcaggtctctataggtttaccgcaggggttaagaataacattggcctgctaattggggatgtagcacttaaaggtgttccattgagggatatggagtttgttcagtttcatccaactggatttatagggaaaaggacttacctaattaccgaggccgttaggggggctggagcaaagcttgtcactggagacggtgagaggttcgttaatgaactggaaactagggatatagttgccagagcaatctacatgaagatgctcgagggtaaaggagtcttccttgacgctagagggatagaaaacttcaaggatagatttccctacatttactcggttcttaggggagaagggataaatcctgagaaggatttaattccgataactccagtagcccactacactataggcgggataagtgtagacgctttctatagaacgaggattaagggtttatacgctattggagaatctgcttgcaatggtttccatggggcaaataggttggccagtaactctctcctagagtgcgtagtttccggcctggaggttgcgagaactatatcaagggaaaaacccaagagggaggtgaacgatgctccttactcttttaatgaacttggagacgttgattcgataagggaggtactctggaaccatgctgggatagttagggatgaatggtcacttagagaagggctgagaaagcttaaagagatagaagtagatgagagacttaagttagttgctaaggccgttataatttcagccctcaagagggaagaaagcaggggggcccactataggaaggactaccccttcatgagaaaagagtttgagcattctagcttcttctaccctaacgtttaa

SEQ ID NO: 24929 - DNA, 1650 bp, Pyrococcus horikoshii
atggcacagttagcaggtcaaccaattctgattttacctgaaggaacccaaaggtatgttggtagagatgctcagagaatgaacattctcgcagctagaataatagctgaaaccgtaagaacaacactcggtccgaagggaatggataagatgctcgttgacagccttggtgacattgtaattacaaatgacggtgctacaattctcgatgagatggatatccagcacccagcagctaagatgatggtcgaggttgcaaagacccaggacaaggaggccggtgatggaacaactacagcagtagttattgctggtgagctcttaaagaaggctgaagaattacttgaccagaacattcacccaagcataatcatcaagggatacaccttagcatctcaaaaggcccaggagatacttgacagcatagccaaggaagtcaagcctgacgatgaggaggttctccttaaagcggcaatgacagcaataaccggtaaagcggccgaggaggagagggagtacttagctaagctcgcagtcgaggccgttaagctagtcgcagaggagaaggatggtaagcttaaggttgacattgacaacatcaagctcgagaagaaggaaggtggggctgtcagagacacaaggttaattagaggtgtagtcattgacaaggaggtagttcacccaggaatgccaaagagaattgagaacgctaagattgcactcattaacgatgcccttgaagtcaaggagaccgagacagatgctgagataagaattaccagcccagagcagctccaggccttcctagagcaagaggagaagatgctcaaagagatggtcgacaagatcaaggaggtcggagctaacgtagtgttcgtccagaagggaattgacgacctagcccagcactacctagctaagtacggaatattggccgtaagaagggttaagaagagtgacatggagaagcttgctaaggccactggagctaagatcgtaaccaacatcagggatctcacaccagaggacctcggtgaagcagaactcgtagaagagagaaaggttgctggagagaacatgatcttcgtcgagggctgcaagaaccccaaggccgtgacgatactcatcaggggtggaactgagcacgtagttgacgaagtcgagagggcccttgaggatgccattaaggtagtcaaggacatacttgaggatggaaagataatcgcaggtggaggtgctagtgaaatagagctcagcatcaagctcgacgagtacgcaaaggaagtcggtggcaaggagcagttagctatcgaagccttcgcagaggccctcaaggttattccaaggacactagctgagaatgctggtctcgatccaattgagacactagttaaggtcatcgctgcccacaaggagaagggacaaaccataggtatcgacgtctatgagggtgagccagctgatatgatggagaggggagtcatcgagcctgtgagagtcaagaagcaggctattaagagtgccagtgaagctgctataatgatactcagaatcgacgatgtcatcgcagccagcaagctcgagaaggagaaggaaggagagaagggaggaggaagcgaggaattcagcggtagtagcgacctagactga

SEQ ID NO: 24930 - DNA, 822 bp, Pyrococcus horikoshii
atgagggatgtaaagctaataggctcggatgaggttacggccataggtatgggaacttggggcattggggggtatgaagtcccggattattccagggatagagagagcattgaggttctaaggtacggtttggagcttgggattaacttaatagataccgctgaattttacggtgctggccactccgaggagctcgttgggaaggctatagagggtttcaatagggaggagatatttataataagcaaggtctggccgagtcactttggctatgaaaaagcaaagaaagcagctaaggctagtgcaaagaggctcggcacctatatagatctctacctcctccattggcctggggatagctgggggaagatagaggaaaccctccatgctcttgaggatttggttgatgaagggttgataaggtacataggggttagcaactttgatttggaattgctaaaacgctctcaggaggcgatgaggaggtacgagatagtggccaacgaggtcaagtattcaatccgcgataggtggccggaaacatctggtctgctcgattacatgaaaagggagaaaattgccctcatagcttacacgccgcttgaaaagggaacccttgctagggatccgtgcctcaccgagatcggtagggcttatggaaagacagcagctcaagtggcccttaactatttaatttgggaggataacgttatagctattccaaaggctggaagaaaggatcatgtggatgaaaactttggtgctatgggatggaggctttcgagagaggatagggaaaaggctaggaggtgcttctcatga

SEQ ID NO: 24931 - DNA, 978 bp, Pyrococcus horikoshii
atgaaaacgctaattgagattaagcaaacgcctgatgggataattaaagctgataaggtatttaataaggtaaaagataagataagcctaccgaatagaatcctgtacttagggtgtggctcttcacacttcctttccaagctcttggcaatggttactaacatgcacggaggcctagggatagcgttaccatgttccgagtttctttactctaaggaaacttatccgataggagaggtagagcttgcggtaggaatatcgaggtcaggggaaaccacagagatcttattggccttagagaaaattaacgtcaagaaacttggaattactacacgtgaaagctccttgacgagaatgtgtgattattctctggtagttccagccattgaagagagcgttgtgatgacgcactcatttacatccttctactttgcatacctccagttgttaagatactcctatggacttccacctttaaatgctggagagatctcaaaagcaacggagaaaagcctggaatacgaaagatacataagggagatagttgagagctttgacttccaaaacattatctttctgggctcaggattgttatatcccgtagctctagaggcaagtctgaaaatgaaggagatgtcaatattctggagtgaggcttacccaacctttgaggtgaggcacggctttaaggccatagctgatgaaaaaactctagttgtgctaatggttgaggagccttttgagtggcatgaaaagcttgtaaaggagttcaagaaccagggggcaaaggtgctagtaatctcaaattctccccaggatcttggacaggactattctatagaacttcccagactcagtaaagatgcgaatccaattccctacctccctatagttcagcttctctcctactataaagcggtaagccgtggattaaatcccgataatcccaggtttttggacaaggttgtaaggtggtag

SEQ ID NO: 24932 - DNA, 1278 bp, Pyrococcus horikoshii
atggtgaactccatggattgtggaagggattactgcgtgaaagatctatccctcgctgacgaagggtggaagaaaattgattgggtttctcgcttcatgcccgttcttcagcacataaggagggaatttgaggagaaaaagcccttcaagggtgtaaggatagcggccaccctccacctggagatgaaaaccgctttccttctgcttactttaaaggccggaggcgctgaagtctctgcagcggcaagcaatcctttaagcacccaggatgatgttgtagccgctctggcaaaagctggagttaaggtttacgcaataaggggcgagagcaaggaacaatactacgagttcatgcacaaggccctcgacataaggccgaacataataattgatgatggagcggatatgataagcctagttcacaaggagaggcaagaattactagatgagatctggggaggtagtgaggaaactacaactggggttataaggcttagggccatggaaagggatggtgtccttaggttctcggttatagccgtgaacgactcctacatgaagtacctcttcgacaaccgctatggaacgggtcaatcaacctgggatggggtcatgagggctacaaacctcttaatcgctgggaagaacgtggtagttgtaggctatggctggtgcggaagagggatagccatgcgcgcccgtgggctgggtgcaacggtaatagtcgttgaggttgatcccataaaagctcttgaagccaggatggatggcttcctggtcatgaacatgaaggaagctgctaagataggggatatattcataaccgcaaccggggatataaagtgcatccgcagggagcacttcgagctcatgaaggatggtgcgataatggccaacgctgggcacttcgacgttgagatatggaagcccgatctcgaggagctcgccgtcgagatcagcaatccaaggccgaacgtaaccgagtataagcttaaagatggtaggaggctgtacctattagctgacggaaggttggtgaacctggttgctgctgacggtcatcctgctgagataatggatatgagctttgcccttcaagctaaagcagctgagtacataaaggataaccatggaaagctggaacctagagtttacattctaccgagagagatagatgagatggtggccaggataaagctagcatcaatgggaattgaaattgaagaactcacggaggagcagaagaagtacctagaaagctgggagcacggaacttag

SEQ ID NO: 24933 - DNA, 1437 bp, Pyrococcus horikoshii
gtgagaaggatgaagcttccctcccataaaacaaagattgtcgcaacgatagggccggcaactaactcgaaaaaaatgatcaaaaaattaattgaagctggcatgaacgttgcaagaataaacttttctcatggcacattcgaagagcatgcaaagatcatagagatggtgagggaacagtcacagaagttagataggagagttgcaatattagccgaccttcccggactgaagattagggttggggagataaaggggggatatgtggaacttgaaagaggggagaaagttactttgacaacaaaagatattgagggagatgaaacaacgatccccgtagaatataaggatttcccaaagcttgtatctaagggagatgtgatatacctaagcgatggctatatagtgttaagagtcgaagatgtaaaggagaatgaagttgaagcagtagttatttctggtggaaaactcttctcgaggaaagggataaacattccaaaggcctatcttcccgttgaagctataactccaagagatatagagataatgaagttcgcaatcgaacatggcgtcgatgcaataggactcagctttgttggaaacgtttacgatgtactaaaagcgaagagctttttggagagaaatggcgcaggtgacaccttcgttatagctaagatcgaaagacccgatgctgttagaaacttcaatgaaattctaaatgccgctgacgggattatgatagccaggggtgatctaggggttgagatgccaatagaacaacttccaattctccagaagaggttaattaggaaagccaacatggaaggaaagcctgtaattacggcaacccagatgctcgtttccatgacaatggaaaaagtcccaacaagagctgaagttacagacgttgccaatgcaatactagatggaaccgatgccgttatgttgtctgaagaaacagcagttggaaaattcccgattgaggccgtcgagatgatggcaaggatagcgaaagtaactgaggaatatagggaaagctttgggataaccagaatgcgagagttcctggaaggaacgaagaggggaacgataaaggaggcgataaccaggagtatcattgatgccatctgcactataggtataaagttcatattgacgccaactaaaacgggtagaacggcaagattgatctccagatttaagccaaagcagtggatacttgcattctctacgagggagaaagtttgcaataacctaatgttcagctatggagtgtatccattctgtatggaggaagggttcaatgagaatgacattgttaggttaataaagggactaggattggttggaagcgatgacatagttttgatgacggaaggtaagccgatagagaaaaccgttgggactaattcaataaagatattccaaatagcgtga

SEQ ID NO: 24934 - DNA, 3327 bp, Pyrococcus horikoshii
atggagagggaagagataattgagaggttcctcaaattctttagggagtatgcagaagagggtgaagaacccctctacatgggtaaaataaaggatctgctaacgataacgccaaagagatcaatagtgataaattggatgcatctaaactcatacgatccggagcttgctgaggaggttatagaaaacccagaggagtgcatacttgcagctgaggatgcaatccagataatactgaaggaggacttcctaagggaagatgtgccaaagatacacgcaaggttccacaacctcccaaagaccctaatggttaaggaagttggtgctgagcacataaacaaactcattcaggttgaaggggtagttacaagggttactgagataaaacccttcgtctcagtcgcggtcttcgtttgtaaggattgcgggcatgaaatggttgtgcctcagaagccctatgagggctttgttgcagtaaagaaatgcgagcaatgcggaagtaaaaacgtccagcttgatgtggagaagagcaaattcgtgaacttccagatgttcagaatacaggataggccagagagcttgagaggagggcagatgcctaggttcatagatgggatactcctggatgatatagtggatacagcaatgccaggtgatagggtaatagtcgtggggatcctcagagtgatccaggaaaagagagagaaagttccaacgttcaagaaggtgatagaggtcaaccacatagagcccataagcaaggagctcgaagagcttgagatatctccagaagatgagcagaagatcagggaactcgcaaagaggaaggatatagtttcagccatagttgactcaatagcgccagcgatctacggatacaaggaagttaagaagggaatagccctagccctcttcggaggagtctcaaggacgctacccgatgggacgaggcttagaggggatatccacgtcctcctcgttggagatcctggcgtcgctaagtgcgttgactacgatacagaagtcctacttggagatgggagaaagaggaagataggagagatcgttgaggaagcgataaagaaagcagaaaaagagggaaaacttggaagggttgacgatggcttctacgctccaataaacctggagctgtacgctttagatgtgagaacccttaaggtcaggaaggtcaaagctgacatagcgtggaagagaacaaccccggagaagatgttgaggattagaactaagaggggtagggaaattagggtaaccccaacgcacccattcttcacgttagaggagggaaggataaagacgaagaaagcttatgagctaaaggttggggagaagatagccacccccagggaggaagcacccgaagctgagatattttgggatgaagttgttgagattgaggagtacaagcccaataactcttgggtttacgatctccaagttccagagcaccacaacttcatagcgaacggaatattcgtgcacaatagccaactcttgcgttacgttgcaaacttagcccctagggctatatacacctcgggaaagagttcctcagcagctggactctgcgtggccccggataccttgataaataccgacaacggaagggtagagatcgggaagttcgtggaggagtggatgaaggaagttggagagataagcgaggaagggatcagctatgcaccatgcttcaggaaggtcgagacgttcaaagacgggaagatagttgaatcaccaattagaagggtttggaaactgagagctccgaagaagctcgtgaggataaaaacggagaatggaaggagcatagccctaaccagggagaccaagttactaacgataaatgatggagaattatcctgggttgaggccggggaggttaaggtaggaacatacgtgggaacggtaaaaagtgaaaaagacgtgattccaggggctggaaagacaataagggatgtttcaaaactctacaatatggaaatggaagttaaggattacttaaccagggaagaagtgagaaaagccattgaaaagcttgaagaaattatgaatccaatgaatatcaagattcctggggtgcaagaaagttacgaagagctgttaaggaagcttgaaactaccaacgacgagagggttaggaacgagacattgatcctcctaagtgacgttagcgatgcccacgagctcgccaaggaaaaaatcgagaagatcaaagagatcgtgaactcggaagttcactgggagaaagtcactgaagtaggggaagtagatggggttgaatacgtctatgaccttaccgtagagggaagccacaactttgtagccaacggattcatagtccacaacacagctgctgtagttagggatgagttcacgggaggatgggttctagaagctggggctttagttcttgcagatgggggctacgcattgatagatgagctcgacaagatgagcgatagggatagaagtgtaatccacgaagccctggagcagcaaacgataagcctatcgaaggccggcataacggcaacgctaaacgctagaacgacggttatagctgctgcaaatccgaagcacggaaggtttaacagaatgaagagggtgtcagagcaaatagatcttcctccaacgttgctgagcaggttcgacttaatcttcgtcctcatggatgagccggacgaaaaggtagacagcgagatcgctaggcatatattaaaggttagaaggggagagagcgaggtcgtaactccaaagataccgcacgagttgcttaggaagtacatagcttatgccaggaagaacattcatccagttataagcgaagaagccatggaagaaattgagaagtactatgtgaagatgaggaggagcgcgaagaaaagtagtggggatgagataaagccaattccgataactgctaggcaactagaggccctgataaggctaagcgaagcccacgctaggatgaggctcagcccgatagttacgagggaagatgcaagggaagccataaagctcatggagtacacgctcaagcaaatagccgtcgatgaagccggtcagctcgacgttacgatacttgaagttgggcagagcgcgaggaagcttagcaaagtagagagaatacttgatatagtagaaaagctagagaggacaagcgagaagggtgcaaagattgatgatatcctcgaggaagctgcaaagtttggaatagagaagagtgaagcgagggaaatactcgaaaagctactggagaagggccagatttatatgcccgagaacggctactacaaaaccgtctaa

SEQ ID NO: 24935 - DNA, 2061 bp, Pyrococcus horikoshii
atgatcttaataatagcggaaaaaccaaatgttgcaaggaagatagctggggcactttcagagaggaggccaataaagaagtctctcttcggcgttccctactatgaaattttcagggaggggaaaaagctaatagtagcttccgcagttggtcacctctatggtttagcccccaagcgggatgtatttggttatccaatattcgacattgagtgggttccagtttacatagccgaaaagggtaaggagtacgcaagggagtatattaaagccctctcggttcttgctaagagggtgagagagttcatagttgcatgtgactacgatactgagggagaagttataggttacacggccctgaaatacgcttgtggcgttgatcctagggttgctaagaggatgaagttttcagcattgaccaagagagatctattgaatgcttggcgaaatctcgagccaacgataaactttgggatggcaaatgctggaatcgcgagacatatcctagactggtactggggggtgaacctctcaagggccttaacgcatgctataaagaaggcttcgggtaagtgggtggtgctaagcaccggtagggttcaggggccaactctaaagttcctagttgaaagggaaagagaaatacagagttttgttccaaggccttactgggttatcaaactgatatttgagaaaaacggtcaaaaatttactgccaactatgaaaaagacaagatatgggaagaggaagagggaaagagaatagttttagaggttaaaaagagcatcccaagagtttctaatgtagagataaaaagacagaagagaactccccctcatccctttgatctcggtacacttcaaagagaagcctactcagcttttggctttagccctaagaaaactcttgacatagctcagagcctatatgaaaaaggattctcgagctatccgagaaccgaaagccagaagttacccaggaacatcaactttaggatgataattcaaaatcttgcaaagatgcctcagtataggccttatgctcatatcctactgggattaccagaacttaaaccagttgaggggaaaaaggaagatcccgctcatcccgctatttatccaacgggagaaattcctaggccgggggatctaacgaaagatgaagaaaaattatatgatatgatagtcagaaggttcctagctgtatttatggaaccagcgattagggaaagtgtaaaggttaccataagggccggcccccataaatttttcttgtcgggtgggagaacggttaaaaaaggttggctaagtgtctatgggaaatatgtgaaattcgaggaagttacgctccctgaattctttattggtgagaggataaaggtaattcaagttaaaagagaaaagaagaaaactaaacctcctgccaggtattctcccgctgccgtgataaagaagatggaagatcttggccttgggactaaagctaccagagctcaaatccttgaaaccctttatcagaggggttacattgaaggtaagaagagcattaaagttacacctctcgggatgaaagttatagaaacgttggagaagtacgttcccgagatcataagtgttgaattaactagggaattcgagaagaagatggagttgataatggaagggaggctcactaaggaggaggtaatagaggaagccaaagagaggcttaccaagatcctggaggagtttaaaaagagagaactggagataggtatagaactcgctaaaatcgtcgttggtgaggatgaagttaagccccttgtagttggtaagtgtccaaagtgtggcggggatttaatagttaagtacaacaagaagacaggaaagaggttcgttggatgctcaaattggccgaagtgcgatgtaacttatccgatccttcagaggggagaaataatacctaccaataagacgtgctgtaatggtgctccggtagttataatcagggaagaggatgggagagaattcgaaatatgcctcgacattaactgcaaggactggaaagctaaatctcattaa

SEQ ID NO: 24936 - DNA, 1047 bp, Pyrococcus horikoshii
atgtcagaaaagatggtagctatcatgaagacaaagcctgggtatggtgctgagcttgttgaggtggacgttccaaagcctggacctggagaagttctcattaaggttcttgcaaccagcatatgtggaactgatcttcatatatacgagtggaatgagtgggcacagagcaggattaagccacctcagataatggggcatgaagttgcgggagaagtcgttgaaatcgggccaggtgtggaaggaattgaagttggtgactacgtttccgttgaaacgcacatagtttgtggcaagtgttacgcctgcagaaggggccagtaccacgtctgccagaataccaagatatttggcgtcgatacagatggcgtattcgcagagtatgccgttgttccagcccaaaatatctggaagaatcctaaatcaattccaccagaatatgcaaccctccaggagcccttgggtaatgctgttgataccgttttggcaggaccaatttctggtaagagcgttttaataaccggagcggggccccttggattattgggaattgcagtggcaaaagcgtctggcgcataccctgtgatagtctcagaacctagtgacttcagaagggagttggccaagaaggtaggtgctgattacgttatcaatccattcgaagaggatgtcgttaaggaggtaatggatatcacagatggaaatggtgttgacgtatttctggaattcagtggagctcctaaggctctagagcagggtcttcaagcagttacacctgctggaagggtatctctcctgggtctatacccaggaaaggttaccattgactttaacaatctaataatcttcaaggcgctaacaatctatggaataactggaaggcacctctgggaaacttggtatacagtttcaaggctccttcagagcggaaagctcaacttagatcctattataactcataaatataagggattcgacaagtacgaggaagcctttgagctaatgagggccggcaaaacgggtaaagttgtttttatgcttaaatga

SEQ ID NO: 24937 - DNA, 333 bp, Pyrococcus horikoshii
atggtaaagttctgccctaggtgcgggagtataatgattccggataagaagagaggagttttcgtgtgtaggaagtgtggttacgaggaacccattaatcctgaggatgctaaagcctatagaagaactgaggagattaagcataagcccgatgagggagttatagtgatagaacaagacttttcaacgttaccaactgcaaaagttacctgtccgaaatgcggctatcatgaagcctggtattgggaggttcagactagggccggggatgaaccctcaacgatattctataagtgcaaaaggtgtggctacgtatggaggagctacgagtaa

SEQ ID NO: 24938 - DNA, 750 bp, Pyrococcus horikoshii
atgccattcgaaatagtctttgagggtgcaaaggaatttgcccagctcatagagacggccagcaggcttatagatgaagcggcctttaaggtaacagaagaaggaatatcaatgagggctatggatccgagtagagtagttttaattgaccttaacttaccttcgagcatattcagtaagtatgaggtggatggggaagagacgataggtgtcaatatggatcacctaaagaaagttcttaagagaggtaaggccaaggatacgcttatcttgagaaaaggagaagagaacttcctagaaataagcctccaagggactgctactagaacctttagattacccctaatcgacgttgaagagatcgaagtggaattacctgatctcccgtatacagcaaaggttgtcgttctgggcgaagtgcttaaggaagcagttaaagatgcttccttagtaagcgatagcataaagttcatggctaaggaaaatgagtttatcatgagagcggaaggagaaacccaggaagttgaagttaagttaaccctggaggatgaggggttacttgatatagaagttcaagaggagacaaagagcgcttatggggttagttatctagcggatatggtaaagggaataggaaaggccgatgaagtgacaatgagattcgggaatgaaatgccgatgcagatggagtactatattagggatgaaggtaggttaacgttcctgctagccccaagggttgaggagtga

SEQ ID NO: 24939 - DNA, 1170 bp, Pyrococcus horikoshii
atgaataataaggtaataatagttggcgttggcatgactcccgtaggggagcactggaggacgtcacttagagatctggccgttgaagcaattttaaaggccatggatgatgccggaatagacaaagttgactctctgtatgtaggaaacatggcatcaggctcattcatagagcaggaaaatcttggagccctcatagcggactgggcaggtttaggaaacattcccgctgttaaaattgaagcagcttgtgcctcaggtggagctgcggttcaggagggagttaaagcagtactaagcggattagaggatgtcgtcctagtagtcggcgtagagaagatgaccgatgcctggccaagcgatgccacaaggtatttagcttacgcaagtgacgcagagtgggagcttttccatggggtcagcttcgtcgcacttaatgcattagtaatgaggtattacatgaatacttatggatatacagaggaagatttagccctatttgcagttaatgctcacgctaatggggctaagaatccatatgcaatgtttaagaagccgataactgttgaaacagtcatgaaaagcccctatattgcagatccactaaagctatttgatgcatctccagtttgcgatggggcagcggcggtaataataacaactccagagaaggcgaaagaactgggagttccaaaggataagtgggtagaagttgcaggaatgggaagggctatagatacaataaacctagcaaacagggaggatctgttaacgctaaaagccgcaaaaattgcagctgagaaggcctataaaatggcccacgtcgagccgaaggatatagacttctttgaagtccacgatgcatttacaattatggccgcccttagcttagaagcccttggagttgccgaaaagggaaagggagctatgcttgctaaagagggacaaatagccatagatggcgattatccaatacaaacgatgggaggattaaaagctagaggacacccagttggagcaacgggagtttaccaagcagttgaagctaccttacagctcagaggagaagctccaaatggtattcaggttcctgacgctgaagtaggattaacccaaaacataggtggaacgggttcaaatataaccgtcacaatcttcaggagggtttga

SEQ ID NO: 24940 - DNA, 2523 bp, Pyrococcus horikoshii
atgatactcgggaggagtgagcctcaaaaggaggagatcaagcttagggtagctgaggcccttaagcgtgacgttggtagggggattgttagatttgatagacgctatcagaagatgataggcgttgagccgggggatatagttgagatagagggagagagggtaacagcagctatcgttgcgaactcccatccggatgataaagggctcgacataataaggatggatggttatataagaaaaaacgctggagttagcattggagattacgttaccattaggagagctcaagttaaagaggccaaaaaggttgtccttgctcctgcgcagaagggagttatagtccagattcctggagatattataaagaataaccttctcgggaggcctgtagttaagggtgacatcgtagttgctagtggtcgtggggatttatactattctagcggaactccattcgatgagatcttcaggggattctttgaggccatgtcggtcggctttggagagcttaaattcatggttgtaaataccattccaaaagggatagtccagataacatataacaccgaagtcgaggttcttcctcaggccgttgaggtcagggaagagaagatcccggaagttacctatgaggatattggtggccttaaggaggcaatacagaagataagggaaatggtcgagctacccctaaagcatcctgagctctttgaaagactgggtattgagcctcctaagggtgttcttctttatggtcctcctgggactggtaagactctcttagctaaggccgttgctaatgaggctaacgcttactttatcgcaataaacgggccagagataatgagcaaatactacggagaaagcgaagaaagattaagggagatatttaaggaagctgaggaaaatgctcctgcaataatcttcattgacgagattgatgcaatagctccgaagagggaggaggttgttggtgaggtagaaaagagggttgtctctcaattgttaactttgatggatggtttgaagggtaggggtaaggttattgttattggggctactaataggcctgatgctttggatcctgctttgaggaggcctgggcgttttgatagggagattgaggttggagtgccagacaagcaaggaagaaaagaaatactacaaatccacacaagaggaatgccaatagaaccagacttcgagaaggatgcagtaataaaagtcctcaaagatttggagaaggatgagaggtttgagaaggagaagattgagaagataatcgagaaggtttcaaaggccaacagcgaggatgaaataaaggagatactcaaggaggacgggaacgtatatgtagaggttagaaacaggctaatagataagttgcttgaggaattggctgaggttactcatggtttcgttggcgctgacctagcagcactagccagagaagcagcaatggtcgtgcttagaaggctcataaatgagggtaagataaatccagaggccgaaagtattccaagggaggttctcgaagagttgaaggttacaaagagagatttctatgaggctttgaagatggttgagccttctgctttgagggaggtcctcatcgaagtcccaaacgtccactgggatgacataggcggattagaagaagtaaaacaagaactaagagaagcagtagaatggccactaaaataccccaaggcgtttaagaaactcggtataactcctcctaagggtgttttgttgtatggtcctcctgggactggtaagactctcttagctaaggccgttgctactgagagtgaagccaacttcatagccgttagaggcccagaagtattaagcaagtgggttggcgaaagcgagaagagaattagggaaatctttaggaaagcaaggcaagctgcacccgcaataatctttattgatgagattgatgcaatagctccggctaggggaacttctgagggtgaaaaggttactgataggatcattaatcagttgcttacggaaatggatggactagttgagaacagtggtgtcgtcgttattgctgctactaataggcctgatattttggatcctgctttgttgaggcctgggcgttttgataggcttattttagttcctgctcctgatgaggaggctaggtttgagattttcaaggttcacactagaagcatgccattagccgatgacgttgatttaagagaattagcaaggagaacagaaggatacacaggagcagacatagcagcagtatgcagagaagcagccctaaacgcgctgaggagggttgttaagagcgtgccaaaggagaaattggaggaggaaagtgaagagttcctcaataaattggtagtcacaagaaaggattttgaagaagcgttgaagaaagtcaaaccgagtgttagcaagtatatgatggaatactatagacaatttgaagaggcaagaaagagggttagtggagagtccgtaggaagggaaccagattactttactggataa

SEQ ID NO: 24941 - DNA, 1926 bp, Pyrococcus horikoshii
atggaggagcttcagtacttcccatatgaaaagttcaggccgaatcagagggaatttatcgaaatagttaaggaagccgtaaaaagaggagagaaccttattgttgaggctccaactggatttggaaagacaataagcgttttagctggggtgcttccctatgctatctcgctgggctataaagtagtgtatttagctagaactcataagcagatggatagggtgatagaggagctcagaaagatcggggagaaaagcgaagttagtggaatagagtttaggagtagaaaagatttatgccttcacgcctatattcagacctttgcccaggatgcttacactagtatgatagtgtgtaagagtctaagaaagcttggaaagtgcaagtattatgaaaacttaaaggagaagagggatagggttgatgaaattgtaaaattcttcttaagctttcccccctttcctcgtgaagttattgagtatagcgaattacttgagctctgtccttatgagattacaaagaaggttggtgagaaagccaacgtcgttgtggctagttacttatacatgataagccccccaataaggcaggcattcttggaaaacctaggtgttgattattcagatttgatagtgatattcgatgaagctcacaacttgcccgatcaggctatttctgcacttagcgatagattaagcgtgagaagtatagaaagggccattaaagaagccgaagagtacggggaaaaagatatcgaaaacttcctctcgatattactaaggggtctagaaatcttatataaagaaaagttagagaactatgaaagtgaagagatccccataaggccagaggaggtgtttcttcacccagcttccatcctggggtggaggggaagagatattggaatgatgctagaggatatgatcgaggttggtgatgccattagggaggatagaatagaaaggaatcttcctcctaggagttacgttggaagagttggagagtttctgtggaattggctttcccttcgagatagggaagactacttacacctattcacaaaagaaaaaggcttagccttggagttagtggccctcgatccttccgttgcccttgacttccttgaggaggttcactctgcaatatttatgtccggaactctcagccccctagaggcatttagggatataattggtgttaatgctagactaaagaagtttcccagaattgtaaagagggaaaatgctatcgtccttgtggcgagagatgtatcaaccagagggatagagagaagtcctcctctgtataaaaggatcgcggaatacatatttgaagccgtcaaaaatactccaaaaaatgttggagtatttacggcttcctatgaggttcttgagggagttctaagtactaatgttcacataaagattgaggaagaagtcggaaagaaagtcttcatagagaaaaaagatgctccttccagggaaaacgatgagatgattagggaattcaaggaagaatctaaaggaaaaggtgcggtactatttggtgttatgggagggaggaacagtgaaggtcaggactattcgggggatgaaatgaatggagtcatcttggttgggatcccttatgcaaggccaactcccagggttcaagctcagacaaggtactttgaaaagaaatttcctgggaaagggaggtattatggatatatcctaccagcccatagaaagctagctcaagctgcaggtagggttcataggtctgaaaatgaaaagggtagtatagtgatcttagactacagagtcctatggaaaaacgttaagaaagacctccccgactggatggtagaaaccatgattcccgtaacattacccaccctaaggattaagcttaggagattttggagggagaggttaaatgagtaa

SEQ ID NO: 24942 - DNA, 483 bp, Pyrococcus horikoshii
gtgtttcagatgagtgaaactgaaagaaccctggtaattataaagcctgatgccgtcgttaggggccttataggtgaaataataagtagatttgagaaaaaaggcctcaagattgtaggaatgaagatgatatggatcgacagggagctagctgagaaacattatgaagagcacagggagaagcccttcttcaaggccttaatcgattacataacaaaaacccctgttgtagttatggtactcgagggaaggtatgccgtggaagttgtgagaaaaatggccggagcaacggatccaaaggatgctgcacctggaacgataagaggggattttggtcttgaggtcagcgatgctatatgtaacgttatacatgccagtgactccaaggagagcgctgagagggaaataagtctattcttcaaacctgaggaattatttgaatatcctagggcggccgattggttctataagaaaggtatttaa

SEQ ID NO: 24943 - DNA, 927 bp, Pyrococcus horikoshii
atggagtggaaaggtagggatgttataagcattagggacttttctaaggaagatatagaggttgttctttccacggccgagaggttggaaaaggagatgaaggaaaaggggcaattagaatatgctaagggaaaaatattggcaacattattctttgaaccatcaactagaactagattaagctttgagagtgcaatgcaccgtttaggtggttcggtaataggatttgccgaagcttcaacaagtagtgtcaagaagggagagagcctgagggataccataaaaacagttgagcagtattccgatgttatagtaataagacacccaaaggaaggagctgcaaggttagctgctgaggttgcagatattcctgtgataaatgccggagatggaagcaatcagcatcccacgcagacgttactggatttgtatacaattaaaaaagagttcggtaccattgatggacttaagatagggttacttggggatcttaagtacggaaggacggtacacagcttggccgaggccctagcattttatgatgttgagctctatttaatctctccagagctattgagaatgccaaagcatatagtggaagagctaagggagaggggaatgaaaatagtcgaaaccactaagctcgaagaagttataggtgaactagatgttctttatgtaacgagaatccagaaggaaaggttcccggatgaacaggagtatttgaaggtcaagggaagctaccaggttaatctaaaaatcctggaaaatgttaaggatagccttagaataatgcatcccctaccaagggttgatgagatacatcctgaagttgataaaacgaagcacgctatatactttaagcaggtgtttaatggagttcccgtgaggatggccctcttggccctagtcttgggggtgatttga

SEQ ID NO: 24944 - DNA, 459 bp, Pyrococcus horikoshii
atgcctgagcttaaggtttccgcaattaaggagggaaccgttatagatcacatcccagctggaaagggacttaaggtaatagaaatacttggactaagtaagctttccaatgggggttctgttttattagcgatgaacgttccaagcaaaaagctggggagaaaggatatagtcaaagtcgagggaaagttccttagtgaagaggaggttaataagatagcactcgtagctcctacagctacggtgaacataatcaggaattacaaagtcgttgagaagtttaaggttgaagttcccgaagtcattgaggggatattgaagtgtggaaatcccaactgcataaccaactatgaatacgttacgacaaaattctacgtgataagcaaaaacccattgaaggttcggtgtcactattgtgaaagaacgatggaagaagaggagatcttggctaacctttga

SEQ ID NO: 24945 - DNA, 954 bp, Pyrococcus horikoshii
atggtagttagcttaaagggtagggatcttctctgcctccaggattatactcctgaagaaatatggacaatcctcgagacggctaagatgttcaagatctggcagaagataggaaagccccacagacttcttgaagggaagactttagccatgatattccaaaagccctcaactagaacaagggttagctttgaggttgcaatggcccacttgggcggtcacgctctctacctaaacgcccaagaccttcagcttaggaggggagagacaatagctgataccgctagagttctcagcaggtacgtcgacgctataatggctagggtttatgcccataaggatgttgaagatttagctaagtatgcaagcgtcccggttataaatggtttgagtgacttctctcatccatgccaggctttagctgattacatgacaatttgggagaagaagggaacgataaagggagttaaagtcgtatacgttggcgatggaaacaacgtctgccactccctaatgatagctgggacaaagcttggtgctgatgttgtagtggcaactccagagggttatgagccagataaaaaagtgattaaatgggccgagcagaatgcagctgaaagcggaggaagctttgagcttcttcacgatccagttaaagccgtcaaagatgccgatgtgatatacactgatgtgtgggcttcaatgggccaagaagctgaggcagaagagagaagaaagattttcagaccgttccaggttaacaaggatcttgtcaagcacgctaagtctgactacatgttcatgcactgcttaccagcccataggggagaagaagttactgacgatgtcatagactcaccaaacagcgtcgtttgggatgaagcagaaaataggttgcatgcacagaaagcagtcttagccttattgttgggaggagttaagactggcttctga

SEQ ID NO: 24946 - DNA, 1128 bp, Pyrococcus horikoshii
atgacattcttcctaaagactaccatattaatgggtaggggatcccttgaaaatataaaaaagcttgtatctgaaggtgagagggtactcgtcttttcttcaaagtctatggataggcttggctttttaaaagaggtaattgactatttagacgaagcaggtgcaacctatgaaagtattacgggattaccttccgagccaagcattgaaaacgttgaggaattgctcccaaaggtcaaggatttctctccggaaaccttcatagcactcggtggagggagcgtgatagatatctcaaaagccctgaaagttttctatgatgctcctgaacttgattttgacagtgttgcaatatttagcagatttaaaaaagctcaacctcttccaaagcttaaaacaaagcttatagccgttccttctacgagtggtgcagggagtgaagtatccgctgcgaccgtgataaagaagggggatatcaagtacacgatagtgagtccagagctttgtccaaattatgcaatcttggatccgagactccccgagaacatgcccagggaagtagctaggaactctggattagatgtattagttcatgccatagaagcttacgtttcaaaggcatcaacaccttttagtgatgctatggccgtaaaagcagcaaggacaattcttgaaaagcttgaagatagcgttaatggcgatcctaccgctagagaagaagttcattatgccgccactatggccggaatagccttcctaaatggtagacttggactcgtccatgcaatgagtcataaagcagcgtggattggccctcatggattgattaatgcgatactactcccatatgtaatggagttcaatatggaaaaagctagagaaaagtacgatgcaatggccaaggaacttgggctttccaatgctgaagaacttcttcagaaggttaaagagctcaatgaaagattaaacgttccaaagttatcggaaatagttagcgaggaagatttcacttcaaggcttgatgagatgagcagaaaggcttacgaagatcccctggttaacttcaatccagtggaaccaagcgttgatgatataaagaacatctatctgagggccttccatgattga

SEQ ID NO: 24947 - DNA, 1176 bp, Pyrococcus horikoshii
atgagagaaaagaggaagtattttatcgctgagagggtcctccttatcaaaagatcgaaaataagagaattattcgaaagagcttctaaaatggaggatgtaatatctttaggaatcggagaaccagactttgatactcctaaaaacataaaagaagccgctaaaagagctctagatgaaggatggactcattacactccaaatgcaggaattccagagctaagagaagccgtcgttgaatactataagaaattctatggaattgatatagaggtagaaaatgtgataataacagctggagcgtatgagggtacttacttagcctttgaatcattattggagagaggagatgaagttataataccagatccagcttttgtttcatatgctgaagatgcgaaagtcgcagaagcaaagccagttaggattcctttaagagaggaaaacaatttcttacccgatcctaacgagttgttagagaagatatcaaagaatactaggatgatagtgataaactatccaaataatccgactggggcaacgctagataaggagttggcaaagacaattgcagacatagcggaagattacaacatttacatactaagtgatgaaccctatgaacatttcatatacgaggatgcaaagcattatccaatgataaaattcgcaccagagaatacaatacttgcaaattcattctcaaagacgtttgcaatgacgggctggaggttgggatttgtagttgctccttcccaggtaattaaagaaatgacaaagttacatgcatacgtaatagggaatgtagcttcgtttgttcaaattgctggaattgaggcattaaggagcgaagagagctggaaggccgttgaggaaatgaaaaaagaatacaatgaaaggaggaaaattgttgtaaaacggctcaagaatatgccaggaataaaggttaaagaaccaaagggggcattttacgtattcccaaatatatccggaactggaatgtctagtgaaaaattcagtgaatggttattggagaaggctagagtggtcgtgatcccaggaacagcgttcggtaggatgggtgaaggttacgttagaataagctacgcgactagtaaggagaaactcatagaagctatgaatagaattgaaaaagccttggagggtgaaaagtga

SEQ ID NO: 24948 - DNA, 1425 bp, Pyrococcus horikoshii
atgccttttctacccttttcttattaccctttttctttggaggtgattctaatggagtacccaaagatagttgttaaacctcctgggccaagggctaaagagttgattgagagggaaaagaaagtattatctacgggaattggagtgaagctatttccattggttccaaagagaggctttgggccttttatagaagatgtagatggcaacgttttcatagacttcctagctggggccgccgctgcatccacaggatatgctcatccaaaacttgttaaggccgttaaagagcaggtggaacttatccagcattcaatgataggttatactcatagtgaaagagcgataagggttgctgaaaaactcgtggaaatctctccaatcgaaaattctaaggtgatttttggattgagcggtagcgatgctgttgatatggctataaaggtttcaaagttctcaactaggagaccttggatactcgccttcataggggcctatcatggacaaactctaggggccacttcagtagcatcattccaagtttcccaaaagaggggctactccccattgatgccgaacgttttctggataccttatccaaatccgtttagaaacatctggggcataaacggttacgaggagccagatgaattgataaatagggttctagattacctagagtattacgtcttttctcacgttgttcctccagatgaagtcgcggcattatttgctgaaccaatccagggagatgcagggatcgttgtccctccagagaacttctttaaagagctaaagaagctacttgaggaatatgggatactacttgtaatggatgaagttcaaacggggatagggagaactggaaagtggttcgcaagcgaatggttcaatgtaaagccagacatgataatatttgggaagggagtagcgagtggaatgggactgagcggagttatagggagaaaagagatcatggatataacgagtggttcagctctgttaactccagctgcaaatccggtaatttcagctgcagcagaagctaccctcgagataatcgaggaggaaaatcttctcaagaatgcccttgaggttggagaatttataatggggaggctaaaggaaatcaaagagcggtttgagataattggagatgtaagaggcaagggtttgatgataggagttgagatagtcaaggagaatggaaggccggatcccgagatgactggtaagatatgctggagggcattcgagcttggcttgatacttccgagttatggaatgttcgggaacgtgatcagaataacgcccccactagttcttacaaaagaggtcgcggagaaagctcttgaaattatagagagggcaatcaaggataccttaactgggaaggtagagaggaaagtagtaacttggcactga

SEQ ID NO: 24949 - DNA, 939 bp, Pyrococcus horikoshii
gtgataaaaatgaacgtcgttatcgaggccataaatctaactaaatattatggtaactttccagcagttaggggggttaccttttccgtcaatgaaggtgaagtcttcggcttcctaggccctaatggggccgggaagaccacaactataagaatgctaacgggcgtgctaaaacctacctccggtcaagtaagagtcttgggatacgatatgactcgcgagcctgaaaaacttaaagctcggcagagaatggggatcgttccagaaatggccaatccttatattgatctaacggctatgcagaaccttaagctcatgggagagctctatggtttgccgaagtgggaaatagaaaagagaagtatagaattactaaaactcttcgagctttacgagaagagaaatattaaggtaagaggcttttcgaagggaatgagacaaaggttagttttagccatggccatgatagcagatcccgaactatactttcttgacgaacctacaagcggccttgatgtaataagtgcacgcataataaaggatataatcagggatgagaagaaagctggaaaaactatcttcttaacgactcataatatgaatgatgcaaatgagctctgcgagaggataggaataattaggaaagggaagctcgtggccatagataccccagagggcctgaaaagacttactaaggagcatctttccgttgaagtttcacttaagccaatgatgtttgacccatcagtcttaagttcagcactccgagttgaaaggttaggggacaaagtaaaaatttacacaaatgatccagataaaacagtaaaggaaatcgtagaatacgctaaggaaagaaaattaaagatagtaagtatcagaactttgtccccaagtctcgaagatgtgttcgtagagataataggtggtaaaaatgattga

SEQ ID NO: 24950 - DNA, 1716 bp, Pyrococcus horikoshii
atggttgaaattatagacacgacgtttagggatgctcaccaatctcttatagccacgagaatgagtacgaaggatatgcttccaattgctgagaagatggataaaataggcttctattctatggaagtttggggaggggcaacttttgatgtttcactaaggtttctgagagaagatccatgggagagattaaaactcctaagggaacatataaggaagacaaagcttcaaatgttgctaaggggtcaaaatctagtaggatataggcactaccctgatgatgtcgtggaaaaatttgtagaacttgcttataaaaatggtattgacatttttagggtatttgatgccttgaatgatgttaggaacatgaagacagcaattaagaaagccaaggaaatcggtgctgaagttcagggggcgatatgctataccaccggtccaatattcacaatagactactacttacagaaggttgacgagcttatcgagcttgacgtggattacataacaattaaagatatggccggattggccgaccctcaaacagcttacgagctcgtgaaggaaattaaagagcgttatggaatcaaggtaaactttcatacacatgcaacgagtggtttagcggtggctacttatcttaaagcagttgaagctggagtcgattacattgatacttcaatttatccactagctgggggaactgctcagcccgcggttcaaacgatgtactatgcacttccaaaagggaaaaggccgaaacttaatataaagctaattcacgagatttccaagtacctgacaaaccttctagagaagaagtacgatcacttgctgaccaaaaaggccatacatggagatccaaatgtcctaatccaccaaatcccaggaggaatgtattctaatttaataaagcagttaagcgagctcaaagccttagataagttagaggaagttctagaggaggtaccaagggttagggaagatctaggctatccaccgttagtgaccccaacttctcaaatagtcggggttcaagcggttctcaatgttctctttggaaggtataaacaggtcaccaaggagacgaaggattacgttaggggactttatggaagacctcctgggaagataaaggaggaaattaaaaagcttatccttggtgatgaggaacccataaacgttaggcctgctgatctacttgaaccaatgcttgagaaagctaagaaagagcttaaggagaagggttaccttgaaaaagaggaagatgttgtaacttattgcctctttcctcaagtagctttggaattctttgagctcagaagacagggaagacttagaccagttgaagagaagccgaaaggaaagccaataaagatttacatcaacgggaaggaattcgaggttttcgtcgaaggaatagaatttgagcctcctaagcccaagccccaagttcaagctatcccttcacaacctcccaagcgggaggtagtagcccctagcgggagcgttgtttctgctcctatgcctggtaaggttttgagggttcttgttcgggttggggatagggttagggttggtcagggtttgcttgttcttgaagccatgaagatggagaatgagattccatcaccaagggatggtgttgtcaagagaatactagtcaaggaaggagaagcagtcgacacaggacaaccactaatagagttagaatag

SEQ ID NO: 24951 - DNA, 2571 bp, Pyrococcus horikoshii
atgactaacccctggaaaattttccttgtgagttacgctcacatagacagtgaatggctctggaaagtcgatgagactgttaatatttgcaagctcaccttcgaaaatactctcaaacttatggaaaagtataacttccttacctttgctcacgggccagttttctattatgaacttatggaaagtcattatccaaacatctttaggaagataaaggaaatggtagataggaagcagtggaagatcatagatggatcctacgtagagttcgatgccaacatcccctctggagagtctctgatcaggcagtttctatatggaattaagtaccttgaggaaaaatttggagtaaagcctagaaccctttaccttccggactccttcggcttccctccaaccttacctaaaatactgtgtgaggttggaatagaaaacttcgcaacgagtaagcttaattggaacgatacaaacccctttccataccatatatttaggtggaaaagcagaagtggagaggaagttctagcttacagcactccaggaagttatagcgactatctttcggatattaaaaggatactctggaacgtggagcaacagagggaaaagcaggagatcccagttattatgcaagtctttggtaggggagatcatgggggaggaccggaagaaatcgaggttcagaacgttaaaaagtggatggaggaatataagggtaggctggaacttattgcatcggggatggatgagttcttcgattatgtgagggagcactacctgaaagatcttcccatcttcgaggatgagctctaccttgagtttcatcgaggcatctttactacgggggcatggataaaaaggttcaacaggctaaatgagcacctgatccttcaagtggaaaagctgtactctcttctgaagattctctatggtattgaatatccctgggaaggaatccttaattcctggaaggcgatcctccttacccaagggcacgatgccttacctgcttctataactaaggaagtttacgatgacgtaatgaggaggagctccaacgtgtacaagggtcttttatccttcctcagaaatgggttaaaggttatagctgagaaggaaaaagcccgctacatcgtctttaatccaaactcgttccctgtttccccctatataaggacatgggaaagcgttaatggcttctatcaaaggcttaaaaatgggagtaagctggtttacctttcagaactacccccgattggatttaaaggctatgaagaggtgggggaaaggccggaggacttcgtgaacattgtggaaagggagaaggattttatacttgagaactcctatcttagggttactgtgtctaagagaacaggttggataacgagcatctatgataagaagaacaagcgagaaatcctcaaagaaccaatacgacctaggattatgttagattatccaatgccttttagaggtcgctttgtgccagcttcaatgtttgatgcatgggaggtttattacagggaggggataaataagtactttcaccgtgacctcagggctaaagaagtttttatctcagagagaggtccgctttacgcttctatctcagctaaattccattataagcagttcctaggaaaggcctcaactatggaatttgaaattggcctctatgcagataaaccttacgttgaggtgaggtttagagctcactggaatacccaccatcgcttcttgaagcttttagttccagtagccattgattcagacaaagcggtatttgaagtcccctatgggatcgttgagagagctgatgcctgcagatctgaaaatcctagggagagggcgaaatacgaggttttggggcataagtgggttgacatctccgatggaagttatggtgttgcagtaataaacgattctaaatacgggttcagttggtgcaatggggttctgagaattagcttgttaaggtctccctcccagccattagctgacttcataatgaagttcattcgcatgaataagaaggcccaggagaagttccaggatattaagctccaaaagtccggaaaattaaagagggaaattataaatataataatttggctcatggttctcttcaatgagcttaggaacaaaaagaaagtaactccgatagatagaggttatcacatagccacagtgtgggtgtatcctcatgagggaaattacgtgaagggtaacgttccaatgcttgctacggagttaaacacgctttacatccttcaaaagggatcaggaagtagctctaccatctggaactttataaacgtggaacctcaggaaaaacttcaagttgtaaccgtgaagccatgcgaaaatggggattgctttgttttaagactcttcaatccaacagatgaacgccttaaagcgattctaagatttaacgttaaggttaagagtgctgccgaggctacccacgatgaaaggtttctcagggggctccctgtgagggacaactccgtggaggtatctctaggttcttatgaagtgagaaccttactcatcaccgtgttgtga

SEQ ID NO: 24952 - DNA, 864 bp, Pyrococcus horikoshii
atggaaggcgtaatagttcccctaataacaccgtttaaagaggatcattccatagactttgaagccctcgaatggctcataaaattcctagaggaaaagggagttcatggaatattcatcaactctaccactggagagtttacaagcttaagcctagaagaaaggaagatactagctgaaaagggaagggaagtcacctctagaacttacctagttggtactggttcaactagcacgtttgaagtaatagagttgacgaagcatgcgaaggagataggggccgatggtgttgtgatagtttcaccatattactgcagacttaaggaagatgccatatttaagcacttttcaatggttgctgagaaggttgacatcccaataatcctttatgcgatcccctcctgtgcaaatccaataagcttagaagttgtaaggaagctagctcttgaatattctaatgtaattggggtaaaggccagcgttgatagcttgacgtaccttagtgggttaattgagataaaagaagagagaaaggacttcaaagtctttactggattagaccagtacttcctccccaatttaatcctgggaggcgatggagggataatggcgtgtgcgaactttgtcccagagatccacttggaagtttggaacgcatttaagaagggtaacctcgagaaagctatgaattctgcaagaaagcttgtcaagataactaaaatctacagcatagcatcctcctttgcctcagcggtaaagcttgcaatggttgctaggggatttcctataaaacccatcttaaggcctccttacatgatggatggggaagaggttttcaaaaagattaaggaaatcgttagctag

SEQ ID NO: 24953 - DNA, 1353 bp, Pyrococcus horikoshii
atggcggttcacccaatagattaccgctacggtagtgaggagatgaggaagatatgggatgaaaagaacaagttgcaaaagctacttgacgttgaagctgccctagcaagggctcatgctaaggtaggaaacattccggaagagagcgctaaggttatttcggaaagggctaatacaaagtgggttaagcttgagagggttaaggagatagaggccgagatccatcatgatataatggccgtcgttaaagcgttaagcgaggtttgcggagaacatggaaagtacgttcatcttggggcaacttctaatgatataatagatacggccaatgcattgttaatcaaggaaagccttgagatagttgaaagggatcttaaagagcttagatccattttgaagcagcttgcggaaaagcatataggtacggtatgcatagggaggacccatggccaacatgcagttccgacgacttatggaatgaagttcgccctgtggcttgatgagatccagaggcatatagagaggttataccagcttaaggagagggttctcgttggtaagatgagaggggccgtgggaactgcggcctcatttggagaaaaagcctttgaaattgagagattggtgatggaagatcttggtctcaagcctgcaaggataacgaatcaaatagtgcaaagggatgtctacgctgaactacttttcttcctggctttagtggcttcaactctggataagatggggttggagataaggaacctgcagaggactgaaatacttgaggtaagcgaacccttcggggagaagcaagtaggttcatctacgatgccccacaagaggaaccccataagaactgaaaaggtctgtggacttgcgagggttttgtactccaacgttattccggcgttgctaaataacccactctggcatgagagggatttgacgaattcttccgttgagagggttatccttccagagagctttgtattgcttgatgagatgctcaagaccatgaagaaggttttaactggactggagttcttccccgagaacataaggaggaacttgtatttaacaaagaacttgatcatggccgagccccttatgttaaagcttgccgagaaaggaatgggaagacaggaagctcatgaagtagtaaggcaacttgcaatgaaagctttccgtgaaaacagagacctcctggaagttgcaaaggaaagtagagaaataactaagtatctaaccgagagagatcttgaggagctaaaaccagaaaattacattggcaaagcaagggaaatagtcaaaaaagtcattgaatatgttgaggagatggaaagaaggggattataa

SEQ ID NO: 24954 - DNA, 1080 bp, Pyrococcus horikoshii
gtggtggagaaacctgtcgttataaagtttggaggaacttcagtaaggtatgcctttgaagaagcactagagctagttgcgaagttacatgaaaacatgaaaatcattgtcgtcgtttctgcacttgcaggagttacagattgcttgttaaggctcgcaaagggggataaatccgctcttctggaaattgatgaaattcacgaagaactatcccaggaactcaacgttcagcttgagcatttaatacatcaacttaaaaagacgataaattctaaatcaagtttcccctcagaaaaggcatttatagacgaaatagcatcttttggagagagattttctgccaaactattctcagagggtcttaaaatactcggaattaccgccaggcctgttgactctaaggatgttctctttgttaaaggggagtttggaaatgcagaagtggagtttaagaagagtgctcagggagtagatgttctctatcgcatgcttaggagaggaatcgttcctgttgttactggatactatggaaatctgaacgggttccgagcaacttttggaagaggaggaagtgattattcggcaacatctatagcgagtctagtaaatgctaaagccgttctaataatgagcgacgttgagggaatttatactgcagatccaaagctagtgcctcctgcaagactaattcattacatttcctacaaagaagcaaaaacagctgcaaaattgggtatgaaggttcttcatccaagagccatcgatccagtagaaggaaagatcccagtcattcttggaaaaactagggatctaaaatttggaacgctaatttctcatgaatcccagggaattccaattgttacccacaagttactagaaaatcatgccgaaatatctgttgtatcagttaaaacaaatattcccttaccttacgaagtttatgaggaaggagatctatactttaagataaaaacttccaaggatcagtttctggaagttttaagggacgtgcacaggagagttgttgaaaatgagaatctgcactccagccacgatggtgaactttggacttgggtttga

SEQ ID NO: 24955 - DNA, 1971 bp, Pyrococcus horikoshii
atgaacataaagagcttcataaacaggcttaaggagttagttgaaatcgagaaggaagctgaaatagaggctatgaggttagagatgaaaaggctcagcggagtggagagggaaaggctaggtagagcaattctcaacttgaacggtaaaatcgctggagaggagctcggctacttcttggttaagtacgggaggaatagggagataaagaccgagatcagcgttggggatttggtggttataagcaagagagatccgttgaagagcgatctcctgggaaccgttgttgagaaggggaagaggttcatcgttgttgccttagaaacagtcccagagtgggcccttagggatgtgagaattgatctttacgccaacgacataaccttcaggagatggctcgaaaacctcgacagggttaagaaggctgggaaaagggctttggagttttaccttggtttagatgagccttcccaaggggaggaagttagctttgaaccatttgacaagagcctaaactcctctcaaaggaaagcgatagctaagggtttaggtagtgaagacttcttcctaatccatggcccgtttggaaccgggaagacaaggactttagttgagctaattaggcaggaagtgaagagggggaacaaagttctagctacagccgagagcaacgtggccgtggataacctagttgaaagattagctaaagatggagtcaagatagtcagggtggggcacccaagtagggtttcgaggcatttacacgagacaaccttagcttacctcattacccagcacgagctctacggcgagcttagggagctaagggtgatagggcagagcttggccgagaagagggatacttatacaaagccgaccccaaagttcaggagaggattaagtgatgctgagataattaagctagcggagaggaggagagggatcagaggactctcggccaggctaataaaggagatggccgagtggataaaactaaacaggcaggttcagaaggcctttgaggatgctaggaagcttgaggagagaattgcgagggatataattagggaagctgatgtaattttaacaactaactcttccgcggcccttgaagtcgttgatgctaccgattacgatgttgcgataatagatgaggcaactcaggcaacgataccgagcatattaattcccttgaataaggttgataggtttatacttgctggagatcacaagcaacttccccctactatcttaagcttggaagcccaggagctctctcacacgcttttcgaaggtttaattgagaggtatccgtggaagagcgaaatgctaacaattcaatataggatgaacgagaggataatggagtttccgagcaaggagttttacgatggaaggatagttgccgatgaaagggtgaaaaacataaccctgggagacctcggaattaaagttaacgccaccggaatatggagggatatcctagatccaagcaacgtcctcgtattcatagatacttgcatgctcgacaataggtttgaaaggcagaggaggggaagcgaaagcagggagaatccattagaggctaagatagtgagtaaaatcgtagaaaagctcttagaaagtggagttaaagcggaaatgataggagtaattaccccttacgatgaccagagggacttgataagcttgaacgttcccgaggaggttgaagtcaagacagtagatggctaccagggaagggaaaaggaagtgataattctatcatttgttcgctctaacaaggtgggagagatcggctttctcaaggacttgaggaggctaaacgtgtccttaaccagggctaagaggaagcttatcatgattggtgattcctcaacgctttcatctcacgaaacttacaagaggttgatagagcacgtgagggagaaggggttatatgttgtgctaacgaaggatggcattaggtga

SEQ ID NO: 24956 - DNA, 975 bp, Pyrococcus horikoshii
gtgaataaggtggaggctataatagtggagaacctcgttaaaaagtatggagactttgaagctgtaagggggatatcctttaaggtaagacggggtgaaatattcgctttcctgggaccaaatggagctggaaaaacgacgacagttcatatgttaaccacgctactgaagcccacttcgggaagagcaatagtagctgggcacgatgttgttaaagaatccagggaagttagaaagaagataggagttgtttttcaagatccaagcgttgaccgagaactaacggcctgggaaaatatgtacattcatgggaggatctacgggcttaaaggacaagaactgaaaaagaagattgaagagttgttaaaattcgttgaactctgggagtttaaggataggcaggtaaaatacttctctggaggtatgcaaaggaggctggagatagcgagggctttaatccatgagccggaagtcctctttttggatgaacctacaatagggctcgatccccagacaagggcccatatttgggagtacatcaagacgatgaaggaagagcatgacatgacgatattcctaaccactcactacatggatgaagctgagcaacttgcagacaggatagcaatcatagaccatggaaagataattgctgagggtacggctgaggagctgaagaagttggtaggtaatgatataatctacgttaagtttgagaaaccgacgtgcatacaagccgagttcataaggggatgtaaggttctcaacaacggaagggttgccctagaagttaagaacgcagcagaagctttacccctggtctttgaaaaagctagggagatggaactcaagattttagaagttacttatcaccgtccaacgttaaacgatgtgttcttgcacttaactggtagagaaataagggatgaagcttctgaaaagccaacaatgccaataaggaggtggaggagatga

SEQ ID NO: 24957 - DNA, 1368 bp, Pyrococcus horikoshii
atgggaaagctctttggtacctttggcgttagagggatagccaacgagaagataacgccggaatttgcaatgaagataggaatggcctttggaaccctactcaaaagggagggaaggaaaaagccacttgtagttgtcgggagggatacaagggttagtggagaaatgctgaaagaggctttaataagcggcctcctaagcgttggctgtgacgtgatagatgtaggcatagcaccaaccccagcggtgcagtgggcgaccaagcacttcaatgccgatggtggtgcggtaataaccgcaagccacaacccaccggagtacaatggaataaagctcttggagcccaatggaatgggtcttaagaaagagagggaggctattgttgaggaactattctttaaggaagatttcgacagggccaagtggtacgagataggtgaggttagaagggaggatataataaagccctacatagaagcgataaagagcaaggttgacgttgaagctataaagaagagaaaacccttcgtagttgtagacacttccaatggggccggatcactaaccctaccttacctgctaagggaactcggatgtaaggtaattaccgtaaacgctcagcccgatggatacttccctgcaagaaatccggaacctaacgaagagaacctcaaggaatttatggagatagtcaaggccttaggtgcggatttcggagttgcccaggatggggatgcagatagggcagtattcatagatgaaaacggaagattcatccagggagataagacgtttgcacttgttgcggatgcggtacttaaggagaagggtggagggctactagtcacaaccgtggcaacttctaacctgttggatgacattgcaaagaagcatggggccaaggtcatgagaactaaagttggcgatttaattgtagctagggccctctatgagaacaacggaacaataggtggggaggagaacgggggagtaatatttccagagcatgtgctgggaagagatggagcgatgaccgtagctaaggttgttgaaatattcgctaagagcggtaagaagttcagcgagcttatagatgagctacctaagtactaccaaataaagaccaagaggcacgttgagggagatagacatgcgatagtcaataaagtggcagaaatggcaagagagaggggatacacggttgacacaacggatggagctaagataatatttgaggatggatgggttctggttagggcgagtggaacggaacctataataaggatatttagcgaagcaaagagcaaagagaaagcccaggagtatttaaacctgggaattgagctgcttgagaaagcactttcatga

SEQ ID NO: 24958 - DNA, 2640 bp, Pyrococcus horikoshii
atgaaaatcgagagagttatcgttcagaattttagatcgcataagaatagcgagatcgagtttaaaccgggcattaacttaataataggtcaaaatggagcagggaaaagttcccttttggatgcaatcttagttggtctttactggtcaaagagaatgaggttaagaggattaaaaaaagatgagttcacaagaaccggaacgagaggagctataattgaaataacgttcgaagaggatggaactaaatacaaggtacttagggattttgctcgaaatgtgtcttatttaaagagacttgacgggagggaatggaggcacgttaccgaaactagtatggagagcgtctcatccttcatagataggattattccatacaacgtattcctaaacgctatatatgtaaggcaggggcagatagatgcaatattggaaagtgacgagaccagggataaaatagtcaaagagatccttaacctcgacaagctagagaaagcctacgacaatcttgggaagatcaggaagtacatcaaatattccatagaggagaaggaaaagttcatcatgaaaacagaaaacatcgaggatctcataaggacccaggaaaagagctttacagaagtgcttaatgaaattcgaaatatatcttcaaaccttcccaggttaagaagggagctggaagggatcaaagaggaagttaaaacgttggaagcaactttcaatagtataaccgaactgaaactaaggttgggagagctaaacggaaaaaaaggtaggcttgaagaaagaataaggcagcttgagtcaggaattgaagaaaagagaaagaaaagcaaagagcttgaagaagttgtaaaggaacttccagaacttgaaaaaaaggagactgaatacagaagattaattgaatttaaggatgagtacctcgtcaagaaaaatgagctagagaagaggcttggtattttaagtaaccgtctacaagaggttaaaagaaaaattaaggatgcggagtctaaagttgctaggattaggtggatagaggaaagattaaaagagatacaggaaaaaattatgaagcttgagccaagggttagggaattcgaagatgctatgcgcctcaaagctcagatggaatccttaaaatccaagttgggtggattggagcctgagaaaataaatgagaaactcctatacttagagaataggaaaaaggagcttgaagaagaaatagacaagataacaaggaagataggcgagttaaaccagaggagtaaagataggagattggcaataattgagctgaagaaggcccgggggaaatgtccagtttgtgggagggagctcaccgaagaacataaggcggatctactgagaaagtactccttggagctttcatcgatagagaaggaaatccaagaggcaaaagcccttgaaaggcaattaagagctgaatttcggaaagttgagaacgaactgagtaggctttccagcttaaaaacgatagctgatcagatcattgagattagagaaagattaagcaagataaatctggaagatttgaagagggataaggaagagtacgagttactaaaaagtgagagcaataaattaaagggtgaagtggagagcctaaaaaaggaagtaaatgagcttaatgattataaaaatgaatctaccaagcttgaaatcgaaatagataaggccaaaaaggaattatctgagatcgaagataggttactaaggttgggatttaaaacaatagatgagctttctgggaggataagggaacttgaaaagtttcacaacaaatacatagaagcaaaaaacgctgagaaggagttaagggacatccttgaaagtcttaaagacgagagggaggaacttgataaggccttcgaagaactagcaaaaattgaaacggatatagaaaaagtcacttcacagcttaacgaacttcaaaggaaatttgaccaaaagaagtacgaagaaaaaagggagaagatgatgaagcttagtatggagataaagggattggaaactaagttagaggaacttgagagaagaagggatgaaattaaatctacaatagaaaagcttaaggaggagagaaaagagagagaatcagctaagatggaacttgaaaagctaaatattgctataaagaggattgaagagcttagaggtaaaataaaagagtataaagccctaataaaagaggaagctctaaacaagataggagaaattgccagtgaaattttctctgaatttacggatggtaaatattctgggatagcgataagggccgaagacaataaggttaaactattcgttatttacgacggcgttgagaggccgctaaccttccttagtggaggtgaaagaatagcccttggtttagcctttaggcttgcgatgtctatgtacttaataggtaaggtagatttgctgatcctcgatgaacccacaccgttcctagatgaggagaggaggaggaaattgatagagataatggagaggcacttgaggaagatatctcaagtgatcatagtttcccatgatgaggaactcaaggatgcagcggatcacgtgataaggataaggctcgagggtggggcctcaaaggtggaggtggtatcttga

SEQ ID NO: 24959 - DNA, 828 bp, Pyrococcus horikoshii
atgccaagaaaggccagggaatatccggaggagggtgagtttgtagtcgctactgtcaagaggattcataattatggagcattcctcgagcttgatgagtatcctgggaaggaagcgttcatgcacataagcgaagtggcctcgacgtgggttaggaacattagagactacctcaaagagggacagaaagttgttgccaaggttatcagggttgatccaaggaagggtcatatagatctaagtctcagaagagttacacagcaacagaggaaggcaaagctacaggagtttaagagagctcagaaagctgagaacttactaagactcgcagcggagaagcttggaaaagattttgaagctgcgtggagggaggtttgggttccgctggaagaagaatggggagaggtctatgcagcgtttgaagatgctgcaaaggatggaattgaagttttaaaaggtcatgttcctgatgaatggttacccgttcttaaggagatagtggagaactacgttgaggttccaactgtaactatagatgcagaatttgagataaccgttccaaagccaaacggagttgagataataaaggaagctttgataagggccagggatagagctaacaaggagaaagatattgaagttaagttcacatatcaaggagcaccgaggtataggatagacatcacggccccagactactacaaggccgaagaagttctcgaggatatagcggaggagatacttagggttataaagcaagcaggtggagaggcaactttgttgaggaaggagaagagaataaggaaggttaagaagagaaagaagtga

SEQ ID NO: 24960 - DNA, 576 bp, Pyrococcus horikoshii
atggtggatacaagcaatgtcaagctaaggatcgagaatatagtggcttccgtagatctttttgctcagctcgatctcgagaaggttctggatatatgcccaaattctaaatataatccagaagagtttcccggtatcatctgtcgttttgatgatccgaaagttgctttgctgatatttagctccggtaaactcgtcgttacgggggcaaagagtatccaggacatagaaagagcagttgcaaagctgatccaaaagcttaagggaattggagtaaagttcaagagggctcccctaatagatgtacaaaacatggtctttagtggggatataggaagggagttcaatctcgataacgttgcattgacccttcccaactgtgaatatgaacctgaacagttccctggagttatatacagagttaaggaaccaagggctgtaatactactgttctcttctggtaagatagtttgctctggagctaaaagcgaagctgacgcttgggaagcagttaggaagttgttaagagagcttgagaaatatggcctaatagaggaagaagaggaggagctctag

SEQ ID NO: 24961 - DNA, 1251 bp, Pyrococcus horikoshii
gtgaataagatgaaggctgtaattcttgctgggggatttgggactagattaaggccaatttcttcaacgaggccaaagccaatggttcccgtgttaggaaagccgaacctacagtatattttagaggccctggaaaaggttaaggaaattgatgaaataatactttcagttcactacatgaggggcgagattagggaatttattcaggaaaaaatgagagactatcctaaggatataaggttcgtaaatgatccaatgccgctcgaaactggtggggcactgaaaaacgtcgaggaatacgtttcagatgatttcctggtgatctatggagacgtcttcacgaactttgattattctgaactaatagaggcccacaagaagaacgatggtttgataactgtagccctcacgaaggtttatgatcctgagaggttcggagtcgtaattaccgatgaggaaggaaagatcgtggagttcgaagagaaacccaggaaaccaaagacaaatttggtagatgctggaatttacatggttaacaaggatgtcctaaaagagataccaaagaacaaagagatctactttgagagggaaattcttccaaagttcgtaaatcaaggattggtttatgggtacaagatgccaaagcagtattactgggttgacttgggaaccccagaggacttcttctatgcccatcaaatagcacttgatgagctatccaaggaaaatggatacatgatcctaggggaaaacgttgaaattccagatgatgtcgaggttcaaggacccgtgtacatagatgacaacgcaaagatagggcatggggttaagataaaggcctacacttacatagggcctaatacaataattgaggataaagcctactttaagcgctcaatactcctggggaacgacataataaaggagagggccgagctaaaggatgcgatattaggcgaaggagtcgtcgtaggaaaggatgtcataataaaggagaacgccgtaataggggattacgctaagatatatgacaatctggttatctatggggccaaggttcttccatggaagaaagttgaggagtacgaggcatacataaagataaagctcgatccaacgaaagttagaccaggacaatatcccgatcactgtcctctcggccttccagagtgtatatacaaaaagtttaaggccattgcaggagagaagccaccttgcgatgagtgtatagagaaccagtggctcttctga

SEQ ID NO: 24962 - DNA, 963 bp, Pyrococcus horikoshii
gtgaaatcactaagtaaggagtggggtgaaaaaatgatattcgatgctcactcagacttgccaacttacgtatatgaggaaagggagaagggaaggactagagtcctcgaaagcaatttcgaaaagttctttactgggatctcggctagggttatgagcgtctggagcaggccggagaagaaaccgataatacttaggtacgccttggaggcatataacaggctgttcaaggatgttagtgaaagcgaaaaactcgtgatagttggtaccgttaaagagatggaagatgcaataaaagacggtaaagtagccctttggcttgggatggaaggaggggaacccatagagagtctagacatactggagatattccactcgattggattgagagtcttaaccttaacttggagcttaaggaatcaaataggggatggtgtctttgaaagaactagaggagggttaaccaactttggagctgaagtcgttggaaagtgcgaagagcttgggataatcatagatctaagccacataaatgagcaggggttctgggatgttctagacattacgggcttccccgtgatagcttcccattcgaatgctaaatccctttgcgataaccccaggaatttaacagatgagcagataaaagctattgctgagagagatggggtgataggggctgtggctattccagccttcgtcgacaaagataatccaacccttgaaaagtacgttaagcatatagagtacatggtggatcttgtcggttacaagcacgtgggaataggcttcgacttcgtctactacctcccaggatggagtggaaagagcgttgaaggacttgaggatgaatctaagataccggatctaataaaggccctagaggagaatttcagtgagaaggaggtaaaaggtataacatttgaaaacttcaagagggtattcgagagggtagttgggtga

SEQ ID NO: 24963 - DNA, 1029 bp, Pyrococcus horikoshii
atggagaaatatgaagaactatttgcaagaataaaagagaaggctaaactcatcgatgagaagatcttcgagctcatcccggaaaaggatcccagagtcctctatgaggccgcaagacactatcctttagcaggtggaaagagggttagacccttcgttgttctaacgtcaactgaagctgttggcggggatcctctaagggccatctatccagcggtggccattgagctaattcataattactccctggttcacgatgatataatggatatggatgaaaccagaaggggaaagccaactgtgcatagaatttggggtgtaaacatggctattttagcaggagatctgctcttcagtaaagcctttgaagctgtggcaagggcggaaattcctccagaaaagaaagctagagtattagaagttattgtaaaggcgtcaaatgagctctgtgaaggccaagctagagatctagagttcgaaaagaagagcacggtaactatagaagaatacatggaaatgataagcggaaagacgggggcattatttgaagcttcagcaaaagtcggaggcataatcggaacggacaacgaggagtatataaaagccctttcaagttgggggagaaacgttggaattgcattccaaatttgggatgatgttcttgaccttattgccgatgagaaaaagctcggaaagcctgtgggtagtgacatcagaaaggggaagaaaaccctgatagttgcccacttctttgagaacgcagatgaaaaggataagcagaggttcctaaagattttcggaaagtatgctggtgatgttaaggggaggggaattattgaggaagacatcaagtccgatgttatggaagctatcgatctacttaagaagtatgggagcatagattatgcagcggaaattgctaaggatatgattaaaaaggcaaacgaagccctaagaatccttccgaaaagtaaggccagaatggatctagagttgcttgctaaattcattgtagaaagagaatactaa

SEQ ID NO: 24964 - DNA, 960 bp, Pyrococcus horikoshii
atgaaagttaacatctcaattttcggatttggaaccgttggtagagctctagctgaaattatagctgaaaaaagtagaatttttggggttgaactgaacgtcatctcaataaccgacagaagcgggactatatggggtgattttgaccttttggaagctaaggaagttaaggaatccacgggaaagctgagcaacatcggggattatgaagtttacaacttttcccctcaggagctagtcgaggaagttaaaccaaacattctagttgatgtcagtagctgggatgaagctcatgaaatgtacaaagttgctcttggtgaggggataagcgtcgtgacaagcaataagccgcccatagctaattattatgacgaactaatgaatttagccaaggaaaataatgcaggaatattctttgaatcaacggtaatggccggaacgccgataataggtgtattaagggaaaatctgcttggagagaatattaagagaattgacgctgttgtaaatgctagtaccaccttcattcttactaagatgagtgaaggaaaaacgcttgatgatgccatagaggaagccaagagcctaggtattctagaagaggatccctcaaaggacatagatggaatagacgcttattacaaggcgaagatccttcactgggtttcctatggggaacctccagaagaggaagagaggttaggaattagggaggttagagatgccaggaatgttagactcgtagctcaggtatctaagggaaagataagcgtaaagccgaggaaactttcaagtgataatccgttgctcgttgaaggagtgcaaaatgcagctgttataaggacgaacaatttaggggaagttatacttaagggcccagggggaggaggaagagttaccgctagcggagttttcaccgatataataaaggcaactctaaaattcccaaacctccgctag

SEQ ID NO: 24965 - DNA, 1005 bp, Pyrococcus horikoshii
atgaaagtcgccgttcttggggccacgggagttgttggaagaactttcgtaaagcttcttgaaaatcatccttggtttaaagttgaaaagctagtagcttctgaaagatcggccggcaaacgatatggagaaatcgttgaagattccccggaagaattcaaggattacacgataataggtcttaaggaattccttgaggatcctggggttgatctcgtatttaatgccctccctgcatcgatatcaaaggaggtagaagagaaacttgcacaggaaattccagttttcacaaacgcaaggagtcaccgctatgatgaagatgttccaattttagtcccagaagtgaatagtgatcatttaaagcttgtagaagtccagagaaagcggaggaagtggagggggttcatagtaactaatcctaactgctcgacagcaatacttactgtttcactagcacccctcagggcctttggcataaagaaggttagggtagctacgatgcaagctattagcggagctgggttctctgggctttcagcctatgcaattcacgacaacgttataccttttataaatggagaagagtggaaaatagagaacgaaagcagaaaaatactcggtaaatttactggagataaagtagaaccagccgagatagaggtagctgcaatagctacgagggttccagttctacacgggcatactgaagcggtcttcgttgagcttgaaaaatttgatatcgaagagataagggaggcatttgaaaactttgatccccttagaagccttgagcttccatcgtatgaaaagcccatagtatatacagagattccccagccgagattgcatagagatagaggaaaagggttaacagttacagtgggtagacttcaagaaatatcaggaggtataaaatatgttgttttaggccataatttagttagaggagctgcagggggttccatccttaatgctgagcttgcttataaactgggaataatataa

SEQ ID NO: 24966 - DNA, 3135 bp, Pyrococcus horikoshii
gtgagttatgtgaagagaattagacagcctattatagcggttctcggtcatgtcgaccatggtaagtgtttattgccagaggagagggtaatacttccagattatggtccaataacgctcgaagagctatttaacatgacaaaggagaccgtctttaaggatgaggagaaggaggtaagaaaactcggaattaggatgccagttgcaggggttgatggtagggtaaggctcctcgaaggaccttacgtttggaaagttaggtataagggtaaaatgcttagggttaaactaaaagattggcattccgttgcagttactccggagcatccatttttaacgacgaggggatgggttagggccgatcagcttaaacctggagattacgttgcggtacccaagatccttcctgggaaggatgataaggaaaagtttttgcaatacgtgcacgaaaaacttaaggggaaagtccacataaagctaccgagctcagatgaggaatgggaaacctttttctactttgcgggaactatatttggtagagaaaacagtgttaatcctgaaggactgactcatgaagtaaaagctttgcttgagttatttaaagtactatttgagtatcccagggaagtcctaagggtacttttcatggccccagtcagatacgttgctaactttctaaggggattctttgatattaatggttatgtaaatggcgaagaattgagggttgaggtaaggggagcacctcacgaggtactggaggagctctccctcatccttctccggttagggatagtctcaaagatctatcctacaagtcttgcaatatctggaagaaggaaccttgagctctttaggaggtacattggcttctcagaaaagcagaaagcaaaagaactagaggggatcattagaagaagcgaaaatagtgagagttacccgatctttgaagagttaagacgtataagactgctcttcgggttcacaagagcagaacttagctcaacgatccccctctatagtaaatacgagtccaaggaggcgccaagctatgaaatcctgatgaagatccttaataccattgaaaagggatcaaaagacctgaacaaaaagattaccatccttgagggtagggtcagagaccatgagtatatagaggaatttaaaagggaggggttaataaaggatgggaagcttaccgaacttggaaaggagctcctcgaagtttggcgcaacagagaattcgactctagggatgtgaactacctcaggaatattattgaaaacttcgtttttctcccagttgagaaaatagaagagttcgaatatgatggctacgtttatgatgtaaccacggagactcacaacttcattgcaaacggaattttagttcacaacaccaccctgctggacaaaatcagaaagacgaacgtcgcggccaaggaagccggtgggataacgcaacacattggagctacggaagttccaatagatgtagtcaagaagatagctggaccccttattaagctctggaaggccgagataagacttccaggtttacttttcatagatactcccggacacgaggctttcactagcctaagggctagaggaggaagcttagccgatttagcagttctggttatagatgtaaacgaaggtttccagccacaaactatagagagcattgaaatattgaggaggtatagaacgccgttcgtagttgcggccaacaagatagacaggataaggggttgggtgattgaggaggatgaaccattcctaatgaacataaagaggcaagatcagagggctattcaagagcttgagacgaagctctgggaacttataggaaaattctacgaattcggcttccaagcgaatcgctttgatagagtccagaactttacgagggaattagcaatagtcccaatctcggcaaaatacggaattggaatagcggaactcctagttctcatagcgggactctctcaaaagtaccttgaggagaagctaaagattgaagtggaaggtccggcccggggaaccatacttgaagttagggaagaaccaggtttggggcataccatagacgtgataatatacgatggaaccctgcacaaggatgacacgatcgtcgttggaggaaaagataaagcgatagtcacgaaggttagggctttacttaagcctaaaccactggatgaaataagagatccaaggttcagattcgactacgtggatgaagttacggccgcagcaggtgtaaagatagctgctcctgggctcgaggaagcccttgcaggttctcccgttatagctgcccccacgcccgaagatgttgagagggcgaaggaggagataatgaggcaaatagaaagcgtcgtcataagcactgataaagttggggttatagtgaaggccgataccctgggaagcctggaagcattaagcaaagagctccaggagaaggaaatacctataaggaaagctgacgtaggaaacataagtaaaacagacgttatggaggctctcagcgtaaaagaggagaacccaaagtatggggtaatcctaggttttaacgtgaaagttaacgaagatgcaaaagaagttgcaaaggccaaggaagtcccgatattcgtcgggaatataatatataagctcatagaggattatgaagcttggataaaagaggaagaggagaagaggaagagagagttacttgcaaaggtgacgttccctggtgtaataaaattgtatccggatgagaggtacgttttcagaagaagtaatccagcaatagttggaattgaagttttggagggaagaataaagccaggtgttacgctgataaagcagaacggccaaaaggttggaactataaggtcaataaagagcagagatgaatttctccaggaagctagaaagggacaagcagttgcaatagcaatagagggggctatagttggaaggcatattcatccaggagaaactctgtacgttgacttaagcagggatgatgcaataatactattgaagcatcttagggatgtcctggaggatacagatattaaggccttgaagatgatagcccaagtaaaggcaaaggaagatccgttctggagggccgtttga

SEQ ID NO: 24967 - DNA, 561 bp, Pyrococcus horikoshii
atgaaaatgaaagatgagctgatcaatctaataataaatgagggatgcataaaatttggccattttgttttgacatctggaaaagagagtaactactatatcgatataaaaagtctgataacaaaccctaaagccctaagaataatagcaaaactaatcaaagaaaaagctgaggaacttaacctaaactatgataaaatcgctggccccgagttgggagcagttccaatagcaacggccctttcgcttgaaactaacaagcctctcttaatagttagaaaaaagaaaaaggaacatggaaccgggaaagtaatagagggaaatgttcaaaaaggagataaagtgctattagttgaggatgttacgactactgggggaagcgtgataagagctgccaaaatcctaagagagcatggagcagatgtcgtcgggatttttgtcgtggtcgatagagaggagggtgcaaaggaaaatatcgaaaaggaaggcttcaagttctacccccttgtcttagtcagcgaactcttcaaggctgctgggatttctaaggatcaaagctaa

SEQ ID NO: 24968 - DNA, 1377 bp, Pyrococcus horikoshii
atggaggggaatactattcttaaaatcgtactaatttgcactattttagcaggcctattcgggcaagtcgtgccagtatatgcagaaaatacaacatatcaaacaccgactggaatttactacgaagtgagaggagatacgatatacatgattaatgtcaccagtggagaggaaactcccattcatctctttggtgtaaactggtttggctttgaaacacctaatcatgtagtgcacggactttggaagagaaactgggaagacatgcttcttcagatcaaaagcttaggcttcaatgcaataagacttcctttctgtactgagtctgtaaaaccaggaacacaaccaattggaatagattacagtaaaaatccagatcttcgtggactagatagcctacagattatggaaaagatcataaagaaggccggagatcttggtatctttgtcttactcgactatcataggataggatgcactcacatagaacccctctggtacacggaagacttctcagaggaagactttattaacacatggatagaggttgccaaaaggttcggtaagtactggaacgtaataggggctgatctaaagaatgagcctcatagtgttacctcacccccagctgcttatacagatggtaccggggctacatggggtatgggaaaccctgcaaccgattggaacttggcggctgagaggataggaaaagcgattctgaaggttgcccctcattggttgatattcgtggaggggacacaatttactaatccgaagactgacagtagttacaaatggggctacaacgcttggtggggaggaaatctaatggccgtaaaggattatccagttaacttacctaggaataagctagtatacagccctcacgtatatgggccagatgtctataatcaaccgtactttggtcccgctaagggttttccggataatcttccagatatctggtatcaccactttggatacgtaaaattagaactaggatattcagttgtaataggagagtttggaggaaaatatgggcatggaggcgatccaagggatgttatatggcaaaataagctagttgattggatgatagagaataaattttgtgatttcttttactggagctggaatccagatagtggagataccggagggattctacaggatgattggacaacaatatgggaagataagtataataacctgaagagattgatggatagttgttccaaaagttcttcaagtactcaatccgttattcggagtaccacccctacaaagtcaaatacaagtaagaagatttgtggaccagcaattcttatcatcctagcagtattctctcttctcttaagaagggctcccaggtag

SEQ ID NO: 24969 - DNA, 1362 bp, Pyrococcus horikoshii
gtgagaatggggagatactttggaaccagtggaattagggaggtagttaatgaaaagttaacccctgagttagctctaaaggttggtctagctttgggaacatacctccaggagggaaaggtcgttatagggtgcgacactaggacgagtagcgtgatgcttaagaatgccgttataagtggactactagccacgggaatcgatgttatagatataggcctcgcacctaccccacttacgggatttgctataagattgtacaacgcagaggctggcgttacgataacagcatctcacaatcctccacaatacaatgggatcaaagtttgggatagagatggaatggcatatactccggacaaggagcacgaactcgagaagattatagaatccggaaactttagaagagtaccctggaacgaggtaggaacattgaagacagcaaatcccaggaaagaatatattgaggctattttaagagaaataaatcttaagggatcctataccgttgttatagatgctgggaatggtgcaggttcgatagtaagtccataccttcacagggaacttggaaacagggtgataacgcttaactccgatcctagtggatttttcgttagagagcttgaaccaaataaggagagcctaagcatgcttgaaaaaaccgttaaagtccttaacgcagatatcgggattgcacacgacggagatgcagacagggttggggtcgtcgatgagaacggagaattcgtagaatatgaggtcatgctctcgctaattgcaggttacatgctaaaaaagtatggaaaggggaagatcgtgacaacggtagacgctggatttgctttagacgattacatccgagaactaggaggagaagtcgttagaactagagttggagacgttgccgtcgctgaagagctagttaagcatggaggggttttcggtggggaaccttctggaacttggataatgcctcaatggaatctaaccccagatgggatattcgcaagcgctttggttttggagatgatcgatagattaggcccaattggagagttagcaaaggatgttccaaagtacgtaaccctaagaaagaagatcccctgctcaaacgaactaaagaacaaggtcatgaataagatagccgatttaattccaagggagttctcctatgagaggataataacaattgatggtataaggatagagaatgacgactggtggattttgtttagacccagtggaacggagccgatcatgaggatcacgcttgaggcccacacggaagagatggcagagaggctaatgaaaaaagctgaaaatttagttaaaagcgtgataaaagatttatcttcttaa

SEQ ID NO: 24970 - DNA, 651 bp, Pyrococcus horikoshii
atggtagtgattggagaaaagtttccagaagttgaggtaaagactacccatggagttattaagttgccagactactttacaaagcaaggaaagtggttcatactctttagccatccagcagactttacaccagtttgtacaacggagttttatggcatgcagaagagggtagaagagtttaggaagcttggggttgaacctataggattgagtgttgatcaggtcttcagccacataaagtggatagagtggattaaggacaaccttagcgtcgagatcgacttcccggtaatagctgacgacagaggagaactagctgagaagctcggcatgattccaagtggagcaacgataacagctagagctgtgtttgttgtcgatgataaaggaataataagggctatcgtttactatccagcggaagttggaagagattgggatgagatcctaaggctcgttaaggcccttaagataagcacagagaagggagtggctctaccacacaagtggcccaacaacgagctaattggagacaaagtgatagttcctccagcatcaaccatcgaagaaaagaagcagagagaagaggccaaggctaaaggagaaatcgagtgctacgactggtggttctgctataagaagcttgaatga

SEQ ID NO: 24971 - DNA, 1233 bp, Pyrococcus horikoshii
atgttcaggttggaggattttaactttcacaataaaacggtattcttaagggtagacttaaactcacccatgaaggatggaaagataataagcgatgccaggtttaaagccgttttaccaactataagatacctcatcgagagtggagcaaaagttgtcattggaacgcatcaagggaaaccctacagtgaagattacactaccacagaggagcatgcgagggttctttcagagttattggatcaacacgttgaatatatcgaagacatatttggtaggtatgccagggaaaagataaaagagcttaaatcaggtgaagttgcaattttagagaatcttagattttccgccgaagaagttaagaacaaacccattgaggagtgtgaaaagactttcctcgttaaaaaactatcgaaagttattgattatgtcgttaacgatgcctttgcaactgcacacagaagtcaaccttctttagtaggtttcgcaaggataaagccaatgataatggggttcttgatggaaaaggagatagaggctttaatgagggcttattacagcaaagacagccctaaaatttatgtacttggaggcgccaaggttgaggattcgcttaaagtagttgaaaacgttctaagaagagagagagctgatctagtgctaaccggaggcttggtggccaatgtatttacgcttgctaagggatttgacttgggaaggaaaaacgtagagttcatgaagaaaaaaggcttgctagattatgtaaagcatgcagaggagatattagatgaattttatccctatataagaactcccgtagacttcgcagtagattacaaaggggaaagagtcgaaatagatctgctaagtgaaaataggggattacttcatcaatatcaaattatggatatcggtaagagaaccgcggagaagtacagggaaatattaatgaaagcaaggattatagttgctaacggaccaatgggagtctttgagagggaagaattcgcgatagggacagtagaggtgttcaaggccatagccgatagcccagcgtttagcgttttgggaggagggcattcgatagctagcatacagaaatacggtataactggaataactcatatctccacaggcggtggagcaatgctctctttcttcgctggagaggagttgcctgtcctgagagctcttcagattagttacgaaaaattcaaggaggtggtgaagtga

SEQ ID NO: 24972 - DNA, 762 bp, Pyrococcus horikoshii
atgataatagttgaaaacctcagaaagaaattcggatcaaaagaggtactaaaggggatcaatttcacggttaatgatggggagatatacggacttctagggccgaatggaagtggaaagtcaactactatgaggatactttccgggataattaccgattttgaaggtaaagtaatggtggctggagtggacgtctcaagagatccaatgaaggttaaggagatcgtgggttatgttccggaaacccccgcactttatgagagcttaaccccagcagagtttttcagtttcataggaggagtgaggaggattcctcaagatattctcgaggagagagttaaaaggctcgtagatgcgtttgggataggtaagtacatgaaccagttaataggaaccttgagctttgggacgaagcaaaaaatttccctaatctcggctttgttacacgatcctcaagttttgatactagatgaagccatgaatggccttgaccctaaaagtgctagaatattcagggagttactttttgagtttaaggaggaaggtaagagtatagtattttcaactcacatcttagccctagctgaggttatgtgcgataggataggtataatatacgaagggaggatagtagccgaaggaactatagatgaattaagggagatcgcaagggaagagaagcttgaagatatattcctaaagctaactcaagcgaaggaagaggtttctcagatagtttcagcactaaaggaggccctttaa

SEQ ID NO: 24973 - DNA, 543 bp, Pyrococcus horikoshii
atgctcatagctataaccggcactcctggcgttggaaagactaccgtggccaagcttctagccaagaagcttaactatgagtacgtgagccttaaagacttcgcccttgagaagggttgcgggaggagggtaaacgatgaagttgaggttgagatcgatgagctagcttactttatcgagagggaacttaaggggaagaatgcagttttagatggacatctaagccatttaatgccggttgaccttgtcgtagtcctcagagcccatccaaaactaataggagaaaggctcagagagaggggttatgacagagagaagataggggaaaatgttgaagctgaactcgtagatgctgtacttatagaagccatcgaggaacacgaaaatgttatagaggttgatactactaataaatctccggaagatgttgttgaggagatagtaagcctaatcaattcaggcattaaaaagagggtaggtatagtggattggagtgaggtgtatgacgagataataccctatctaaggcttggaggtgagtaa

SEQ ID NO: 24974 - DNA, 579 bp, Pyrococcus horikoshii
atgccaaaggacaagctagtgataaccgttagcggattagcaggctccggaactacaacactttcaaagaaaatagctgaacattatggccttaagcatgtctacgctgggctgatattcagacagatggccaaagaaaagggaatgagccttgaggagtttcagaagtacgctgaacttcatccagagatagacagagaagtagacaggagacaaatagaagcagcgaaagaagggaacgtggttatagaaggaagattagccggatggatggttaagaatgctgacctcaaaatctggcttgatgctccaataagggttagggctgaaagggttgccaagagggaaggtataagcgtcgaggaagcttttatgaaaatagctgagagggaaatgcaaaacaggaaaagatatttaaacctttatggtatcgacatcaacgatttgtccatatatgatttaataataaacacgtcgaaatggtctcctgaaggtgtattcgctatagttaaagccgctatagaccacctcgaccccgtcggcgacgcggggtcgaaaaaagagaaggaggtgggatga

SEQ ID NO: 24975 - DNA, 1083 bp, Pyrococcus horikoshii
atgtttgaaaagggttatgtcgatgagaactacatcagagttcccaaggatagacttttctctttcatagtcagggtactaactaaactaggagttccagaggaggatgctaagatagttgcagataacttggtgatggcagatctgagaggggtggagagtcatggagttcagagattaaagaggtacgtggatgggataattagcggtggggtaaaccttcatcctaaaataagggttatccgagaaggcccttcctatgcccttatagatggggatgaaggccttggccaagtagttggatataggtctatgaaactcgcaattaagaaggctaaggatactgggattgggatcgtcattgctaggaacagtaaccactatgggatagctggatactacgccttgatggccgctgaagaggggatgatcggaattagcatgacgaactctaggccactagttgctccaacaggaggaattgaaaggatccttggcacgaatccaatagctttagcagcgcccacgaaggataagccctttttacttgacatggcaaccagcgtagttccgataggtaaactcgaagtctacagaagaaaaggaaaggatatccctgagggatgggccataaatagagaagggaatataactactaaggtcgaagaggtgttcaatggaggggcccttctaccccttggagggtttggagagctacttggaggacataaaggttatgggttaagtttaatggtcgatatactttccggaatactctctggtggaacatggagtaagtacgttaagaataccagtgagaagggaagtaatgtttgtcacttcttcatggtcatagacatagagcatttcatacctctagaagaatttaaggagaagataagtcagatgattgaggaaataaagagttcgagaaagcatcctgaatttgagaggatatggatccatggggagaagggatttttaaccatggagactaggcttaagctcggtattccgatctataggaaggttctcgaagagcttaacgagatagcaaaaagagttggagttgaaggtttatga

SEQ ID NO: 24976 - DNA, 1092 bp, Pyrococcus horikoshii
atgcacaggctccaaatccttcaagtgcagaaatgccacgaggaattcgagaaagccatggccctaggtcagtatgataaggctaggttaatagcacttagatgctccgaattgttaaggaatctagcctctgaaaatttagatctctctcatatactcctcgaagaggcaaagaagtgggaagataaagccagaaatatcagaaaaaagaaagaagccaggaatgaatattttgatagattaaaggttctaataaagaagagcactgtaacttggaatgacattggagggttaaaagaagctaaaaagttaattgcacaagccgttggattaagcattgcaaaatctcctatagatccaccccagggaatacttctatttggccctccaggaactggaaagagcttacttgcaagtgctactgcaaacagtttgaatgcaacattctttagcgtgaaggcaagtgaccttctcagcaagtactttggggaatcttcaaagttggtttcagccctcttctccttggccagacaactaagtccaagtgttatatttatagatgaagttgattccctaaccatgaaaaggtcaagcctggatgatgccgctagaagaatgattgggacgttattagctgaaattgatggattcaaagataaaaggagaaaggtgattgtacttacagctacaaataccccctgggatcttgacgaggccatgctttctaggttgccaattagaatttacgtcccccttccggatataccctctgctgttgagatctttagaatccatctaaggggaattccccatgaggtatcgctgaacaagctagctaaagaagccgttaaaaagttgtactctggaagggaaatcgcaaatgttgtaaagctagcaactatgaagatgctcgaggaaatgaatcccgagctcgtagatcccctaagagtggctacgctaaagggaaaggatctgacgactagacctctaacgatggatgactttaggtacgcaatggccaagataaagagtcccataacgaagagtgatgttaaaaaatatgagaagtgggccaaggaatttggaatttag

SEQ ID NO: 24977 - DNA, 945 bp, Pyrococcus horikoshii
gtgcccgagagagttgttatcgccctgggaggaaacgcactccagcagagagggcaaaaagggacttatgatgagatgatggagaacgtaaggaaaacggctaaacagatagctgagataattgcgaggggttacgaagtcgttataactcacggtaacggacctcaggttgggacgattctccttcatatggatgcgggacaatcccttcatggaataccagcccaacccatggatgttgccggggcgatgagccaaggatggataggttacatgattcaacaagcgttgaggaatgaactcaggaaaagagggatagaaaaggaagttgtcactataataactcaaacgatagttgacaaaaaagatccagcatttcaaaatccaacgaagcctgtaggcccattctatgatgaaaaaactgcaaagaaacttgcaaaggagaaaggatgggttgtcaaggaagatgcaggaaggggatggagaagggttgtcccaagcccagatcccaagggacacgtcgaggctgaaacgataagaagactcgtcgaaagtgggattatagttatagcaagtgggggaggaggagtccccgtaattgaagagaatggagaaataaaaggcgttgaagccgtgatagacaaagatctagctggcgaaaaattggccgaggaggttaatgcagatatacttatgatactaacggatgtcaacggggccgccctatactatggaacggagaaggaaacttggcttagaaacgttaaggtggaagaactggagaagtactaccaagaggggcactttaaggctggaagcatgggtcctaaagttcttgcagcaataaggttcattaaaaatggaggaaaaagagcaataatagctcaccttgagaaagctgttgaagcccttgaaggaaagacaggaacccaggtgactccctaa

SEQ ID NO: 24978 - DNA, 1278 bp, Pyrococcus horikoshii
atggggttgtatagaaaatacattgagtaccctgttcttcagaagatcttgattggccttatcttgggtgcaattgttggtttaatattaggtcactacggttacgcagatgccgtaaagacatatgtaaaaccctttggtgacctctttgttagactattgaaaatgctagtaatgccaatagtctttgcatcgcttgtggtcggtgcagcaagcataagcccagcaagactcggaagggtgggtgtaaagatagtcgtatattaccttctaacatccgccttcgcagttacccttggaataataatggctaggctgttcaacccaggagctggaatacacctcgcagttggcggtcagcaattccagccaaagcaagcacctccactagtcaaaatcttactcgatatagttccaactaatccctttggtgcactagccaatggacaagtactacccacgatattctttgcaataatccttggaatagcaataacctacctaatgaacagcgagaacgagaaggtgaggaagagcgctgaaaccctgcttgatgcaataaatggattagctgaagcgatgtacaagatagtcaatggagtcatgcagtacgctccgataggtgtatttgcccttatagcttacgtaatggcagagcagggggttaaggtcgttggagagttagcaaaggttaccgctgcagtctacgtagggctgacgctacagatactccttgtgtacttcgtactcctaaagatatatggcatcgatccgataagcttcatcaaaaaagcaaaggatgcaatgctaacagcgttcgttacaaggagctcaagtggtacattaccagttacaatgcgcgttgcaaaagagatgggaatatccgagggtatttattcctttaccctaccattaggagcaacgataaacatggatggaactgcactataccagggtgtatgtaccttcttcatagcgaatgccctaggtagtcatttaacggtaggacaacagctaacaatagtccttactgctgttctagcttcaataggaactgctggagtcccaggagcaggtgcaattatgcttgcaatggttcttgaaagcgttggacttccattaaccgatccaaacgttgccgcggcttatgctatgatccttggaatagacgcaatcttagacatgggaagaacgatggtcaacgtcactggagacctgacaggaactgccatagttgcaaagactgagggagagcttgaaaaaggagtaatagcctga

SEQ ID NO: 24979 - DNA, 1161 bp, Pyrococcus horikoshii
gtggagattatggagttcgaagaggcatttaaagaagtttatgagatggtaaagccaaaatacaagctttttacagcggggccagttgcatgtttcccagaagttttagaaataatgaaagttcagatgttcagccacagatctaaggaatacaggaaagttcacatggacaccgttgagaggttgagggagttccttgaagttgagaaaggggaagtactgcttgtaccaagctcaggaaccggaataatggaagccagcataaggaatggagttagtaaaggaggaaaggttcttgtaaccataataggagcatttggaaagagatacaaagaggttgtcgaatccaacggtaggaaagctgttgtactggagtatgaaccaggaaaggctgttaaacccgaggacctagatgatgcattgagaaagaatcctgatgttgaggccgtgacgataacttacaatgaaacttcgactggagtcctgaacccattaccagagcttgcaaaggttgcaaaagagcacgataagcttgtattcgtcgatgcagtttcagcaatgggaggggccgatataaagttcgacaagtgggggttagacgttgtattctcaagttctcaaaaggcctttggagtaccaccaggattggcaattggtgctttcagtgagagattccttgagatcgctgaaaaaatgccagagagaggatggtacttcgacattcctctctatgtaaagtacctaaaggagaaggaatcaacaccttcaacacctccgatgccacaggtatttggaataaacgttgcgctgaggataattgagaagatgggaggaaaggaaaagtggctagaaatgtacgagaagagggctaaaatggttagagaaggagtcagggagataggactcgatatacttgcggagccggggcatgaaagcccaactattaccgcagtactcactcctcctgggataaagggtgatgaggtttatgaagccatgagaaagagaggctttgagctagcaaagggatacggtagcgtgaaagaaaagacctttagaattgggcacatgggatatatgaagtttgaagacatccaggagatgcttgataacttgagagaagttataaatgaattaaagaagcaaaaggggatcaactga

SEQ ID NO: 24980 - DNA, 417 bp, Pyrococcus horikoshii
gtggtggttgttatgattgaggttggggagtacaaggtcaaggaaggactatactatacaaaggaccatgaatgggctcaggttctagaagatggaaccgtgctcgttggcataactgattatgctcagaaggagcttggagatttagcctatgttgaattacctgaggtaggaaaggaagttagcaagggagacgtgttatgtgaagttgaaagcgttaaggccgtgagcgaagtttacgctcctgtaagtggggaggtcattgaagttaacgaagagctaagtgatagccccgaaaagattaacgaggatccgtatggggcttggatagccaaaataaaaccaaagaacctagaggaagaacttaaagagttaatggatgcagaaaaatacgcggagtacttgaaaactctctaa

SEQ ID NO: 24981 - DNA, 1206 bp, Pyrococcus horikoshii
gtgaccctaatgataagggcttctaaaagagctctttctatagaatacgcaattagggatgttgtactacccgctagagagctcgaaaaaaagggcataaaagtgatcagactaaacattggcgaccccgttaaattcgacttccagccaccagagcacatgaaagaggcatactgtagggcaattcaggaaggtcataactattatggagacagcgagggattaattgagcttagagaagcaatagtgaaaagggaaaaggagaagaatggggttgatataactcccgatgacgttagagttacggccgctgtaacagaggcactacaattgatattcggggcccttctggatccaggagatgagattctaatcccaggaccgagctatcctccatatacgggcttagtgaaattttatggcggaaagccagtagagtatagaacaattgaggaggaaggatggcaaccagatatagacgacctaaggaaaaagataagtgaaagaacgaaagcgatagccgttataaatcctaacaatccaacgggggccctatacgataagaaaactatagaagagattataaacgttgcaggagaacacgatttagtagttttaagcgacgaaatctacgatttgatgacttatgaaggaaaacacatttctcctggctccttgaccaaggatgttccagttatagtcatgaatggattatcaaaggtatactttgccacgggatggaggcttgggtatatgtactttgttgatcccgaagggaaattaagcgaagtcagggaagcaattgataaactagcaaggataagaatatgtcctaacacaccaggacaatttgcagcgatagcgggattaacaggctccatggactatcttaaagagtatatgaaaaaactaaaggagagaagagacttcatatataagagactcaatgaaattccaggaataagcacaacaaaaccccagggggcattctatatctttccaagaattgaagaaggcccatggaagagtgataaggaatttgtgctcgacgttctacataacgcccatgtcctattcgttcatggctcaggattcggcgaatatgggaagggacacttcagaattgtattcttacctccgattgaaatcctcgaagaagctatggacaggtttgagaaattcatgagggaaaggctttcttcatga

SEQ ID NO: 24982 - DNA, 2040 bp, Pyrococcus horikoshii
atgctcaatgggatcggaatgggagttagggttgtatgcccatactgtggctttggttgcaacctattaattgacccgaaaagtaggagggtaaagccttatcctggagaacccaacaggggaaagctttgccctaagggattgtatgctttggagcatgtattctcaaaggatagactaaagcatcctttaaaaaaagaaggggaaagctttagaagaatttcatgggaaaaagcgatctccgaaatatcaactaaactgaaggagatcatcgaggattatggcccaggatcaatagcatttattgcctcatcgaaggttactaatgaggaaaattacctaatacagaaaattgcgagacttcttgggacgaataatgttgacaactgtgctagactctgtcacgaatcaagcgtccatgcccttaaacttaccttaggagatggcgttcagacgaacccatactcagatctagagagatttggtgctataatgatctggggttacaatccagcagagacccatccagttgtcatgcaatacatactcggcgcgaaaagaaggggaggcaagataatagtcattgacattagggaaacgctcacaatgagatttgctgattacaggctcgttataaaaccgggaacagatataacgctcgcaaatgctattatgaacgttataatagagggcaacctctacaataaagagtttgtagagagcagaactactggattctcagagataaggatgggggtgaaaaagtacacacctgagtacgctgaaaaggttaccggcgttccagctgagctcataagggaagttgctgaagtttttgctaaagctggaagcggcgcgataatgtggggaatgggaataactcagcaaatttccggcgttgaaaatgtcttggctttggtagatattgcccttcttttaggatatttcggtgagaagggaggattgtacccaatgagagggcagaacaatgttcaaggcgctgcgtacatgggaacattgagtgaatttcttcccggttacattcccttaagcgattctaaatttaggagaaaagttgctaagatgtggggagtggaggatcttcccaccgaaaggggattttatttaactgagtactgggatgctatacttaaaggtgacttaaaggccctctacatcgttggtgagaatccagcggtgagcgatgctaacgcgctgaaggttagaaaagctttaactaagcttgaccttctcgttgttcaggatctgttcctaacgaaaacagcgcgcttcgcacactacatccttcccgcagcggccttctgtgagaaggaaggttcctatatgaacagcgagagaaggatccagtggagttttaaggtctgcgatcctcctggagaaagtaagcctgactgggaaatccttgtaatgcttgcaagggccttaggccttaagggttttgactattcaaaagttgaggatataacgagggagtactttaaactctttccagcgcttaggaatagaagcatcgaggaacttaaagcaaggggaattataattcctgctccaaggctatacgttgattcgtttaatacacacgatggaaaggcccggttcgtagctgttgaacagatcatgccctgggaggaaccaaacggagagtatccacttatacttacaaccgtcaggctgataaatcactacaacacgggagagatgacgaggagaagtccttccttagctaagatgtctggagagtcagttgtctttataagcagggaggatgctcgggagtatggaattgaggatggtgactacgttatcgtggagacgagaaggggaagcttaaggctaaaagcaaagatagcgaaaatccaaaagggcgtcatagcaataccctttcactttgatgccaatctgctgacaaacgatgcgcttaacaaggccggaactccagagtttaagttttcagctgcaaggattagaaaaattgaaaaggaaaattatgggacaaagtgtgatgagggtaagggttag

SEQ ID NO: 24983 - DNA, 1920 bp, Pyrococcus horikoshii
gtgaaatacatgttctccgcgtgcatgagggattgttatgatacctgttcaataatgagcgagattaaaaatgggaagttaatagtgaggggaaaccccgatcatccaataactcaaggtttcctgtgtcccaagggggctctgttacctaggtggtttcactccaatgaaaggctaaaatctcctctcgtcagggaaggtaagaggggagatgaggattttaaggaagtttcttggggagaagccctcaccttaattaaagaaaagcttcaggagactataaaagagtacgggagcgaaagcattctagtttataagtacgctggagacagaggaattgtcaactattacttcccgatgcgtctcttccactatcttaatgctagcactatagatagtggtatatgcgacagagctggacaggaggctctaaaagatatctatgggactgcagttgggatggatcctgaaaagattaaggagcataaactcctcgtctactgggggataaatgccttctggacgaatcttcatggcttcatgctggcaaagaagggtaatgtagaaatttggacggtagatgttgtgagaactgaaaccgctaagaggagcgataaattcttccaaataaggcctgacacagatgtactatttgcattaggagttgcaaaggttataattgaagaggagctttatgacaaggactttgtaactaagaatgtctatgggtttgaagaattcaagaattatgtaactagactatcacttaattatgtaagccaagagacaggtattaaaccagagaggattaaagaatttgcaagggaatttactgagaagagggggataattcacataggttatggctttcaaagatccctagctggtggagaagctgtaagggcagtggcgatcttaccagtgttggttggtcataagttcggctttatatatgacatgaagacgatagataaaagctatgccgaggggaaattcctgagaacaaaacctgagaataagatcccacaaatggagcttaccaaggtaatagagagcgatgatatcaaattcctctacatttataattcaaaccccttagctagctatcctaatcagaacaggcttagaagagccttaaagaagagtgacgtttttgttgttacccatgacatattccttacggataccgctctattttcagacgtagttcttccagctaacacctttttcgaaagactagatatagttgactcttactatcacagatacgttctattgaatgaacccgtcgctaagggcccaggaaagagtaacagtgaggtgactaggcttatagccaagtccctgggtattagggtcccctatctatatgaaagcgatgaagacgtgattaggaaggttttagaggccaatggaataagttttgaagagcttaagagaagaggttttataaaggtgccagaaggaccaaggaattggaaaacccctagcggaaagatagagttctactctcaaagagctgtttccaggggcctaggaccatttccagagtacaagaagttcaagggcaagtacccgttgaggttgctaactcctacccacaggatgacgataacgagccaatatcataccacccatgggattatagatccaaacttatacatgaatccagaagatgcaaaggttagaggcattaaggatggggataaagtcggtgttttcaatgaaaatggtagagttataactaaagttaagataactgaagatgttccaaaaggagttgttatcctatacaaagctttttggcccaagttacttggttggaatgcaaacttcttaacgacagatgagaaagtagaaaaatatggcaagggatcagcgttccattcaacttgggtggaagttaatccatatggatga

SEQ ID NO: 24984 - DNA, 927 bp, Pyrococcus horikoshii
atgtacgcaattgaagttgagaagctaactaaaagttatggaaaatttaaggccattgataatctatcctttgttgtagatgaggggatagtgttcggcttcctgggacctaacggagctggaaagacaacgacgatcttaagcatgctcggcattataatcccagatagtggagacgtaagaatacttggctatgatatatttaaggaacctcttaaggctaaggagagacttggattcctaccagaaaatgccacgatatacgaagagttaacggcatggagaaaccttgactttttcgcaagcttctacagaatgtcaaaacaggaaaaagaaaagaggatcgaggagctcctaaagttagtgggactatgggatgtgaggtacaggaaggcaaagacgttctctaagggtatgaggcagagactcctcctcgctcaagccctcataaacgatcctgaacttttaatcctggatgaaccaaccagtggcctggatcccgaaggagcaagactagtaaaagatataattagggagcagagaaagcagggaaagactgtcttcttttcatcccacatacttagtgaagtcgaagaactagcagataaggttggaataatagttaagggaaagcttagaacggtaggaacactggaggagataaagaagcagtacatggaattagagggatacgagataaagatagaaactaagcaaccattacctgagcttgaaattccagatataataaggatcgaaaagacaaccgagaataaggcaataatcttcgcaaagtctgatataagggaaagcataagtgaagagttagccaagaaggggatcaccattataagccttgaaattgaggagcctagcctagaggatgtattcttaaagacaatatataggagggaaggaaatgaatag

SEQ ID NO: 24985 - DNA, 1170 bp, Pyrococcus horikoshii
atggcgctaagtgacagattagaattagttagtgcttctgaaattagaaagctctttgatattgctgcaggaatgaaggatgttatctccctgggaataggggaacctgattttgatacgcctcaacatattaaggagtatgccaaggaagccctggataagggattgactcattatggtccaaatatagggcttttagagcttagggaagccatagctgaaaagttaaagaagcagaatggcatagaggctgatccaaagacagagataatggtcttattaggtgcgaaccaagctttcttaatgggcctctcggcttttcttaaggatggtgaagaggtattaataccaactccagcctttgtcagctacgcacctgccgttatattggctggaggaaagcccgttgaagtcccaacgtacgaagaggatgaattcaggctaaacgttgatgagcttaaaaagtatgttaccgacaagactagagctttaataataaactcaccgtgtaatccaacgggagcagtgttaactaagaaagatctagaagagatagcggattttgtcgttgaacatgatctaattgtaataagcgatgaagtttatgagcacttcatttacgatgatgctaggcactacagtatagcctccctggatggaatgtttgaaaggacaataaccgttaacggattctcaaagacgtttgcaatgacgggctggaggttgggatttgttgcagcgccttcttggataatagagaggatggtgaagtttcagatgtataacgctacttgtccagtgactttcatacaatacgctgctgctaaagcgttaaaggatgagagaagctggaaagctgttgaagagatgagaaaggagtacgacagaagaagaaagctcgtgtggaagaggcttaacgagatgggactcccaacggtaaagccgaagggtgcattttacatattcccgaggataagggatactgggctaacgagcaagaaattcagcgagctcatgcttaaagaagctagggttgcagtagttccaggtagtgcctttggaaaagccggtgagggatacgtaaggatcagctatgcaacagcttatgagaagcttgaagaggccatggatagaatggaaagggtgttaaaggagaggaagctagtttaa

SEQ ID NO: 24986 - DNA, 1566 bp, Pyrococcus horikoshii
atggatatggagcaaagggaaaggtgggcaacaaagattggacttattttagcaatggcaggaaatgccatcggtctaggaaacttcgttagattcccaactcaggttgctggaaacggtggaggagcattcatggttccttatttccttgcactgttcctccttggaattccagtgatgtgggttgagtgggttcaaggtaggtacggtggaaagtacggacatggtaccctaggtccaacgttctacttaatggctagggaaagtttaaagcctagaagtgcgttgtggtttggtttaatcggtggagctttagcgtttgcaacgacaaccttgcttaacagctactaccttcacttaatcggctggtccgcggcttactcgtggttcagcataactggagcatactacggtaagaatacagcccagttcttcagccaatatctgagtaaccatggtctcgtgttcctattctggggaataacggtagttctcctgggaatagcagttggacaaggcgtaagtaagggaattgagagatgggttaaggtaatgatgcccctcttgtatgtgtttgcaataatcctagtaatctacgtgtttgctttaggttctccactaggacaaccccagtggtcaacaattaagggattcgagttcatctggtcaccaaactggggctatctaaaggatcacctatggaaagtaatgcttgcagcgagtggtcagatattcttcacgctctctctaggaatgggtatcatacagaactatgcttcgtacctagggccaaaggatgatgttgcactatcaggattagcaactgtttcactaaacgagtttgccgaagtagttcttggtggttcaattgcagttccattggcagttgcctacgctccaaagatcgttcctccagatgtccttgcaaaaggaagtgatgctgcattagcctggatttcggagaactttggactcggattctcatacacgagccttccaaacatattcgtgcagatgggaacagcaggaaggttctttggagctctatggttcctcctgctctggtttgcaggatttacctcagcaatagcaatgtataactatttaaccgcactacttgaagaagatctaggaataaagaggagcgttggaacatgggtagtcttcataatctacttcctcctgggaattccagtagtttacataaatggttatcttgaccaggtagatgcctggataagcttccagcttgcactacttgcattgttcgacataattgtcagcgtatggctattcaagccagacaacttctggagagagctacacgagggagcactaattaacgttccagagttctacaagtggataacggtgataatagcaccaatattcatagcactaccactgtttggtacgttcactgacctagtaagtaaaactctcgggtggccagctaagatagcaatactcacaatgctaaccattggtgcaattgaagcctactacgctatcaagaagaagtatggcgaagaactagagaagaacgaggtaataataaaggtctga

SEQ ID NO: 24987 - DNA, 624 bp, Pyrococcus horikoshii
gtgttgcaattgaccgagaaattcaaaggtacaactacagtaggcatagtttgtaaagatggagtagtgctagctgcagataggagggctagcctagggaacataatatacgcaaggaacgtgactaagatacacaagatagatgagcatctagccatagctggggccggtgacgtaggcgacatactgaacttagttagactccttagggcagaagcaaagctttactattctcaatcagggaaaaggatgagtgtaaaagcattggccacactgctggctaatattatgaatggagctaaatacttcccatacctcgcatggtttttagttggagggtacgatgaaaagccgaaattatattccgttgatatggtgggagggataactgaggataagtacgcaactgccggaagtggtatggagtttgcatattcgattcttgactctgaatataaagataatttaacccttgaagaaggtataaaactggccgttaaggcaataaacacggcaattaagagggatgtattctcaggggatggtattctggtcgttaccataacaaaggagggttacaaagagctttcagattcagagcttgaagcaactctcaagcagtga

SEQ ID NO: 24988 - DNA, 1032 bp, Pyrococcus horikoshii
atgggtgttcctatcggtgacctcgttccgaggaaggagatagatcttgaaaatctgtatggaaagaagatagcgatagatgccctaaacgccatctatcagtttttatcaacgataagacagagggatggaacaccacttatggactctaagggtaggataacctctcatttaagtgggctcttttatagaacgataaatctaatggaagccggtattaagccggcctacgtctttgatggaaagcctccggaattcaaaaggaaggagctcgaaaaaaggagggaagctagagaagaggcagaactaaaatggaaagaagctctagccaagggaaacctggaggaagctaggaaatacgctcaaagggcaactaaggttaatgaaatgctaatcgaagatgcaaagaagcttttgcaactaatgggaataccaataattcaggctccaagtgaaggagaagcccaagcggcatacatggcaagtaaaggggatgtctacgcgtcagcgagtcaagattatgattcactactctttggtgctccaaggttgattaggaatctgacaattacgggaaaaagaaagatgcctgggaaagatgtttacgttgaaataaagccagagttagtagttctagatgaggtactaaaagagcttaagataacaagagaaaagcttatagaacttgcaattctggttgggactgactataatcctgggggcgtaaaggggataggacctaagaaggcccttgagattgtaagatattcaagggatcccctagcaaagttccaaagacagagcgatgtggatctttacgctattaaggaattcttccttaaccctcctgtcactaatgaatactcgcttagttggaaggagcctgatgaggaaggaatattaaaattcctctgtgatgagcataattttagcgaagaaagggtaaaaaatgggatagaaagactaaaaaaggcgataaaagctggaagacaatcaacgcttgagagttggttcgttaaaaagaaaccctaa

SEQ ID NO: 24989 - DNA, 1365 bp, Pyrococcus horikoshii
atggagttgaagccaaacgttaaagagatacccggaccaaaagctaggaaagttattgaggagcaccacaagtacatggcaaccacgacaaacgatccaaacgagtacttcctagttatcgagagggcagagggagtttattggatcgatgtcgatggaaacgtactcttggatttctcctcaggaatcggtgtcatgaacgtaggacttaggaatccaaaagttattgaggccataaagaagcaacttgatctggtacttcacgctgctgggactgactactataacccatatcaagtagaacttgcaaagaagctcgttgagatagccccaggagacatcgaaagaaaggtcttcctaagcaatagtgggaccgaggccaatgaggcagcgttaaagatagcaaagtggtccacaaacaggaagatgttcatagccttcattggagcattccatggaagaacccatggaactatgagccttaccgcgagtaaacctgtccagagaagcagaatgttcccaacgatgcctggtgtagttcatgttccatatccaaatccatacagaaatccatggggaattgatggttatgaaaacccagatgagttgataaatagggtaatcgactacattgaagagtacctctttgagcactacgttccagccgaagaagttgccggaatattctttgaacccatccaaggtgagggaggttacgtagttccaccaaagaacttcttcaaagagctcaagaaattggcagataagcatggaatactcttaatagacgatgaagttcagatgggaatgggaagaactggaaggatgtgggccatagagcacttcgatatcgttcccgatatagttaccgttgcaaaggcccttggtggtggaatacccatcggagcgactatattcagagctgaccttgactttggagtcagcggtgttcacagcaacacattcggaggaaacactgtcgctgcagctgcagcccttgcggtgatagaagagcttcagaatggtttaatagagaatgcccagaagctggaacctctcttcagggagaggcttgaggagatgaaagagaagtatgagataatcggtgatgtaagaggccttggacttgcatggggagttgagttcgttaaagataggaagaccaaggaatatgcaaccaaggaaagaggagaaatagttgtcgaagcccttaagagaggtttagcattgcttggctgtggaaagagtgcaataaggcttatcccaccattgataatcagtgaagaagaggcaaagatgggattggatatctttgaggaagcaataaaggtcgtcagcgaaaggcacggatacaagattcattag

SEQ ID NO: 24990 - DNA, 933 bp, Pyrococcus horikoshii
atgaatttggtgtttgggatgatagcttcaattggagagctcctaattgacttgatatctgttgaagagggtgacttgaaggatgttaggctctttgaaaaacatcctggaggggccccagccaacgttgccgttggtgtttctagacttggggttaagtcttcccttataagtaaagttggtaatgatcctttcggcgagtacttaattgaagaattatctaaagaaaacgtggatacaaggggaatagtaaaagatgagaaaaaacatactggaatagtgttcgtccagctaaagggtgcgtctcctagctttttattgtatgatgatgtcgcctatttcaacatgaccctgaatgatatcaactgggatattgtggaggaagctaagatcgtaaattttggatctgtaattctagctaggaatccaagcagggagacagtaatgaaggtcattaagaagataaaagggtcttctctcatagcttttgatgtaaatttaaggctggatttatggagaggacaagaagaggaaatgataaaagtgcttgaggaatcaataaagctagcagacattgtaaaggccagtgaagaggaagtcttatacctagagaaccaaggggttgaggtcaagggaagtatgctgacggccataaccctgggtcctaagggatgtaggttaataaagaatgaaacagtcgttgatgttccttcctataatgttaatcccctcgacacgactggagcgggagatgcattcatggccgctttacttgtcggaattctaaagttgaaagggcttgatctattaaaactcggtaaatttgcaaaccttgttgctgctttgtcaactcaaaaacggggggcgtggagcactccaagaaaagatgaactattaaaatataaagaggcgagggaagttctagctccttga

SEQ ID NO: 24991 - DNA, 1056 bp, Pyrococcus horikoshii
atgaggcgaggtaagatgcacctaatggaatttccacgagaagtcattcttggaaaaaatctaatccaggaaattaataatgtaattaagagactcaaactcggttctcctggattagtagtttatggtccaataacgaaaaagatagcaggttcaaatgttgagaagatagtaaaagaggaatttgaagtttattccattaccgttaaagaagctcacataaatgaggttgagagggtaatcagtaaaataagagataaaggcattaaatgggcaattgcagttggagggggaagtataatagatgttacaaagctggcaagttttaagatgggaattccattcataagttttccaaccaccgcatcacacgatggtatagcaagcgctaatgcatccattaaaggcttaaacgttaaaacatcaataaaggctaaacctccaatagccgtcattgcagatatagatgtaataaaaacggccccaaaaagatacctagccgctggagttggagatatcgtaagtaatataaccgcagtaagggattggaaacttgcacataagcttaaaggggaatacttcagtgaatatgccgcttcactaagcttgatgagtgcaaagatggttatccgggatgccgagataattagacttggacaggatgagggaattagaaaggttgtcaaggctctaatatcaagtggagttgccatgagcatagctggctcctcaagacccgcaagcggtgctgagcatttattcagccatgccctagatatgctgttagataaaccggccctccatggagagcaaacaggcattggaaccataattatggcatatcttcatgggatcaactggaagaaaataagggatacattgaagatagttggggctccaacgacagcttacgaactaggtatagatcccgagattataatagaagctctaacgatagcccatacaattaggccagagagatatacaatcctgggtaaggaaggcataactagagaggccgctgaaaaggctgctaaaataacgggtgtaatttga

SEQ ID NO: 24992 - DNA, 363 bp, Pyrococcus horikoshii
gtgatgagaaagctaaaaactcttcctccaacccttagagataagaatagatacattgcatttgaaataattagtgatggtgattttacaaaagatgaagttaaagagctcatatggaaaagctctttagaggtacttggtgaaacaggtactgctatcgttaaaccttggcttataaaatttgatcctaacacgaagactggtatagttagatgtgatcgagagtacgttgagtaccttagatttgcgttgatgctagtttccgagttcaatggtaaaagactaattataaggacgcttggagtctctgggacaataaaaagactaaaaagaaaattcttagcaaagtatgggtggaaatga

SEQ ID NO: 24993 - DNA, 903 bp, Pyrococcus horikoshii
gtgactaagcaaaaagtttgtcccgtttgtggatcaacggaatttatttatgaccctgaaaggggtgaaatagtctgcgcacgctgtggttacgttattgaggaaaatataatagacatgggaccagaatggcgtgcttttgacgcttctcagagggaaaagagatccaggactggggctcctgagagcatactattacacgataagggactttcaaccgacataggaatagacaggagcctaaccggattgatgagggagaaaatgtataggctcaggaagtggcaatcgaggcttagggttagtgatgcagctgagagaaatttagcgtttgcattgagtgagttggacagaataactgctcaattaaaattgccaaagcacgttgaggaagaagctgctagattgtatagggaggccgtgagaaagggattaattagaggaagatcaattgaaagcgtgattgcagcttgtgtttacgccgcatgtagattattaaaggttcctagaacattagatgaaatttcagatatagctagagttgaaaagaaggaaattggaaggagttatcgtttcattgctaggaatctaaatctaactcccaaaaaactatttgtcaaaccaacggattatgtaaataaatttgcggatgaacttggactcagtgagaaagtcagaaggagggccatagaaattttggaagaggcctatcggagaggactaactagtggaaaaagtccggcaggattagtagctgcagccctatacatagcatctcttcttgaaggagaaaagagaactcagagagaggtcgcagaagttgctagggttaccgaggtaactgtaagaaacagatacaaggaactcgtagaaaagttagggataaaggtgcctattacctaa

SEQ ID NO: 24994 - DNA, 1287 bp, Pyrococcus horikoshii
atgccaaaggagaagccccacgttaacatcgtgtttatcgggcacgtagaccacggaaagagcacgacaatcggaaggctcctttatgatactgggaacattccagagacaatcatcaagaagttcgaggagatgggcgaaaagggtaagtccttcaagttcgcttgggtcatggataggcttaaggaagagagagaaagaggtattacgatcgatgttgctcacaccaagtttgaaactccacacaggtacattaccatcatcgatgctcctggtcacagggacttcgttaagaacatgatcaccggtgcttcacaggcagatgctgcagttctagtcgttgcagctactgatggggtcatgccacagactaaggagcatgccttccttgcaagaacgctcggtatcaagcacataattgttacaataaacaagatggatatggttaactatgaccagaaggtcttcgagaaagtaaaagctcaggttgagaagcttctcaagacccttggttacaaggacttcccagttattccaacgagtgcttggaacggtgacaacgtcgtcaagaagagcgacaagatgccttggtacaatggtccaactctaattgaagctcttgaccagattccggaacccgagaagcccatcgacaagccgctcagaatacccatccaggatgtgtactcaattaagggtgtcggtaccgtcccagttggaagagttgagactggtaagctcaaggttggagacgttgtaatctttgagccagcatcaacgatcttccacaagccaatacagggtgaagttaagagcattgagatgcaccacgagcccctccaggaggctcttcctggcgacaacataggattcaacgttagaggtgtaagcaagaacgatatcaagagaggtgacgttgctggacacaccgacaagccaccaacagtagtcagaaccaaggatacattcaaggcccagatcatagtccttaaccacccaaccgcaattacagttggttacagcccagtcttgcacgcacacaccgctcagattccagttagattcgagcagatcttagccaaggtcgacccaagaactggtaacatcgtcgaggagaacccgcagttcattaagaccggtgattcagctatcgttgtcctcagaccaatgaagccagtagtccttgagcccgtcaaggagattccacagctcggtagatttgccattagagatatgggtatgacaatagctgctggtatggtaatatctattcagaagggtgagtga

SEQ ID NO: 24995 - DNA, 1317 bp, Pyrococcus horikoshii
atgctgatattaaataacatgaaggccaatgacataattaagaggtattccaaggttatagctcaagcaaacaaaatgcactactttccactcgttcccgtaaaggccgagaatgctaaggtgtgggatatcaacggaaaggaatacatcgacttccttagcgatgccgcagttcaaaatgttgggcataacaatccaagggttgtaaaggccgtgaaagagcaggtggataagttaatgcatgcaagctacatatatgcctaccccattgaaccgctactcctcgctgaaaagctagccgagatagctccaatagataaccccaaagtatcatttggcctaactgggggagatgccaacgatgctgcaataaagtttgcaagagcttataccaagagacaaacgatacttagctacatgaagagtttttacggctcaacttatggagcaatgagcttaactggtcttgattttcgggtaagggcaatagtgggagagctaagcggagtccactaccttccctacccctactgttacaggtgtccttttgggaaggaaccaggaagttgcaaaatggaatgcgtcgaatacataaaggagaagtttgaaggagaagtatatgctgaaggagttgcagcactattcgccgaaccaatacagggagattctggaatagtagtcccaccaaagaattacttcaaaaaagttaccaaaatcttgagagaacatggaatattgttagttgtcgacgagatacagagtggaatgggaaggactggaaagtggtttgcgatagagcactttggagtaaaacctgatataatcaccgtaggaaaagccttaggtggaggtttacctataagcgctacaataggaaaagcagagattatggattctctacctccacttagtcatgcattcactctctctggaaatcccactacctcaagagcggctttagctgttatagaggaaattgaggaaaagaatctactaaggagggccgaaaaattaggaaattacgcaatgaagaggctaagggaaatgatggataaacatgaattaataggggatgtcaggggaataggtttaatgattggagttgagctcgttaaggatagagaaaccaaggagagagctatagaagagactagtaaggtaattgagagagcttttgatcttggattaatagtcactcactttagtggcaacgtccttaggatagagccacccctaacaatagagagggaaaccctagatgagggtttagatgtcctcgagaaggccatagaggatgttgaagaaggccgagtatga

SEQ ID NO: 24996 - DNA, 912 bp, Pyrococcus horikoshii
atggtgaaaaggatgctagaggtaaaactctttggcattagatttgaaaatcccctaatattagcctctggagtagttgacatgacaccggaactactcaggagagcccacaatgaaggagcaggaggagtcgttacaaaatccataggtaaggaacctagaaagggttacgataatccaactatcgttgaactaccctacgggttaataaatgctatgggtctcccaaaccctggatgggaggcatttttaaatgaatttattgatgaaaggtttgactttccagtgatagtttcaatatttggaggcacaccggaagagtttgcatttcttgcagagaagttagaaccagttgcagatgcctttgaattaaatttgagctgtccccatgcgaaaggctatggtatggaaattgggcaagaccctaaaaatgtgtatgaagttgtaaaagctgtcaaggatgtaacagataagccagttatagccaaactaactccaaatgttaatgacataacaaagctcggattagcagcggaaagaggaggagccgatggggtttcagcaattaatactgtgaaagcaatagccattgatatctacgctaagagaccgatacttagcaataaagttggaggatattcagggccggggataaaaccaatagcgcttagggctgtttacgatttagcgaaggttttagatattccagtaattggaattggaggaataactagctggcgggatgctgtagaatttttactagcaggagcatctgcccttcagataggaactgccgtataccttagaggatttaaagtgtttaaggaaatttcgaatgggataattgagtacctcaaggaggagggattctcaagtattagggatatcatcgggctagccctcaaggtttaa

SEQ ID NO: 24997 - DNA, 3354 bp, Pyrococcus horikoshii
atgagaggtccaactgttgtagaggttactcccgacgacctttggattgttatggagagctactgggaagaaaagggacttgtaaggcagcatcttgattcttacaatgctttcatcgagaggggtctccaggaagttgtcgacgaatttggaggaataaaaccagatattcccgattttgaagttaagtttggaaaaattagagtaggagagcccgagtttcaagagcctcatggtcagagaaaaccactttatccaatggatgcaaggattaggaacttaacttactcggccccactatacctggaaatgatccccgtgataagggggattgaacaggatcccgttgaggttagaataggtgaacttccaataatgcttaagtctaaggcttgtaggctctatggccttagtgatgaggaactaataaagcttggggaagatcctaaggatcctggtggttacttcataataaatggttccgaaagagtgatagtttctatagaggatatagcccccaatagaacgctagttgagaaagatgagaggcaagaaaagtatatagcaaaagttttctcgtataggcatggttacagggccctcgtaaccgttgaaagaaagaaagatggaatcctttatgtagggattccaaacgttcctagacctgtgaagtttgtctatgttatgagagctctaggacttgaaagggataaggatatagtcgatgcagttggaaacgatcccgaggttcaacagatattattcgataacctagaggatgctagtgatataacaacacaacaggaagcgctagaatatattggaaagcttgttgctcctggtcaagctagagaatacaggctaaagagggctgagtacgttatagataataacctccttcctcacatgggagttactcccgaggacaggataagaaaggcttactatcttggaatgatggcactgaaagtaatagagctatccctcggaaagagagatgaggatgataaggatcactatgcgaacaagaggttaaggctggcaggagatcttctaaaagatctctttagagttgcattcagtcagttaattaaggatatacagtatcagatgactaagacatatcaaagaaggggagagaaatatgtgtttagtaacatccacagattcataaggaactcgattagacctgatgttctcaccgagaggattgagcacgccttagcaactggagcttggccaggaggaaggacgggtgtaagccagcttttagacagaacaaactacgtttcaacattgtctcaccttaggagggttacatctccccttgacagagaacaaccccacttcgaggctagagatctacacgggactcattggggtagaatatgtcctactgagacacctgaaggtccaaattgtggattggttaagaatttagccttgatggcccagataacaacagcagtcccagaagaggaagttagggagtacctgatgtccctgggaatagttccaatagaagtgagaagaccgagtcctgagctttggagagtctatttgaatggagttctaattggtaccgttgaggatggtaaagcccttgttgaaaggataaagaaagacagaagaagtggaaagataagtgacataataaacgtagcctactatgaggatgttaaagaggtttacgttaacagcgatgatggtagagttaggaggcctctgattattgttgaaaatggtgttcctaagctaactaaggagcacgtgcaagccattaaggaaggaaggcttaagtggagtgatctagtcagaatgggcgtcatcgagtacctagatgctgaagaagaggaaaatgcctacgttgccatgtggccatgggaagttaccaaggagcacacccacttggagctaatgccggccgctattctaggattacctgcgtctttgattccatacccagagcacaatgctgctccgaggaatacctatggtgcaggtatggccaagcagagccttggtttagggtgggctaactttagaataagggtagataccagaggtcacctacttcactatccgcaaattccacttgttaactcgaggataatgaaagctgtcggttatgaagacaggcctgctggtcagaacttcgtagtcgcagttttagcttaccacggttataacatggaagatgcaattataataaataaagcctccatagagagaggactggcaaggtctacattcttcagaacatacgaggccgaggaaaagaagtatcttggtggtcagacagatagatttgaaattcccgctcctaccgtaaggggatataggggagagaagtactatagacacctggatgaggatggcctaatattccccgagtcaaaggttgagggtaaggatgtcctgataggaaggacatccccgccgaggttccttgaagagagagggttaggggccgtgagcctacaagaaaggagagaaacgagcgttgctgtaagacctagtgaaaagggaatcgttgacaaggtaataattaccgagacgggggatggaactaagctcgtcaaggtcaccgttagagaccttagaataccggagatcggtgataaattcgcttcaagacacggtcagaaaggtgtcataggattaatcgttccccaggaagatatgccctggactgagagtggaatagttcctgacctaatagtcaatcctcacggtattccatcgagaatgacagttggtcagttgcttgaagccatagggggcaaggttgcagccctgaagggaaggagagttgatggtactgcattcattggagagcccgaagaaaagctaaggaaggagctcgaggagcttggctttaagcacactggaagggagataatgtacgatggtataacaggtaagaggtttgaggccgacatattcattggaataatctactaccagagattgcaccacatggttgccgataagatacacgcccgttcaagaggtccagttcaggttctcactaagcaaccaacagagggtagggctagagaaggaggtctgaggtttggtgaaatggagagagatgtcctcgttggtcatggagctgcgatgctactcattgagagattgcttgaagaaagcgataaaactgaggtatgggtctgtgaaaactgtggtcacatagctatagaggataagaggagacataaggtctattgcccagtttgtggagaggaggaaaggattagcaaagttgaaatgagttatgcatttaagcttctcctggatgagcttaaggctatggtgattagacctaagttaaacctcacggagagggtgtga

SEQ ID NO: 24998 - DNA, 783 bp, Pyrococcus horikoshii
atggcattcgttccaccacaagcagggtacgatagggctattaccgtgtttagtccagatgggagattgttccaggttaactatgcaagggaagcggtaaaaagaggagctaccgctgttggtgttaagtgcaatgaaggtgttgttttagccgttgaaaagaggatcacaagtagattgatagaacccgaaagctatgagaaaatctttcaaattgacgatcatatagcggctgcttcgagtggtataattgcggatgctagggttcttgtaaatagggcgagacttgaggcccagattcacagactcacgtatggtgagcctgctccgttagctgtgatagtgaagaagatatgtgacttgaaacaaatgcatacccaatatggtggggttaggccttttggtgctgctctacttatggctggagttaatgaaaagcctgaactttatgaaacagatcctagtggcgcttattttgcgtggaaggccgtggcaataggaagtggaagaaatacagcaatggccatatttgaggaaaagtacaaggatgatatgagtctagaggaagcgataaagttggccatttttgctctagctaagacgatggagaaaccgagtgcggagaatatcgaagttgcgataataaccgtgaaggacaagaagtttaggaagctatcaagggaggagatagagaaatatctaaatgaggtaatgaaagaagttgaggaggaagaggttaaggaaaaggaggaggattattcagagctcgatagccactactga

SEQ ID NO: 24999 - DNA, 1269 bp, Pyrococcus horikoshii
gtggatatggttgagcaggatccctttgaaattgcagttaagcagcttgagagagctgcccaacacatgaagataagtgaagaagctctcgagttcttgaagaggcctcagaggattgttgaggtcacaatccccgttgaaatggatgatggctctgtaaaagttttcacaggatttagagtccaatacaactgggctaggggtccaactaaaggtggaattaggtggcatcccgaagagactctaagtactgttaaggcccttgcagcttggatgacctggaagactgctgtaatggatctcccatacggtggaggtaagggtggaattatagttgatccaaagaagctctccgatagagagaaggagagacttgcaaggggctacattagggccgtttacgatataataagcccatacgaggacatacctgctcccgatgtttacaccaacccacagataatggcttggatgatggatgaatacgagacgattgccaggaggaagacaccagcctttggtataataaccgggaagcccctcagcatcggtggatcccttggaaggaatgaggctaccgcaagaggagcaagctacacaattagggaagcagctaaggttcttggatgggacggactcaagggtaagacaatcgcaattcagggttatggtaacgcaggttactacctagcaaagataatgagcgaagattacggaatgaaagtcgtagccgtaagcgacagcaagggtggaatttacaacccagatggccttaacgctgatgaggttctcaagtggaagagggagcatggaagcgttaaggacttcccaggagctacgaacataagcaatgaagaactacttgagcttgacgttgatgtcctagctccggcggctatagaagaagtcataaccaagaagaacgcagacaacattaaggctaagattgttgcagaggtagccaacggtccggttaccccagaggccgatgagatactattcgagaaaggaatccttcagattccggacttcctatgtaacgctggtggagttacggtcagctacttcgagtgggtgcagaacataaccggttactactggacacttgaagaggttagagagagacttgacaagaagatgacgaaagcattctatgacgtctacaacaccgcaaaggagaagaacatacacatgagagatgcagcttatgtagttgcagtccagagggtctaccaggcaatgctcgatcgcggatgggttaagcactga

SEQ ID NO: 25000 - DNA, 1257 bp, Pyrococcus horikoshii
atgaggatagcagttttagggttgggttatattggccttccaaccgcgataatgtttgcatcatctggatatgatgtcgttggctatgacataagatctgaggttatcaaaaagataaactctggagttgcccacataatagagcccgaaatagataggaggttaaaggaggtattatcacttggaaagcttaaggttactgatagggtggaagacctaaagggttctaatgtgttcataatctgtgttcagactccactttcaggagatgaccccgacttaagctacttggaaagagctattagaaccgttgcggaggttatggataggggagctctagttatcattgaaagtactatacctccaggcacgacagagaaaatggccaggcttttggaaaacttaacaggattaagggaaggggttgacttttatgttgctcatgcccctgagagggtgatgccgggtcggatatttaaggaactcgtttataactcaaggatcatcggtggggttagtgaaaaagcagcgaacttggccgagaagctttatagatcattcgttaagggtaggatattcttgacgaatgcaacgaccgctgaaatggttaagctaatggaaaatacgtttagggatgttaacattgcattggcaaacgaatttgccctgcttgctcatcagtatggagttaatgtctatgaagctatagagctagcaaacacgcatccaagggttaagatccacaccccgggaataggagttggaggtcattgtcttccaaaggatccttatctattattgtctaacgccaaagaagattttggtttgataagaatcgcgagaagaataaatgagagaatgccagcatttgctgctggtttactttttgaagcattagagaaggcgaatataaagccttccgaggctatcattgctgttcttggtctcgcatataagggagggaccgatgatactaggaattctccagctcttaagtttgtagagataattcgcaactccgtaaaggaggttagaacttacgatccatacgttaggggaactcatgattccctggagaaagttgttgaaggagctgacgcaattgttatagcaacggatcatcctgagtttaagagtgtaaattgggaaagcattggaaagtcgatgaggcataaaataataattgatgggaggaacattattaaagagcctccagttggctttatatttaggggtattgggaggggggacgtttga

SEQ ID NO: 25001 - DNA, 1680 bp, Pyrococcus horikoshii
atgaagtatatcgagcttgcccaactttatcaaaaattggaaaaaacaacaatgaaacttattaaaacaagactcgttgctgattttttgaagagggttccagaagatcatttagacttcattccatacttaatactgggagatgtattcccagagtgggatgaaagggagcttggagttggggagaagctgttgataaaagcagtctcaatggcaacaggtgttgacccgaaggagatagagaactcggtcaaagatactggagatcttggggaaagtattgccctcgccattaagagaagaaagcagaaatcattcttctcccaaccattaacaattaagagggtctaccaaactctagttaaaatagctgagactactggagagggaagtcaagagaaaaaaatgaagtatttagccaacctatttatggatgctgagcctttagaggcgaaatacctcgccagaacagttctaggaaccatgagaacgggagtggcagaaggattgctaagagatgcaatagctttggcattccacgtgaaggtagagctagttgaaagggcttacatgctcacgagcgattttgggtttgtggcaaaaatagcaaaagccgaaggaaatgaaggacttgagaaggtaacaatccagttagggaagcctataaagccaatgctagctcaacaagccgctaacattaaggaggcccttttagaaatggggggagaggccgagttcgaaattaagtacgatggagcaagagttcaagttcacaaagatggagagaaggtgataatatactcaaggagactggaaaatgtaaccagggcaattccagaaattgttgaagccataaaggaagctattgagccagaaaaagttatagttgaaggggaacttgtagcaataggagaagagggaagacctttaccattccagtatgttcttcgcaggttcagaaggaagcacaatatagaggagatgatgaagaagataccattggagctaaatctcttcgatgttctctatgtcgacggtaagagctttgtagatacaaagtttatagagagaaggaagaaacttgaagagatcgttaagccaaacggaaagataaaagtagcagagaacctcataactaagaacgctgaagaagctgagaaattctataagagagcactagagatgggacatgaaggccttatggcaaagagacttgatgcagtatatgaacctggaaacagaggaaagaaatggctcaaaatcaagccaaccatggaaaaccttgacctcgtgataattggagctgaatggggggaggggagaagagcacacctatttgggtcgtttatcctgggagcttacgatcctgagaccggggaattccttgaggtcggaaaagtcggaagtggattcacagacgacgacttagttgagtttacaaagatgttaaagcccttaatagttaaggaagaaggaaagagagtggttatacaaccaaagatcgttatagaagtaacgtaccaggaaatccaaaagagtcctaagtacaggagcggatttgccttaagatttccaaggtatgttgcactaagagatgacaagggacctgaggatgcagacacgatagaaaggatagcccaactctatgaactgcaggaaaggattaagggaaaagtttaa

SEQ ID NO: 25002 - DNA, 1008 bp, Pyrococcus horikoshii
atggttaagtacgttttagcttcagctcctgcaaaggtaatactcttcggggaacatagcgtagtctatggaaaaccggctatagcttctgctatagaacttagaacatatgttagagctcaattcaatgattcgggtaatataaaaatagaagctcatgatataaaaactcctggattgatagtctcgttttccgaggataagatatactttgaaacagactatggaaaggccgctgaagttttgagctatgtgaggtatgccatagaacttgccctggaggagtctgataagagggttggtattgacgtttcaataacctctcaaattccagttggggccggattgggttcctcagcagcggttgcagttgctacaattggtgcggtctctaggttacttggccttgaattgagtaaggaggaaatagcaaagcttgggcataaagttgaacttctagtgcagggagcttcaagtggcattgatcctacagtttctgcagtgggaggcttcctctattataagcaaggaaagtttgagcctctcccattcatggagcttcccatagtcgttggttacaccggctctactggttcaactaaagaattagtggcaatggtaaggaaaaggtacgaggaaatgcccgaacttgtggagcctatattggaggcaatgggaaaattagtggataaggccaaggagataatactttcaaagctcgatgaagaggagaagcttactaagcttggagagttaatgaacataaatcatgggcttttagatgctttgggggtgtctacgaagaagcttggtgagttagtttacgctgctagaacggctggtgcaattggggcaaaacttacgggtgctggtggtggagggtgtatgtatgccttggcccctgggagacagagggaagtcgccacggcaataaagatagctggtggaattccaatgataacgagggtaagtagggaaggattgagaatagaggaggtttcaagatga

SEQ ID NO: 25003 - DNA, 1026 bp, Pyrococcus horikoshii
atgagtgtgatacaaaacattatcggcagaattgccgtattgagaggtggaaaatattcggttgaggtagatgttgcaacagacgagggttttggtagattcacttcccccatagatgacaatccaatgctccatattgccgaggctagaagggcggtaagtgaagtggatgaaataatagggccagaattgataggatttgatgcctcggagcaggagttaatagatagttacctttgggagatagatggaacggaagatttcagccacataggggctaatacagcgttggccgtttctacagcgatagcaaaggctgctgcgaattcaagagacatgcccctatattcatacattggtgggacatttgctactgaattgccggttccagttttgagctttgcccaggatgacatgtttgattattatctggtagttaaagaccttctagaggttaccgatataatagatgccaccaataagatcagagagattgtgaaggagataaaccttgagaacttatcgaaagcttccgaagatgtgggggttgaacttggacttgaggtggccttgggaattggcatgaaaaaagaaatggatattgagaaggtattaaatttggttgaagattataatgtggcatacataaaaccgatagggccacctgaactttttttagagctaatagctggtacccatggagttttcattgatggggaatacctctttagaactaacagcgtacttgataggaggtactataatgcattatcaataaagcctataaaccttggaacgctcaccgatttgtataacttcgtgaatgatgtaaaggccgaaaaaataacaccaattttagccgaggcgaaatacgagcccgccgatgaaacatttccacacattgcattgggtttaaggtgccctgctatgttaataagttggagctcaattgagaagataaacgaattgaatagaattgctgaggaattgggggaaaggggaagaataataacgtttgaagagtag

SEQ ID NO: 25004 - DNA, 663 bp, Pyrococcus horikoshii
atgaaggttgctggagttgatgaagcggggagggggccggtaattggcccgttagtaattggagtagccgttatagatgagaaaaatattgagaggttacgtgacattggggttaaagactccaaacaattaactcctgggcaacgtgaaaaactatttagcaaattaatagatatcctagacgattattatgttcttctcgttacccccaaggaaatagatgagaggcatcattctatgaatgaactagaagctgagaaattcgttgtagccttgaattctttaaggatcaagccgcagaagatatatgtggactctgccgatgtagatcctaagaggtttgctagtctaataaaggctgggttgaaatatgaagccacggttatcgccgagcataaagccgatgcaaagtatgagatagtatcggcagcatcaataattgcaaaggtcactagggatagagagatagagaagctaaagcaaaagtatggggaatttggttctggctatccgagtgatccgagaactaaggagtggcttgaagaatattacaaacaatatggtgactttcctccaatagttaggagaacttgggaaaccgctaggaagatagaggaaaggtttagaaaaaatcagctaacgcttgataaattccttaagtga

SEQ ID NO: 25005 - DNA, 1164 bp, Pyrococcus horikoshii
atgccaaccaatgtaacagcagaatacctagcagcggaagaggagtatagaaatgcaaagacaattccagagaagataagagcacttgagaagatgtacgccttagttccgaaacataaaggaaccgaaaaattacgattacaaataaagaggagacttgcagagcttaggagggaattagaaaagcagagacaacagagaaagggaggaggttattctttagcggttaaaaaagaaggtgcagctcaaatagtcctggtaggattgcctaacgttggaaagtctgaacttttgagagcgttaactggagtggacgttgaaagtgcagattatccttttacgaccacggaacccgttccagcgatgatgaactacaaagatgttcagatacaacttgttgaagttcctgggctcttagaaggggcagctcttggaaaaggtatgggccctcaacttctagccgttataaggaatgctgatgcaatagctatagttatagacctaagtgaggacccgataaagcagatggaaatcctgcttagagaatttgagagggctggaattaaagtgaataaacgaagacctagggtagagatcagaaaaacaccaagtggtgggatagttataaacggggcggagaacataaagggtgatctaagtgaggtaatgagaatgcttagagaagagaagatacactcagcagagattacggtaaaagaacccgtaacacttgaggagtttgcagatgctttagacgatagcctagtctggaaaaaagctataataatagcaaataaaggggacagcccaggaagtaaagagaattaccacaaattgataaataaatatggggagaaatttaagatcgttccagtttcagcaaagaagagaataaacctagaagcagtgaaagaggctatttacgacgttgccgaaataataagggtatttaccaagagtccaggagaagagcctgcatatccaccaatagccctaaagaggggagcaacggtaatggatgttgcagaaaggattcataaggatcttgtaaagaactttagatatgctagagtttggggaaaaagcgtaaaattcccaggacagagagttggcccagaccatgttttggaagatggggatatagttgagatacatgcaaagtag

SEQ ID NO: 25006 - DNA, 1713 bp, Pyrococcus horikoshii
atggatgtggaaaagatagctctcaaacatgcccttattaatgcaattgagcatggaggtaaggctaatcttaaggccgtcatcggtaaagtgctcggcgagaaccctgagcttaggcccagggccaaggagataattcccataattaataaggtagtggaagaggtcaactcactagcaagggatgagcagctggaaaagcttaaggatatatatccagagtactttgaaaagaaggaagagaagaaggaaaagaagggactacctcttcttcctaaagcagagaaaggcaaggtcgttactcgctttgctccaaatccagatggtgcttttcacctgggtaatgcaagggccgcaatacttagttatgaatacgccaagatgtacggtgggaagtttatactccgctttgatgataccgatccaaaagtcaagaggcctgaacccatattctacaagatgataattgaagatctagagtggcttggaataaagccagatgaaatagtgtacgctagtgatagactcgaaatttactacaagtacgctgaggaactaataaaaatgggtaaagcatatgtctgcacttgtcctccagagaagttcagagagcttagagataagggaattccatgtccgcatagagatgagcctgtggaagttcagctcgagcgctggaagaagatgttaaacggcgaatataaagaaggagaagctgttgtaaggataaagactgacttaaatcacccaaatcctgcggttagggattggcccgcacttagaataattgataacccaaaccatccgagaaccggaaataagtacagggtatggcctctctacaattttgcctcagcgattgatgatcacgagcttggagttacccatatcttccgtggacaggagcacgccgagaacgagactagacagaggtatatctacgagtactttggttgggagtatcccgtcacgatccatcacgggaggcttagcatagagggagttgttttaagcaaatccaagacaaggaaaggaatagaagaaggtaagtatctcggttgggatgatcctaggcttggaacgataagagctttgaggaggaggggaattcttcctgaagccataaaagaattgatcatagaagttggattgaagaaaagtgacgcgacgatcagttgggagaatctggcagcgataaacagaaaacttgttgatccaattgccaatagatatttctttgttgcagatccaattccgatggaagtcgaaggggctcctgaatttatagcagagataccgcttcatcctgaccatcctgaaaggggcgttagaaggcttaagttcactccagaaagacctgtttacgtttcgaaagacgatttgaatctcttaaaaccaggcaattttgtgaggttaaaggatctcttcaatgttgaaatacttgaagttggagacaaaataagagctaggttctacagctttgaatatgaaattgcaaagaagaacaggtggaagatggttcactgggttaccgaaggtagaccctgtgaggttataattcctgaaggagacgagcttgtagtgaggaagggattgctcgagaaggatgccaaagttcaagttaacgaaatagtccagtttgaacgtttcggttttgtaaggatagacagaattgagggggataaagttatcgcaatatatgctcacaagtaa

SEQ ID NO: 25007 - DNA, 618 bp, Pyrococcus horikoshii
atgagggggtatttcatagtacttgaaggtattgatggatcaggaaaaactacccaagctaagctacttgctgaatggttcgaggacaaaggatatgaagttttgctaactaaggaaccaaccgatagcgaactcggaaaacttataagaaggattattcttgaagaaagcgttatagatggttctaaaataagttatgaagcagaggctttactatttgcagccgatcgagctgaacacgtaaagaaaataattctaccagccttaagcgagggtaaggttgtaatttgtgatcggtatttttattcttccctcgcatatcaatgggctagggggctcgatctaaactggctaattcaagtaaattcttttgcaccaagacctgatctagctatcctcttggatttacctgtaaaggagagtttaagaaggattaaacttaggggaaccctaacagagttcgataaaatagtcgaacttcaaaggaaggttagacataactatttaaaactcgctgaaatgttccctgaaatgaggatagttaatgccctatcaagcattgaggatattcactcggatatagttgccctggttaagcatgagctcctgggtttataa

SEQ ID NO: 25008 - DNA, 1086 bp, Pyrococcus horikoshii
atgcaagcggtattattggcaggtggaaagggaacaagattgttacctctaacggtgtataggccaaagccaatgattcccttttttaataagcctctaatggaatatatgttgatgaaccttattgggataggagttgaggaaataatagttctcgttggatatctaaaggagaagataattgaatactttggaaggggagataaatttggagttgagattaagtattccaatggtgagaatataaagcttggtactgctggcgcactaaagaaggccgagaaatttatagacgacacattcattgtagcctctagcgatgtacttacgaaccttagctttgactcatttataagatttcacagagaaaagggtggaatagcaacaatggccttgactaaagttgaagatccaacaccctatggagttgcggttctcgataatgaaaatagaattctatactttaaggagaagccaaaaagagaggaagcgccaagtaacttagtaaatgcggggatttacatctttgagcctgagatcttggacttaattcctagaggtaaagcttttgatttctcgctagacctctttcccaagatgctagaggaagggattccaatatatggatttccttttgatgagtactggaatgacgttggtagaccttcaacgtatcttcaggcaacggaagatgttttcctgggtaaacttaggttacctcagattaatgtgggaagggataagggaaatattgagagaggtggtagcctgtttacagggagcaaatgcttgattaggaatcccaagatagttggctttgcagtcttggggaataatgttaaagttggaagagatgttaagatagagagatcagttatattttcaaacgtcacgattgaggatgaagttgagataagggaagctataataggggaaaatgtgtatataggaagaggggccgtcattgaacccggaagtgttataggggataattccgtaatagaagaatacagtaagattggggcaaacgttaagatttggactgactcaaaggttggaagagagagtatcgtgcttccagattag

SEQ ID NO: 25009 - DNA, 1236 bp, Pyrococcus horikoshii
atgggagagaggagaaaaacaaggcaagctgaggtaaatattggaatggttggtcacgttgaccacggtaaaacaacactaactaaggccttaacaggcgtttggacagatacccatagtgaagagctgaggagaggaattacgataaagataggatttgcagatgcagagataagaaggtgtccgaattgtgggaggtactctacctccccagtttgtccatactgcgggcatgaaacagaatttgtaaggagggtttccttcatagatgctcctgggcatgaagctttgatgacgacgatgcttgcaggagcatcactcatggatggagctattttagttatcgcagcaaatgaaccctgtccaaggccccagactagggagcatttaatggcacttcaaataattgggcaaaagaacataataatagcccaaaacaaaatagagcttgtcgataaggagaaagcccttgaaaattataggcaaataaaagagtttataaagggaactgtagctgagaatgcacccataattccaatttcagccctgcacggggccaacatagacgttctagtcaaagccattgaggattttattccgacgccgaagagggatcctaataagccaccaaaaatgctagttttgaggagttttgatgtaaacaaaccaggaactcccccagaaaagcttgtaggtggcgttttaggaggttccatagttcagggaaagttaaaggtcggggatgagatagagattagaccaggaattccatatgaggaacatggaaggataaggtacgaaccaataacaactgaaatagtttccctacaggctggaggacagttcgtagaagaagcatatccaggaggacttgttggagttggaacaaagctagatccgtatttaactaagggcgatctcatggcaggaaacgtcgtgggtaagcctggaaaattaccaccagtttgggatagcctaagattagaggtacacctacttgagagagtcgtcgggaccgagcaggaacttagagttgaacccataaaaaggaaagaggtactcctgctgaacgtcggaaccgctagaaccatgggactagttacaaacctagggaaagatgaaattgaggttaagcttcagattcccgtatgtgcagaacctggagacagggtagcaataagtagacagataggatcaaggtggagattgataggttatggtattatcaaggagtaa

SEQ ID NO: 25010 - DNA, 1101 bp, Pyrococcus horikoshii
atgagcctctataggaagagacttaagatcataaagggagaagggatatacgtatgggatgatcaggggcgaaggtacgtcgatcttattgctggaataggagtcgcaatacttggacataatcatcctgagtgggtagaaggaattagggagcagttgaacaagctcgtcattgcaggtccaatgtttaatcacgaagagaaggaagaaatgcttgaagaactctcaaagtttgtaaacttcgaatacctctacatggggaattctggcaccgaagctgttgaagctgcactgaagtttgcgagactctatacaggtaggaaagaaataatagcaatggtaaatgcctttcatggaagaaccatgggagctttaagtgcaacctggaaaccaaagtataaaaaagattttgagcctttggttcctggattcaagcatattccctttaacgacgttgaagcagcaaaggaagcaatatctaaggagactgctgcagttattgttgagccaatccagggagaaagtggagttataccggcaaaaaaggaattcatgaaagcacttagggacttaactgaggatgtcggtgcattgctgatagttgatgaagttcagacgggtttaagaactggaaagtttttagcagtagaacactataaaatcgagcctgacatagtgactatgggaaaaggaataggaaatggaattccggtaggcttaacgctgactaacttcgacgttgaaagaggaaagcatggatctacatttggaggaaatcctctagcttgtaaggccgttgctataacacttaggatccttagaaaggaaagactaatagagaaggcaaagaacaagttcattcaaattgatgctgatgaagtagttacaacgagaggaaaaggccttatgataggtattgtgtttaaaaccaccataggaaaatacgttgaagagctccaaaatagagggtatttagttcatactgctggacaaagagttatgagacttcttccacctttaataatttcaaaagagacgatgcaagatgtaaaattggcaatagagggtgtgataaatgatctcagaggaggagaaaattaa

SEQ ID NO: 25011 - DNA, 750 bp, Pyrococcus horikoshii
gtgaggtgggtttccatgagagttattaaagtcggaggttcagttttggagaaccttgaaaaagtgtttaaacctgaaatattcagagatgctgtcgttgttcacggtggttctagatatgtggatgaacttgcaaaaaagcttggattaaatgtggaaaagctaacgagtccctctggtgtaacatttagaagaacaactaggaaagttttagacgtttatatagctgcagttatgaaggcaaacagagagcttgtctccttcctgcgaaggcagggtatagaagcgataggagttagcggggtcaaggaagttataattggaagaagaaagaagctcattaaggcagtgataaatggaaagatcatggcgataagggatgattactcggggataataaaggaggttaacgtcgagatgataaggaactatatgaaggtgggagttcctgtaatagctccaatagcgtacgatccagttgaaaacgttcctcttaatgttgatggagataaggtagcttatcacgttgcgttagcactcaaaagtagagagctatactttctctctgataccgcatttttgattaatggtgaagtaattgataagattcccaggaatagaatagaagagtatttcccctattcaagtggtggaatgaggaaaaaattgctcatggcaaaaaaagcgattgaaagtggggttgaaagagtgatcatagagggattaaatggaaggacggtgatatcttga

SEQ ID NO: 25012 - DNA, 993 bp, Pyrococcus horikoshii
atgattaaggtagctattgttggaggaagtggatacattggaggtgagctgataaggttacttgccatgcatcctgaagttgaaattgtggctgtaacatctagagaatatgctggaaagaaagttcataaagttcatccgaacctgagaggtcttaaccttagatttacctcagactataattttgatgctgatgtgatatttctcgccgttcctcatggggtttcaatgaaactcattaacgagttcctgggaagtgcaaagataattgatttgagtgcagatttcagggttagaaaggagctatacgagaagtactatggaaagcatgaaagaccggaactcatagaagattttgtctatggtcttcctgaaatccacaggaaggaaataaagaaggccgaactcgttgccaatcctgggtgcaatgcaactgcggtaatcctagccctttatccgttcaaagacctgacaaaagaagtattagttgatttaaaggttagctcttctgctggaggaaggagagagaacttaccaagcatacatcctgagaggagcaacgttgtaagggtctataaaccttatcatcatagacatgaggccgaagttttacaggaaactggagttagggcaatgtttacggttcattctgtagacattgtgagagggcttctcgccactatatactttacgtttgagggaaacgaaaaggatcttctaaagagaatgctaatttacaaggatgaaccttttataaggcttgtagtggacaaaggtggccttcagagatatccagatccaaaatacgttttggggagtaatttcgttgatcttggattggcttatgatgaggagaattccagggtgatagtgttctcagcacttgataacttgataaagggtggtgcaggtcaggcggttcagaatatgaacataatgtttggccttgatgaaacccttggccttggatattatcccctttatccggtgtga

SEQ ID NO: 25013 - DNA, 972 bp, Pyrococcus horikoshii
gtggtaaaatctgtgacagataaaattaaattttatgaattcgaagggggtttaagtgtttttaaaaaatatggggtgccaatcagggaggaggatctcgaggaaattaggaagatggatgctatattatttggagcaacgacgacaccctttgatgttcctagatataagagcttaattataacgttgaggaaggaacttgacttgtacgcaaatctaaggataattccaaactttaagttgagaaaagagataattatagttagagaaaatagtgaagggctatacagtggagaaggagcatacgatagtaacaaggtagttgactttaggataataacaaggaaaggtgcggagaggatagctaaatttgcagtaaaacttgcaaaagataggagcaccttcttaacctttgttcataaggcaaacatacttgagagtgatagattcttcagaaaaattgtcctagacattgctaggaaggaagatgttaaagttagagaagaaatagttgactcttttacaataaagttagtgaaagacccttggaacttgggaataatcctttctgaaaatatgtttggtgacatcctttcagatctggcaacgatacatgctggtagcatcgggatcgttcccagcggaaactatggggaggatatagcattgtttgagccaatacatggctctgctccggatatagctggcaagggaatagcaaatccaataggggcaatactgagtgctgcaatgatgctggattaccttggtttagatggttctatcatctggaaagctgttgggaggtatgtgaggagaggaaacctaacaccggatatggaggggagagcaacaactctggaggttactaatgggataatctcggagatatatcgcttggatgagtacgaaatagatgaggtttggagggatgaagttagacttgggaggatactgctcgagataagttaa

SEQ ID NO: 25014 - DNA, 1749 bp, Pyrococcus horikoshii
gtgaggaatatgagaaataacgaatcatcattttcacttcttattaggttcattagggaagcactctccgaaaagaagactctagtagtagttataattagtatagtaggatctgccattgccaacttggcatcgccctacgtccttcatattgctatagataactatatagttccagggaagtatggagagttatggtttgtgacacttttatatctcctatccctcattggccaatggttcttcatgactcttcagacttattatactgaagtttttggccaaggggttcttaagaggttgagaagcaagcttcatgagaagatattaatttcaaacctagatttctttaaagagaaatcaacaggggatctagtttcgaggataattaacgatacaaacatagtcaatgatgttctagtttcaggactcctcgggggattaggaagtttgttgagcttagcgggaattattatcgcaatgtttctcctagacgttaaactaacgctagtaactctagctagcgttcctttaatggtgctcgtggcctattactttggaggtaaaatgaggagggcatatcgtgaaactaggcagaaaatagcaaagatatcgagcgttgttgaagagagtgtggccggaatagagacaattagggcatttggaaaagaaagggacgtggaaagagaattttcaaaagtttccttagagacaataaaagcatatctaagggttgcagtttacatgggagttttctggccacttatgaatattacgagcttactttccgttatagccgttatagcatacggaggttacctggcttataaaggagctgtgagcattggtgttgtggtcgcgttcattcagtacgctcaaaggtttagaggccccataaataatgttgtaagtatgtatgatagtttgcaatcagctttagctgctcttgaaaggatatatgaaatcttggacgatgaaaacgttgaagattacaacggaataaacgttgagaggcttaatggtgaaatagaatttagaaatgtatggtttgaatatgaaagggggagacctgttcttaaggatattaacttattaataccttcgggatctaaagtagcaatagtaggaaagacaggagctggaaagacaactttggctaatctgattatgcgcttctatgatccaactaaaggggatattttctacgatggaatagaggggagaaagataagtaggaaaagccttagaaggagaataggttatgttccccaggaaacatacctatttccaggaaccataatggaaaacatcctcatggcaaacccagaagctagagaagaagatgtgataagggtttgcaaggagctgggaattcacgagttcataatgaagttaccaaatggatataagactagtgcaggtgaagcggggaagttattatccctaggggagagacaattaatatctttggcgagggctttgttaaaggatcctgacatagtcattttggatgaagcgctttcaagcgtcgatcctaagaccgagcaacttgtacagaatgcaatgctaaagttaatggaggggagaactagtataattatcgctcatagattgtcaataacgaggtttgctgataaggtaatcgttgttaaggatggaagaataattgaggagggtcctccaaagcttctcttagaaaagaagggctacttctacaggctttatacctctcaagttcaggaagtttaa

SEQ ID NO: 25015 - DNA, 1743 bp, Pyrococcus horikoshii
atggatggttcgctaaggcaactggaaagactgttaagctatttaagagagtatagatggcattttattggtggaatagggttagttctcttgatgtcgtacactaacggggtaatccccgtgttaattaggaatgctatagataaagggatcgtcaccaaaaagtattcagttgccttcaattatggccttttgattttgcttgttgcagtatttaacggaatatttagtttcacggggagatatttacttgtaaaatccgctcagcatgcagtatattacattagaatggatgcctttaaggctatacagaggcatagaatggaattttttgataagactttttctggtcagctaataagcagaataacgaatgacacagagaggataacgaggttcctttcttttcgaataagaatgttcgtttattcaatattcctaatagctgtatccttgtattatatgattagaatgaacgtcttccttagcttagttgctttagggactatagctgttgtggttcttttaaatacaacttatgcaactaaagttaggccgatatatgataaaataagacaccaaactggggtgatagcctcaatagccactggaacaatagctggaataaagactattaaatcactttcggttgaagaaaatatccaggaaaaattctctaaagaaaatgagaacctttattccctaaatattgatgccattaaaataactgctctttatgggaatgctccatttttgattttgggattagcgatgagtgcaatgctctactatggggggaaagctataattgccaaaaccttaactgttggtgaactcgttgcatttttaacttacatgcttacaatgatgtggccccttcgtgctttgggattcactattggtgatatacagagaagtttagctgcggcggcaagattgtttgaggttattgattcggcccccaaagcaattgacgcacccgacgctgtagagattaatgatccaaagggggaggtagaatttagggatgtttggcttacttatcatactggaagaactgtgcttaggggtgtaaatctcaaagtatctcctggagagaaggttctcatagtaggtcctcctggatccgggaagagtagtattctaaagcttattgcaaggttttatgtgcctgataagggggaagtgttaatagatggagttaatgtgaagaagataaagacagaaagcctaaggagaatagtggcctatgttcctcaggaacctttcatttttaacaggagcataagggaaaacatcgcactcgcaaagcctgatgctaaaatggatgaaataataagggctgcaaaaatagcaaagatacatgactttatatcctcccttcccaacgggtatgacactatagttggtgaaaaaggtgtaacgctatccgggggacaaagacagagaatagcccttgcaagagctctccttttagatcccaaaattatcctccttgatgatcccgtctctaatctagatgctgaaacggagaaaagattggttgaagacctaaaagagatactaaagggtagaactgctctaatagtatctcagagactttccttagttaaactgacggatagggtgattgtaataaaagatggaaggataattgaggaaggaaaacctagcgagctcgtcaagaagggtggagcatttagcgaaatgattagagctataggtgaggaatatgagaaataa

SEQ ID NO: 25016 - DNA, 921 bp, Pyrococcus horikoshii
atgaaaaacaagctcatagtaattactggaggggctggatttataggttctcatttggctgaagcattaaaagatgaaaatgacgtgattataatagacaatctatattccggtagaatcgagaacattccagaaggtgtcaagttcataagggctgatgtcagggattatgaaagcatagctgaagttataagtgaagccgattatgtctttcatgaggccgctcaaattagtgtcaaagaaagtatcgaagaccccgtatttacggaggaggtaaatgttataggaactataaatgttttaagggctttatcccagggagatgggaaattaatatttgcatcttctgcggccgtttatggtgaacccaaggaactaccaattactgaagatacgttaactaatcctatttctccttatggaattacaaagctggctgcggaacattactgcagagtatatcaaagcttatatggaattccagtagtcatcctaaggtattttaacgtctacggccctaggcaaagttctgcttatgctggagtgataagtatcttcttagaaagggcaataaaaggggaacctttgataatttttggagatgggaaacagacaagagatttcatctacgttaaggatgttgttgaggccaatatccttgttgctaagaaaaggagtgctaatggaaggatttttaatgtcgcgactggaaaggagacaacaatcctcgagcttgcaatgaaaataatagatatgacttcctcttcgtcttcaattttattttatccaccgagacctggtgatatcaggagaagtgttgccaaaatagaaagaataaagaaacttggctttaagcctaggtattcccttgaggagggtctcaaggagacttttaaatggtttacatctcgtactcaatga

SEQ ID NO: 25017 - DNA, 3540 bp, Pyrococcus horikoshii
atgccatacattgaaaggcttgaactcaaagggttcaaatcttatggtaacaagaaggtagttattctgttctcgaggggctttacggctatagtcggggctaacggttctgggaagagcaatatcggtgatgcgatactttttgttcttggtggattatccgctaaggccatgagggctagtaggataagtgacctaatatttgccggtagcaagagggaacctcccgctaaatatgccgaagttacaatatacttcaataatgaggataggggattccctatagatgaagatgaagtcatcataaaaagacgagtttatccagacggaaggagtcattactggctaaacggtagaagggcaactagaagtgaaatactagatctactcagcgcggccatgatatctccggaagggtacaatataattcttcagggagatataactaagttcattaagatgtctcccctggagaggagattgataatagatgatatctctgggatagcggagtacgatgcgaagaaagagagagcccttcaagaattgaagcaagctgaggaaaacttagctaaggttgatatacttataggagaagtaaagaaacagttagataagctagaaaaggaaagaaatgatgcgctaagatatttagaccttaaggagaagcttgaaaaggctagagttggtctcgtgcttggtgaaataagaaagatcgagtctgaaataaggaataatgatgagagaattggaaatatcgagagagaaatagaaaggatggaaaaaaggttagaggaaatagccaaggaaatcgttgagaaagagaatgaacttaggagaattgaagagatgatagagagggaaagtagcagtgaagccttaaggctgacgcgtgaaattggagaggtaaactccaaaataaatctcgctagaaggaacatagagatcgcaaggagggagcttgacgaatcccaattaaggttagccaaggtgaaggatgagttaaagaaagttatgagcgaaatagagaagtctaaaggagcgataattaggtgggggaggagaagagaagccctaattaagcagatatctgagaaagaggaagagagaaaccatttagtggttaggttgggagagatcgataggacatttgccgtcgctagagaggagtttgatagtgttgttaaagagctcgaaaatgctagaaggctaatgtacgagggagaagccgagataaaaaggcttgatgctgaaaaagagaagttacgttccagaatagcagttcttaaggccaaacttcctggtattagggatgaaattttgaagcttagagataccttagatgagaaaaaagctgaactaagcgagattgaaaataaactatcatcggtatctaataaaagaatgaaagttgaggaggaggttgagaagaaaacattagagcttcaaaaggtttccaaggagcttgaggatgccgaaagagaactaataaggattgaagctcaaaatgaaactaagagcaacagggccgttgaagagcttaagagatctggaatacccggcatatatgggactttacttgaattaattagggttagagatgagaagtactccatagctgttgaggtagccttaggtaatagggctgataacgttgtagttgaagatgaaatcgttgccgagaaagcgattgagtttttaaagaggaataagctcggaaggttaactttccttccgcttaacaaaataaaggcacgacacgtaaatggggatgtagggattccagtagttagtgtcatagagtacgatcccaagatcgagaatgccgtaagctttgcccttggggataccgtcatagtgtcttctatggaggaggccagatcttacatcggtaaggttagaatggtaaccctaaaaggggagctctacgagaggagtggtgcgataaccggtgggcattacaggccgaggggtttacttttggataccaaggaacttaaggaaaaagttgagaaccttagaataatgaaggaatctttagaaggggaagttaactcgctgagggtcaagctaaaggcattagaaaatcaaagctttgagctcaggataaggatgagtgatgtcgagaaggagataagcttgatcagcaaggatttagagaagcttatcaaggaagaggagtcgttgagatcagaaattgaagattccgagaggaagatagctgaaattgatgagacaatcagtaaaaagaaggatgaagtagcgaagctcaaaggaagaatagagaggcttgaaaagaggagggacaagctgaagaaggccctagaaaatcctgaagcgagggaagtaaccgagaagatcagggaggttgagagggaaatagccaaactaagagaagagctcagtagagttgagggtaaattggaatccttaaattcaaggctaaatgatgagttaattcccaggaaagcttctcttgaggaggagatagagggtcttgtaaataagataaacgcgttgaaagctaatataaacgaaaatgaagaggcccttaagtccctaacggaaaaacttgaaaaactaaaaaaagaggagggcgaaatttactctaggatagaggagcagaaaaagaaaaaagaggaacttgaaagaaaggttgcggagttaagagaggaaaaagagaagatctctagaaggatacaggagcttagaatagaggttaacaccctcaaggtaaggaattctcaactaaaatctctcctcatggaaaagaactctcagctgaaacacttctctaaggaagttatcaaatcaataagggatatcccttcggatcttgagggattaaagaaggaaattgagaagatggaggaagaaataaaagcgttagagccagtgaacatgaaggccatagaggattttgaagttgtcgagaggaggtacctagagcttaagagtaagagggaaagactagaggccgagaaggatagcataatagaattcataaatgaaatagagaaggagaagaagaatgtgttcatgaaaacatttgatgctattgcaaagaatttctcagagctctttgctagactatctcctgggggaagtgctaggttaatccttgagaacccagatgatccattctctggagggcttgaaattgaagctaagccagctggaaaggatgtaaagagaatagaagctatgagtggtggagaaaaagctttaacggctttggcatttatctttgctattcaaaaattcaagccggctcccttctatctcttcgatgagatagatgcacaccttgacgatgctaacgtcaagagggttgcagacttgataaaggaatcttccaaggagagccaatttatagtgataaccctcagagacgttatgatggccaatgctgagaagataataggtgtaagcatgagagatggtgtaagtaaggttgtctctctgagcttagagaaggccatgagaatactagaagacattaggagaaggggtgaatatggaggaaattaccccagttga

SEQ ID NO: 25018 - DNA, 1026 bp, Pyrococcus horikoshii
atgattggtgtagttcaaataccaatgggagttgctggcccattaaaaatcaatggggagtacgctaagggtgaattctacatcccattagctactactgagggggccttagtggcctctgtgaacaggggatgctcggccttaacggaagctggtggagttgttacaacattgatagatgacaaaatgacgagggccccattgataaggtgtccaaatgcaagaagggctagagaagttgctaagtgggtagaggaaaatctagattacctccaggagaaggccgtttcaaaggtcactagacacggaaagcttaggggagttaagcctttcatcgtcggtaataacctttacctccgctttgagttcgagactggagatgccatgggaatgaacatggtgactatagcgagcgaggagataatgaaggtcatcgaggaggagttcccagatgttagatatctagccctctctggaaatttatgtgtagataaaaagccaaatgctgtaaatttcatcctgggaaggggaaagacggttatagctgaagctgtggttcccagaaaaattgttgaaaagaagcttaagacaacgccggaacttatagctgaggttaactactttaagaacctcgttggttccgcacaagctgggagttacggatttaatgctcactttgctaacattgtaggggcaatattcctggctacgggtcaggatgaagctcagattaccgagggagcccacgggataacgatagctgaggtaacccccgacggggatctttacataagcataacgatgccaagtcttgaaataggaactgtgggaggtggaacgagggttccaagtcaaagggaagccctggagataatgggcgttgcaggtggaggggatcctccaggtattaacgctaagaagtttgctgaaatagttgctggggccgttttagctggagaactttcactacttgcagcgatagccgctaagcatcttgcaagggctcataaaatgcttggaagatga

SEQ ID NO: 25019 - DNA, 786 bp, Pyrococcus horikoshii
atgaacatgaaagttctgatcacagcatcatccagggggatagggttcaaccttgcaaaagagctacttaataaggggcatgaggtaacgataacttccagcaatatcaggaacatagaaaacgcgtacaaggaattaagggaactaggtaccgttcactattttcaagctgatctttcatctaaagaggatataaagaggatggtaaaagatgcatgggatgcaatgggaagaatagaggccctaatatggaatgctccaaatgtaaagtgcgaaccttgcatggttcatgaggcaaggtacagggattggctcgaagcggccctcctgcatctagtctcaccaggttatataacaacacttctcatccaagcgtggcttgaaaagaagataaaaggcgttctgatatatttaagctccgcttcagttttggaaccaatgcctccacttctcttagctgatactgctagggcgggactcgttcaattgacgaagggcataactagggcatatggaggaaagggaattagagcttacgtagtattattagggagctttgataccccaggggcaagagagaacctcgcaaagatagccgaagaaagaggtatgagtcttgaagagatctggaggaaagaggttatagagagaacacctctcaaaagaactgggaaatggagtgaactcggagctttgatagatttccttctaagtgagaatgcagagtatatgatgggttcaacgattctcttcgacggtgccatgacgagaggggtcaacttatga

SEQ ID NO: 25020 - DNA, 2397 bp, Pyrococcus horikoshii
gtgatgctaatggtggagaaaaaggagataaagctgaaggttgcttccgcttatcaaagggatgttggtagagggattgtaagaattgataggagaagtatgagagaattaggagtatcgccaggggatgttgtagagattatcggaaccaagaataccgctgctatcgtttggcccgcttatcctgaggatgagggcctcggaataatcaggatggatggtaccattagaaagaatgcaggggttggccttggggatgaagttaccataagaaaagctgacgttaaggaagccagaaaggtagtactagccccaacggagcctattaggtttggaagggacttcgttgagtggcttcacgagaggctggtaggaaggcctgtagtgagaggtgactatattaaaattggagttcttggccaggagctaacctttgtagttactacaactcaaccgagcggagttgttcaaataacagagtacacggactttgatataagtgaaaagccagtgaaagaagttgaaaagagaatgacaactggagtgacctacgaggatataggtggactaaaggatgttatcgagaagatcagagaaatgatagagctaccattaaagcatccagaattattcgaaaagctgggtattgagcctcctaagggtgttcttctttatggtcctcctgggactggtaagactctcttagctaaggccgttgctaatgaggctaatgcttactttatcgcaataaacgggccagagataatgagcaaatactacggagaaagcgaagaaagattaagggaggtgttcaaggaggccgaagagaacgcaccatcgataatctttattgatgagattgatgcaatagctccaaagagaagtgaggttactggagaagttgagaagagagtcgtagcccagctacttgccttgatggatggtttgaagggtaggggtaaggttattgttattggggctactaataggcctgatgctttggatcctgctttgaggaggcctgggcgttttgatagggagattgaggttggagtgccagacaagcaaggaagaaaagaaatactacaaatccacacaagaggaatgccaatagaaccagacttcagaaaagaggatgtacttaagatccttgaggggcttaaaaaggaagggaagttcagggatgtcattgataaggccattgatagggttatgaaggttagcgaggatgatattcctaaagtgcttaaggaacttaatggtgagctatacgaggaagttagaaccagattagttgatctattacttgaggaattggctgaggttactcatggtttcgttggcgctgacctagcagcactagccagagaagcagcaatggccgcacttagaaggttaatcaaggaaggaaagatagactttgaggccgagacaataccaagagaagtcctagatgaacttaaggtaactagaaaggacttctatgaggctttgaagatggttgagccttctgctttgagggaggtcctcatcgaagtcccaaacgtccactgggatgacataggcggattagaagaagtaaaacaagaactaagagaagcagtagaatggccactaaaatacccagaggccttcagggcttacgggatcacacctcctaagggtgttttgttgtatggtcctcctgggactggtaagactctcttagctaaggccgttgctactgagagtgaagccaacttcatagccgttagaggcccagaagtattaagcaagtgggttggcgaaagcgagaagaacataagggaaatctttaggaaagcaagacaagctgctccaaccgtgatattcatagacgaaattgatgcaatagccccgaggaggggaacagatgtaaacagagttactgataggcttatcaatcaattactcacagagatggacggaatccaggagaatacgggagttgtcgttattgctgctactaataggcctgatattttggatcctgctttgttgaggcctgggcgttttgataggcttattttagttcctgctcctgatgaggaggctaggtttgagattttcaaggttcacactagaagcatgccattagccgatgacgttgatttaagagaattagcaaggagaacagaaggatacacaggagcagacatagcagcagtatgcagagaagcagctatgatagctatgaggaaggcccttgagaaggggataattaagcctgggatgaaagctgacgagataaagcagaaggctaaagttaccatgaaagacttcgaagaggcactgaagaagataggaccctcagtaagcaaggagaccatggagtattacagaaagatccaagagcagttcaagcaggctagaggatga

SEQ ID NO: 25021 - DNA, 1146 bp, Pyrococcus horikoshii
gtggttgggatgaagatagctctagttagtgactggtattatcctaaaataggaggagtcgcaactcacatgcacaacttagccataaagctgagagaaagagggcatgaagtgggaatagtcacaaacaacaggcccacgggaaaggaagaagagcttaagagatatggaatagagctcataaagatcccaggaattataagtccttttttagatgtaaatttaacctatggattgaaatcctcagaagagctcaacgaattcttgaaagacttcgacataattcattctcatcatgcattcacacctctctccttaaaggctttaaaagctggaaagaatatggaaaagggaaccctgctaacaactcacagcatttcctttgcccatgaatcaaagctctgggatactttggggtttacgatacccctttttaagagttacctgaaatattcacatcgaataatagcagtaagtaaagctgcaaaatcctttatagaacacttcacttcggttcccgttttaatagtacccaatggagtcgatgatgagcgtttcttccctgcaagggataaggagaaaataaaggccaaatttggacttgaagggaatgtggtactctacgtgagcagaatgagttatcgaaaaggcccccacgttcttttaaatgcattctccaaaatagaagatgcaactctcgtaatggttggaaacggagagatgcttcccttcttaaaggctcaaactaaattcctgggaatagaaaataaagtagtattcatgggatatgtacctgatgatattcttccagaggttttcagaatggccgacgtgttcgtcttaccttcgatatcatcggaagcgttcggcatagtaatccttgaggccatggcctccggagttcccattatagctacagacgttggtggtatacctgaggttataaaggaaaacagtgcagggcttttagttccacccggaaatgaacttaagctaagagaagcaattgaaaagctcttaaaaaatgaagagcttagaaaatggtacggaaacaacggaagaagatccgttgaagaaaaatattcctggaataagatcgtagttaagatagaaaggatttacaacgaagttcttcaggaagtttaa

SEQ ID NO: 25022 - DNA, 891 bp, Pyrococcus horikoshii
atgagactggatgtaatttgtatggggaacctcaactatgacataactttcatacttgaaagatttccagagttccacgaaaaggtgaatgctaaagaagtttatacgggattaggaggttccgcaggaaatacagcgacttggttgtctctcctaggattaaaggttggtttcataggttctgtgggaaatgacgactttggaaggttgcatctggaattctttaagaaaattggagtagatactagagggattaaagtcgtagacgaaccaacgggagtcgccgtaatgatggtgatcggagaagacaaaaggatagttaagtaccctggggccaataggtttaaggaggtaagagaggactatttgaagcttgccaggcatttgcacctctcttcaaatcccctttcacttgtcgaaaaagctgtaaccttggccaaaaatcttggcctaactgtttcttttgatccaggagaaatggaagtcccaaagaatattgaagaaaaagtagacatcttaatgatgaacgaagatgagttcaagaggaagtatggagacttaaaaaatataactaaagttaagtctagaatagccatagcaacgctaaacggtggaggagctctggttagagatcaaaatggaaaagtttacgaggtaaggggactgtcggcaaaggccgtagataccaccggtggtggagactcttttaatgctggatttatatatggctttctaaatggctgggatgtggtaagttcagcaaaattaggaatgctacttgcttaccttacagttcaaaaagtaggagcaagaagtgcggtaattcccctagaggaagttaaaaagaaagcaaatgaattaaacctagatcttccatttaatagctcttaa

SEQ ID NO: 25023 - DNA, 957 bp, Pyrococcus horikoshii
atgaacgttattgaggtgaggaatttaaggaagttgtacccaaagaaaattccccttccttttaggaaggttgaatggtttgaggctttaaaggggataacatttagggtaaagaaaggtgagttatttggccttttaggtcccaatggagctgggaagacaactacaataaaaattcttacaactttattggagccaagttctggagaggctaaagttctcggccttgatgtggttaaggatgctcgtgagattaggaagagaataaaccttgtagctgagggggaaagaacgctctattggaggttaactgcatatgagaacttaaggtactttgcaagcatatattatattccaaggagggaggccgaaaaaagaatagaggaactacttaagatggttgggctgtgggataggaggaacgatttagttatgaattactcgaggggaatgaagcaaagattggccatagcaaaggccttgataaacgatcctgaagttctatttctagatgagcctaccctaggtttagacgttcaaagtgcagttttcgttagggaactcgttaggagattagtggatgaggaaggaaaaaccgttctcctaacgactcactatatgaatgaagctgaagaactctgtgacagaatagcaataattgaccatggaaaaataatagcccttaacactcccgaaggcttgaagaggatggtgaggaatgatacaatagtagaggttagggttaggaattatcctggggttaatccctttggattggttaaagttgatgataggaatggggttgtaatactaagggggagcttggaggaggaagagattcctaagctggttgagtttctggttaaaagtaatgcaaaggttctttcggtcgaagtgaaggagccaaccttggaggacgtcttcataaagcttactgggagggggcttagggattga

SEQ ID NO: 25024 - DNA, 819 bp, Pyrococcus horikoshii
atgttaatgttgttattctttgcaaactccactaaatcctctctgaccgaaagcgttaccttcctcttcaatgcgcgcctctgtacagaatacgtgaactcatctgtgagatgtgagagaatggtaatccatttatatcttttgaccttccatctaatgatggatgagaaagagctctatgaaaaatggaagaggacagttgagatgctaaaggctgaagggataattaagagtgaaaaggttgagagggcttttttaaagtgccctcgatatttgttcgtggaggataggtataaaaagtacgctcacgttgatgaaccccttccgattccggcgggtcaaactatttcagctcctcacatggttgctataatgcttgagattgctgatctgaagcctgggatgaacgttctagaagtgggaactggaagtggatggaacgctgctttaatagctgagatagttaaaggtgacgtgtacagcatagaaaggatacccgaactggtagaatttgctaagagaaatttagaaagggccggagtgaagaatgttcacgtgatcttgggggatggtagcaagggctttcctccaaaatctccctacgatgctataatcgttactgctggagctccagagatacctaagcctcttgttgaacagttaaagcctggaggaaaactcataatccctgtaggaagctatcacctatggcaggagctacttgaagtcataaagagggaagatggaagcataaaaataaagaatcatggaggggttgcttttgtccccctaataggcgagcatgggtggagagaatga

SEQ ID NO: 25025 - DNA, 1953 bp, Pyrococcus horikoshii
gtgaatttgatgtacattagaaaggatctactacagccaaggctttatcaggagctaatatacgcaaaatgcaaggaaaggaattgcttgatagttctaccgactgggttagggaagactataatagctatgatgatagcagattatcggttagataaatatggtgggaaagtcttaatgctcgcgcctacgaagcccctcgtccttcagcatgctgaaacctttagaaagttttttaccctaccccctgagaagatcgttgcgttaaccggtgagataagtcccaatgagagggttagagcttgggccagggcaaaagtcgtgatagctactccccaaaccattgaaaatgatttacttgtaggaagaataagtttagaggatgtaacccttataatctttgacgaggcccatagagcagtcggcaactatgcttacgtttatatagctaaggagtacttaaaacaggcaaaaaatccacatgttataggcttaacggcttctcctgggagtactcctgaaaagataatggaggtattgaggaacctcggaatagagcatatagaatacagatcggagaactccccagatgtaaagccttacgttcaggggataaagtttgaatgggttaaggttgagcttcccgagctatataaggaagttagaaagttactaagagatatgctaagggactcacttaaacctttagctgaggccggtttgttggattccacatcagcggatattccaaagaaggaaatactaagggcgggtcaaataataaatgaagaaatggccaaggggaatcacgatctaaggaaacttttgctgtttcatgcaatggccctgaagttgcatcatgcaatagagttactcgaaactcaggggttatccgctttgagggtttatctaaagaggctgtatgaagaagctaaggctggttctactagagcaagcaaggagttattcttggataaaagaatgaaaaaggccttagccttattgattcaggcaaaggaactgggcatcgatcatcccaagatggaggttttgaaggggcttataagggagcagctgaagaggaaggagaactccaagataatagtattcactaactatagggagaccgctaaaaaggttgttgaagaacttatgaaggatggtataaaagctagaagatttgtgggtcaagcaagtagggaaaatgatagggggatgagtcagaaagagcaaaaattaatattagatgcttttgcaaggagtgaattcaatgttttggtcgcaactagtgttggtgaagaaggtttggatgttccagaggttgatctcgtcatattctatgaaccggttccttcagcaataaggagcgttcagaggaggggaagaactggaaggcagaaaccggggagggttgtgatactcatggcccagggtacgagggatgaagcctactactggagctcaagacagaaggagaaaataatgagagagaccataaggatggtaagccaaatggttaggaaggagaggcaattatccttggaatcgtatgttaagagggaagttaatgaagaaataaaggaggagaaaaaagaaactggagggattaaagtcgttatagatagtagggagcttagaagtgaggttgttaagaagcttaaaacccttggaatcaaaattgaggttagaaccctggatgttggggattatatagttagtgaggatgttgccatagaaaggaagtctgcgaatgacttcattcagtcgataattgatggtagactattcgatcaagttaaaagacttaaggaggcgtatcctaggcctgtaattataatcgaaggtcagctctacggaattaggaatgttcatccaaacgccataaggggggccatagcatcgatagttctcgattttggggttcccgtaatattctcttctagttcagattag

SEQ ID NO: 25026 - DNA, 849 bp, Pyrococcus horikoshii
gtgaacccctaccaaaatttattagctcacaatgaagcattttattggggattggaaatgctaaggatagatctttcaggtaagttagcatttacgacggcatcgagcaagggaataggattcggggttgcgagggttctagctagggccggtgccgatgtcataatactctcaagaaatgaagagaacctaaagagggctaaagaaaagataaagagcgagagcaacgttgaggttcactatatagttgcagacctaacaaaaatggaagacctagagagaacgattaaagaactgaaagacattggagatccagatatattcttcttctccacaggcgggccaaagccaggatactttatggagatgagcatggaagactgggaaggggccgttaagcttctcctttacccggccgtatacctcaccaaagccttagttccaggcatggaaaggaaggggtttgggagaatagtgtactcgacaagcgttgccataaaagagccgatacccaacatagccctaagtaacgttgtaaggatagcgatggccggattagttaggacactggcaaaagagctaggaccaaagggaataaccgtcaacggaataatgccagggataataaggacagacagagtcattcaacttgcccaggatagggctaaaagggaaggaaaaagcgttgaagaggccctaaaagagtacgcaaagcctataccattgggaagactaggagagccagaggagataggatatctagtggccttccttgcaagtgagttaggaagttacataaatggagccatgatccccgtagatggaggtagacttaattcggtattctaa

SEQ ID NO: 25027 - DNA, 864 bp, Pyrococcus horikoshii
gtgaataaggtgtttgtaattggtagtggagcgaaacaccttgaggaggagatttcaaagaatgccaagatcctcaaaacggagattaaaaaatttcctgatggtgaaaaatacgtgagaatcctggagcatggagaggaagtgatagtagtccaatcgacgtacaggccccaggatgagcatctaattgaaacgataattataggggatgcattgaaagaagctggattcgaaaaacttaagctggtagttccttacttggcatattcaagacaggatagagtcacaaaagagggagaacccattagtgtgagagcgataatgaaaatgctcggcttatattatgatgaactatacgtcttcgacatacataatccaaagacattagatttctttcctggtaaggccgtaaacatatacccagctaaagtgatagcggaatactttagggataagctcgagaatgggctagtgttagctccagatagaggggccctagaaagagcgaaggaagttgcaaatatactcggactggagtacagtcactttgaaaaagaaaggatatcaccaacggaagtcaagatgacgcccgtagacgtcaatgtaaaaggaaggaacgtgctaatagtcgacgatataataagtactggagggactatgataagggctgcagagatcctaaaagatctcggagctgaaaaagttttcgtagtagccacacatggcgtttttgccgaaggggccatagagagagtcagcaaagctgtagatgagctagcagttacaaacacgataccgactaaggtatcaaagataagcatagttcccgaaataatgagatctatcttggaggtaaagtcatga

SEQ ID NO: 25028 - DNA, 654 bp, Pyrococcus horikoshii
atggtgaaggcagtattgtttgatatagatggaaccctactttcggagaagcccttgataatgttcatccttcctcaggtttacgatgagctagctaataagttaaacatctctagaatggaagctagaaggatttttctttcagaaattgaaaaaaggaaagggaagtatgaatggcacgattggaacttcttctttaggctgttctccctacccttcaagtatgaagattttataatgaagtatccaaccaagattgaagtattcccaggagttgttgaagttttaaagtacctaaaggagaggggatataggcttgggattgtcacaagcggaccaagataccaagtacttaagctcaaggtctccgggatctacagatatttcgatgttgttgtaaccagggatgacgtgggttctataaagcctgagcccaggatattccttgctgctctagaaaagctgaagatttcacctaaagatgctgtaatggtaggtgacagcttggagcaagacattcttggtgctaagggggtaggcatgaagagcgtatggataaacgttgggggtgaaaacggttataacctcccagactttgagataagttcgatccttcaactaccggaggtgatagaggatgaaagtgatatttga

SEQ ID NO: 25029 - DNA, 1287 bp, Pyrococcus horikoshii
atggaaaacccatatgaaattactgctatcgttgcaagggagatacttgacagtagggggaacccaacggtagaggttgatgtccatactcctattgcaatgggaagggccgcagtcccaagtggtgcttcaactggaactcatgaagccgttgaacttagagatgggggaaagaggtatcatggaaagggagttaggcgagcagtagaaaatgtaaacaagataatagctcctgaattaataggaatggacgttagatggcagagagaaatagataagctgctaatagagcttgatggtactgaaaacaaaagcaatctaggagcaaatgcaattcttgcagtttccttagccgttgcaaaagcagctgccaattcgctagaattaccgctgtatcaatatctcggaggcgttaacgcttatgttcttccagtaccgctgagcaacgtaataaatggcggggttcatgccgggaacgaattagacttccaggagtttatgataatgcccataggagctagctcatttagggaagctataaggtgggtttcagaaacatatcatgtcctaaagagggtgatcatggggaagtatggaaagaatgcggtaaacgttggagatgaaggtggatttgcaccaccgatgaaggaagttacggaacccttggatgcactaataaaggcaatagaggaggccggctacaaacctggagatgaaatagcccttgcaattgatgcagcatccagcgagttcttcaaggatggaaagtacattgtaggaggaaaggaatacacgagggaggagttacttgacctatacaaagagctcgtatcgacatatccaatagtctcaatagaagatccgttccacgaggaagattgggaaggattcgtgatgataaccaatgaactcggaaagaagatccagatagttggtgatgacctcttcgttacaaatccaagaagacttaagaaaggtatagaactaggagctgcaaacgccctattgctaaaggtgaatcagatcggtacattaacagaagctatggatgcagcttacacagcatttagagctggatacagtgtaatagtttcccatagaagtggagaaactgaagatactacgatagctgacttagcggttgccctcaacgctggacaaattaaaactggagctccggcaagaagcgataggaacgctaagtacaatcagctcataaggatcgaagaggagcttgaaggaatagcagtttacgccggcaagaactttaggaaggttttcttctga

SEQ ID NO: 25030 - DNA, 3708 bp, Pyrococcus horikoshii
atgatcctggatgctgattatataaccgaagatggcaaaccgataattaggatatttaaaaaagaaaatggtgagtttaaagtcgaatacgacaggaattttaggccatatatttacgccctccttagagatgactctgcgatagacgaaataaagaagatcacggcccaaagacatggaaaagttgtgagaattgtagaaaccgagaagattcaaagaaaatttttgggaaggccaatagaagtgtggaagctctaccttgagcatccccaagacgttcccgctataagggataagataagagagcatccagcggttgttgatatttttgagtacgatattccatttgcaaaaagatacctcatagacaagggattgactccaatggaaggaaatgaaaagctaacttttctagcggttgacatagaaactctctatcatgaaggggaggaatttggaaagggtcccgtgataatgattagctatgctgacgaagagggagcaaaggtaataacttggaaaaaaattgatctaccttatgttgaagttgtttcgagcgaaagggaaatgataaagaggctaattagggtaattaaggagaaagatccggatgtaataatcacttacaacggtgataactttgactttccatacctcctaaagagggctgaaaagctcggtataaagctcctccttggaagggataatagcgagccaaaaatgcagaaaatgggtgactctctagcggtagagataaaagggagaatacactttgatctcttccctgtgatacggagaacaataaacttgccaacttacacacttgaagcggtttacgaggccatatttggtaagccgaaggagaaggtatatgcagatgagattgcaaaggcctgggaaactggggaaggactcgagagagttgcaaagtactcaatggaggacgccaaggtaacttacgagctcgggagagagttctttccgatggaagcccagctcgcaaggctcgtcggacaaccagtttgggatgtttctagatccagtacaggaaacttagttgagtggttcctcctcagaaaagcatatgaaaggaacgagctagcccctaacaagccagatgaaaaggagtatgagagaaggctaagggaaagttacgagggaggatatgtaaaggagccagaaaagggattatgggagggaatagtaagcttagacttccgcagtctatatccctcaataataataacccacaacgtttctcccgataccctcaaccgagaaggatgcgaggaatatgacgtggctcccaaggtaggacaccgcttctgtaaagactttccagggttcattccaagtctacttggtcagctactcgaagaaaggcaaaagatcaagaagagaatgaaggagagcaaagatcccgttgagaaaaagctcctcgactacaggcaacgggctatcaagatcttagcaaacagcattttaccagatgaatggctcccaattgttgaaaatgaaaaagttcgattcgtaaaaattggagacttcatagatagggagattgaggaaaacgctgagagagtgaagagggatggtgaaactgaaattctagaggttaaagatcttaaagccctttccttcaatagagaaacaaaaaagagcgagctcaagaaggtaaaggccctaattagacaccgctattcagggaaggtttacagcattaaactaaagtcagggagaaggatcaaaataacctcaggtcatagtctgttctcagtaaaaaatggaaagctagttaaggtcaggggagatgaactcaagcctggtgatctcgttgtcgttccaggaaggttaaaacttccagaaagcaagcaagtgctaaatctcgttgaactactcctgaaattacccgaagaggagacatcgaacatcgtaatgatgatcccagttaaaggtagaaagaatttcttcaaagggatgctcaaaacattatactggatcttcggggagggagaaaggccaagaaccgcagggcgctatctcaagcatcttgaaagattaggatacgttaagctcaagagaagaggctgtgaagttctcgactgggagtcacttaagaggtacaggaagctttacgagaccctcattaagaacctgaaatataacggtaatagcagggcatacatggttgaatttaactctctcagggatgtagtgagcttaatgccaatagaagaacttaaggagtggataattggagaacctaggggtcctaagataggtaccttcattgatgtagatgattcatttgcaaagctcctaggttactacataagtagcggagatgtagagaaagatagggtgaagttccacagtaaagatcaaaacgttctcgaggatatagcgaaacttgccgagaagttatttggaaaggtgaggagaggaagaggatatattgaggtatcagggaaaattagccatgccatatttagagttttagcggaaggtaagagaattccagagttcatcttcacatccccaatggatattaaggtagccttccttaagggactcaacggtaatgctgaagaattaacgttctccactaagagtgagctattagttaaccagcttatccttctcctgaactccattggagtttcggatataaagattgaacatgagaaaggggtttacagagtttacataaataagaaggaatcctccaatggggatatagtacttgatagcgtcgaatctatcgaagttgaaaaatacgagggctacgtttatgatctaagtgttgaggataatgagaacttcctcgttggcttcggactactttacgcacacaacagttattacgggtattatggttatgcgaaagctagatggtactgcaaagagtgcgcagaaagcgttacggcatgggggaggcaatacatagatttagttaggagagaacttgaagctagaggatttaaagtcctgtatatagacacggatggactctacgcgactattcctggggttaaggactgggaagaggttaaaaggagggccttagagttcgtagactatataaactccaagctcccaggagttctcgaactcgaatatgagggcttttacgcaagggggttcttcgtcacaaagaagaagtatgccctgatagatgaggaaggaaagatagtgacaagaggtctagagatagttaggagggactggagtgagatagcaaaggagacccaagcaagagttttagaggccatactcaagcacggtaatgttgaagaggccgtcaagatagttaaggatgtaaccgaaaagctgacaaattatgaagttcccccagaaaagctggtcatatacgagcagataacgaggccaataaatgaatacaaggcaatagggccccacgtagccgtggcaaagaggcttatggccaggggaatcaaggtgaaacctgggatggtgatagggtacatagtcctcaggggtgatggcccgataagtaagagggctatctcaatagaagaattcgatcccaggaagcataaatacgacgccgaatactacatagagaaccaagtcttacctgccgttgaaagaatactcaaagcttttgggtacaaaagggaagaccttaggtggcagaaaacaaaacaagtgggattaggagcatggatcaaggtcaagaagtcttaa

SEQ ID NO: 25031 - DNA, 969 bp, Pyrococcus horikoshii
gtggttggtatgggtaagaagatacttgaggttaagaaccttaagatgtattacttcacctctaggggccccgttaaggccgttgacgacgttaccttcgacttagagaagggtgaagttcttggcttagctggagagagtggttgcggaaaatcatctattggattcactctaatgggaatgccccagcccccaggaagaatcgttggtggtagcataaagatcgacggtagggaaattgttggattacctgaggatgtcctgagaagggagataagatggcagaagatttcaatgatcttccagggggcaatgaatgctctcaatccagtttataccgtgggatatcaaatgattgaacccttgatatatcacaagggaatggacagggaagatgctttagacagggctatgaagtatttagagctcgtaggactcgacccagagatcgtttacaggtatccccacgagctttcaggtggaatgaaacaaagggttgtaatagcaatggccctactcctggaacctgacatagtaatagccgacgagccaacaacggctttagacgtggtagttcaagctcaaataattaatttaatgaagaggttaaagaagaagcttggcctctcaatgatattcattacccacgacttaagcattcttgctgagattagtgatagagtggctgtgatgtacgctgggaagctcgtggagatcgggcctagtgagaagatctattacgaaccagcccatccatacactcagaaactcctagccgcaattcctagacttcacgaagatgtcgaaaaacttgaattcattcctgggagtccaccgaacttgattaacccgccaagcggttgcagattccacccaaggtgtccttatgcaatggataagtgcaaggaagaggagccgaagatggttgaggttgataaggatcactatgcagcatgctggctcctgtga

SEQ ID NO: 25032 - DNA, 645 bp, Pyrococcus horikoshii
atgccagaaattcttaagataaaacccacaagaatggaactcctaaagttgaagagaagagttaagttagctgagaggggccataagcttctcaaggagaagcaggatgccctaatcatggagttctttacaatatatgatgaagccctttctttaaggagagagctaattcgaaagatggaggaggctttcaactctctaagaagggcccaggtggacgttggagcattaagattaaaggaaatagccattggggtcaagcctaacaaagaaattgaaatcaaaacaagaaacataatgggtgttagggtcccgttgatcgaggtacctgaacttaaaaggaaagccagcgaaagaggttatgccttcgtttcaacaacttcaacggtagacatggccgctgaaaagtttgaggaggttttggagttagcaataagacttgcagaagttgaagaatcccttaagaggcttggaaaagagatagagaaaaccaagaggagagttaatgctttagaatacataataatcccgaggatggagaacacgatcaagttcatagagcaacatttggatgagatggaaagggagaacttcttcagactaaagagagttaaggcaatattagaggctagacagtctatgtag

SEQ ID NO: 25033 - DNA, 1398 bp, Pyrococcus horikoshii
gtgatgaaaatgagcaaggaatactcaacgataagcaagatttacggtcctctaatgatagttgagggggttaaaggagtagcttatggtgaagtggttgagatcgaaactgagagcggagagaagagaaaggggcaggttttagatgcaagggaaaatatggcaatagttcaggttttcgagggaactagagatttagatataaaaacaactagcgtacgcttcaccggggaaaccctcaaagttccagtaagcatggatatgttgggaaggatattcaatggaatagggaagccaatagatggaggtccagagattattccagaggataggagagacgttcatggtgctccccttaacccagtggctagagcttatcccagggatttcattcaaactggaatttcagcaatagatggtatgaacacacttgttaggggccaaaagctacctatatttagcggttcaggtttaccccacaatcaacttgccgctcaaatagctaggcaagctaaggttctcggggaagaggagagtttcgcagtagttttcgctgctatgggtataacttatgaagaagccaatttctttaagaagagctttgaagagactggagcaatagagagagcagtcctattcctgaatttagccgatgatccagctattgagagaataataacgcctagaatggcccttacggttgccgagtacttagccttcgactatgatatgcacgtattagttatcctcacagacatgacgaattactgtgaagctttgagagagatatcagcagctagagaagaagttcctgggagaagaggctatcctggctacatgtacacagatctagcgacgatctacgagagagctggaagaattaggggaagaaagggttcaataacacagatgccaatactaacgatgcctgacgatgacataactcatccaatcccagatttaacaggttacattacggagggtcaaatagttctaagcagggaattgcacagaaagggaatctatccgcctatagatgttcttccgagcctttcaaggctcatgaaggatggtattgggaaaggaaagactagagaagatcatccacagttagcccagcaattgtatgctgcctacgctgaaggaaggagtctgagggatctcgttgctgtcgttggtgaggaagccctaagtgaaaccgacaagaagtacttagaattcgctgatagattcgagagggagttcgttgcccagggatactacgaggataggagcatagaagaaacccttgaccttggctgggaattactttcaatactacccgaaagtgagctaaagagagtgaagaaagagatgataatgaagtatcatccaaagtacaggaagcgctcctcttaa

SEQ ID NO: 25034 - DNA, 2895 bp, Pyrococcus horikoshii
atggtggcgaaggggaggataattagggttactggacctttagtggtcgcagatggaatgaaaggagctaagatgtacgaggtagttagagtgggcgaacttggacttataggagagatcatcaggcttgaaggagataaagcggtaattcaggtttatgaggaaactgctggagttaggccaggagaacctgttgttggaaccggtgcatccttaagcgttgaactaggtcctgggttgttaacttcaatatatgatggtattcagagaccattagaggtcattagggagaaaactggtgatttcatagcaagaggagttacagctccggccctcccaagggataagaagtggcacttcattccaaaagctaaagttggagataaggtggttgggggagacataataggagaagttccagagacaagtataatcgtccataaaataatggttcccccaggaatcgaaggagagatcgttgagattgcggaggaaggagactacacaatagaagaggttatagcaaaggtaaagactcctagcggtgagataaaagagcttaagatgtatcagaggtggcccgttagagtgaagaggccttacaaggagaagcttccacctgaagttcctctaataactggacagagggtaatagataccttcttcccgcaagctaaaggtggaacagctgcaattcctgggcctttcggcagcggtaagtgcgtagatggagatactcttgtgctcaccaaggaattcggcttaatcaaaattaaggagctctatgaaaagctcgatggaaagggaagaaaaatcgttgaaggaaatgaggaatggacagaacttgagaaaccgataactgtttatggctataaggatggtaagatagtggagattaaggctactcacgtctacaagggagtatcctctggaatggttgagatcagaacgagaacagggagaaagataaaggtcactccaattcataggctattcacgggtagggtaaccaaggatggccttatccttaaagaagtaatggccatgcatgtaaagccaggagatagaatagcagtcgtaaagaaaatagatggtggcgagtacatcaaattggatagttctaatgttggagagatcaaagttccggagatcctaaatgaagaacttgcggaattcctaggatatttaatggccaatggaaccttgaagtctgggatcattgagatttactgtgacgatgaatctctgcttgagagggtaaattctctctccctaaagctcttcggagttggtggaagaatagtccagaaagtagatggtaaggcgttagtgatccaaagtaaacctctggttgacgttcttagaaggttgggagttccagaggataaaaaggttgaaaactggaaagtacccagggagcttctactttctcccagcaatgtagttagggcatttgtaaatgcctatattaaaggaaaagaggaagttgaaataacactggcatccgaagagggggcctatgaactaagctatctgttcgcgaaacttggaatatacgtaacgatcagtaagagtggggagtactacaaggttagggtaagtagaaggggcaatttagatacgattccagttgaagtcaacggtatgcctaaggtattaccttatgaggacttcagaaagtttgccaagtctataggacttgaagaggtggcggagaatcacctacagcacatcatctttgacgaggtcattgacgtcaggtacattcctgaacctcaagaggtatatgatgtaacgactgaaacccacaatttcgttggtggcaacatgccaacattgcttcacaacacggtgactcagcatcagctagccaagtggagtgatgcccaagtggttatctatattggttgtggagagagaggaaacgagatgacggatgttcttgaagagttccccaagcttaaggatcctaagactggtaagccattaatggaaagaaccgttttaatagctaacacctctaacatgcctgtggccgctagagaagcctctatttacaccggaatcacgatagccgagtacttcagggatatgggatatgatgtagccctaatggctgattcaacctcaagatgggccgaagccctgagagagatctcaggtagacttgaggaaatgcctggtgaagagggatatccagcttacttagcctcaaagcttgccgaattctacgagagagcaggtagagttgttacccttggaagtgactacagggttggaagcgtttctgtaataggagcggtgtcacctcctggaggagacttcagtgaacctgtagttcagaacacgcttagagttgtcaaggtcttctgggctttagatgccgacttagctaggagaagacacttcccagcaatcaactggttgacgagctattccttgtatgttgatgcagtaaaggactggtggcataagaacattgatcccgaatggaaggcgatgagggataaagccatggctttgcttcagaaggaatccgagttacaggagatagttagaattgttggtcccgatgcattacctgagagggagagagcaatcctcttagttgccagaatgcttagggaggattatctacagcaggatgccttcgatgaagtagatacctactgtccacccgagaagcaggttacgatgatgagggttctcctgaacttctatgacaagaccatggaagccataaacaggggagttcccttagaggagatagctaagttacccgttagggaggaaataggtaggatgaagtttgagcgtgacgtatctaaaattagatccttaattgacaaaactaacgaacagtttgaggagctcttcaagaagtatggggcgtga

SEQ ID NO: 25035 - DNA, 312 bp, Pyrococcus horikoshii
atgaaggtagttatcatgggagattcagatacggtagttggttttagactagcgggaattcatgaggcttatgaatttgacctctctgagctctcaatagagagggccaggaacaagttaaaggagttggtggagagagatgatgttggtatcattttaatcacggagagattggcccaaaaaataggggaactccctcaagtaaatcttccgataatccttcaaatacctgataagttcggctcaatttacggtgaagaattgttaagggagatagttagaagggccgttgggattgaggttaagaggtga

SEQ ID NO: 25036 - DNA, 597 bp, Pyrococcus horikoshii
atgaacggtgctgagctaataattcaagaaataaacaaagaggctgagagaaagatagagtacatactcaatgaggctaggcagcaggccgaaaaaattaaagaggaagctagaaggaatgctgaagctaaagctgaatggataattagaagagcaaaaacgcaagcagagctggagaagcagagaataatagcgaatgcaaggcttgaagttaggagaaagcgacttgccatacaggaggagataatctctagtgtcctggaggaagttaaaagaagacttgaaaccatgagcgaggatgagtactttgaatccgttaaggcattactgaaagaagctattaaagaacttaatgagaagaaggtaagggttatgtcaaatgagaagacattaggcttaatagcttcaaggatagaggagataaagtcagagcttggggacgtttcaatagagcttggagaaacagtagatacaatgggaggagtcatagtagagactgaagatggaagaataaggatagataatacgtttgaggctaggatggaaagatttgagggggaaataagatccacaatagctaaggtattattcgggtga

SEQ ID NO: 25037 - DNA, 1782 bp, Saccharomyces cerevisiae
atgtattcaattgttaaagagattattgtagatccttacaaaagactaaaatggggttttattccagtaaagcggcaggtggaagacctgccagatgacttaaattcaacagaaattgtcactatctccaacagtatccagagtcatgaaacagctgaaaatttcatcacgactacaagtgaaaaagatcaactacattttgagactagtagctatagtgaacataaagacaatgtgaacgttactagaagttatgaatatagagatgaagccgataggccatggtggagatttttcgatgaacaagagtatcggatcaatgaaaaggaaagatctcacaataaatggtatagttggttcaaacagggtacctctttcaaagaaaaaaaattattaattaaattggatgtccttttagccttttattcttgtattgcttattgggtgaaatatctggatacggttaatataaacaacgcttacgtttcgggaatgaaggaagatttaggctttcaaggtaatgatttggtgcatactcaagtaatgtacacagttggtaatattatatttcaattgccatttttgatttacctgaacaagctcccattaaactatgttttaccaagcctcgacttatgttggtcgcttttaaccgttggtgctgcatatgtcaattctgtaccacacttgaaagcaattaggtttttcattggggcttttgaagcgccaagttatttggcataccaatatttgtttggttccttttacaaacatgatgaaatggtgcgtcgttctgctttttactatttgggccagtatatcggtattctatccgctggtgggatccagtcagccgtatattcatcgttaaatggtgtaaatggtttagagggatggagatggaactttattattgacgctattgtgtctgtcgtagtgggccttattggattttactccctgccaggtgacccatacaactgttattctattttcttaactgatgatgaaattaggttggcgaggaaaagattaaaagaaaaccaaacaggtaaaagtgattttgaaacaaaagtattcgatattaaactgtggaaaacaattttcagtgattggaaaatatacattttaactttatggaatattttctgttggaatgacagtaatgtttcatctggggcatacctactatggttgaaatctttgaaaagatactctattcctaagctcaatcagttatccatgattactccgggtttaggtatggtttatttgatgcttactggtattattgcagataaattacactctcgttggtttgcgattatttttactcaggttttcaatatcattggtaactccatattagccgcttgggacgtcgcagaaggagccaaatggtttgcatttatgctgcaatgttttggttgggctatggctcctgttttatactcttggcaaaacgatatttgtcgccgagatgctcaaactagagctattactttagttacaatgaatattatggctcaatcatctaccgcatggataagtgttttggtttggaaaacagaagaagctcccaggtatttaaaggggtttactttcactgcatgttctgctttttgtctctccatttggacttttgttgtactctacttctataaacgtgatgaaaggaacaatgccaagaagaacggtattgtgctttataactctaaacatggtgtggaaaagccaacgtcaaaagacgttgaaaccttatcagtatctgatgaaaaataa

SEQ ID NO: 25038 - DNA, 309 bp, Saccharomyces cerevisiae
atgttatctcttgtaaaaagaagtattcttcattcaataccaattactcgtcacattcttccaatccaattaatattggttaaaatgaaccatgtgcaaatcagaaacataaaattatatcactttatttcatatggtttcatgcttacaaagcttactgtctttctctttaacttatttttctacaggctacgaattctttgcaggcttactttactcatattatcattacctgtacaaatatatattaaagaaatccaaacaaaaatgcttgaaaagcatacagcttccgatacatcatgtatatag

SEQ ID NO: 25039 - DNA, 327 bp, Saccharomyces cerevisiae
atgcgatatactgcaacttttcggcctttgcaacgatttgtaatgaatccttttgcatcgctagaaggacaagataatatttcttctgttttttttttacatatgcaacaatttgaaagtcaggtcaaagacagattccggttccccatattcagattggagagaaaaacttttggcaactcatgttaccaagtcgagacgcttaaagttaagtgtcggccaagacacgcaaaatcttgtaatcttttaacgctgctcttcaaatcacggacgcaatcagtacttgtacctaattttggttttctaatattgaatagcgaaccatag

SEQ ID NO: 25040 - DNA, 3969 bp, Saccharomyces cerevisiae
atgtctctggcacattattgtttactactagccatcgtcacattgctgggattaactaatgttgtctctgcgactacagcggcatgcctgccagcaaactcaaggaagaatggtatgaatgtaaacttttaccagtattcattgagagattcctccacatattcgaatgcagcatatatggcttatggatatgcctcaaaaactaaactgggttctgtcggaggacaaactgatatctcgattgattataatattccttgtgttagttcatcaggcacatttccttgtcctcaagaagatttatatggtaattggggatgcaaaggaattggtgcttgttctaataatccaataattgcatactggagtactgatttatttggtttctatactaccccaacaaacgtaaccctagaaatgacaggttattttttaccaccacagacgggttcttacacattcaagtttgctacagttgacgactctgcaattctatcagtcggtggtagcattgcgttcgaatgttgtgcacaagaacaacctcccatcacgtcgactaacttcaccatcaatggtatcaagccatggaatggaagtccccctgataatattacagggactgtctacatgtatgctggtttctattatccaatgaagattgtttactcaaatgccgttgcctggggtacacttccaattagtgtgacactaccagatggcactaccgttagtgatgactttgaagggtacgtatatacttttgacaacaatctaagccagccaaactgtaccattccagacccttcaaattatactgtcagtactaccataactacaacggaaccatggaccggtactttcacttctacatctactgaaatgaccaccgtcaccggtaccaacggcgttccaactgacgaaaccgtcattgtcatcagaactccaacaactgctagcaccatcataactacaactgagccatggaacagcacttttacctctacttctaccgaattgaccacagtcactggcaccaatggtgtacgaactgacgaaaccatcattgtaatcagaacaccaacaacagccactactgccataactacaactgagccatggaacagcacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacatccactgaaatcaccaccgtcaccggtaccaatggtttgccaactgatgagaccatcattgtcatcagaacaccaacaacagccactactgccatgactacaactcagccatggaacgacacttttacctctacatccactgaaatgaccaccgtcaccggtaccaacggtttgccaactgatgaaaccatcattgtcatcagaacaccaacaacagccactactgccataactacaactgagccatggaacagcacttttacctctacatccactgaaatgaccaccgtcaccggtaccaacggtttgccaactgatgaaaccatcattgtcatcagaacaccaacaacagccactactgccataactacaactcagccatggaacgacacttttacctctacatccactgaaatgaccaccgtcaccggtaccaacggtttgccaactgatgaaaccatcattgtcatcagaacaccaacaacagccactactgccatgactacaactcagccatggaacgacacttttacctctacatccactgaaatcaccaccgtcaccggtaccaacggtttgccaactgatgagaccatcattgtcatcagaacaccaacaacagccactactgccatgactacaactcagccatggaacgacacttttacctctacatccactgaaatgaccaccgtcaccggtaccaacggcgttccaactgacgaaaccgtcattgtcatcagaactccaactagtgaaggtctaatcagcaccaccactgaaccatggactggtactttcacctctacatccactgagatgaccaccgtcaccggtactaacggtcaaccaactgacgaaaccgtgattgttatcagaactccaaccagtgaaggtttggttacaactacaaccgagccatggaccggtactttcacctctacatctactgagatgaccaccatcactggaaccaacggtcaaccaactgatgaaactgtcattattgtcaaaactccaactactgccatctcatccagtttgtcatcttcttcaggacaaatcaccagctttatcacgtctgcgcgtccaattattaccccattctatcctagcaatggaacttctgtgatttcctcctcagtaatttcttcctcagacacttcttctctagtcatttcttcctcagtcacttcttctctagtcacttcttctccagtcatttcttcttcattcatttcttcccctgtcatttcttctacaacaacctccgcttctatactctctgaatcatctaaatcatccgtcattccaaccagtagttccacctctggttcttctgagagcgaaacgggttcagctagttctgcctcttcttcctcttctatctcttctgaatcaccaaagtctacatattcgtcttcatcattaccacctgttaccagtgcaacaacaagtcaggaaattacttcttcattaccacctgttaccactacaaaaacgagcgaacaaaccactttggttaccgtgacatcctgcgaatctcatgtgtgcactgaatctatctcctctgcgattgtttccacggccaccgttactgttagcggtgccacaacagagtataccacatggtgccctatttctaccacagagataacaaagcaaactacggagacaacaaagcaaaccaaggggacaacagagcaaaccacagaaacaacaaaacaaaccacagtagttacaatttcttcttgtgaatctgacgtatgctctaagactgcttctccagccattgtatctacaagcactgctactattaatggcgttaccacagaatacacaacatggtgtcctatttccaccacagaatcgaagcaacaaactacgctagttactgttacttcctgcggatctggtgtgtgttccgaaactacttcacctgccattgtttcgacggccacggctactgtgaatgatgttgttacggtctattctacatggaggccacagactacgaatgaacagtctgtcagctctaaaatgaacagtgctaccagtgagacaacaaccaatactggagctgctgagacaactaccagtactggagctgctgagacgaaaacagtagtcacctcttcaatttcaagattcaatcatgctgaaacacagacggcttccgcgaccgatgtgattggtcacagcagtagtgttgtttctgtatccgaaactggcaacaccaagagtctaacaagttccgggttgagtactatgtcgcaacagcctcgtagcacaccagcaagtagcatggtaggatctagtacagcttctttagaaatttcaacgtatgctggcagtgccaacagcttactggccggtagtggtttaagtgtcttcattgcgtccttattgctggcaattatttaa

SEQ ID NO: 25041 - DNA, 1374 bp, Saccharomyces cerevisiae
atgacaagcgaaccagagtttcagcaggcttacgatgagatcgtttcttctgtggaggattccaaaatttttgaaaaattcccacagtataaaaaagtgttacctattgtttctgtcccggagaggatcattcaattcagggtcacgtgggaaaatgataatggcgagcaagaagtggctcaaggatacagggtgcagttcaattcagccaagggcccttacaagggtggcctacgcttccacccatcagtgaacctgtctatcctaaaatttttgggttttgaacagatcttcaagaatgcgctcactgggctagatatgggcggtggtaagggtggcctgtgtgtggacttgaaaggcaagtctgacaacgagatcagaaggatttgttatgcgttcatgagagaactgagcaggcatattggtaaggacacagacgtgcccgcaggagatattggtgtcggtggccgtgaaattggctacctattcggcgcttacagatcatacaagaactcctgggaaggtgtgttgactggtaagggtttaaactggggtggctcacttatcaggccggaggccaccgggttcggcttagtttactatacgcaagcaatgatcgattatgcaacaaacggcaaggagtcgtttgagggcaaacgtgtgacaatctccggaagtggcaatgttgcgcaatatgcagctttgaaagtgatcgagctgggtggtattgtggtgtctttatccgattcgaaggggtgcatcatctctgagacgggcattacttctgagcaaattcacgatatcgcttccgccaagatccgtttcaagtcgttagaggaaatcgttgatgaatactctactttcagcgaaagtaagatgaagtacgttgcaggagcacgcccatggacgcatgtgagcaacgtcgacattgccttgccctgtgccacccaaaacgaggtcagtggtgacgaagccaaggccctagtggcatctggcgttaagttcgttgccgaaggtgctaacatgggttctacacccgaggctatttctgttttcgaaacagcgcgtagcactgcaaccaatgcaaaggatgcagtttggtttgggccaccaaaggcagctaacctgggcggcgtggcagtatccggtctggaaatggctcagaattctcaaaaagtaacttggactgccgagcgggtcgatcaagaactaaagaagataatgatcaactgcttcaacgactgcatacaggccgcacaagagtactctacggaaaaaaatacaaacaccttgccatcattggtcaagggggccaacattgccagcttcgtcatggtggctgacgcaatgcttgaccagggagacgttttttag

SEQ ID NO: 25042 - DNA, 1254 bp, Saccharomyces cerevisiae
atgagagccttagcgtatttcggtaaaggtaacatcagattcaccaaccatttaaaggagccacatattgtggcgcccgatgagcttgtgattgatatcgaatggtgtggtatttgcggtacggacctgcatgagtacacagatggtcctatctttttcccagaagatggacacacacatgagattagtcataacccattgccacaggcgatgggccacgaaatggctggtaccgttttggaggtgggccctggtgtgaaaaacttgaaagtgggagacaaggtagttgtcgagcccacaggtacatgcagagaccggtatcgttggcccctgtcgccaaacgttgacaaggaatggtgcgctgcttgcaaaaagggctactataacatttgttcatatttggggctttgtggtgcgggtgtgcagagcggtggatttgcagaacgtgttgtgatgaacgaatctcactgctacaaagtaccggacttcgtgcccttagacgttgcagctttgattcaaccgttggctgtgtgctggcatgcaattagagtctgcgagttcaaagcaggctctacggctttgatcattggtgctggccccatcggactgggcacgatactggcgttgaacgctgcaggttgcaaggacatcgtcgtttcagagcctgccaaggtaagaagagaactggctgaaaaaatgggtgccagggtttacgacccaactgcgcacgctgccaaggagagcattgattatctgaggtcgattgctgatggtggagacggcttcgattacacatttgattgctccgggttggaagtcacattgaatgctgctattcagtgtctcactttcagaggcaccgcagtgaacttggccatgtggggccatcacaagatacagttttctccgatggacatcacattgcatgaaagaaagtacacagggtccatgtgctacacacaccacgattttgaggcagtaatagaagctttggaagaaggcaggattgacattgatagagcaagacatatgataacgggcagagtcaacattgaggacggccttgatggcgccatcatgaagctgataaacgagaaggagtctacaatcaagattattctgactccaaacaatcacggagagttgaacagggaagccgataatgagaagaaagaaatttccgagctgagcagtcggaaagatcaagaaagactacgagaatcaataaacgaggctaaactgcgtcacacatga

SEQ ID NO: 25043 - DNA, 1149 bp, Saccharomyces cerevisiae
atgagagctttggcatatttcaagaagggtgatattcacttcactaatgatatccctaggccagaaatccaaaccgacgatgaggttattatcgacgtctcttggtgtgggatttgtggctcggatcttcacgagtacttggatggtccaatcttcatgcctaaagatggagagtgccataaattatccaacgctgctttacctctggcaatgggccatgagatgtcaggaattgtttccaaggttggtcctaaagtgacaaaggtgaaggttggcgaccacgtggtcgttgatgctgccagcagttgtgcggacctgcattgctggccacactccaaattttacaattccaaaccatgtgatgcttgtcagaggggcagtgaaaatctatgtacccacgccggttttgtaggactaggtgtgatcagtggtggctttgctgaacaagtcgtagtctctcaacatcacattatcccggttccaaaggaaattcctctagatgtggctgctttagttgagcctctttctgtcacctggcatgctgttaagatttctggtttcaaaaaaggcagttcagccttggttcttggtgcaggtcccattgggttgtgtaccattttggtacttaagggaatgggggctagtaaaattgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagccttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaagtaa

SEQ ID NO: 25044 - DNA, 639 bp, Saccharomyces cerevisiae
atgtgggaacaaagacgacaaaaggtagttttttccttgactatactggtaagatatcgtctaaaacaaagcatggccaagaaaatatcaaagaattcaagagctgctagacaatcggatgctcttgaaccagaggtaaaggatttaagtgaactacctagagctgaaaaaaccgatttgactaatattttgattagaacagcagccaagaatgaggcattgctggaagcaaagatatctaagaaagccaataaaagtaagaggggcaagaagttaaataaaaaggctctggaagacaaactggacaactctatttcatccatggacagggatcgtttagtgaaggccttgaattttaccaatcgtctggacggtaaaattgccaagtccatttctcgtgccaagtacattcaaaatacaagaaaggctggctgggatagcaccaatgagactataaaaaaagagctggcttttttgaacggagggttgtctgtgcaggcaaaaagtgctagtgaaggtaatgctgaaaaggaagatgaggagatcccagaagtttttgactctttagcagaggataacacagtgcagaagactcctacaaatagattcggtgtcctgccagacgatgttgaagaatag

SEQ ID NO: 25045 - DNA, 1509 bp, Saccharomyces cerevisiae
atgaaattttctgcgtatttatggtggctgtttttgaatctagcgttggtgaaaggcacttcattgctatccaacgttacattagcggaagattctttctgggagcattttcaggcttacactaatacaaagcatttaaaccaagagtggatcacaagtgaagccgtcaacaatgaaggctctaaaatatatggtgcacaatggcgactatcacagggtcgattgcaaggatccgcatgggataaaggaatcgcagttcgaacaggcaatgccgcagctatgataggacatctcttggagacacctattaatgtttcagaaacggataccttggttgtccagtacgaaattaagttggacaattctttgacgtgcggcggtgcgtttattaagttaatgtctggtttcatgaatgttgaagcattaaaacactatgcacccgatacagagggtgtcgagttagtttttggtccggattattgtgctcctgaaataaatggcgtgcaatttgccatcaataaggttgacaagatcacacatgaatctaaactaagatatttgcaagagatgcccctgtcaaaattaactgatacctcgcaatctcatctgtatacgctcataatagatgaatcagcgcagtcttttcaaattcttatagacggtaagacggttatggtaagagaacatatcgaagacaagaaaaaggtcaattttgagccacccattacaccgcctttaatgattcctgatgtttcagtagcgaaaccgcatgattgggatgatcgcatccgaatcccagatcctgaggcggtgaagctcagtgatcgggatgaacgagacccattgatgattccacatccagatggcactgaaccaccagaatggaacagctccatccccgaatacattcttgacccaaatgctcaaaagccctcgtggtggaaggaacttgagcacggggaatggataccgcccatgattaaaaatcctctttgcactgcagaacgtggttgtggccagcagataccagggctgataaataatgccaagtacaaaggtccaggcgaactcaatgaaatcataaatcccaattacatgggggaatggcatccaccggaaattgaaaacccgctatactacgaagagcagcacccattgcgcatcgaaaacgttatcagtggtgtgatcctcgagttttggagtggatctccaaacatgttgataagcaacatttatgttggtaaaaatgtaacagaggcgcaaattattgggaataagacttggctgatgagagaccgcgcgtttagaggctccgatggccccacagaacgcaaattcatgaatagcagactaggaaatctacaaacaactttccataacgaaagagaatcccctaatccatttgaccgcattatagatcgcatattagagcaacctctgaaatttgtgcttactgcggccgtcgtgctcttgacgacgtcggttctttgttgtgtagtatttacatag

SEQ ID NO: 25046 - DNA, 2544 bp, Saccharomyces cerevisiae
atggaaatttccagttcaccatggaacgacggtggatacagcccctatgagagaaacagagtcgctgtatcaccattttcatcagcgttggaaggcgaagaacgaatagaaacctctcgatctttgggtgatcattgctttgaacctttgccatacgtgacgaattatctttctattttcgcgctttttggtaaagagatatttggtgacaagggaaatgtgagctcaagaaatgaatatttgctaaaaaaatactactctttgaaaaagccatttgtattgcgacataatgggcatgcgttgaagaatcccgacatgccactccagaggaatgacatattgcaaaccaatttcatggttgacaaatttctgaatcgtactgtgcggtcagtgaattttaataatttcaagataatatcagatatgcaaagtaaaagcggtcgaggaacaaagtcaggcacaaatcagaatcaaagtgccgacgctattcaaaatatttgtctaccatctataccgtcggcgttgccttatttccagtattataggaagctattgacagttaataccaaagaatgggatattttaaaactgcacagtttatgggtaccaaagctaaggaaggattttaaagatttttcgttgtatggtgataaaaactctttaaagccgatcgatagtcactatgatgaggataataccatgaagaaaaatttattttttgaaagatctccaagtcgacagactctagatggtaaagggtgtgcctctaaggggtatgacatttcttccggtaatatgattatcccatccctattttctgaagataagctgccggctttaacttatcattgttccgtagaattaaatggaaacatttacatatttgggggattgatgccatgctacagctatgaggaggatgcgccgatgctgaacgatttttttgtagacggaataaagaacttacctccccctttactacctcaagtgattaataatccatcaatggtcaataatcctcatctttatgtcgcttctataccatcatgccggtttagcaaacctaaaatggggggttatataccgcctccattgctatgtgttcaaggatccaaattaacggaccgacatattttcttttatggcggatttgaaatcaggacagaaacccgtggtgatgaaaatgggaagtatcatctcaagaaaagattatatgtgaataacactggttacatactcgatattatgtcgttcaagttcactaaaatagatatcatagtacaaccttccaaatataatgcatatccgacaatgtcatcgaggtttggtcacttacaaatttctattgataatccaaataggagagctagcgttcattcttcaagcatgaacgaaattcataaaatggggagtgcttccatgaaacaaggtagcagcatcacttccgggcggcttgaaaaagcagcagtactttcatcattacctcataatactgtgcacacggttataatatttggtggttacagacaaaccggtgatgatcgttacgaagcaatgaatgatttgtggaagatagagatacccgtgatacgtcgcggtaaaaaaggttattgtaagttttcagagacagctaacgcgatactactgacgccaagcgaaaaggacaaatcggattggcccgaagaaagagccttttctgccttttctgttcatgggacttcgttaatggataggagttctcttgacatgagactattgaacaacttaaaaaaccattttgttttaaaaccgtcatatatatcacaggatcgcgttgttagtcctaaaccggttttccccatgatggttcatggcacgcatcaagatcttttcaatagtggctctgcggcacaagaatcgcccaaagctggtgcctcggccagcagcgcaagtgctgcgagctttgatcccgatatggacgataatttggaaaattatataatcaatccagggagaaaatcgtcatctattccaatgactgcgatagggagacagagattaattttaagccaagagaagccagtaggtaaaactgttgtattgcatggtgggtctaacggtctcaacgttcttgatgatatgtggttgatggacttagagtgtgagacatggactccaatagagacatttgcaaaggcagattcgagcgaagacggtgatgaaaaattggatagtgtgaacgtaggtctcgttggccacagaatggaaagtattggacgaatatgtgtatgtataggtggtatggtacaagaggatgttgaccaattttactcggagaatgatgatgagcctcctcgaaaacgcaaggtcgatacattaccgttgggtggtaattttttgaacacaattgatttaagcacgcagttttgggaagaacataaaattactctgtccaagaaggcagccgatgaggacagacaagatagcgaaaatgaagatacaaattcaaatatagtagttggtgtcggtggcacttctttcaatgtgacaaaagtattattttga

SEQ ID NO: 25047 - DNA, 543 bp, Saccharomyces cerevisiae
atgccaccaccatcaagaagtagaataaacaaaacaagaacattaggaatagtgggtacagctatagcagtgttggtcacgtcctactatatatatcaaaaggtgacaagtgcaaaggaagataatggggcacgacctccagagggtgattcagtaaaagagaacaaaaaggcaaggaagagcaaatgtattataatgagcaagtcgatacaaggactgcccataaagtgggaggagtacgccgctgatgaagtggttttgctggtacctacgagccacactgatggatcaatgaaacaagccattggggatgcctttcgcaagacgaaaaacgaacacaaaatcatatattgcgatagcatggatggattatggtcatgtgtaagacggctaggtaaatttcagtgcatattgaactccagggacttcacaagtagtggtggtagcgatgcagcagtcgttcctgaagatataggcaggtttgtcaaatttgttgttgatagcgatgtagaggatgtgctgattgacactttatgcaattaa

SEQ ID NO: 25048 - DNA, 2142 bp, Saccharomyces cerevisiae
atgtcgccctctgccgtacaatcatcaaaactagaagaacagtcaagtgaaattgacaagttgaaagcaaaaatgtcccagtctgccgccactgcgcagcagaagaaggaacatgagtatgaacatttgacttcggtcaagatcgtgccacaacggcccatctcagatagactgcagcccgcaattgctacccactattctccacacttggacgggttgcaggactatcagcgcttgcacaaggagtctattgaagaccctgctaagttcttcggttctaaagctacccaatttttaaactggtctaagccattcgataaggtgttcatcccagaccctaaaacgggcaggccctccttccagaacaatgcatggttcctcaacggccaattaaacgcctgttacaactgtgttgacagacatgccttgaagactcctaacaagaaagccattattttcgaaggtgacgagcctggccaaggctattccattacctacaaggaactacttgaagaagtttgtcaagtggcacaagtgctgacttactctatgggcgttcgcaagggcgatactgttgccgtgtacatgcctatggtcccagaagcaatcataaccttgttggccatttcccgtatcggtgccattcactccgtagtctttgccgggttttcttccaactccttgagagatcgtatcaacgatggggactctaaagttgtcatcactacagatgaatccaacagaggtggtaaagtcattgagactaaaagaattgttgatgacgcgctaagagagaccccaggcgtgagacacgtcttggtttatagaaagaccaacaatccatctgttgctttccatgcccccagagatttggattgggcaacagaaaagaagaaatacaagacctactatccatgcacacccgttgattctgaggatccattattcttgttgtatacgtctggttctactggtgcccccaagggtgttcaacattctaccgcaggttacttgctgggagctttgttgaccatgcgctacacttttgacactcaccaagaagacgttttcttcacagctggagacattggctggattacaggccacacttatgtggtttatggtcccttactatatggttgtgccactttggtctttgaagggactcctgcgtacccaaattactcccgttattgggatattattgatgaacacaaagtcacccaattttatgttgcgccaactgctttgcgtttgttgaaaagagctggtgattcctacatcgaaaatcattccttaaaatctttgcgttgcttgggttcggtcggtgagccaattgctgctgaagtttgggagtggtactctgaaaaaataggtaaaaatgaaatccccattgtagacacctactggcaaacagaatctggttcgcatctggtcaccccgctggctggtggtgttacaccaatgaaaccgggttctgcctcattccccttcttcggtattgatgcagttgttcttgaccctaacactggtgaagaacttaacaccagccacgcagagggtgtccttgccgtcaaagctgcatggccatcatttgcaagaactatttggaaaaatcatgataggtatctagacacttatttgaacccttaccctggctactatttcactggtgatggtgctgcaaaggataaggatggttatatctggattttgggtcgtgtagacgatgtggtgaacgtctctggtcaccgtctgtctaccgctgaaattgaggctgctattatcgaagatccaattgtggccgagtgtgctgttgtcggattcaacgatgacttgactggtcaagcagttgctgcatttgtggtgttgaaaaacaaatctagttggtccaccgcaacagatgatgaattacaagatatcaagaagcatttggtctttactgttagaaaagacatcgggccatttgccgcaccaaaattgatcattttagtggatgacttgcccaagacaagatccggcaaaattatgagacgtattttaagaaaaatcctagcaggagaaagtgaccaactaggcgacgtttctacattgtcaaaccctggcattgttagacatctaattgattcggtcaagttgtaa

SEQ ID NO: 25049 - DNA, 2352 bp, Saccharomyces cerevisiae
atgatcttcctaaacaccttcgcaaggtgccttttaacgtgtttcgtactgtgcagcggtacagcacgttcctctgacacaaacgacactactccggcgtctgcaaagcatttgcagaccacttctttattgacgtgtatggacaattcgcaattaacggcatcattctttgatgtgaaattttaccccgataataatactgttatctttgatattgacgctacgacgacgcttaatgggaacgtcactgtgaaggctgagctgcttacttacggactgaaagtcctggataagacttttgatttatgttccttgggccaagtatcgctttcccccctaagtgctgggcgtattgatgtcatgtccacacaggtgatcgaatcatccattaccaagcaatttcccggcattgcttacaccattccagatttggacgcacaagtacgtgtggtggcatacgctcagaatgacacggaattcgaaactccgctggcttgtgtccaggctatcttgagtaacgggaagacagtgcaaacaaagtatgcggcctggcccattgccgctatctcaggtgtcggtgtacttacctcagggtttgtgtctgtgatcggttactcagccactgctgctcacattgcgtccaactccatctcattgttcatatacttccaaaatctagctatcactgcaatgatgggtgtctcaagggttccacccattgctgccgcgtggacgcagaatttccaatggtccatgggtatcatcaatacaaacttcatgcaaaagatttttgattggtacgtacaggccactaatggtgtctcaaatgttgtggtagctaacaaggacgtcttgtccattagtgtgcaaaaacgtgctatctctatggcatcgtctagtgattacaattttgacaccattttagacgattcggatctgtacaccacttctgagaaggatccaagcaattactcagccaagattctcgtgttaagaggtatagaaagagttgcttatttggctaatattgagctatctaatttctttttgaccggtattgtgttttttctattcttcctatttgtagttgtcgtctctttgattttctttaaggcgctattggaagttcttacaagagcaagaatattgaaagagacttccaatttcttccaatataggaagaactgggggagtattatcaaaggcacccttttcagattatctatcatcgccttccctcaagtttctcttctggcgatttgggaatttactcaggtcaactctccagcgattgttgttgatgcggtagtaatattactgatcatcacgggacttctggtttatggaactataagggttttcatcaagggaagagagtctctcagattatacaagaatcctgcgtacctactttacagtgatacctacttcttgaacaagtttgggttcttatacgttcaattcaaagcagataagttttggtggcttttacccttattaagttatgcgttcttaagatccctgtttgttgccgttttacaaaaccaaggtaaggctcaagcaatgatcatctttgtcattgaactagcttacttcgtttgtctctgttggataagaccatatttggacaagagaactaatgttttcaatattgctattcatttggtgaatttgatcaatgcatttttctttttgtttttcagtaatttgttcaagcaaccagcagtggtttcgtcagtgatggcggttattctgttcgttttgaacgcggtgtttgctctattcctattattgttcactattgtcacctgtacactggcattactacacagaaacccagatgtccgttaccaaccaatgaaagatgaccgtgtgtcattcattcctaagattcaaaatgatttcgatggcaaaaacaaaattgatcctgaactgtttgaattgagaaaagctgttatggacaccaatgaaaatgaggaagaaaaaatgttccgtgacgacactttcggcaagaacctgaatgcaaacacaaatacagcaagactctttgatgatgagactagttcatcctcttttaagcaaaattcctctcccttcgatgcctcggaagtaacggagcaacctgtgcaaccaacctccgctgtcatgggtacgggtggcagcttcttgtctccacagtaccaacgtgcgtcatctgcttctcgtactaatctagcgccgaataatacaagcacctccagtttaatgaagcctgaatcaagtctctacctggggaattccaataaatcatattcgcattttaacaacaacggcagcaacgaaaacgcccgcaacaacaacccatatttgtaa

SEQ ID NO: 25050 - DNA, 3189 bp, Saccharomyces cerevisiae
atggtcgaaaatagtacgcagaaggccccacatgccggaaatgatgataatagctctaccaagccatattcggaggcgtttttcttagggttcaataacccaacgcctggattagaagctgagcactcaagcacatcgcctgcccccgagaactccgaaacacataataggaaaagaaatagaatattgtttgtctgccaggcttgttggaagtcaaaaacaaagtgtgatagagaaaaacctgaatgtggtcgatgcgtcaagcatgggttaaaatgtgtttatgacgtatcaaaacagccagcaccacgaattccgagtaaagacgccattatatcaaggttggaaaaagatatgttttattggaaagataaagctatgaagctactaacagagagagaggtgaatgaatcaggcaagagatcagcaagtccgatcaatacaaacaatgctagcggggacagtcctgataccaagaagcagcataaaatggaacctatatatgaacaaagtggtaacggggatataaacaatggtaccagaaatgatattgaaatcaacttgtatagaagtcatccaaccatgatcatgagtaaagtcatgaaaagagaagttaagccgttatctgaaaattatattataattcaggactgttttctaaaaatcctggtcacttcagtgttccttgacacttcaaagaacacgatgataccggcattgacggcaaacgcgaatattacaagagcccagcctagcgtagcaaataaccttttgaaattgaaggaaatgctaatcagacagtgtcaaaccgaagatgaaaaaaatcgtgtaaacgaattcactgatagaatactacaaaatacaaattcaaatagaaacttgaaaatcggtatgctattatcaatgctttacaattctgtcggttaccaatatctggaggatcattgccctcaaggtggcgaatattcggatttattgagaaatttgatcaatgaatgtgaagctattttgccatcttacgaaattattgaacgctacaagaaccacttttatgagtacgtttatccaagtctacctttcatcgaattagaaatttttgaagaatcattaagtcaaacaatttttccggacccaaacaacccctccaaggtgcaaatacgtatgggtagcacacatttgagagctaaggtggaaaacttgagtcttctattggttatcttgaaactctcatacatgtcaataaggtttttagatcatagtacagcagactcgagtttttatctttcaaaggaaataattgataaatacccaataccgaacgattttattttattgagtccaagatgtctagcatcggaaaattggtgtgcatgcgctaatgaaaacatcatatcatgtttactatatatctggtctttttttgctttttctcctgaagagggtgatttctttctcgagcaccccaccgatgttatcagtagtttgataatgatgctttccacctcgattggtctccacagagatccttcagatttccctcaattgatttccccgtccacctcagataaaagaaccttgaatcacagaagaatactctggttgagtatcgttaccgtttgttcgtttgaagcaagtctcaaaggtagacattctgtctcaccgatatctttaatggccttattcctaaatattaaggatcctgattctctgacggtatatatgaaccgagttaggggcgatctaagcgatatcaataatcacacacttttgagaattcataaatttacattcaagagagcccagcttgcgttactcctgtcggacttagataacttgacgatgacatactatggtagtttccatttgcattcaattgaattcataagagaaaagattgagatttttgtggaggaaaactttcccatagtaccattaaaaagtgtcgcacaggataagtcagaccttgatgacatgaatgtgatttcagaaatgaatatattatcttcagaaaattcttcttcatttcacaatcgaataatgaataaactattgatgttgagaacttcaatggccgtattcttgcattttgaaacacttatcactaaggataaaagtatcttcccattctacaagaaatactttatggttagctgtatggatgcgttgtcactaataaattatttcaataagtttttcaacggagaatatcgacacgcaatatcttctttaaccagttttaatgttacaaaatttattcagttagcactatccagcacaatcttcagcctattagggattatactaagaataggtttagccatccatatgttatcttctgaagtacaaaagttatcgggaacgacagatccaagaataaaggagttaaataccaaagtcgaaaaatttagtaccctgcaaagagatctcgagtctgctttagaaggtatatattgctctgcttcggaacatttaagattcacatacttccccgtttttaagatgttggctttattcgatgtcattgtacaaaggatgagaaagggtgaattatggcacggcatatttacgatgattcaaatggaacaaatgcattctaggataatcaagacattaagcattaccttaggagtcaaactggacaaaaaggataggctattagaggaattgatggcatgcaatcacgttgcgaattttagcgttgaagatatagatgagctgaaccgtaatatcaaaaaagagattcaaatttcttcaggattgaagccgcctgtaaacacaattgacttaaccaacggcgaaccattcggaaatgctgttcctaccttcacaaagacatggagttcatccttagataatttagaaaaactatcatcggccgctgcagttggtcagagcttggactacaacagtggtttacgtcagggtcctttggcgggtggtggttcaaaagagcaaacgccaatagccgggatgaataacttgaacaattcaatcaatgctacaccaattgtcgataactcatctggatcacaacttcctaatggtttcgatagaggccaagcgaataatactccttttccaggttattttggaggtttggatttatttgattatgactttttggtttgggcaatgactttgcttaaaaattttctttccaaactcctacctattcatttcatcaattaa

SEQ ID NO: 25051 - DNA, 741 bp, Saccharomyces cerevisiae
atggcatctaatcaacctggcaagtgttgctttgaaggagtttgtcacgatggaacacccaagggtcgtcgtgaagaaatcttcggtttagatacttatgcagcaggctctacatctcccaaggaaaaagttatagttatcttgacagatgtgtatggcaataaattcaacaatgttttattaacggccgacaaatttgctagtgctgggtacatggtctttgttcccgatattttattcggcgatgctatctcatcggacaaaccaattgatcgtgatgcctggtttcaaagacattctcctgaagtcaccaagaaaattgttgatggattcatgaagttgttaaaacttgaatatgacccaaagtttattggcgttgtgggttactgttttggtgcaaagtttgccgtccaacacattagtggcgacgggggtcttgccaatgctgcagccattgcacatccatctttcgtcagcatcgaggaaattgaagcaattgatagcaagaaaccaatattgatttcagcagcggaagaggatcacatctttccggcaaacttaagacacttaacggaggaaaaattaaaggataatcacgctacttaccagttagacctcttcagtggtgtggctcacgggtttgcagcaagaggcgatatatccatacctgccgtaaaatatgcgaaggagaaagtcttgctcgaccaaatatactggttcaatcatttttcgaatgtttaa

SEQ ID NO: 25052 - DNA, 1989 bp, Saccharomyces cerevisiae
atgactaaagaaacgattcgggtagttatttgcggtgatgaaggggttggtaaatccagtctgattgtatcattaacaaaagctgaattcataccgaccatacaggacgtgctgccacccatcagtatcccaagagatttctcatcatcacctacatattctcctaagaatacagtacttatagacacttcagattcggacctcatagctttagaccatgagttgaagtccgccgacgtaatttggcttgtgtattgcgatcacgaatcgtatgaccatgtttctctcttttggttgcctcatttcagatccctggggttgaatattcctgtcattctctgcaaaaataaatgtgattccatatcgaatgttaatgccaatgcaatggtcgtgtcagagaacagtgatgatgatatcgataccaaagtggaggatgaagaatttatcccaatattaatggagtttaaagaaatcgacacttgcattaagacaagtgccaagacacagtttgatcttaaccaagcgttttatctttgccaaagggctataacacacccaatatcacctttatttgatgccatggtaggtgaactaaagccattggctgtcatggctttaaaaagaatttttcttttaagcgatttaaaccaggactcatatttagatgacaacgaaatcttgggcttacaaaaaaagtgcttcaataagagtatcgatgtaaacgaactgaattttattaaagatttgcttttggatatttccaagcacgatcaagagtacattaaccgcaagctatacgtaccgggaaaaggcatcaccaaagatggtttccttgtactgaacaaaatatacgctgaaagggggagacacgaaactacatgggctatcctaagaactttccattacacagattccttgtgtattaatgacaaaattctccatccgaggttggttgtccctgacacttccagtgtggaattgagccccaagggctacagatttcttgtagatatttttttgaagtttgatatcgacaatgatggtggtttgaataatcaagaattacatcgtctatttaagtgcacaccagggctgcctaaactatggacctcaacgaatttccccttctccactgtcgtaaacaacaagggttgcatcaccttacaaggctggctagcacaatggagtatgacgactttcttgaactatagcacaactaccgcttacttggtgtattttggctttcaggaagatgcaagactagccctacaagtaaccaagccaaggaaaatgagacgccgttccgggaaactttacagatccaatatcaatgacagaaaagtgttcaattgctttgtcattggaaagccatgttgcggcaaaagctctttgctagaggccttcttgggcagatctttctcggaggagtattctccgacaatcaaaccaagaattgcagtcaatagtttagaactcaaaggtgggaaacagtactatttgattttgcaagaacttggagaacaggaatacgccatactagagaataaggataagttaaaagaatgtgacgtaatctgtctaacatacgattccagcgacccagaatcattctcctacttagtttcgcttctagacaaattcacacatttacaagatctaccgttggtatttgtagcttctaaggcagatttggataagcagcaacaaaggtgtcaaatccaaccagatgaactggcagacgagctatttgtgaaccacccactgcacatatcatccagatggctaagttcccttaatgaattgtttattaaaatcacagaagctgctcttgatcctggcaaaaacactccgggattgccagaagaaacagcagcaaaagatgtcgactacagacaaacggctctcatttttgggtccactgttggattcgtagcactatgttcctttacgttaatgaaattattcaaatcatcaaaattctcaaaataa

SEQ ID NO: 25053 - DNA, 1869 bp, Saccharomyces cerevisiae
atggtacgtcgatggattcctagtggcaggcatcttcgcaataatgacaacactggtgatgatgacgacagcgagttcacaaactcgatggattctgggatgtccataccatcactcagggactccatgaccacgaggtcatctcataacgatcccatcaagcctgctctgatgaacgattccaacaaagtcaaaaatttggagaaggagttgactaatgccaaaatcaagattcaagtactctatgaatacattcgcagaatccctaataaagacggcaatgcaccatcgctgggcaatgacactgattttagaaattcgattatcgagggtctaaatcttgaaataaacaaattgaaacaggatttaaaggcgaaggaagtcgagtaccaagatacgctacaattcgttcaagagaatttagaaaattcggaaagtatcgtgaatacgatcaatcacctattgtcctttatattgacgcattttaatgagcaagatgaaaatgcccatcttcttgataaagaagagagggagaccctggaggaaactttagagctgagctcggattatgttcttgaaaaaatggatactttgtccaagttcatcatccaattcttgcaggactttttgcattccaaaagtcgagcggaatcaaagcaggataaggaagaatttctttcactggcccagtcctcaccagcaggatcacagttagaaagtagggactcaccatcaagtaaagaggagaatactgatggtggataccagaatgacgaaattcatgacagtaacaaccacattgatacagaaaatgtaatggcaaacagtacttccttaccaatttcagccgtcgagtctcgttttgagaaaaccttagacactcaattagagattgtcatagaaattttgcacaaagaatatgatcaatttataaattccattagattgaaattcgagaaatcgcaaaaattagaaaaaataatagcgtccaaactaaatgagcagtctcatctactagattccttagaattggaagaaaattctagttccgttatagaaaaacaagatcatttgatttcccaactgaaggaaaagatcgaatcgcaatctgttttgataaacaatttggaaaaattgaaggaagacatcattaaaatgaaacaaaatgaaaaagttttaaccaaagaactggaaactcagaccaaaatcaataaactaaaggaaaataattgggacagctacatcaatgacttggaaaaacaaatcaatgaccttcaaatcgataaatcagaggaattccacgtaatacaaaatcagttagacaaattagacttggagaattaccaattaaaaaatcagttaaatactttggacaaccaaaagttaatactatcccaatatgaaagcaattttatcaaatttaatcagaaccttttactacaccttgacagtattttcaatattctgcagaaaatcttacaagaaagttctattgcccaatttgacaggaaaatgaaatccataaaatctgtaccaaatgcgttgaaaaacttgaatttgattcagcccaaactagaatcgctctacacttttatagagactgcattagagtccataataaactcatatatctcttcactgatttccatggaaaccccagagcagccacatcaacagggcaatgaattaacggcaactccaaataaagaactgaccttacgaatagaggagttacaaagaagatggatatccgaaagagaaagacggaagctcgatgctaacgcttcagaagctcgaatcaaggctttagaacaggaaaatgagtcattgagatcgaaacttttcaacctatcaatcaacaatccctaa

SEQ ID NO: 25054 - DNA, 357 bp, Saccharomyces cerevisiae
atgaagctcccacagaccatgctacgttctatatctgtgaagcatgtccggtggccaaggattctgacgggctcaaagctttggtactcaacgcagatggcaatgactccggaggagaagatgatcaccgataaactacaacaggaactggaacctgaagtgtgtaaagtgcaagacgtttccggtggctgcggatccatgtttgctatcaacataacaagcaagaagttcaacggactgagtctcatcaagcagcaccagctggtgaacagaattttgagggacgatatttccagatggcatggcctacaattgaccactaagaagtcaactgggaagggtccggcatcatcatga

SEQ ID NO: 25055 - DNA, 309 bp, Saccharomyces cerevisiae
atggataccgttcgcctgagccatctcgtcttgcaagagggaataaaccatacgatggcgttgtggaagtttcaggccttcgaactttttactgaccatctcaatccggaaatgtgtctcagcagagacatttccctgtacaccagcatggcccttatgcttgtgagaatcgttgtagaggccaaacgcaaagttcttgtaatctggaaagccgcattccagtctcttcaggatggtacgtgccacgggaccatctgtgctcattgctctcttgaacattattctctttccactttcgtttgctgctaa

SEQ ID NO: 25056 - DNA, 534 bp, Saccharomyces cerevisiae
atgaagcataccacatcgacaatgttacgcactactagactatggaccacccgcatgcccgctgtgagcaaattgtttttgagaaacagctccggcaatgccctaaacaagaataaactaccatttttgtactcatcccaaggacctcaagccgtgaggtacacttcccaacatgagtggatagctgtgcatcaggacaagactgcctttgtcggaattacaaaatacgccactgattccttaggggacgctacctatgttgagttgccagaagtgggcactgagatttcccaaggtgagtcgctagggtccattgagtccgtcaagtcagcctccgagatctaccagcctgccgatggtaccgtagaggaaattaacactaatcttgaggaaaatccaggtgtggtgaacgaagatcctatgggtgacggctggctagtcaaaatgaagcttggtgagggcgttaatgtggaacaggtcgagggtctaatgtccttagaacagtacgaaaagacactggttcatgatgactga

SEQ ID NO: 25057 - DNA, 2358 bp, Saccharomyces cerevisiae
atgtcatctgcagagatggaacaattgttacaggccaagacactggccatgcacaacaatccaacggagatgctgcccaaggtgctcgaaactacggcatccatgtaccacaacggtaatctcagcaagctgaagttgcctttggccaagttttttacacagttagttctagacgtggtgtcgatggactctccaattgcgaatactgagagaccgtttattgctgctcaatatctgccactacttcttgctatggcgcaatccaccgcggacgtactagtgtacaagaatatcgtgcttattatgtgcgcttcatacccgctggtgttggatctggttgctaagacatcaaaccaggaaatgtttgatcagttgtgtatgctgaagaagttcgtgctctcgcactggagaactgcatatcctttgcgtgccaccgttgacgatgaaacggatgtcgaacaatggctggcgcagattgaccaaaatatcggcgtgaaattagcgaccatcaagttcatatctgaggtcgtgctgtcgcaaactaaatcacccagcggcaacgagattaattcatctaccatcccggataaccaccctgtgttgaacaaaccggctttggagagcgaggctaagaggcttcttgatatgttgctaaactacctaattgaggaacagtacatggtctcgtccgttttcattggtatcatcaattctttatccttcgtcatcaaaagaaggccgcagacaacaataagaattctttccgggctgttgcgtttcaacgtcgacgccaagtttcccctagagggcaagtctgacttgaactacaaactatccaagagatttgttgaaagggcgtacaagaactttgtgcaatttgggctaaaaaatcaaatcattacaaaatccctctcatccggatcagggtcatcgatctactccaagctgaccaagatttctcaaactttacacgttattggcgaagagaccaagagcaagggaattttgaacttcgacccttccaagggcaatagcaagaaaacgttgtccaggcaggacaaactaaaatacatctcactatggaaaaggcaattatccgcgttattgtctactctaggggtgtccacaaagacccccacgcctgtgtccgcacctgcaacgggctcttcaaccgaaaacatgcttgatcaactgaagatattgcaaaaatacaccctcaacaaggcttcacaccagggcaatacttttttcaacaactcacccaaaccaatcagcaacacctactcatctgtgtactcattgatgaacagttcgaactccaaccaggatgtgacccagctacccaatgacatacttatcaagctgtccacagaggccatcttgcaaatggacagcacgaaactgatcaccggattgtctatcgttgcttcgaggtacacggatttaatgaatacgtacatcaattctgtaccgtcctcgtcatcatcaaagaggaaatccgacgatgatgacgacggcaacgacaatgaagaagttggaaacgatggcccaacggctaatagcaagaaaatcaaaatggaaacagaaccactagcggaggaaccagaggagcccgaagacgatgaccgaatgcagaagatgcttcaagaagaggaaagcgcccaagaaatctcaggagatgccaacaaatcaacttctgccattaaggagatcgcacccccctttgaacctgactcattgacgcaggatgaaaaactaaagtacctctcaaagctgaccaagaaactgtttgaattatccggtcgccaggatactacccgggccaaatcttcgtcttcctcctccatattactggacgatgacgactcctcgtcatggttacacgtcttaatcagattggttacgagaggaatcgaagcacaagaggccagtgacctgattcgtgaagaactgcttggcttcttcatccaggatttcgagcaacgtgtcagtctgatcattgaatggctcaatgaagaatggttcttccaaacctcgctgcatcaagatccctctaactacaaaaaatggtccttaagagttctcgagtctctgggtccattccttgaaaacaaacacagacgattcttcatcagacttatgagcgaactgcccagtcttcaaagcgatcatcttgaggcactgaagcctatctgcctggatccggcaagaagttcccttggtttccaaacgctaaagtttctcattatgtttagacccccagtgcaggacactgttcgcgacctgctgcatcagctaaagcaagaagatgaaggcttacacaagcagtgcgattcactgcttgacaggctaaaatga

SEQ ID NO: 25058 - DNA, 1248 bp, Saccharomyces cerevisiae
atgaaaaggtccacgttgctgtcgctggacgcattcgctaagaccgaagaggacgtacgagtccgcaccagggccggcgggctgatcactttatcgtgcatcttgaccacgttatttctgctggtgaacgagtggggacagttcaattctgtggtaacaaggccacaattggtggtggaccgtgaccgacacgcaaagctggagcttaatatggatgtgacatttccatcgatgccatgtgacctggtgaatctcgatattatggacgactctggagagatgcaactagacattcttgacgcagggttcacgatgtctaggttgaatagcgagggtcgccccgtgggagatgctactgagttgcatgtgggtgggaacggcgacggaaccgcgccggttaataacgatcctaactattgtgggccatgttacggtgccaaagatcagtcgcagaatgagaatctagcacaggaagagaaggtttgctgccaagactgtgatgcagtgagatcagcatacttggaggcaggctgggcttttttcgacgggaagaatatcgagcagtgtgaaagagagggctatgtcagcaagattaacgagcacttgaatgaaggctgcaggatcaaaggttctgcacaaattaacagaattcaggggaatcttcactttgcccctggaaaaccctaccagaatgcatatggacattttcatgatacttctttgtacgacaagacttcgaatttgaacttcaaccacatcatcaatcatttgagctttgggaagccgatccagtcccacagtaagttgttaggaaacgataagcgccacggcggcgccgtagttgccacttctcccttggacggacgccaggtgttcccggacaggaacacacactttcaccagttctcgtattttgccaagattgtccccaccagatatgagtacttggataatgttgtcattgagaccgcgcagttcagcgccacttttcattcccgacctcttgccggtggaagggacaaggatcatccaaacacacttcacgttaggggtggtatccctggtatgttcgtctttttcgaaatgtctccattgaaagtcatcaataaggaacagcacgggcagacttggtcgggcttcatcttgaattgtatcaccagcattggtggtgtcctagctgtgggcactgtcatggacaagctattctacaaagcacagagatcgatctggggcaagaagagccagtag

SEQ ID NO: 25059 - DNA, 2565 bp, Saccharomyces cerevisiae
atggcgatccaaacccgttttgcctcgggcacatctttatccgatttgaaaccaaaaccaagtgcaacttccatctccatacccatgcaaaatgtcatgaacaagcctgtcacggaacaggactcactgttccatatatgcgcaaacatccggaaaagactggaggtgttacctcaactcaaaccttttttacaattggcctaccaatcgagcgaggttttgagtgaaaggcaatctcttttgctatcccaaaagcagcatcaggaactgctcaagtccaatggcgctaaccgggacagtagcgacttggcaccaactttaaggtctagctctatctccacagctaccagtctcatgtcgatggaaggtatatcatacacgaattcgaatccctcggccaccccaaatatggaggacactttactgacttttagtatgggtattttgcccattaccatggattgcgaccctgtgacacaactatcacagctgtttcaacaaggtgcgcccctctgtatacttttcaactctgtgaagccgcaatttaaattaccggtaatagcatctgacgatttgaaagtctgtaaaaaatccatttatgactttatattgggctgcaagaaacactttgcatttaacgatgaggagcttttcactatatccgacgtttttgccaactctacttcccagctggtcaaagtgctagaagtagtagaaacgctaatgaattccagccctactattttcccctctaagagtaagacacagcaaatcatgaacgcagaaaaccaacaccgacatcagcctcagcagtcttcgaagaagcataacgagtatgttaaaattatcaaggaattcgttgcaacggaaagaaaatatgttcacgatttggaaattttggataaatatagacagcagttattagacagcaatctaataacgtctgaagagttgtacatgttgttccctaatttgggtgatgctatagattttcaaagaagatttctaatatccttggaaataaatgctttagtagaaccttccaagcaaagaatcggggctcttttcatgcattccaaacatttttttaagttgtatgagccttggtctattggccaaaatgcagccatcgaatttctctcttcaactttgcacaagatgagggttgatgaatcgcagcggttcataattaacaataaactggaattgcaatccttcctttataaacccgtgcaaaggctttgtagatatcccctgttggtcaaagaattgcttgctgaatcgagtgacgataataatacgaaagaacttgaagctgctttagatatttctaaaaatattgcgagaagtatcaacgaaaatcaaagaagaacagaaaatcatcaagtggtgaagaaactttatggtagagtggtcaactggaagggttatagaatttccaagttcggtgagttattatatttcgataaagtgttcatttcaacaacaaatagctcctcggaacctgaaagagaatttgaggtttatctttttgaaaaaatcatcatccttttttcagaggtagtgactaagaaatctgcatcatcactaatccttaagaagaaatcctcaacctcagcatcaatctccgcctcgaacataacggacaacaatggcagccctcaccacagttaccataagaggcatagcaatagtagtagcagtaataatatccatttatcttcgtcttcagcagcggcgataatacattccagtaccaatagtagtgacaacaattccaacaattcatcatcatcctcattattcaagctgtccgctaacgaacctaagctggatctaagaggtcgaattatgataatgaatctgaatcaaatcataccgcaaaacaaccggtcattaaatataacatgggaatccataaaagagcaaggtaatttccttttgaaattcaaaaatgaggaaacaagagataattggtcatcgtgtttacaacagttgattcatgatctgaaaaatgagcagtttaaggcaagacatcactcttcaacatcgacgacttcatcgacagccaaatcatcttcaatgatgtcacccaccacaactatgaatacaccgaatcatcacaacagccgccagacacacgatagtatggcttctttctcaagttctcatatgaaaagggtttcggatgtcctgcctaaacggaggaccacttcatcaagtttcgaaagtgaaattaaatccatttcagaaaatttcaagaactctattccagaatcttccatactcttcaggatatcatataataacaactctaataatacctctagtagcgagatcttcacacttttggtagaaaaagtttggaattttgacgacttgataatggcgatcaattctaaaatttcgaatacacataataacaacatttcaccaatcaccaagatcaaatatcaggacgaagatggggattttgttgtgttaggtagcgatgaagattggaatgttgctaaagaaatgttggcggaaaacaatgagaaattcttgaacattcgtctgtattga

SEQ ID NO: 25060 - DNA, 1743 bp, Saccharomyces cerevisiae
atggccatattgaaggataccataattagatacgctaatgcaaggtatgctaccgctagtggcacttccaccgccactgccgcctctgtcagcgctgcctcatgtcctaatttgcccttgctcttgcaaaagaggcgggccattgctagtgcaaagtctaaaaaccctaatctcgttaaaagagaattgcaagcacatcactcagcgatcagcgaatacaataatgatcaattggaccactatttccgtctttcccacacagaaaggccgctgtacaacctgactaacttcaactctcagccacaagttaatccgaagatgcgtttcttgatctttgacttcatcatgtactgtcacacaagactcaatctatcgacctcgactttgttccttactttcactatcttggacaagtattcctcgcggttcattatcaagagttacaactaccagctcttgtccttgaccgcgctttggatttcgtccaaattttgggactccaagaatagaatggccactttgaaagtcttgcaaaacttgtgttgcaatcaatattctataaagcaattcacgactatggaaatgcatcttttcaaatcactcgattggtccatctgtcagtcggcaacattcgactcctacatcgacatcttcttgttccaatctacgtccccgttatcgcctggcgttgtcctttctgcccctttggaagctttcattcaacagaaactggccttattaaataacgctgctggtactgctattaataaatcgtcctcttctcaaggcccctctttgaacatcaacgagatcaaattgggtgccattatgttgtgcgagttagcttccttcaatctcgaattatcatttaaatatgatcgttcactaattgcgctgggtgcaattaacctcatcaaattatctttgaactactataattcaaacctttgggaaaatatcaatctggctttggaggaaaactgccaagacctagatattaaattgtcagaaatctctaatactttattggatatagcaatggaccaaaattctttcccctccagtttcaaatcaaaatatttgaatagcaataagacatctttagcaaaatctctcttagacgcattacaaaactattgtattcaattgaaactggaagaattctaccgttcacaagaattggaaaccatgtacaatactatctttgctcagtcctttgacagcgattcattgacttgtgtttactcaaatgctactactccaaagagcgctacggtttcatctgcggccacagactatttctcggatcacactcatttaagaaggttgaccaaagatagcatttctccaccatttgccttcactccaacctcatcttcatcctctccatctccattcaattccccttacaagacttcaagttcaatgacgaccccagactctgcatcacaccattcacattcaggttcgttctcttctacccaaaattcttttaaaaggtcactgagcatcccacaaaattcaagcatcttttggccaagcccactaactcccaccaccccatctctaatgtcaaatagaaaattattacaaaatttatctgtgcgttcaaaaagattatttcctgttagacccatggccactgctcacccatgctctgcccccacccaactgaaaaagagatcaacttcctctgtggattgtgattttaatgatagtagcaacctcaagaaaactcgctga

SEQ ID NO: 25061 - DNA, 810 bp, Saccharomyces cerevisiae
atgggttggttttgggcagatcaaaaaactacgggcaaagatattggtggggcagcagtatcatccatgtcagggtgcccagtcatgcacgagtcgtcgtcgtcgtcgccaccatcctctgagtgccccgttatgcagggagataacgatagaataaacccgctgaacaatatgccggagttggcagcatccaaacagcctggccaaaagatggacttgcccgttgatcggaccatctccagcatccccaagagtccagacagtaacgagttctgggagtatccttctccacaacagatgtacaatgctatggttagaaagggcaagattggcggtagcggcgaagtcgccgaagatgcagtggagtccatggtgcaggtccacaactttctaaatgaagggtgctggcaggaagtgctcgaatgggaaaaaccgcacacagatgaaagccacgtgcagcctaagttgctgaaattcatggggaaaccgggcgtattgagccctcgtgctcgctggatgcacctgtgcggcctactgtttccgtcccattttagccaagaactaccattcgacaggcacgactggattgtactccgaggcgagcgcaaagcggaacaacaacctccaaccttcaaggaagttagatacgtcttggatttctacggagggcccgacgacgaaaacggaatgcctactttccacgtggatgtccgtcctgccctagatagtctagacaatgctaaggaccggatgacccgtttcttggaccggatgatctcgggtccgtcctcttcgtcctccgccccttaa

SEQ ID NO: 25062 - DNA, 1503 bp, Saccharomyces cerevisiae
atgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaa

SEQ ID NO: 25063 - DNA, 804 bp, Saccharomyces cerevisiae
atggatatggaaatcgaagattcaagccccatagatgacctgaagttacaaaaactggataccaatgtttattttggaccctgtgagatattgacacaacctattcttttgcaatatgaaaatattaagttcatcattggtgtcaatctaagtactgaaaagatagcgtcgttttatacccagtatttcaggaactctaattcggtagtcgtgaatctttgctcaccaactacagcagcagtagcaacaaagaaggccgcaattgatttgtatatacgaaacaatacaatactactacagaaattcgttggacagtacttgcagatgggcaaaaagataaaaacatctttaacacaggcacaaaccgatacaatccaatcactgccccagttttgtaattcgaatgtcctcagtggtgagcccttggtacagtaccaggcattcaacgatctgttggcactctttaagtcatttagtcattttggaaatatcttggttatatcatcacattcctatgattgcgcacttctcaaatttcttatttccagggtgatgacctactatccactagtgaccatccaggattctttgcaatatatgaaagcaaccctgaacatatccatcagtacatccgatgagttcgatattctgaatgataaagaactgtgggagtttggccaaacccaggaaattctaaaacgtaggcagacgagctcagtcaagaggagatgtgtcaatttaccagaaaactctacgatcgataacagaatgcttatgggtaccacaaagcgaggtcgcttttga

SEQ ID NO: 25064 - DNA, 1110 bp, Saccharomyces cerevisiae
atgtctactacagttgaaaaaatcaaagctatcgaagatgaaatggcccgtacccaaaagaacaaggccacatctttccatttgggtcaactgaaggccaagctggccaaactgagaagagaattgttgaccagtgcttcatccggcagcggtggtggtgctggtattggttttgatgtggctagaactggtgtggccagtgtggggtttgtcgggttcccgtcggtggggaaatctacattactgtccaagttgactggtactgagtctgaagcagctgagtacgagtttaccaccctggttaccgtccccggtgtcattcgttataaaggtgccaagatccaaatgttggatttacctggtattatcgatggtgctaaggatggtagaggtagaggtaagcaagttattgccgtggcaagaacctgtaacctgttatttatcatcctagatgtgaacaaacccttgcatcataagcaaatcattgagaaggaactggaaggtgtggggattcgtctgaataaaactccgccagatatcttgatcaaaaaaaaagagaaaggtggtatttccatcacaaacacagtcccattgacccatctggggaatgacgaaatcagagccgttatgagcgagtacagaataaatagcgctgagattgccttcaggtgtgatgccactgtggatgatttgattgatgttttggaagcttcgtcaagaagatacatgcctgccatctatgtgttaaacaagattgattctctgtcaatagaggaattggaattactttaccgaattcctaatgccgtgcctatttcgtctggtcaagattggaacttggacgagctgttgcaagtcatgtgggatagactaaatctagtccgtatttacactaaaccaaagggccaaataccagattttaccgaccctgtggtgctaagatcagaccgttgcagtgtcaaggatttttgtaaccaaattcataaatctttagtggacgactttagaaatgctctggtttacggtagcagtgtcaaacatcaacctcaatacgtggggttgagtcacattttggaagacgaagatgttgttaccatcttgaaaaagtga

SEQ ID NO: 25065 - DNA, 3009 bp, Saccharomyces cerevisiae
atggcgaaaaagagtaaaaagaaccaacagaactactgggatgaggaattcgaagaagacgccgcccagaacgaagaaatcagtgccacgccaactccaaatccagaaagcagcgcaggtgcagatgacacttccagagaagcaagtgcaagtgctgaaggtgctgaggccattgaaggcgacttcatgtctactttgaagcaatcgaagaagaagcaagaaaagaaggttattgaagagaagaaggatggtaagcctatactaaagtccaagaaggaaaaggagaaggaaaaaaaggaaaaggagaagcagaagaagaaagaacaagctgccaggaagaaggcccaacagcaagctcaaaaggagaagaacaaggagttgaacaagcaaaatgttgaaaaagctgctgctgagaaggctgctgctgagaaatcccaaaaatctaaaggtgaaagtgataaaccaagtgctagtgctaagaagccagccaagaaagtacctgccggtttggctgctttgagacgtcaattagaattgaagaaacaacttgaagaacaagaaaagttggaaagagaggaagaagaaagattggagaaagaagaggaggaaagattggccaacgaagaaaaaatgaaggaagaagctaaagcagctaaaaaggaaaaggagaaggcaaagcgtgaaaaacgaaaggctgaaggtaagctattgaccagaaagcaaaaagaagaaaagaaattattggaaagaagacgtgccgctttattgtcttccggtaacgtcaaagttgccggtctggccaagaaggatggagaagaaaacaaaccaaagaaggttgtttacagcaagaagaagaagagaacaacccaggaaaacgcctccgaagccattaaatctgactctaagaaagactcggaagttgtacctgatgacgaactcaaagaatccgaagatgttttgattgatgattgggaaaatttggctcttggtgatgatgacgaggagggaaccaacgaagaaacgcaagaatccaccgcaagccatgaaaatgaagaccaaaatcaaggcgaagaagaagaagaaggagaagaagaagaagaagaagaagaagaaagagcacatgtgcatgaagttgccaaaagcacaccagcagctacaccagcagctactccaactccatccagcgcttctccaaacaaaaaagatcttcgttccccaatttgttgtattttgggtcatgtcgataccggtaagactaaattgttagacaaaatcagacaaaccaacgttcaaggtggtgaagctggtggcatcacccaacagattggtgccacttatttccccatcgacgctattaaggcaaaaactaaagttatggctgaatatgaaaaacaaacttttgatgtcccaggtcttttggttattgataccccaggtcacgaatccttctctaacttacgttcaagaggttcttcattgtgtaacatcgcaattttggttattgacattatgcatggtttggaacaacagactattgaatctatcaaactgttaagagatagaaaggctccatttgtcgttgccctaaacaaaattgatagattatatgactggaaagccattccaaacaattcattcagagactcctttgcaaagcaatcaagagctgttcaagaggaatttcaatctaggtattctaagattcaattggaattagctgaacaaggtttgaattcggaattgtatttccaaaacaaaaatatgtctaagtatgtctccattgtcccaacatctgccgtcaccggtgagggtgttccagatttattgtggttgctattagaattgacccaaaagaggatgtccaaacaattgatgtacttgtctcacgtggaagcaaccattttggaagtgaaagtcgtagaaggttttggtaccacaattgatgttatcttgtccaacggttacttgagagaaggtgaccgtattgtactgtgtggtatgaatggtccaattgtaacgaatatcagagcattactaacaccacaaccattacgtgaactacgtttgaaatctgaatatgtccaccacaaagaagtcaaggctgctttaggtgtcaagattgccgctaatgatttagaaaaagccgtttctggttctaggctgctagttgtcggtcctgaagatgacgaagatgaattgatggacgacgttatggatgatttgactggtttgttggactccgttgacacaactggtaaaggtgttgtggtccaagcatccaccttgggttctttggaagctttgttggatttcttgaaagacatgaaaatccctgtgatgtctatcgggttaggtccagtgtacaagcgtgatgttatgaaagcctccactatgttggaaaaggctccagagtatgccgtgatgttatgttttgatgttaaagtggataaggaagctgaacaatacgctgaacaagaaggaattaagatctttaatgcagacgtcatctatcatttatttgattcatttacagcataccaagaaaagttattggaagaacgtcgtaaagatttcctagattacgctattttcccatgtgtcttacaaaccttacaaattattaacaaacgtggtccaatgattattggtgtagacgttctggaaggtactctacgtgtgggaactcctatttgcgctgtgaaaaccgaccctactacaaaggaaagacaaactttgatattaggtaaagtcatctctttagaaatcaaccatcaacctgtccaagaagtaaagaagggccaaaccgctgctggtgttgccgtccgtctagaagatccctccggtcaacaacctatctggggtcgtcatgttgacgagaatgatacattatactccttggtttcaagaagatctattgacactttgaaggataaagcttttagggaccaagttgctagatccgattggctgctattgaagaagctgaaggtcgttttcggcatcgaatga

SEQ ID NO: 25066 - DNA, 870 bp, Saccharomyces cerevisiae
atgtctgctcccactatgagatccacctcaatattgacagagcatttgggatatccgcccatctcgcttgttgatgatatcattaatgctgtaaatgaaattatgtacaagtgcactgctgccatggaaaaatatctgctatccaagagcaaaatcggcgaggaagattatggagaagagatcaaaagtggagttgctaagttggaatcacttttggaaaactccgtggataagaattttgacaaactagaactatatgttttgaggaacgtccttcgaatccctgaagagtatttggacgccaatgtttttagattggagaaccaaaaggatctggtcattgtagatgagaatgagttgaagaaaagtgaggagaaacttcgagagaaagtgaacgacgtggagttagcgttcaaaaagaatgaaatgctattgaaaagagttacaaaagtgaaaagactgttgtttacgataagaggattcaaacaaaagctaaacgagttactgaaatgcaaagacgatgtacaattgcagaaaattttggagtcgttaaaacctatagatgacacaatgactctactgactgattcattacgtaaactatatgttgatagtgaaagtaccagttcaacagaggaggtagaggcactactgcagagattgaagaccaacgggaagcaaaataataaggatttcagaacacgatatatcgatataaggacgaataatgtcctacgaaaattggggctactaggtgataaagaggacgaaaaacagtctgccaagccggatgcgaggacgcaagcaggggatatagttagtatagatattgaagagcctcaattggatttacttgatgatgtgttataa

SEQ ID NO: 25067 - DNA, 1392 bp, Saccharomyces cerevisiae
atgaggtgcaggggtctatcaagaacccccttcttcctaagagaaccgcttataaaagtagccacatggttcataacatccccgttatggctcatacactgggcatcgataaacaggatattcgcgcatcgtaacatttataggggaaacatgggattatattctcctgaatctgaaaagtctcaattaaatatgaattacattggtaaggatgattcgcagtccattttcagacgtctgaatcagaatttgaaagcaagtaacaacaataacgatagtaataaaaacggtttaaacatgagtgattatagcaataattcaccctatgggcgctcgtacgacgtaagaattaaccagaactcacaaaataatggcaatggatgcttttctggcagcattgactccttggttgatgaacatataataccatcgccacctttgtcgcccaagctggagtcgaaaattagccacaatggctcaccccgcatggcctcttcagtgctagtgggatctacgcctaaaggcgctgtagagaatgtgctgttcgtgaagcctgtatggcccaatgggttatcaagaaaaaggtaccgctacgccacctacgggtttctgtctcaatacaaaattttcagcaatttggcccaaccatattctaagaacattatcaaccggtacaacaatctggcctataatgctagacataaatattccaaatacaatgatgatatgactcctcctcctctgccttcctcttcttctagattaccttccccgttagcatctccgaatttgaatagacaagcaagatataatatgaggaaacaggctctctacaataacaatctaggaaagtttgaatccgacactgaatggataccacggaaacgcaaggtatactcaccacaaagaagaacgatgactaccagtccacatcgcgccaagaagttctcaccctctgcatccactcctcacactaacattgcatccattgaggcgattcatgatgctcctcaatatataccaaacgtctcatggaaaaaattaccagattactctccgcccttatctacgcttcctacagacagtaacaagtcactcaagatcgagtggaaggggtctccaatggacctgtccacagacccgctgaggaacgagctacaccctgctgaactagttctcgctcaaactctaaggttaccttgtgatttgtatctggattctaagagaaggttatttttggaaaaagtttatagactaaagaaagggttgccgtttagaaggaccgacgcccaaaaagcctgtaggatcgacgttaataaagcatcaagactattccaagctttcgagaaggttggctggctacaggattcgaattttacgaagtacttataa

SEQ ID NO: 25068 - DNA, 522 bp, Saccharomyces cerevisiae
atggtacgtttaaaaagtagatatatcctttttgaaattatattcccacctacagacaccaacgttgaggaatctgtgtcgaaagcagacatcttgctttcgcatcacagagcatcgcctgcggatgtgtccataaagtcgatactccaagagatacgacgctcgctgtcgttgaatctgggcgactatgggtctgcaaaatgtaactctctcttgcagttgaaatacttttcaaataagacgtctacggggataatccgatgccatcgagaggattgcgaccttgttatcatggcattgatgttgatgtcgaaaattggcgacgtcgatggactgatcgtgaaccccgtcaaggtaagtgggaccatcaagaaaatagagcagtttgctatgagaaggaattctaaaattctgaacataatcaagtgtagtcaatcatcacacctcagcgataatgactttattatcaatgatttcaagaaaattggaagggaaaacgaaaacgaaaacgaggacgattag

SEQ ID NO: 25069 - DNA, 1140 bp, Saccharomyces cerevisiae
atgtttagtaacagactaccacctccaaaacattctcaaggacgagtttcgacggctttgagctcagatcgcgttgagccggcaatattgactgaccaaatcgctaaaaacgttaagctcgatgattttattccaaagagacagtctaatttcgaactatcggttcctttgccaacgaaagcagaaatccaagaatgtacagcaagaaccaagtcatacattcagcggcttgtgaatgcgaaactagccaactcaaataacagggcatcatcaaggtacgtcaccgaaacacatcaggcacccgcgaatctattattgaacaacagccaccatattgaggtagtgtccaagcaaatggatccattgttgccaaggttcgttgggaagaaggcgagaaaggttgtagcacccacagaaaacgacgaagtcgtgcctgttctccatatggatggcagcaatgataggggagaagctgatccaaatgagtggaagatacctgcagctgtgtcaaactggaaaaatccaaatggttataccgtggccttggaaagacgtgtaggtaaagctcttgacaacgaaaataataccatcaacgatgggtttatgaagctctccgaagcgttagaaaacgctgacaagaaggcaagacaagagatcaggtccaaaatggaattgaagcggcttgctatggaacaggaaatgcttgctaaagaatctaaattgaaagaattgagccaacgagccagataccacaacgggactccgcagacgggagcaatagttaagcccaaaaagcaaacgagcacagtggccagactaaaagagctggcgtactctcaaggaagagacgtatccgaaaagataattctgggcgcagcaaagcgttcagaacaaccggatctgcagtacgattcaagatttttcacaagaggggcaaatgcctccgccaaaaggcatgaagaccaggtttatgacaacccactgttcgtccaacaagatattgaaagcatatacaagaccaactacgaaaagctggacgaagcggtcaatgttaagagtgaaggtgccagtggttctcacggccccattcagtttactaaagctgaatccgatgataaatcggataactatggcgcctag

SEQ ID NO: 25070 - DNA, 2283 bp, Saccharomyces cerevisiae
atggtagatgtgcaaaagagaaaaaagttgctagccaaagctgctgccagcgcttctattccggcaatcaaaggttctgttccgttggactcgtatgatataaaaatcattcaatataagaacgctctttacaagctgaatgaactgaataggctactaaacgttctggtaccgcatttgaagaagaaaagagacaatgacgagtcctacaaaattattcccctcgttaatttcatcttatcactttgtgagggtcctatatttaatgtaagccccgtattggctaagaggtaccatttgctctgtcgattccagctgataaagctaagcgaagtgcagcagagattatcaactaattttattgatgtagagggctggatgtttcccgaggaggtacccctagatcactataaatcgtgcatatacaataattctctacaatggaagattttaaattcgctgtcttgcattgctcaaaatgctataaaaatttataatgccaagttgagacagattttattggaaagggatgcgtacaaagctcggtcacttccatttgacacttcaataattgaagacttgttaaatccagttgaaatgacattgattctagatttagccgttttgattaatgatccagtaagggataagtccacccattccttttacaaattgcaatggcaagtgatggagaaactgaactcctgtgttcattcgaaaatcttccccattctaaggacatattacaaccaattgcagaaattttcggaaacaagacctacttcactgtcaaatttacagaaggatctaccacattgggaatggactctacacaggatatacactttccacttgcgggttttttctgtcttgtgtgttattatcagtttctctaggcaaattttcctaccgaataaacaacatttcttggacatcaagacaagattatccagcgaaaacgtgtaccattacgatttgataatttgtgagctgatggctttgctctctccagaatgtgatgatgtcacagctttattcgaactgcaggagaatttaaaattttggactcaaacggcgcgtaccgataacaattcctcaagaactcccattttccaccttcaacctggtttagttgtggaattgtttaataatcatatctgcaagattataccgaaattgaggtccattatgggattattatccaattggatggattgctggaaatatattgagaaaaattataaaaccttcgatgaaaccaatgacttgcgggagaatttgaaagaaaagctagaaagagataaggctctgtatttagaggttaaaaacgcgaaaagtaagctaaagaagaagccgtcaataacaaagctgccagcctcttcttctccatccccctcacccacatcttcagcaagcccatcaagacaggcctctttagagagcataagaacaagggcaagggcgcatttagcctcaaattcttctaggtctccctcagtatcgcctgtaaggaccactttcaacaataaaaacgcagaaacgaagaaaagcgtggtgtctccggagaaaagaaaactgatcaacggcagaaggcctagatcctcatctttgcaatcctatacaaacaaacaacaaacctcatatttgaattctacaagacatccgtcaatagctccaccttcaaagctcaacaatcaaaggtccaattctttgcagtcctcaaccatgacgttaaatcaaaaaatcgtccaagatacagtgcggcatttgatgaacaaaagtgcatctacacccaatccttctgcatcttcatcgttagcgccttcaccaaaagtatccagtataaacaacacctcctcaggaaaatcatcaagtaccctgattgccaatagtagtgatactttggctatagagacattaactctagatccggagtcaaactccagtgaattgtccatcaaaagggtgagatttgctggtgtaccgccaatgacagaggcagaaaatcctaaaccaacaaaggtgggttggtacaagaagccggctgtgctacattatccgccaatacctgcttcggcaatgatcaagccgctacagcataagtccaaatataacacgctgagacaagaagaagggtttacctttcgaaaaagtcttcgagatggattagagtgggaaaatggcgaatctggctccgaaactaccatgatgccgtttgggatcgaaatcaaagagtcgaccgggcatagaatagcttctaaaatcagaagcaaattgagataa

SEQ ID NO: 25071 - DNA, 467 bp, Saccharomyces cerevisiae
atgtcgtcatctactccctttgacccttatgctctatccgagcacgatgaagaacgaccccagaatgtacagtctaagtcaaggactgcggaactacaagctgtaagtacagaaagccacagagtaccatctaggaaattaacattatactaactttctacatcgttgatacttatgcgtatacattcatatacgttcttcgtgtttatttttaggaaattgatgataccgtgggaataatgagagataacataaataaagtagcagaaagaggtgaaagattaacgtccattgaagataaagccgataacctagcggtctcagcccaaggctttaagaggggtgccaatagggtcagaaaagccatgtggtacaaggatctaaaaatgaagatgtgtctggctttagtaatcatcatattgcttgttgtaatcatcgtccccattgctgttcactttagtcgatag

SEQ ID NO: 25072 - DNA, 4416 bp, Saccharomyces cerevisiae
atgtcatttgaagtaggaactaagtgttggtaccctcacaaagaacaaggctggataggcggcgaagtcaccaagaatgacttctttgaaggaacgttccacttagagttgaaattggaggatggagaaactgtatccattgaaacaaatagcttcgaaaatgatgatgatcatcccacgctacctgtactacgaaacccacctattttagagtctactgatgacttaaccaccctatcatatctgaacgaaccggcagtgctgcatgccataaaaaaaagatacatgaatggacagatatatacttactctggtattgtccttattgccgctaatccctttgataaagtcgaccatttgtactctcgcgagatgatacagaattattctagtaagcgtaaagatgagctggagccgcacctttttgccatagcagaggaggcgtacaggttcatggtccatgaaaaggctaaccagactgttgtagtcagtggtgaatccggtgctggtaagaccgtctctgctaaatacattatgagatactttgcctcagtccaagaaagcaacaatcgtgaaggggaagtggaaatgtctcaaatcgagagccaaattttagctactaacccgatcatggaagcctttggtaacgccaaaactaccagaaatgataattcctctcgtttcggcaaatatctgcaaattttatttgatgagaatactaccatcagggggtccaaaattagaacctatctcttggaaaaatccaggttagtttatcagccagagacagaaagaaattaccatattttttaccaaattttggaaggattgccagaaccggtaaaacaagaactgcatttgtcatctcccaaggactaccattatactaaccaaggtggacagccgaacatagctggtatagatgaagctcgagaatacaagataaccactgatgccctgtcattagtaggtataaaccacgagactcagcttggaattttcaaaattcttgcaggcttgctacatataggtaatatcgagatgaaaatgactagaaacgacgcatcactatcatcggaagagcaaaacctgcaaatcgcatgtgaattattgggtattgatcccttcaattttgcaaaatggattgtcaagaaacaaatcgtcacaaggtctgaaaaaattgtcactaatttgaattacaatcaagcgctaattgctagggactctgtggcgaaatttatttattccacgctttttgattggctagtagacaacattaacaagacattatacgatcctgagctggatcaacaagatcatgtcttttcctttattggtattttagatatctacgggtttgagcattttgagaaaaactcattcgaacaattctgtataaactatgcgaatgaaaaattacaacaagagttcaaccagcacgttttcaaattggagcaagaagaatatgtaaaggaggaaattgagtggtctttcattgagttcagcgacaaccaaccttgcatagacttgattgagaataaacttggaatactttctctattagatgaagaaagtagattaccatcaggctcagatgaatcatgggcctcaaaactatattctgcctttaataaaccgccctcaaatgaagttttttcgaagccaagattcggacaaacgaagtttatagtaagccattatgctgttgatgtagaatatgaagttgaagggtttattgaaaagaatagagacagcgtttccctaggtcatctggatgttttcaaagcaacgacaaatccaattttcaaacaaattttagacaacagagaacttaggagtgacgatgctcctgaagagcaaaatactgaaaaaaagataatgatcccagcaagattaagtcaaaagaaaccaaccctgggatctatgttcaaaaaatcgctcggggaattgatggccatcataaattctactaatgttcattatattcgttgcataaaaccaaattctgaaaaaaagccatgggagttcgataatttgatggtcttatcgcaattaagagcttgtggtgtgctggaaacaatcaggatttcatgtgcaggctttccatcaagatggacttttgacgaattcgttcaaagatatttcctcctgacggactacagcttatggagtggaattctttataatccagacctcccaaaagaggcaatcgtcaacttctgtcaatctattctagatgctactatctctgattcagcaaaataccaaattggtaataccaaaattttctttaaagcaggaatgcttgcatttttggaaaagctaaggactaataaaatgaatgaaatatgcatcataatacagaaaaagataagggcaagatactataggcttcagtatttgcagaccatggaatcaataaagaagtgccaaagccaaattagaagtttgttggttcgtacaagggtcgatcatgagctcaagacaagagctgccatattactacaaacgaacattagagcattatggaaacgggaatactatagagctgccattgggcaaataataaaactacaatgtacctgtaaaagaaaattgattttagatagtgttaacaggaaattcatgctcatggcggcagtaattatccaaagctacatcagatcatatggtcacaaaacagattacagaacattgaaaaggagctccattcttgtacaaagcgccatgagaatgcagttagctagacgaaggtatatagttctgcaaaaagaagttgaagaacggaatattagggctagttacgggattggattactggaggaagctatcgaatttaagaactctttcattttgaatctagagatgttaaatgactcatatacaagattaacacagttgttgcagggagatttgtcaaatattccatctaagcaaaggcaagagtacgaaacgatagtaaatggttataatgataagatttccaagctgaagacgttacaagttgaaatcatgaatactttaaacaagaagaatgccttgaaggagagaaaaaagaagcaatcttctttaatacagtcacatatgcaaagtttggctgctataaaaggtaacaaaccttcaagattaagtgatgaagtcaaatcaatgaagcaagaactagcgtttattgaaaacgtaatagcacaagatttcaccaccacatattctgctaataagaatgataaagtgaaaggtttgggaatcgcaggacaacaagtaaaaccgaagctagtcaatgtaattcgtagagaatcaggaaatcctgatcttctagaattactaatggacctgaattgttacacattagaagtcacagaaggttacttgaaaaaagtaaatgttactgaggtgaatggagacaatgttctgggtcctatacacgtcattactacagtggtaagtagcttagtgagaaatgggttattgattcaaagtagcaaattcatctcgaaagtcctattgactgtagaaagcattgttatgagtctaccaaaggacgaaacaatgcttggtggtatcttttggttaagtaatctttccagacttcccgcatttgctgcaaatcaaaaaacattatatgaagcgaatggtggtgatgaaaaagataagttaacactgatatatttgaatgatttggagaatgaaactttaaaagtattcgacaagatttattccacttggttagtgaaattcatgaagcatgcttcagcccacatcgagatcttcgatatggttttaaacgagaagctatttaaaaattctggtgatgagaagttcgctaaattattcacattcttaaatgaatttgatgctgtcttgtgtaaatttcaagttgttgactcaatgcatacaaaaatttttaacgacaccctgaagtatctgaacgtaatgctatttaatgacctaataaccaaatgtcccgcgttaaattggaagtatgggtacgaagtggatagaaatatcgagcggttggtgagctggtttgaaccaagaattgaagacgttcgtcccaatttgattcaaataattcaggctgtcaagatattacagttgaagataagcaacttgaacgagttcaagttactattcgatttctggtatgccttgaatccagcccaaatacaagcaattctgttgaaatacaagcctgctaacaagggcgaagctggagtaccgaacgaaatcttgaattatttagctaacgtgatcaaaagagaaaatctgtctttgccagggaagatggaaattatgctttctgcccaatttgactctgctaaaaaccatctgcgttatgacactagtgcaataacacagaacagcaatacagagggcttagctactgtcagtaaaattataaaattagacagaaaataa

SEQ ID NO: 25073 - DNA, 1587 bp, Saccharomyces cerevisiae
atgcaaaatgctcaaataaagagctcttctaaaggcagcggaatagatggtacagatcgcaatagcaaagatggtgtagaaaagagacccctggaagatgtaaagcaaatgattgacgctggaacaccagatgttggccacaaatctactgttgaaactaagccaaacgttggatggcaagcctctcacagtaatttggctgcattacacgaaaaagagcagaaatatgaaatggagcaccatcatgctcgtcataaactgcatcgtcaagttattccggattacacgtctgcctcgaccgcaatgttcagcgattgtatgttcaacgcagcaccagataaagtacgaagtctcagtacgatgaagtcttctggactctcgccaaaacacccatttaacgtagtcgccacctttaaaggaccattcccgcagcatagtgtagaatcaaagcctctcgatggtggatactctgccaaagaccattttccctcatttaagatgttgcaagcccagcagcacccagcccatcgccattacaaagacaacgacaagtacggtcttaaatcaccttcccggtccttcgtgaaggacaagaaaaggttggttcaccggtttttgaaatccatggagccttcttcgtctgggcaatctaaggattcgtctgcactggcgccggctttcgatccaatattgcccaatgttatatctaagccttccaagcgacccacacatcattcgcattcatcagacgggagttctagcacgcagacagatatatcgttacagagcttgctttaccatgatcttgaaagctcaccaaagaaacatgtttcgccctcaagaccgccctctgtagcttccgaatcctctcctgccgttgctaatcccattgggctttcgccaaaagacgcctgcaatgcatcgttttcgcagtcgtcctcatcttcgttgtcttcttcttcatcgtcttcatcatcgacgtcattctcacagtcagtggctgttgatcctcttgaacctcctggaaatatcacatatagtagttcgaatctttcgctaaattcagatgaattagactactatcagcgtcatatcggattgcagttacagcagacagaagctttactaaagcacagtttgaaagatgaggttctgaaagatgaaaatgaccttgttaaaaacattgcaaattttgacaagatcgttaaagagctaagggacttaagatccaggaccattggatggaaagagcttgttgaagaggattatttaatgaatttgaaacaggattttgacaaggaaaaccccgaatcatttgaggcacgtttgagtgatacaataaatacaaacgtggcaaaattacaagatttagagaaaagaatggcttcttgcaaagacaggttggcctctaggaaggaagtaatgaggaaaatggaaagtttattgtctttggagaattccttaatgatatccaaaaaaaatgtaacattcgcatctaaataccgcaacgaggcccttgatattgtctttttaattatcatcatcgtcatatgctataccttcaagcatctagtatcgcataaataa

SEQ ID NO: 25074 - DNA, 786 bp, Saccharomyces cerevisiae
atggcaccaagtatagcaacggtaaagatagccagggacatggttttgccattacgtatatttgtcaatagaaagcagatccttcaaaccaatgataagactagcaataagtcgaatgccactatatttgaagcaccattattatcaaataactccataatctgcttaaaatcaccaaatacaagaatatatttatcgcaacaagataagaagaatctttgtgacgagatcaaggaggacctgttattgattgtttacgaactagcgtccccggaaatcatcagttccgtactcagcaaaataagagttggtcattctactgatttccaaatcaacgttctgcccaaactttttgcaggtgccgatacggataatgcggtaacttctcacatccagtctgtgacaaggctggctaaattcaaatacaagttgcactacaaacataagtgggagctcgacatattcatcaacagcattaagaagatcgccaatttaaggcactatttgatgtttcaaacattaacattaaacggtttctcattaaatgcaggacccaaaacgttattagctaggaaaatagaaaaacagccccaggtacctaatttgttaatagaaaatggggacgctgatgccctggatacaccggtggaagaggatataaaacctgtaatagaatttatgtacaagcctgttattaatttaggtgaaattattgatgtacatgtgttgcataggcctagaagacataaggtacgtacccagtcgaagcaaccccaggaggaatga

SEQ ID NO: 25075 - DNA, 4068 bp, Saccharomyces cerevisiae
atgaatgacgacagagaaacccccccaaagaggaaacctggggaggacgacacgcttttcgatattgacttcttagacgacacgacttctcattctggatcccgttcaaaggtcaccaactcacatgcgaacggatattatataccaccaagtcatgtacttcccgaagagactatcgacttagacgctgatgatgataacattgaaaatgatgtccatgaaaatctatttatgagcaataaccatgacgaccaaacgtcttggaatgccaatagattcgactcagatgcatatcaaccacaatccctacgagcagtcaagcctcccggtttatttgctaggtttggtaatggtctcaaaaatgcctttacgttcaaacggaagaaagggcccgaaagtttcgaaatgaatcattacaatgcggtgactaataacgaattagacgataattatctagactcgaggaataagttcaacattaaaattcttttcaaccggtacattttaagaaagaacgttggcgacgcagagggcaatggtgaaccaagagtcatccacatcaacgattctctcgctaattcctccttcggttatagtgacaaccatatatctaccaccaagtataattttgcgacctttctgcctaaatttttgttccaagaattttccaaatacgctaatctgttttttttatgtacatctgccattcaacaggtgcctcacgtctcgccaactaatagatacaccacaattggtactttattagtggttttgattgtttctgccatgaaggaatgtatcgaagatatcaagagagctaattctgataaagaattaaataattcgacagcagaaatattttcagaagcacatgatgactttgttgagaaacgatggattgatattcgtgtaggtgacataattagagtaaaatcagaggaacctattcctgctgataccataattttgtcatcttcggaaccggagggtctttgctacattgaaactgccaacttggatggtgaaacaaatttgaaaatcaaacagtcgagagtagaaactgccaaatttatagacgttaaaactttgaagaacatgaacggaaaagttgtttccgaacagccgaactctagcttgtatacttatgaaggtacaatgactttaaatgatcgtcaaataccgttatctcctgaccaaatgattttaagaggtgcaactttaagaaatactgcatggatatttggtttagttatcttcactggtcatgaaactaagttattgcgtaatgctactgcaaccccaattaaaagaaccgcggttgagaaaattatcaacagacagattattcgattgttcacagttttaatcgtgctaattttaatttcttcaattggtaatgttattatgtctactgcagatgccaaacatttatcgtacctttacctggagggtaccaacaaggctggcttattcttcaaagactttttaacattttggattctattttcgaatctagttcctatttctctatttgtcaccgttgaattaatcaaatattatcaggcttttatgataggttcagatctagatttgtactacgaaaaaactgataccccaactgtggttcgtacatcctctttggttgaagaacttggtcaaatagaatatatattcagtgacaagacaggaactttaacaagaaatattatggaatttaaatcctgctctattgcaggccattgctatattgataaaatacctgaagataaaacggccactgttgaagatgggattgaagttggttatagaaaatttgacgatttgaagaaaaagttaaatgatccctctgatgaggattcacctattatcaatgacttcttaacattactggctacctgtcatactgtcattccagaatttcaaagcgatggatctattaaatatcaagcagcctctccagatgaaggtgccctcgttcaaggtggtgcagatttagggtataagtttatcatccgtaaaggaaactctgtaactgttttattggaggaaactggcgaggaaaaagagtatcaactacttaacatttgtgaatttaattccaccaggaagagaatgagcgctatatttagatttccggatggttcgataaagttattctgtaaaggtgctgatactgtcattctggaaagattggatgatgaagctaatcaatatgtagaagctacaatgagacatttagaagattatgcatctgagggtttgcggacgttgtgtttggcgatgagagatatctctgaaggagaatatgaagaatggaatagcatttataatgaggctgccacaacattagataacagagccgagaagctagacgaagccgcaaatctaatcgagaaaaatctaatattaattggtgcaactgctattgaagataagttacaggacggtgttccagaaactatccacacattacaagaagcgggtattaaaatttgggttttaactggtgacagacaggaaactgctattaacattggtatgagttgccgtttattgagtgaagacatgaatttgttgatcatcaacgaggaaaccagagatgatactgagagaaatttgttagagaagattaacgctctaaacgagcatcaattgtcaacacatgatatgaaatccttagcgctcgtcattgatgggaagtcattaggctttgccttggaaccagaattagaagattatttgctaactgtggcgaagctttgtaaagcggttatatgttgccgtgtatctccactacagaaagccttggttgttaaaatggtaaaaagaaagtcgtcttcactactgctagccattgcgagtggtgccaacgatgttagtatgatacaggcagctcatgttggtgtcggtattagtggtatggaaggtatgcaagcggctcgttcagctgatatagctcttggccaatttaaatttttaaaaaaactattacttgtccatggctcctggtcttatcaaagaatttctgtcgcaattttgtactctttttacaagaatacagcattatacatgacgcagttttggtacgtttttgccaatgccttttcaggtcaatccattatggaatcatggacaatgagtttctacaacttattcttcactgtttggcccccttttgtcattggtgtatttgatcaatttgttagtagtagattacttgagcggtacccacaattgtacaaattaggacagaagggtcaatttttctctgtttacatcttctggggatggattattaatggctttttccattctgcaatagtatttattggcaccatattgatttacagatatgggtttgccttaaatatgcacggcgaactagctgatcattggtcttggggtgtaactgtctacactacaagtgtcattattgttttgggaaaggctgctttggtaactaatcaatggacgaaattcaccttaattgccattcctggttccctcttattttggttaatattcttcccaatttatgcttctatatttcctcatgctaacatctcaagagagtattatggtgtggttaaacacacgtatggatccggtgtattttggttaactttgatcgttttaccaatttttgcactggtaagagattttctatggaagtactataaaagaatgtatgaaccagaaacgtatcatgttattcaagaaatgcagaaatacaatatcagcgactctaggccgcacgttcagcaatttcaaaatgccatcaggaaggtgaggcaagtgcaaagaatgaaaaaacaaagaggatttgccttttcacaggctgaagagggtgggcaagaaaaaattgtcagaatgtatgatactactcaaaagagaggtaagtacggtgaattacaagatgcttcggcgaacccctttaatgacaataatggactgggaagtaacgactttgaaagtgcagaaccgttcattgaaaatccatttgctgatggtaatcaaaattcaaatagattcagttcttcgagagatgatatttcatttgatatatga

SEQ ID NO: 25076 - DNA, 921 bp, Saccharomyces cerevisiae
atgtccgacgaaattgtttggcaagtgattaatcaaagtttctgctctcatagaattaaggcacctaatggtcaaaatttttgcagaaatgagtataacgtcactgggttgtgtacaaggcaatcatgcccacttgccaactccaagtatgcaacagtgaagtgtgacaatgggaaactgtacttgtatatgaagacgcctgaaagagcgcacactcctgccaagttatgggaaagaatcaaactatccaaaaattacacgaaggctttacaacagatcgacgaacacctactacattggagcaagtttttccgtcataagtgtaaacagagatttacaaaattgacgcaggtcatgataacagagagacgtttagcattaagggaggaggagagacactacgttggtgtagcaccaaaggtcaaaagaagagaacaaaacagggagagaaaggcattggtagctgccaagattgaaaaagccatcgaaaaagaattgatggacagattaaagagtggtgcttacggtgataaaccattaaatgttgacgaaaaggtctggaagaagataatgggtcaaatggaagaggagaattctcaggacgaggaagaagactgggatgaagaagaggaaagtgatgatggggaagttgaatacgttgcagatgatggcgaaggtgaatacgttgacgtggatgacttagaaaagtggttagctgactctgacagagaagcttccagcgccagtcaaagcgaaagcgacagtgaaagcgagagcgacagcgatagtgatgaagaaaataagaattcagccaagagacgtaagaagggaactagtgccaaaactaaacgtcctaaagtcgaaatcgaatacgaggaggaacacgaagttcaaaatgctgagcaagaagtggcacaataa

SEQ ID NO: 25077 - DNA, 4308 bp, Saccharomyces cerevisiae
atggaaatatttagccagaaagattactacccgactccatcctcaaatgttattagctatgaaagcgattgtgtatccaaaccagtgaatagtgcagacctgcccgcgttaattgtacacctttcttcccctttggaaggtgtagactacaacgcatctgcagattttttccttatttataggaattttataacgcctcaagacttacacgacttactcatctatagatttcgatggtgtattagggagatcacaacaaatgctgcaaaagctaagagaaggcgaattggtgaagttgccctcgtgaggacgtttgtgttgttgaggcattccatactgaattattttgtgcaagattttttaccgaacataacattaagacttcggttgatcgagtttctaaacgacaaacacattgaacagtacccaaaaataatttccagctgtataatcaatctgaaaaaaaactgggtgcattgttctaagttggtttgggagaatattgaactaaatgaacctgataaattagactttgatgcatggctgcattattcgttaaaggatttcacgcaactagaaagcctacacaaaagaggaagccgactgagcatttacgccaggcaaagttttgccagtcctgattttcgtaaccaaagcgttttatcattatataaaacttctgatgtatttagactgccggagaagctacagtcttcaaattcttccaaaaaccagagaagcccttctatgcttttatttcccgataatacatcaaatgtttactcgaagcaccgaatagcgaaagaaccttcagttgataatgaaagcgaggacatgtcagatagtaaacaaaagatcagccacttgtcaaaagtcactctagtatccacactaatgaaaggcgtagactacccgtcatcatatgcagtcgataaaataatgcctccaacaccggctaaaaaagttgaatttattctgaattccttatatattcctgaagatttaaatgaacaaagcggaacgcttcaaggtacatcgacgacatcatctctagataacaatagcaacagtaatagtagatctaatacatcttcaatgtctgtgttacatcgcagcgctattggtcttttagctaagtggatgaaaaaccataatcgccatgatagcagtaatgataaaaaatttatgagtgctattaaaccagcaaaccagaaacctgaaatggatgcgtttgtcaaatacgttgtatcaatatcatctctcaatagaaaatcttccaaggaagaagaggaagagtttcttaactctgattcttctaaatttgacatcctaagtgcaagaaccatagatgaagtggagtccctactgcatttacaaaaccagctgatagaaaaagttcaaacacattcgaataacaaccgaggtcctacagttaatgttgattgtgaacgtcgggaacacatacatgatataaagattttacaacaaaatagctttaaaccgagtaatgataattttagcgctatggacaatttggatctgtatcaaaccgtaagttcaattgctcagtcagtcatctctttaactaatactttaaacaagcaactgcagaacaatgaatcgaatatgcagccatcaccctcgtatgatgcactgcaacgaaggaaagtaaaaagtctcacgacagcatattacaataaaatgcacggtagctactcagcagaaagtatgaggctctttgataaagataatagttcttcacgtacagacgagaatggacctcaaagattgttattccatgaaactgataaaaccaactcagaagcgattacaaatatgacaccaaggaggaaaaatcattcccaatcccaaaaaagcatgacttcttcgcctctgaaaaatgttctacctgatcttaaagaatcgtctcccttaaacgatagtagggaagacacagaatcaataacatactcatacgattccgagttgtcatccagctctccacccagagatactgtaacgaaaaagtcaagaaaagtcagaaacatcgtgaataatacagatagtccaactctaaaaacaaaaactggatttttaaatctaagagagtttacatttgaagataccaagtctttagatgagaaaaagagtactatagatggccttgaaaagaattatgataacaaagaaaatcaggaatcagaatatgagagcacaaaaaagctggacaactcactcgatgcatcatcagaagccaataattatgatataactacaagaaaaaaacattcatcttgcaatcacaagatcaaacaagcagttgtaagaccggctagtggaaggatcagcatttcaagagttcaaagcattgccataacaccaaccaaagagttatccatagtagatcctgagcaaaacaagtcaaactcagttatagaggaaataagtgaaatagaacctctcaacctggaatataataaaaaaagcgcgttgtactctgatacatcgtccaccgttatcagtatctcaacgagcaagctttttgaatctgctcagaatagtcctctaaaacaaactcaaaatccacagagagaatttcccaacgggaccagcgtgagtgaaaccaatagaatcagattatccatagcacccacaatagaatctgttgtaagtgatttgaattcgattaccactggtagcacagttgaaactttcgaaacgtccagagatttaccagtgccacaccaaaggataataaatttgagagaagaatatcaaaggggtaatcaagatataatctcaaatacttcttcattgcatgagttaaaaacaattgatttaagcgattccaataatgacctagaaagtccaagtacccatgcgaaaaacaacaagtattttttttcaccagatgacggtagcattgacgttgcttctccaatgaaaaacgttgaagagctgaaaagtaaatttctgaagaacgagagtgaaactaatagtaacatatcaggaagtgtattgacaatggacgatatcgacattaatgacacatctagtgcccggaacacacggagagcaaactctgagtcggcttttacaggctccttgaataagaaaaatttaaatgaaattgctaatatgctcgatgattcaattaatgacgatccaataaccgtggcattaatgaaactggaaggtacatacgagaaaattcccgaaaaaccagagaacaccaagagtagtgacgctattggaattaaaacgagcaagttagcagatgaagtggaaatgctaaaccttaacaacttgccgtcattccaaaatagccccgcagaaaaaagaaaatcgttattaatagaaagaaggagacaaactataatgaatatcccctttactccagatcaatccgagaaggaaggctttacttcctcctctcctgaaaaaatagacgtgtcagctaatgttgatgttgctgtgcaagcggcgcaaatccaggaattaatcggtcaatacaggattcacgattcgagattaatgatttctaataatgaaagtcacgttccatttatactaatgtacgattccctgtctgtagcgcaacaaatgaccttgatagagaaggaaattttaggagaaatagactggaaagatttattagatttaaagatgaagcatgaaggcccacaagttataagttggttgcaactactagtaaggaacgagaccttatctggcattgatttagctatatccagatttaacttaactgtggattggattatatcagaaatacttcttaccaagagcagcaaaatgaaaagaaatgtcattcaaaggtttatacacgttgcagaccactgcaggacatttcagaactttaacacattgatggaaatcattctagccttaagttcttcagttgttcaaaaattcactgatgcatggcgtctgattgaaccaggcgacttactgacttgggaagagctaaagaagattccctcgctagacaggaattattctacaataagaaatctacttaactctgtgaatccactggtgggttgcgtccctttcatcgtcgtatatctttcggacctatcagcaaacgcagagaagaaagactggatcttagaagataaagtagtgaattacaataaattcgatacgaacgttcaaatagtcaagaatttcattcaaagggttcaatggtccaagttttacactttcaaagttaaccacgaattgctgagtaagtgtgtttatattagcacattaacacaagaagagattaatgaactatccacatga

SEQ ID NO: 25078 - DNA, 1908 bp, Saccharomyces cerevisiae
atgtctggagcaagatcaacaacggcaggtgccgtgccctcggcagcaacaacatcaacaacatcaacaacgtcaaactctaaggactcagactctaacgagtcattatatcccttggctctgcttatggatgagttaaaacatgatgatattgctaatagggtagaagccatgaaaaaactagataccatcgcgttggcactcggtcccgaaagaacaagaaacgagttgattccctttttaacggaagttgcacaagatgatgaagatgaggtgtttgccgttttagccgaacagttaggaaaatttgtcccctacattggcggtcctcaatacgccacaatcctattaccagttttggaaattttggcatctgcagaagaaactttggttagagaaaaggccgtagattctctgaataacgtggcccaagaactttctcaagaacaattatttagtgacttcgtccctttaattgaacatttagctactgcagattggttttcttcaaaagtttctgcttgtggtcttttcaagtctgttattgttagaatcaaagatgattcattgagaaagaatatcctggctttatacttacaactcgctcaagatgatactccaatggtgaaaagggccgtcggtaaaaacctgcccatcttgatcgatctgttgactcaaaatttgggattatctacagacgaagattgggattacatttctaacattttccagaaaatcattaacgataatcaagattctgtcaagtttctggcagttgattgtttaatttccatcttgaaattttttaacgctaaaggtgatgagtctcacactcaagatttattgaactctgctgtcaaattaattggtgacgaagcgtggagggtacgttacatggctgccgatagattttcagatttagcctcgcaattcagttccaaccaagcatatatcgatgaattagtacaaccatttttgaacctttgtgaggacaacgagggagatgttagggaagctgtggctaaacaagtttctgggtttgccaagttcctaaatgatccttcaattatattgaataagatcttacctgctgtgcagaatttgagtatggacgaaagtgaaacagtgagatctgctttggcttctaagattacaaatattgtattactgttgaataaagatcaagtcattaacaattttcttccgattttactgaatatgctaagagatgagttccctgacgttcgtttaaatatcattgccagcttgaaggttgtcaatgacgtaataggaattgagctgctatcagactctttgttacctgccataacagaattagccaaggacgtgaattggagagttagaatggctataattgagtacatacctatcttggcagaacaattaggtatgcaattttttgaccaacagttaagcgatttatgtctttcatggttgtgggatactgtttattctatcagagaagccgcagtgaataatttaaaaaggttaacggaaatatttggctctgattggtgtcgtgatgaaattatttcaagactgctcaaatttgatctacaattactggaaaattttgtctcgaggttcacaatactctctgctctaaccactttggtgcccgtggtatcgttagatgtcgttactgagcaactattaccattcatttctcacttggctgatgacggtgttccaaatattaggtttaatgtggccaaatcctacgctgtgatagtgaaggttttaattaaggacgaggccaaatatgatgcattaattaagaacacaattttaccctcattgcaaacgctgtgtcaagacgaagatgttgatgtaaaatacttcgctaagaaaagtttggcagaatgtcaagaacttttaaaaaattga

SEQ ID NO: 25079 - DNA, 1200 bp, Saccharomyces cerevisiae
atgcaaaagatcagtaaatactcatctatggcaattctgaggaaaagaccgctggtaaagactgaaactgggccagaatcagaactcctaccggagaaaaggaccaaaatcaaacaagaagaggttgtccctcaacccgtggatatcgactgggttaaatcgctgccaaataagcagtacttcgaatggattgtggttagaaacggcaatgtgcccaacaggtgggccacaccattggacccctcgatccttgtcactccggcctcgacgaaagtcccttacaagtttcaagaaacatacgctagaatgcgagtactgagatctaagattctagcccccgtcgatataattggtggatcatccattcctgtaacggttgcctctaagtgtggtatctcgaaagagcagatatcaccgagggactacagattacaggtccttcttggggtgatgctatcatcgcaaacaaaagatgaagttaccgcaatggcaatgcttaacataatgcggtattgtatagacgaactgcacagcgaagaaggtatgacattagaggccgttttacaaatcaatgagaccaaattagacgaattgattcattcagttgggttccacacaaggaaggccaagtatattttgtcaacctgcaaaatccttcaagatcagttttcgagtgatgttccagctacgattaatgagctattgggcctgcccggtgtagggcccaaaatggcttatctaacattacaaaaggcatggggcaagattgaaggtatctgcgttgacgttcacgtggatagattgaccaagctttggaaatgggtagatgcgcagaaatgcaagactccagatcagacaagaactcaattacaaaattggctgcctaaggggctttggacagaaataaatgggttgctggttggatttggacaaataatcactaaatcgaggaaccttggtgacatgttacaattcttgccaccggatgatcccagaagctccttagattgggatttgcagtctcaattgtacaaggaaatccagcaaaatatcatgagttatccaaagtgggtgaaatacctggaaggaaaacgtgaactgaacgtggaggcggaaatcaatgttaaacacgaggagaaaacagttgaagaaactatggtcaaactggaaaatgatatttctgttaaagtagaggactaa

SEQ ID NO: 25080 - DNA, 1185 bp, Saccharomyces cerevisiae
atgactctacaagaatctgataaatttgctaccaaggccattcatgccggtgaacatgtggacgttcacggttccgtgatcgaacccatttctttgtccaccactttcaaacaatcttctccagctaaccctatcggtacttacgaatactccagatctcaaaatcctaacagagagaacttggaaagagcagttgccgctttagagaacgctcaatacgggttggctttctcctctggttctgccaccaccgccacaatcttgcaatcgcttcctcagggctcccatgcggtctctatcggtgatgtgtacggtggtacccacagatacttcaccaaagtcgccaacgctcacggtgtggaaacctccttcactaacgatttgttgaacgatctacctcaattgataaaggaaaacaccaaattggtctggatcgaaaccccaaccaacccaactttgaaggtcaccgacatccaaaaggtggcagaccttatcaagaagcacgctgccggccaagacgtgatcttggttgtcgacaacaccttcttgtccccatatatctccaatccattgaacttcggtgcagacatcgttgtccactccgctacaaagtacatcaacggtcactcagacgttgtgctcggtgtcctggccactaataacaagccattgtacgagcgtctgcagttcttacaaaacgccattggtgctatcccatctcctttcgatgcttggttgacccacagaggtttgaagactttgcatctacgtgtcagacaagctgccctcagcgccaacaaaatcgctgaattcttggcagcagacaaggaaaacgttgtcgcagtcaactacccaggtttgaagacacaccctaactacgacgtagtgttaaagcaacaccgtgatgcccttggtggtggtatgatctccttcagaatcaagggtggtgctgaagctgcttccaagttcgcctcctccacaagactgttcacattggccgaatcccttggtggtatcgaatctctattggaagtgcccgctgtgatgacccacggtggtatcccaaaggaggccagagaggcctctggtgtttttgacgacttggttagaatctctgtcggtattgaagacactgacgatcttttggaagacatcaagcaagccttgaaacaagccaccaactaa

SEQ ID NO: 25081 - DNA, 1929 bp, Saccharomyces cerevisiae
atgtcaaaagctgtcggtattgatttaggtacaacatactcgtgtgttgctcactttgctaatgatcgtgtggacattattgccaacgatcaaggtaacagaaccactccatcttttgtcgctttcactgacactgaaagattgattggtgatgctgctaagaatcaagctgctatgaatccttcgaataccgttttcgacgctaagcgtttgatcggtagaaacttcaacgacccagaagtgcaggctgacatgaagcacttcccattcaagttgatcgatgttgacggtaagcctcaaattcaagttgaatttaagggtgaaaccaagaactttaccccagaacaaatctcctccatggtcttgggtaagatgaaggaaactgccgaatcttacttgggagccaaggtcaatgacgctgtcgtcactgtcccagcttacttcaacgattctcaaagacaagctaccaaggatgctggtaccattgctggtttgaatgtcttgcgtattattaacgaacctaccgccgctgccattgcttacggtttggacaagaagggtaaggaagaacacgtcttgattttcgacttgggtggtggtactttcgatgtctctttgttgttcattgaagacggtatctttgaagttaaggccaccgctggtgacacccatttgggtggtgaagattttgacaacagattggtcaaccacttcatccaagaattcaagagaaagaacaagaaggacttgtctaccaaccaaagagctttgagaagattaagaaccgcttgtgaaagagccaagagaactttgtcttcctccgctcaaacttccgttgaaattgactctttgttcgaaggtatcgatttctacacttccatcaccagagccagattcgaagaattgtgtgctgacttgttcagatctactttggacccagttgaaaaggtcttgagagatgctaaattggacaaatctcaagtcgatgaaattgtcttggtcggtggttctaccagaattccaaaggtccaaaaattggtcactgactacttcaacggtaaggaaccaaacagatctatcaacccagatgaagctgttgcttacggtgctgctgttcaagctgctattttgactggtgacgaatcttccaagactcaagatctattgttgttggatgtcgctccattatccttgggtattgaaactgctggtggtgtcatgaccaagttgattccaagaaactctaccatttcaacaaagaagttcgagatcttttccacttatgctgataaccaaccaggtgtcttgattcaagtctttgaaggtgaaagagccaagactaaggacaacaacttgttgggtaagttcgaattgagtggtattccaccagctccaagaggtgtcccacaaattgaagtcactttcgatgtcgactctaacggtattttgaatgtttccgccgtcgaaaagggtactggtaagtctaacaagatcactattaccaacgacaagggtagattgtccaaggaagatatcgaaaagatggttgctgaagccgaaaaattcaaggaagaagatgaaaaggaatctcaaagaattgcttccaagaaccaattggaatccattgcttactctttgaagaacaccatttctgaagctggtgacaaattggaacaagctgacaaggacaccgtcaccaagaaggctgaagagactatttcttggttagacagcaacaccactgccagcaaggaagaattcgatgacaagttgaaggagttgcaagacattgccaacccaatcatgtctaagttgtaccaagctggtggtgctccaggtggcgctgcaggtggtgctccaggcggtttcccaggtggtgctcctccagctccagaggctgaaggtccaaccgttgaagaagttgattaa

SEQ ID NO: 25082 - DNA, 1866 bp, Saccharomyces cerevisiae
atgagcagtgttcaactttcgaggggcgattttcatagcatcttcaccaataagcaaaggtacgataatcccaccggtggcgtttatcaagtttataacaccaggaaatctgatggggctaacagcaacagaaagaatttgatcatgatttccgatggtatttaccatatgaaggctctgttgagaaaccaagctgcatccaagttccagtcaatggaactacaaaggggtgatatcattcgcgtgataattgcagaacctgctattgtcagggaaagaaagaaatacgttcttttagtagatgactttgagttggtccagtcgcgtgctgatatggtcaaccaaactagtacttttttggataactatttctcagagcatccaaatgaaaccttaaaagacgaagatataactgacagtggtaatgttgccaatcaaacaaacgccagcaatgctggtgtccctgatatgctgcattcaaactcaaacttgaatgcaaatgagagaaaattcgccaatgaaaaccctaattcgcaaaaaaccagaccaatttttgccatcgaacaactgtctccataccaaaacgtttggactatcaaagcaagagtttcctacaagggagaaattaaaacgtggcacaatcaaagaggtgatggtaaactattcaatgtcaacttcttggatacctctggagaaatccgagccacggcgtttaatgattttgctacaaaatttaacgaaattttacaagaaggcaaagtatactatgtatcaaaggcaaaactccaaccagctaagccccaatttactaatctaacacacccttatgaactgaatttggatagagacactgttatagaagaatgtttcgatgaaagtaatgttccgaaaacccatttcaatttcatcaaactagatgctattcagaaccaggaagtaaattccaacgtagacgtcctcggtattatccaaactataaacccacattttgagctaacttcaagggctgggaagaaattcgatcgtcgtgacatcacaattgttgacgactctgggttttctatctctgttggcctatggaatcagcaagcccttgatttcaaccttcctgaaggttctgttgctgccattaaaggtgttcgtgtgacggattttggtggcaaatctttgtctatgggattttctagtaccctgattccgaatccagaaattcctgaggcatatgccttaaagggttggtatgattccaagggccgcaacgcaaacttcatcactttaaagcaagaacccggtatgggtggtcaatcggctgctagcttaacaaaattcattgctcagcgtattactattgctagagctcaagctgaaaatctaggaagaagcgagaaaggtgacttttttagtgttaaagctgctataagtttcttaaaagttgataattttgcatatcctgcctgttctaatgagaattgtaataagaaagttctggaacagcctgatggtacttggagatgtgagaagtgcgacaccaataatgcaaggccaaattggagatacatcttgacaatatcaattattgacgaaaccaatcaactatggctcactttatttgacgaccaagctaaacaattattgggtgttgatgctaatacattaatgtctttgaaggaagaagaccccaacgaattcacaaaaattactcaaagtatccaaatgaacgaatatgactttaggattagagcgcgtgaggatacatacaatgatcaaagcagaattagatataccgttgctaacctacacagcttgaattacagggctgaagccgactatcttgccgatgagttatccaaggctttgttagcttaa

SEQ ID NO: 25083 - DNA, 1308 bp, Saccharomyces cerevisiae
atgcatagacgacagtttttccaagaataccgtagtcctcagcagcagcagggacacccaccaaggtcagaataccaagttctcgaagaaattgggagaggttcatttgggtctgtacgaaaagtcatccatatacctaccaagaaacttttggttagaaaggatatcaaatatggccatatgaatagcaaagagagacaacagctgatcgctgaatgtagcattctatcgcagttgaagcatgaaaatattgtagaattttataactgggacttcgatgaacaaaaagaagtgttatacctttatatggaatattgttccaggggtgatttatcccagatgattaagcactacaaacaggagcataaatatataccagaaaaaattgtgtggggtatcctggcccaattattgactgcgctctataaatgtcattatggtgttgaattgccaactttgaccacaatatatgaccggatgaaaccaccggtaaaaggcaaaaacatcgttatccatcgtgatctgaaaccaggaaatatattcttaagctatgatgatagcgattacaatattaatgaacaagtagacggtcacgaggaagtgaatagtaattattacagagaccatagagtgaattcagggaaaagggggagccctatggactatagtcaagttgtggtaaagttaggtgattttgggttagccaaatctctggaaactagtattcaatttgccacaacatacgtcggtacaccatattacatgtcgcctgaagtgttgatggaccaaccatactccccactatccgacatctggtcactaggttgtgttatttttgagatgtgttcgttgcaccccccatttcaggcaaaaaattatctcgagctacaaactaagattaaaaacgggaaatgtgacaccgtccctgagtattactctagagggcttaatgccataatacattcaatgatagatgtgaacttaagaaccaggccttccacttttgaattactgcaagatattcagatacgaactgcaagaaagtcgttgcaattagagagatttgaaaggaagttactggactatgaaaatgagctgacaaacattgaaaaaatcctcgagaagcaagctattgaatacgaaagagaactgagtcagttgaaggaacaatttacccaggcagtggaggagcgagccagggaagtaattagcggtaagaaagttggtaaggttccagaatctataaacggatattatggtaaaaaatttgccaaacctgcataccactggcaaacaagatatcgataa

SEQ ID NO: 25084 - DNA, 2064 bp, Saccharomyces cerevisiae
atgccaaacttaaagagactacccatcccgccactgcaggacacgctcaaccgctacctggcacgcgtggaacccctgcaggacgagcgccaaaaccgccgtacgcgccgcactgtgctctccgcagaaaacctggacgcattgaacacgctgcacgagcggctgctagaatacgacgcacggctcgcggaaagcaacccagagtcctcatacatcgagcagttctggtatgacgcgtacttgctatatgatgcaactgtcgttctcaacgtcaacccgtacttccaactgcaggacgacccaaccatcaaagacacaccagagacggcggcacagggcccctatggcgcacacacggtgcaggttcgtcgtgccgcacgactcaccacctctattctcaagttcatccgccagattcgccacggcacactccgcacagacactgtgcgcggcaaaacgccgctgtcgatggaccagtatgagcggctattcggctccagtagaatccctccgggtcccggcgagccctcttgccacttgcaaacagacgccacgtcgcatcacgtggtggcgatgtatcgtggccagttctactggttcgacgtgctggacacacgcaacgagcccatcttcgccaccccagaacaactggagtggaacctctactcgatcatcatggacgcggaatccgccggaagcggatccgcgccctttggcgtgttcaccacagagtcgcgccgggtgtggtccaacatcagggactatctgttccatgcggacgactgcaccaactggcgcaatctcaagctgatcgactccgcgctgttcgtggtctgtctcgacgacgtggcgtttgccgccgatcagcaggacgagctcacgcgttcgatgctgtgcgggacttctaccatcaatctcgacccgcaccaacaccagccgccattgaacgtgcagacaggcacctgtctcaaccgctggtacgacaagttacaactgatcgtgaccaagaacggtaaggcgggcatcaacttcgaacacaccggtgtggacggccacactgtgctgcggctcgccacagacatctacacagactcgatcctgagcttcgcacgcggtgtcaccaagaacgtcgtcgacatctttagcgacgacgatggaaaaccatcgtcgtcgtcgttggcctcggcggctcactccgccaacttgatcaccatccctcgtaaactggaatggcgcactgacaatttcctgcaatcgtcgctgcactttgccgagacgcgcatctcggacttgatctcgcaatacgagtttgttaatcttgacttctccaactacggcgcgtcccatatcaagacagtgttcaagtgctcgccagacgccttcgtgcagcaggtgttccaggtcgcatacttcgcgttgtacggtcgcttcgagaccgtgtacgagcctgccatgaccaaggcgttccaaaacggccgcacagaggccatccgctccgtcacgggccaatcgaagctctttgtcaagtcactactggaccaggatgcctcggacgccaccaaaattcagctcttgcacgacgcctgtacggcgcactcgcaaatcacaagggaatgctcccaggggctcggccaggaccgtcacttgtatgcgctctactgcctctggaaccaatggtacaaggacaagttggagctcccacccatcttccgcgacaagtcctggactaccatgcagaacaacgtcttgagcacctccaactgcggtaacccctgcctcaagagcttcgggttcgggcctgtcaccgccaacggcttcggcatcggctacatcatcagagaccactccgtctctgtggtggtgtcctcaaggcatcgccagactgctcggtttgcgtcgctcatggaaaagtcgctgctggagatcgaccgcatcttcaaacggcagcaagctcgcgcagcaaaacccgctgccaggaccactgctagcgccaacaccaaatcagaagacatgaaatacctgttgtccggctacgattacttcgacgtgagcgtgtccggttga

SEQ ID NO: 25085 - DNA, 4614 bp, Saccharomyces cerevisiae
atgacaatgcctcatcgctatatgtttttggcagtctttacacttctggcactaactagtgtggcctcaggagccacagaggcgtgcttaccagcaggccagaggaaaagtgggatgaatataaatttttaccagtattcattgaaagattcctccacatattcgaatgcagcatatatggcttatggatatgcctcaaaaaccaaactaggttctgtcggaggacaaactgatatctcgattgattataatattccctgtgttagttcatcaggcacatttccttgtcctcaagaagattcctatggaaactggggatgcaaaggaatgggtgcttgttctaatagtcaaggaattgcatactggagtactgatttatttggtttctatactaccccaacaaacgtaaccctagaaatgacaggttattttttaccaccacagacgggttcttacacattcaagtttgctacagttgacgactctgcaattctatcagtaggtggtgcaaccgcgttcaactgttgtgctcaacagcaaccgcctatcacatcaacgaactttaccattgacggtatcaagccatggggtggaagtttgccacctaatatcgaaggaaccgtctatatgtacgctggctactattatccaatgaaggttgtttactcgaacgctgtttcttggggtacacttccaattagtgtgacacttccagatggtaccactgtaagtgatgacttcgaagggtacgtctattcctttgacgatgacctaagtcaatctaactgtactgtccctgacccttcaaattatgctgtcagtaccactacaactacaacggaaccatggaccggtactttcacttctacatctactgaaatgaccaccgtcaccggtaccaacggcgttccaactgacgaaaccgtcattgtcatcagaactccaacaactgctagcaccatcataactacaactgagccatggaacagcacttttacctctacttctaccgaattgaccacagtcactggcaccaatggtgtacgaactgacgaaaccatcattgtaatcagaacaccaacaacagccactactgccataactacaactgagccatggaacagcacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacatccactgaaatcaccaccgtcaccggtaccaatggtttgccaactgatgagaccatcattgtcatcagaacaccaacaacagccactactgccatgactacacctcagccatggaacgacacttttacctctacatccactgaaatgaccaccgtcaccggtaccaacggtttgccaactgatgaaaccatcattgtcatcagaacaccaacaacagccactactgccataactacaactgagccatggaacagcacttttacctctacatccactgaaatgaccaccgtcaccggtaccaacggtttgccaactgatgaaaccatcattgtcatcagaacaccaacaacagccactactgccataactacaactcagccatggaacgacacttttacctctacatccactgaaatgaccaccgtcaccggtaccaacggtttgccaactgatgaaaccatcattgtcatcagaacaccaacaacagccactactgccatgactacaactcagccatggaacgacacttttacctctacatccactgaaatcaccaccgtcaccggtaccaccggtttgccaactgatgagaccatcattgtcatcagaacaccaacaacagccactactgccatgactacaactcagccatggaacgacacttttacctctacatccactgaaatgaccaccgtcaccggtaccaacggcgttccaactgacgaaaccgtcattgtcatcagaactccaactagtgaaggtctaatcagcaccaccactgaaccatggactggtactttcacctctacatccactgagatgaccaccgtcaccggtactaacggtcaaccaactgacgaaaccgtgattgttatcagaactccaaccagtgaaggtttggttacaaccaccactgaaccatggactggtacttttacttctacatctactgaaatgaccaccattactggaaccaacggcgttccaactgacgaaaccgtcattgtcatcagaactccaaccagtgaaggtctaatcagcaccaccactgaaccatggactggtacttttacttctacatctactgaaatgaccaccattactggaaccaatggtcaaccaactgacgaaaccgttattgttatcagaactccaactagtgaaggtctaatcagcactacaacggaaccatggaccggtactttcacttctacatctactgaaatgacgcacgtcaccggtaccaacggcgttccaactgacgaaaccgtcattgtcatcagaactccaaccagtgaaggtctaatcagcaccaccactgaaccatggactggcactttcacttcgacttccactgaggttaccaccatcactggaaccaacggtcaaccaactgacgaaactgtgattgttatcagaactccaaccagtgaaggtctaatcagcaccaccactgaaccatggactggtactttcacttctacatctactgaaatgaccaccgtcaccggtactaacggtcaaccaactgacgaaaccgtgattgttatcagaactccaaccagtgaaggtttggttacaaccaccactgaaccatggactggtacttttacttcgacttccactgaaatgtctactgtcactggaaccaatggcttgccaactgatgaaactgtcattgttgtcaaaactccaactactgccatctcatccagtttgtcatcatcatcttcaggacaaatcaccagctctatcacgtcttcgcgtccaattattaccccattctatcctagcaatggaacttctgtgatttcttcctcagtaatttcttcctcagtcacttcttctctattcacttcttctccagtcatttcttcctcagtcatttcttcttctacaacaacctccacttctatattttctgaatcatctaaatcatccgtcattccaaccagtagttccacctctggttcttctgagagcgaaacgagttcagctggttctgtctcttcttcctcttttatctcttctgaatcatcaaaatctcctacatattcttcttcatcattaccacttgttaccagtgcgacaacaagccaggaaactgcttcttcattaccacctgctaccactacaaaaacgagcgaacaaaccactttggttaccgtgacatcctgcgagtctcatgtgtgcactgaatccatctcccctgcgattgtttccacagctactgttactgttagcggcgtcacaacagagtataccacatggtgccctatttctactacagagacaacaaagcaaaccaaagggacaacagagcaaaccacagaaacaacaaaacaaaccacggtagttacaatttcttcttgtgaatctgacgtatgctctaagactgcttctccagccattgtatctacaagcactgctactattaacggcgttactacagaatacacaacatggtgtcctatttccaccacagaatcgaggcaacaaacaacgctagttactgttacttcctgcgaatctggtgtgtgttccgaaactgcttcacctgccattgtttcgacggccacggctactgtgaatgatgttgttacggtctatcctacatggaggccacagactgcgaatgaagagtctgtcagctctaaaatgaacagtgctaccggtgagacaacaaccaatactttagctgctgaaacgactaccaatactgtagctgctgagacgattaccaatactggagctgctgagacgaaaacagtagtcacctcttcgctttcaagatctaatcacgctgaaacacagacggcttccgcgaccgatgtgattggtcacagcagtagtgttgtttctgtatccgaaactggcaacaccaagagtctaacaagttccgggttgagtactatgtcgcaacagcctcgtagcacaccagcaagcagcatggtaggatatagtacagcttctttagaaatttcaacgtatgctggcagtgccaacagcttactggccggtagtggtttaagtgtcttcattgcgtccttattgctggcaattatttaa

SEQ ID NO: 25086 - DNA, 381 bp, Saccharomyces cerevisiae
atggcaggtgaagcagtttcggaacacacaccagattcgcaggaagtaacagtaactagcgttgtttgttgcctcgattctgtggtggaaataggacaccatgttgtgtattctgtagtaacgccgttaatagtagcagtgcttgtagatacaatggctggagaagcagtcttagagcatacgtcagattcacaagaagaaattgtaactaccgtggtttgttttgttgtttctgtggtttgctctgttgtccctttggtttgctttgttgtctctgtagtagaaatagggcaccatgtggtatactctgttgtgacgccgctaacagtaacagtagctgtggaaacaatcgcaggggagatggattcagtgcacacatga

SEQ ID NO: 25087 - DNA, 597 bp, Saccharomyces cerevisiae
atgacaggttactttttaccaccacaaacaagttcttacacgttcaggtttgctaaggtcgatgactctgcaattctatcagtcggtggtaacgttgcgttcgaatgttgtgcacaagaacaacctccaattacatcgacggattttacaatcaatggtattaagccatggcaaggaagtttgcctgataacatcggagggactgtctacatgtatgcaggctactattatccgctgaaggttgtttactccaatgccgtttcctggggcacgcttccaattagcgtggaattgcctgatggtactactgttagtgatgactttgaagggtacgtttactcttttgacgatgatttaagtcagtcaaattgtactatccctgatccttcaaaacatactactagcatcgtcacaactactaccgaactgtggactggtacttttacttctacatctactgaaatgaccaccgtcaccggtactaatggtcaaccaactgacgaaaccgttattgttgccaaagctccaaccactgccacctcatccagtttgtcatcatcttcttcagaacaaatcaccagctctatcacgtcttag

SEQ ID NO: 25088 - DNA, 1404 bp, Saccharomyces cerevisiae
atgttgaagtcagccgtttattcaattttagccgcttctttggttaatgcaggtaccatacccctcggaaagttatctgacattgacaaaatcggaactcaaacggaaattttcccatttttgggtggttctgggccatactactctttccctggtgattatggtatttctcgtgatttgccggaaagttgtgaaatgaagcaagtgcaaatggttggtagacacggtgaaagataccccactgtcagcaaagccaaaagtatcatgacaacatggtacaaattgagtaactataccggtcaattcagcggagcattgtctttcttgaacgatgactacgaatttttcattcgtgacaccaaaaacctagaaatggaaaccacacttgccaattcggtcaatgttttgaacccatataccggtgagatgaatgctaagagacacgctcgtgatttcttggcgcaatatggctacatggtcgaaaaccaaaccagttttgccgtttttacgtctaactcgaacagatgtcatgatactgcccagtatttcattgacggtttgggtgataaattcaacatatccttgcaaaccatcagtgaagccgagtctgctggtgccaatactctgagtgcccaccattcgtgtcctgcttgggacgatgatgtcaacgatgacattttgaaaaaatatgataccaaatatttgagtggtattgccaagagattaaacaaggaaaacaagggtttgaatctgacttcaagtgatgcaaacactttttttgcatggtgtgcatatgaaataaacgctagaggttacagtgacatctgtaacatcttcaccaaagatgaattggtccgtttctcctacggccaagacttggaaacttattatcaaacgggaccaggctatgacgtcgtcagatccgtcggtgccaacttgttcaacgcttcagtgaaactactaaaggaaagtgaggtccaggaccaaaaggtttggttgagtttcacccacgataccgatattctgaactatttgaccactatcggcataatcgatgacaaaaataacttgaccgccgaacatgttccattcatggaaaacactttccacagatcctggtacgttccacaaggtgctcgtgtttacactgaaaagttccagtgttccaatgacacctatgttagatacgtcatcaacgatgctgtcgttccaattgaaacctgttctactggtccagggttctcctgtgaaataaatgacttctacgactatgctgaaaagagagtagccggtactgacttcctaaaggtctgtaacgtcagcagcgtcagtaactctactgaattgacctttttctgggactggaataccaagcactacaacgacactttattaaaacagtaa

SEQ ID NO: 25089 - DNA, 1212 bp, Saccharomyces cerevisiae
atggccgccattagagactacaagaccgcactagatcttaccaagagcctaccaagaccggatggtttgtcagtgcaggaactgatggactccaagatcagaggtgggttggcttataacgattttttaatcttaccaggtttagtcgattttgcgtcctctgaagttagcctacagaccaagctaaccaggaatattactttaaacattccattagtatcctctccaatggacactgtgacggaatctgaaatggccacttttatggctctgttggatggtatcggtttcattcaccataactgtactccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacggcagatggaaagagaaatgcaaagttggtgggtgccatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctactggttgttgatgaaaagggtaacttagtttctatgctttcccgaactgatttaatgaaaaatcagaagtacccattagcgtccaaatctgccaacaccaagcaactgttatggggtgcttctattgggactatggacgctgataaagaaagactaagattattggtaaaagctggcttggatgtcgtcatattggattcctctcaaggtaactctattttccaattgaacatgatcaaatggattaaagaaactttcccagatttggaaatcattgctggtaacgttgtcaccaaggaacaagctgccaatttgattgctgccggtgcggacggtttgagaattggtatgggaactggctctatttgtattacccaaaaagttatggcttgtggtaggccacaaggtacagccgtctacaacgtgtgtgaatttgctaaccaattcggtgttccatgtatggctgatggtggtgttcaaaaacattggtcatattattaccaaagctttggctcttggttcttctactgttatgatgggtggtatgttggccggtactaccgaatcaccaggtga

SEQ ID NO: 25090 - DNA, 3453 bp, Saccharomyces cerevisiae
atgagtttttcacaattggagcagaacattaaaaaaaagatagccgtcgaagaaaatattattcggggagcttctgccctcaagaaaaagactagcaatgttatggtcattcagaaatgtaatacgaatattagagaggcacgtcaaaatcttgagtacttggaggatagcttaaaaaaattacggttgaagaccgctcaacaaagtcagggtgaaaatggcagcgaagataatgagcgattcaattcgaaggaatacgggtttctttctaccaaatcgccaaatgaacacatattttctcgtttggatttagtaaaatatgattgcccttctttggcgcaaagaatccaatacatgttgcaacaattagaattcaaattacaggtggaaaagcaataccaagaagccaatactaaattgactaaattgtatcaaattgacggtgatcaacgtagtagttctgcggcagaagggggtgctatggaatccaaatacaggattcaaatgcttaacaaagctttgaagaaataccaagctattaacgttgactttgatcaatttaaacaccaacccaatgacataatggataatcaacaaccgaaattccgaagaaaacaactgactggcgttctaacaattggaataactgctgctagagatgttgaccatatacaatcaccgatgtttgccaggaagccagagagctacgttactataaaaatcgatgatacgatcaaagccagaacgaagccttctagaaatgacaggtggagtgaagattttcaaattccagttgaaaaagggaatgaaatcgagattactgtatatgataaggtgaacgactcgctcattccagtggctataatgtggttactgctttccgatatcgctgaagaaattcgtaagaagaaagccggacaaacaaatgaacaacaaggatgggtcaacgcttcaaacattaatggtggttcttctctcgctagcgaagagggaagcacattgacttctacatactcaaactcagccattcagtctacttcagcaaagaatgtgcaaggcgaaaatacatcaactagtcaaatcagtacgaattcatggtttgtcttagaaccatccgggcagattttgttaacactaggattccacaagtcttctcaaatagaaaggaagcagttgatgggtggactacatcgtcatggtgctattatcaataggaaagaagagatattcgaacagcatggccaccactttgtacaaaaatcattttacaacattatgtgctgtgcatattgtggtgatttccttcggtatactgggttccaatgtcaagattgtaaatttttatgtcacaaaaaatgttacaccaatgttgttactaagtgtattgctaaaacttctactgatacggatccggacgaggcaaagttgaaccaccgtattcctcatagattcctgcctacttcaaaccgtggtactaaatggtgctgtcactgtggttatattttaccatggggtagacataaagtacgcaaatgttctgaatgtggtataatgtgtcatgctcaatgtgctcatttggttcccgatttctgtggcatgtcgatggaaatggctaataaaattctgaaaacgattcaagacacaaaacgtaatcaagagaaaaagaagaggacagttccgtcggcacagttggggtcatctattggtactgccaatggtagtgatctttccccatccaaattagctgaaagggcaaacgctcctttgcctcctcagccaagaaaacatgataaaactccttcgcctcagaaggtaggaagagattctccaactaagcagcatgatcctattattgataaaaaaatttcactacaaacgcacgggcgtgagaaactaaataaatttatcgatgaaaatgaggcctatttaaattttacagaaggtgcacaacaaaccgccgaattttcatcaccagagaaaacactggatccaacgtcgaatagacgttccttgggactcactgatttatctattgagcatagtcaaacttgggaatctaaagatgatttaatgagagatgaacttgaactgtggaaagcacaacgtgaggaaatggaacttgaaataaaacaagatagtggggaaatccaagaggatctagaagttgatcacattgatttagagaccaaacagaaactagactgggagaacaaaaatgatttccgtgaagctgatttgacaatagattccacacacacaaatccattccgcgatatgaatagtgaaacctttcaaattgaacaagaccatgcttcaaaggaagtactacaagaaacagtgtccttggctcctacaagtactcatccctccagaaccactgatcaacaatctccgcagaaatcacaaaccagcacaagcgcaaagcataaaaagagagcggctaaacgtcgtaaggtttcattagataatttcgtattactcaaagttcttggtaaaggtaattttggtaaagttattttatctaaatcaaagaatactgacaggctttgtgccataaaagttctgaagaaagataatattattcaaaatcatgacatcgagagtgcaagagcagaaaagaaagtatttttgttagccacaaaaactaaacacccattcttaaccaatctatactgctcttttcaaactgaaaaccgtatatattttgctatggagtttattgggggcggtgacttaatgtggcatgttcaaaaccaaagactatctgtaagaagggccaaattttatgccgccgaggtcttactggctctgaaatattttcatgataatggtgtaatataccgtgatttgaagttggaaaacattctattaactccagaaggtcatataaaaattgccgattatggtttgtgtaaagatgaaatgtggtatggtaatagaacttctacattttgtggcacaccagaatttatggctccagaaattttaaaagagcaagaatataccaaagctgtcgattggtgggcatttggggtgctgctatatcaaatgctactgtgccaatctccattctcaggagatgacgaagatgaagtttttaacgctatccttaccgatgaacccttatacccaatagatatggcaggtgagattgtacaaatattccaaggcctattaacaaaagatcctgaaaagaggttgggtgctggtcccagggacgcagacgaagttatggaagaacctttcttccgtaacatcaactttgacgatatcttaaaccttcgcgtgaaaccaccctacatcccagaaattaaatctccggaagatacatcatatttcgagcaagaattcacctctgcgccacccacacttacacctctgccctctgttttgacaacgagccagcaagaagagtttagaggattttcctttatgccagatgatttggattta

SEQ ID NO: 25091 - DNA, 1638 bp, Saccharomyces cerevisiae
atgttggctcgtactgctgctattcgttctctatcgagaactctaattaactctaccaaggccgcaagacctgccgctgctgctttggcttccaccagaagattggcttccaccaaggcacaacccacagaagtttcctccatcttagaggaaagaattaagggtgtgtccgacgaggccaatttgaacgaaactggtagagttcttgcagtcggtgatggtattgctcgtgtttttggtttgaacaacattcaggctgaagaattggtcgagttctcctctggtgttaaaggtatggctttgaacttggagcctggtcaagtcggtatcgttcttttcggttccgatagactggttaaagaaggtgaattggtcaagagaaccggtaatattgttgatgtcccagtcggtccaggccttttgggtagagttgtcgacgctttaggtaaccctattgatggtaaaggtcctattgacgctgccggtcgttcaagagctcaagtcaaagcaccaggtattttgccaagaagatctgtccatgaaccagttcaaaccggtttgaaagccgttgacgccttggtccctatcggtagaggtcaaagagagttgattattggtgatcgtcaaacaggtaagactgctgtcgccttagacaccatcttgaatcaaaagagatggaataacggtagtgacgaatccaagaaactttactgtgtttacgttgccgttggacaaaaaagatctaccgttgctcaattggtccaaactttggaacaacatgacgccatgaagtactctattattgttgcagctactgcatctgaagccgctcctctacaatacttggctccatttactgccgcatccattggtgaatggttcagagataatggaaagcacgctttgatcgtctatgacgatttgtccaagcaagccgtggcataccgtcaattatctttgttgttgagacgtcctcctggtcgtgaagcctaccctggtgatgtcttttacttgcatccaagattgctagaaagagccgctaagctttctgaaaaggaaggttctggttctttaactgctttgcctgttattgaaacccaaggtggtgatgtctccgcttatattccaaccaatgttatttccattaccgatggtcaaatattcttggaagctgaattattctacaagggtatcagacctgccattaacgttggtttgtccgtttctcgtgtcggttccgctgctcaagttaaggctttgaagcaagtcgctggttccttgaaattgtttttggctcaatacagagaagtcgctgcttttgctcaattcggttccgatttagatgcctccaccaagcaaactttggttagaggtgaaagattgactcaattgttgaagcaaaaccaatattctcctttggctacagaagaacaggttccattgatttatgccggtgttaatggtcatttggatggtattgaactatcaagaattggtgaatttgagtcctcctttttgtcctatctaaaatccaatcacaatgagcttttgaccgaaattagagaaaagggtgaattgtctaaagaattgttggcatctctaaagagtgctactgaatcatttgttgccactttttaa

SEQ ID NO: 25092 - DNA, 2187 bp, Saccharomyces cerevisiae
atgatggcaaattttgaagaatggatcaaaatggctacagataataaaatcaattcccgaaatagttggaatttcgcattgatcgactatttttatgacttggacgttttgaaagatggcgagaataacatcaattttcagaaagcatctgcaaccttggatgggtgtattaagatttactcttcgagagttgattcagtgacaacggaaacaggtaagttattgagcgggttggcacaaagaaagacgaatggggcatctaacggagatgacagtaacgggggaaatggtgaagggcttggaggtgacagtgacgaagcaaatatagagattgatcccttaactggtatgcctatatctaatgatcctgatgtgaataacactaggcggagagtgtacaacagagttttagaaacaacattggtggagttcgaaacgatcaagatgaaagagctagaccaggaattaataattgatccattattcaaaaaggccttggttgatttcgatgaaggtggcgccaagagtttattgttgaacacattaaacatagacaacactgcaagagtcattttcgatgcatcaattaaggatacacaaaacgtagggcaaggtaaacttcaaaggaaagaagaagaattaattgaaagagatagtttagtagatgacgaaaatgaacctagccagtcattgataagtactcgtaatgactcaaccgtaaatgattccgttattagtgcaccttccatggaagatgagattttatctcttggtatggattttataaaatttgatcaaattgcggtgtgtgaaatttcaggatcgattgagcaactaaggaacgttgtcgaagatattaatcaagcgaaagactttatcgaaaatgttaacaacagatttgataacttcttaactgaagaagaattgcaagcagctgtcccagataatgcagaagatgatagcgatggctttgatatgggcatgcaacaggagctgtgctatccagatgaaaatcatgacaatacatcacatgatgaacaagatgatgataatgtcaacagtaccacaggaagtatattcgaaaaagatttgatggcatactttgacgaaaatctaaatagaaactggagagggagagaacattggaaagtacgaaattttaagaaagcaaacttagtgaataaagaatccgacctgttggaagaaacgcgaactactataggagatactactgacaaaaacacaacggacgacaaatcgatggatacgaagaagaagcataaacaaaaaaaggttctggaaattgatttcttcaaaacggatgatagttttgaagacaaagtctttgcctcaaaaggaaggacaaagattgacatgccgattaagaacagaaagaacgacacacattatttactgccggatgacttccatttttccactgatagaataacaagattgttcattaaaccggcgcagaaaatgagtctgttcagtcataggaagcataccagaggcgacgttagttcggggctttttgaaaaaagcacagtttctgccaaccattcaaataacgacattcctactattgcagatgagcacttttgggcggataattacgaaaggaaagaacaagaggaaaaagaaaaggagcagtctaaagaggttggtgatgtggtgggtggagcgctcgataatccgtttgaagatgacatggacggtgttgacttcaaccaagctttcgaaggaacagatgataacgaggaggccagtgtgaaacttgatttacaggatgacgaagatcataagttccccattcgagaaaataaagttacttattcaagagtttcgaaaaaagttgacgtaagaagattaaagaaaaacgtatggagatcgatcaacaatttgatacaagaacatgacagtaggaaaaatagagaacaaagctctaatgacagtgaaacccacacagaagatgaatcaacaaaggagctcaagttttctgatatcattcagggtataagtaaaatgtattcggatgatacactaaaggacatttcaacaagcttttgttttatatgccttctacacttagccaatgagcatgggttgcagataactcataccgaaaactataatgacttgatagtgaattatgaggatctagcgacaacacaggcagcgtcatag

SEQ ID NO: 25093 - DNA, 2943 bp, Saccharomyces cerevisiae
atgagtctcgaaggaaataccctaggcaaaggggccaaatcttttcctctgtatattgcggtaaatcagtactctaaacgaatggaggacgagctcaatatgaaaccaggtgataaaattaaagtcattactgatgatggggagtacaatgacggctggtattatgggcgcaatttgagaaccaaagaggaaggtttatacccagcggtatttaccaaaagaatagcaatagaaaaaccagagaacctgcacaaatcaccaacccaagagagtggaaattctggtgttaaatatggaaatttaaatgattctgcgagtaacataggtaaagtctcctcgcatcaacaggagaacagatatacatcattgaaaagtacaatgagcgatatagacaaagccttggaagagctaagaagtggttcagttgaacaagaggtatcaaaatcgcccacacgcgtgcccgaagttagcactccacagttgcaagatgaacagactttgattcaagaaaaaaccagaaatgaggaaaacacgacacatgactcgttattttctagcacagcggatttaaacttaagttctgaatctttgaagaatataagtaagtcaaatatatcaacaaaatccctagaaccgagttcggaatcagttcgtcaattagatttgaaaatggctaaaagttggagcccagaagaggttactgattactttagcttggttggatttgatcaatccacttgcaataaattcaaagagcatcaagtctccggaaaaatactactggaattagaactggaacacctaaaagaattggaaataaattcttttggtataagatttcagatattcaaagaaataaggaacatcaagtctgcaattgattcgtcgtcaaataaactggacgccgactactctacctttgcttttgaaaaccaagctgcccaactaatgcctgcagccactgtaaatagagacgaaatccaacaacaaatttcctccaagtgtaacaagttgtcaagtgaaagctctgatagaaaatcatcttcggtcaccacagaattgcaaagaccaagctcggttgttgttaatcccaattttaaacttcacgacccagctgagcagatcctagatatgacagaagttcctaatttgtttgctgataaagatattttcgaatcaccgggaagggctccaaaaccaccatcatatccaagtccagttcaacctccacaatcgccctcttttaataacaggtacacaaataataacgcaaggtttcctcctcaaacaacatatccacctaaaaacaagaacccaaccgtttattcaaatgggctaattccaaattcttcgacatcttccgataattcaacgggcaagttcaaattccctgccatgaatggtcatgactcgaactctaggaaaacaacactgacatctgctactataccttctattaacacggttaacacagatgaatctctacccgcaatttcaaatatatcttcaaatgctacatctcatcatccgaacagaaattccgttgtttacaataaccataagaggacggaatccggaagctcatttgttgatttgttcaacaggatttcaatgctatcgccagtcaagtcaagtttcgacgaagaagaaacgaaacaaccttcaaaagctagcagagcagtttttgactcagcacgcagaaagtcgtcttacggacattcaagagatgcctcactttctgaaatgaaaaagcataggagaaactcttctatattatcttttttttcttcaaaaagtcagtctaatccaacgtcaccaaccaaacaaactttcactatcgatcccgcaaagatgacttcccattctcgttctcagtcgaattcctattcgcatgcaagatcacaatcttactcccatagtagaaaacactcgttagttaccagccccttgaaaacttctttaagccctataaattccaaatccaatattgctttagcgcatagcgaaactcctactagtagtaataataaggaggcagtatcacaaccaagtgaagggaagcacaagcacaagcacaagcacaagagcaagcacaaacacaagaacagtagctccaaagatggctcttccgaagaaaaaagcaaaaagaaattatttagtagcaccaaagaatcatttgtaggaagcaaggaattcaaaagatctcccagtgaacttacccaaaaatctaccaaatcgatacttcccaggtcgaatgctaaaaagcaacaaacatctgcttttaccgaaggtatacgctctatcacagcaaaggaatctatgcaaactgcggactgttcaggctggatgagcaaaaaaggtaccggtgctatggggacttggaaacaacggtttttcacacttcatggaacaaggctttcttattttacgaataccaatgatgagaaggagcgtggcctgatagatataacggcacatagggtcttacctgccagtgatgatgataggctcatttccttatacgctgcgagcttaggaaaaggaaaatactgtttcaaattggtccctccgcaaccggggtccaaaaaggggctaacctttacagaacctcgcgttcactattttgcagttgagaataaatctgaaatgaaggcatggctgtcagccataataaaggccactattgatattgatacaagcgtccctgtcattagttcatatgccacaccaacgatacctctaagcaaggcacagacgctattggaagaagctaggttacaaacccagttaagagatgctgaagaggaagagggaagagatcaatttggatgggatgacacccaaaataaaagaaattctaattatccaatcgaacaagatcaatttgagaccagcgattacctggaaagttcagcatttgaataccctggtggcagactttga

SEQ ID NO: 25094 - DNA, 2274 bp, Saccharomyces cerevisiae
atggcggtaaatcctgagttagcaccgttcaccctctcgagaggaatccccagctttgatgatcaagctttgagcaccatcatacagcttcaggactgcattcagcaggctattcagcagttgaactacagtaccgcagagtttttggccgaactgctctatgctgaatgctccattctcgataaatcaagtgtttactggtccgatgcggtatatttatatgcactttcgctgtttctgaataaaagctaccacactgcgttccagatatccaaagaattcaaggagtatcatcttggtatcgcttacatattcgggcgttgtgctttacagctttcgcagggagttaacgaagctatcctcactcttctctcaataataaatgtattttcttcgaacagcagtaatacgcgcataaatatggtgttgaattctaatctcgtccatattcccgatttggccactttgaattgcctgttaggcaatctttatatgaaactggaccattctaaggagggagcattttatcattctgaagcattagccattaatccttacctttgggaatcttacgaagcgatttgtaaaatgagagctaccgtggatctcaagagggtttttttcgacattgcagggaaaaaaagtaatagtcataataataatgcagcttcatcgtttccgtctacatcactatcgcatttcgaacctcgttcacaacctagcttatattcaaaaacaaacaaaaacggcaataataatatcaataataatgttaatacactgtttcagtcgtctaattctcccccttctacatcggcatcttctttttcttccattcagcatttctcaaggtcacagcagcaacaagcgaacacatcaataaggacctgccagaacaaaaatactcaaactcctaaaaaccctgcaatcaacagtaagacgtcttctgcgctaccaaataacatttccatgaacttagtgtctccatcctccaaacagcctacaataagctcgttggccaaagtttataacagaaacaaacttttaacgactcctccatcgaaactgttaaataacgataggaaccaccaaaataacaataataataataataataataataataataataataataataataataataataataataataacattataaataaaacaactttcaaaactccaagaaacctatattcctcaacaggaaggttaacaacttccaagaaaaatccaaggtctttaataatcagtaactcaatactaacgagtgattatcaaattacgctgcctgaaatcatgtataatttcgctttaatattaaggtcgtcatcacaatacaattcgttcaaggcaataagactgttcgagtctcaaatcccatctcatattaaagacacaatgccatggtgtctagtgcaattaggaaaacttcattttgagatcattaattatgatatgtccttaaagtatttcaatagattgaaagacctacaaccggcaagggtaaaagatatggaaattttttctactttgctgtggcatttgcatgacaaggttaaatcttcaaatttggcaaatgggctaatggatacaatgcctaataagcccgaaacatggtgttgtataggtaatttgctatcattgcaaaaggatcatgatgccgcaataaaagccttcgaaaaagctactcagttagacccaaattttgcatacgcgtatactttgcaaggtcatgaacattcttccaacgattcttcggattctgccaagacatgctatagaaaggcgctagcttgtgatcctcagcattacaatgcatattacggattgggtacgagcgctatgaaattaggtcaatatgaagaagcgttgttatattttgaaaaggcaaggtcaattaatcccgtcaatgttgtgttaatctgttgttgcggtggttctttagaaaagctgggctataaggaaaaggctctacaatattatgaactagcatgtcatttgcaaccgacttcctcgctatccaaatataagatgggccagttgctctattccatgacaagatataatgttgctttgcaaacttttgaagaattggtgaaactcgttcctgatgatgccacagcccattatttgctgggtcaaacatatagaatagttgggaggaaaaaagatgcaatcaaggagctaactgttgctatgaatttggatccaaagggtaaccaagttatcatcgatgaattacaaaaatgtcatatgcaagaa

SEQ ID NO: 25095 - DNA, 1377 bp, Saccharomyces cerevisiae
atggaaggtgaacagtctccgcaaggtgaaaagtctctgcaaaggaagcaatttgtcagacctccgctggatctgtggcaggatctcaaggacggtgtgcgctacgtgatcttcgattgtagggccaatcttatcgttatgccccttttgattttgttcgaaagcatgctgtgcaagattatcattaagaaggtagcttacacagagatcgattacaaggcgtacatggagcagatcgagatgattcagctcgatggcatgctggactactctcaggtgagtggtggaacgggcccgctggtgtatccagcaggccacgtcttgatctacaagatgatgtactggctaacagagggaatggaccacgttgagcgcgggcaagtgtttttcagatacttgtatctccttacactggcgttacaaatggcgtgttactaccttttacatctaccaccgtggtgtgtggtcttggcgtgcctctctaaaagattgcactctatttacgtgctacggttattcaatgattgcttcactactttgtttatggtcgtcacggttttgggggctatcgtggccagcaggtgccatcagcgccccaaattaaagaagtcccttgcgctggtgatctccgcaacatacagtatggctgtgagcattaagatgaatgcgctgttgtatttccctgcaatgatgatttctctattcatccttaatgacgcgaacgtaatccttactttgttggatctcgttgcgatgattgcatggcaagtcgcagttgcagtgcccttcctgcgcagctttccgcaacagtacctgcattgcgcttttaatttcggcaggaagtttatgtaccaatggagtatcaattggcaaatgatggatgaagaggctttcaatgataagaggttccacttggcccttttaatcagccacctgatagcgctcaccacactgttcgtcacaagataccctcgcatcctgcccgatttatggtcttccctgtgccatccgctgaggaaaaatgcagtgctcaatgccaatcccgccaagactattccattcgttctaatcgcatccaacttcatcggcgtcctattttcaaggtccctccactaccagtttctatcctggtatcactggactttgcctatactgatcttttggtcgggaatgcccttcttcgttggtcccatttggtacgtcttgcacgagtggtgctggaattcctatccaccaaactcacaagcaagcacgctattgttggcattgaatactgttctgttgcttctattggccttgacgcagctatctggttcggtcgccctcgccaaaagccatcttcgtaccaccagctctatggaaaaaaagctcaactga

SEQ ID NO: 25096 - DNA, 1947 bp, Saccharomyces cerevisiae
atgtctagagcagttggtattgatttgggaacaacttactcgtgtgttgctcatttttccaatgatagggtagagataattgcaaatgatcaaggtaataggaccactccatcgtatgtggctttcacagacaccgaaagattaattggtgacgccgccaaaaatcaagctgcaatcaatcctcataatacagtttttgatgcaaagcggttaattggtcgtaaatttgatgatcctgaagtgacgacagatgccaagcacttccctttcaaagttatatccagagatggtaaacctgtagtgcaagtagaatataagggtgaaacgaaaacatttacgcctgaggaaatttcttccatggttttaagcaaaatgaaggaaactgctgagaactatttgggaactacggtcaatgatgctgttgtaactgttcctgcatatttcaatgattctcaaagacaagccactaaggatgcaggaactattgcagggatgaacgttttacgtattatcaatgaacccactgcagcagcaattgcttatggcttggataagaaaggcagggctgagcacaatgtcctgatttttgatttgggtggtggtacttttgacgtctctttactttcaattgatgagggtgtttttgaggttaaggctaccgcaggagacactcatttaggtggtgaagattttgataataggttggtgaaccatttagccactgaattcaaaaggaaaacgaaaaaggacatctctaataatcaaagatcgttaagaagattgagaactgcggcagaaagagctaagagagcgctttcttcctcatctcaaacctcgatcgagatcgattctttatttgaaggtatggatttctacacttcgttaacaagggcaaggtttgaagagctatgtgctgatttattcagatccacattggaaccagtagaaaaggttcttaaagattcgaagctggacaagtcccaaattgatgagattgtgttagtcggtggatctaccagaatcccaaagattcagaaattagtttctgacttcttcaatggcaaagagcctaatcgttctatcaacccggatgaggctgttgcttatggtgcagccgttcaagctgccattttaaccggcgatcaatcaacaaagacacaagatttactattattggatgttgcgccattgtccctaggaattgaaactgcaggcggcataatgactaagctaattcctagaaactcaacgattccaacaaagaaatcggaaaccttctctacctatgcagataatcaacctggtgttttaattcaagtctttgaaggtgaaagaacaagaacaaaggataataacttacttggtaaattcgaattaagtggcattccgcctgctcccagaggtgtgcctcaaattgatgttacctttgatatcgacgctaatggtattcttaatgtgtctgctttggaaaagggtactggtaagagtaacaaaatcacgatcactaacgataaaggtaggctctcgaaggatgatattgataggatggtttctgaagctgaaaaatatagggctgacgatgaaagggaggcagaacgagttcaggctaagaatcagcttgaatcgtatgcatttactttgaagaataccataaacgaagcaagtttcaaagagaaagtaggtgaagatgatgcaaagagattagaaacagcgtctcaggaaaccattgactggttagatgcatcgcaggcagcctctacggacgaatataaggatagacaaaaggagttggaaggcattgccaatccaataatgacgaaattttacggtgctggtgccggcgcaggtcctggagcgggggaatccggtggattccccggatccatgcccaactcgggtgctacgggaggtggagaagatacaggtccaacagtggaagaggttgat

SEQ ID NO: 25097 - DNA, 1068 bp, Saccharomyces cerevisiae
atggtcatcgaccttgagcatgtggtagactacataatgcacatagactctcagcttcaactccacaaggcttctccagcaaaaatgaattcagagtctcgagaagatatggctataaatagtatcaaattgctagcgggaaactcccatcctgatttggctgaacaaatatcgaaaaagttaggtattccactttccaaagttggtgtgtaccagtattctaataaagaaacctctgtcaccataggtgagagccttcgcgacgaagatgtgtatattatccaaactggaataggtgaacaagaaattaatgatttcttgatggaattattaattttaattcatgcttgccaaattgcatctgcaagaaagatcactactgtaatacccaattttccatatgcaagacaagacaagaaagataaatcccgggcgcccattaccgcaaagttggttgccaatttattgcaaactgctggtgctgatcatgtcatcacaatggatctccatgcctcccaaattcaagggtttttccatatcccggttgacaacctatatgcagaaccaagtgttttaaattatattagagcccggaaaacagatttcgacaatgctattttggtgtcgcctgatgcaggtggtgctaagagagtagctgctttggctgacaagttagatttaaattttgctttgattcacaaagagaggcaaaaagctaacgaggtttcaaaaatggtgcttgttggtgatgttaccaataaatcatgtttattagttgatgatatggcggatacttgtggtacgttggtaaaagcttgtgatacgttgatggagcatggtgccaaagaagttatagctattgttacacacggtattttctccggttcagcaagagaaaagctaagaaatagtagattgtctagaattgtttgcacaaataccgttccggtagatttggatttacctattgctgaccagatcgatattagtcccacgttcgctgaagctataagaagactacacaatggtgaatccgtgtcatatttgttcacccatgctccagtatag

SEQ ID NO: 25098 - DNA, 2064 bp, Saccharomyces cerevisiae
atgatcagaagatggctaactataagtaagtctgggaagaagaaaaaggctgttaatgataccattacagaagaagtagaaaaggttgactttaagcctgtaaaccacgatataaatgatgaactctgttatagcgaatcatccgataatccctctagctcattgtttgtctctaatttggataccaaggaaacttttttgaatgaagacaataatttgcagatttcttccggactagactattcttctgaaacgtgcaatcaaggcagtaattacagccaggatgggatattttatatttcaaacgcaaaggctataaacgcatacggaggcattatcacgcaagggcccgaggcacccatattagctatgaaggtgtccgactcaatgccctatggagacggctccaacaaagtttttggatacgaaaattttggcaatacatgttactgtaactcagttcttcaatgtctctataatctgtcctcattacgtgaaaatatattgcaatttccaaaaaaatcaagagaatctgatcacccaagaaagaaagaaatgagaggtaagaaaccaagaatatttaccgaagcaagttttgagaaaagcattgctggtaccaatggacatttgcctaaccctaaacctcaatctgttgatgatggaaagcctacccctgtaaattctgtaaattcaaatacagctgggccttcagagaagaagagtaaattttttaaaagttttagcgcgaaacatgtacaagacaataataaaaaggaaggaagtcctgctatattaaccactggaaaaccctcttctcgtcctcaagacgcacctccattgatagtcgaaacacctaatgagcctggtgctccgagcagattgagtttcgagaacgtcacagatagacctccggatgttccgcgtaaaataattgttggcagagttctcaattatgaaaatccttcaagaggtagcagtaatagtaataacctggacttgaaaggagaaagtaatagcagcttatccactccacttgataaaaaagatactagaagatctagttcctcttctcaaatatccccagaacatagaaagaaatccgcacttattcgtgggccagtgctcaatattgaccatagcttaaacggctcagataaggctactttgtattccagtttgagagatatctttgaatgcataactgagaatacgtatttaactggtgttgtatcgcctagctcttttgttgatgttctcaaaagagaaaatgtattatttaatactactatgcatcaggatgctcacgaatttttcaatttcttattaaacgagttgagtgaatatatagaacgtgagaataaaaaaatagcagccagtgatatcaacagcgatagcgaaccgagtaagagtaaaaatttcatcagtgacttgtttcaaggcactttaacgaatcaaataaaatgtctgacgtgcgataacattacatctagggatgagccatttttggatttccccatagaagttcagggagatgaggaaacagatatacaggaaattttgaaaagttatcaccagcgagaaatgctaaatggctcaaacaagttttattgtgacgaatgttgcggtttacaggaggcagagagattagttggtttgaagcaattgcctgatactttaacattacacttgaaaagattcaagtattctgagaaacaaaactgtaatattaagctttttaataacattcactatcctctgacgctaaatgtttgctcttcaataaattctaaggtttgtcaaaagtatgaattggctgggattgtcgttcatatgggcggtggcccacaacacggccattatgtttccctatgtaaacatgaaaagtttggctggttgttatttgatgacgaaacggtagaggcagttaaagaggaaacagtgttagaattcacaggtgaatctccaaatatggcaacagcatatgtttgttttataaagcgatgtattcaaacgctgttgaaaagaatgatcgtgaaaatatggcaaaagaacaagatgataata

SEQ ID NO: 25099 - DNA, 783 bp, Saccharomyces cerevisiae
atgtttagtagaatttgtagcgctcaattaaagaggacggcatggacccttcctaagcaggctcacttgcaatcacagacgattaaaacatttgccacagcacctattctgtgcaaacaattcaaacaaagtgatcaaccaagactaagaataaactctgatgctcctaactttgatgctgacacaacggttggtaaaatcaatttttacgactacttgggcgactcttggggggtcttgttttctcacccagcagatttcacccctgtctgcaccaccgaagtcagcgcattcgccaaattgaagccggaattcgacaagagaaatgttaaattgatcgggctttcagtggaagatgttgagtcccacgaaaaatggattcaagacatcaaggaaatagcaaaggttaaaaatgttggtttcccaataattggtgacacttttagaaacgtggcattcctatatgatatggtagatgccgaaggattcaaaaatatcaatgatgggtcactgaagaccgtgaggtctgttttcgtcatcgatcccaagaagaagattagactgatttttacctacccttccaccgtcggaagaaacacttctgaagtgttaagggtaatcgacgccttgcaattgactgacaaggagggcgtagtaactccaattaattggcagccagctgacgatgtcattattcctccctctgtctccaatgatgaggcgaaggctaaatttggtcaatttaatgaaattaaaccctatttaagattcaccaagtcgaaa

SEQ ID NO: 25100 - DNA, 3336 bp, Saccharomyces cerevisiae
atggctcgttcttccttgcccaaccgccgcaccgcccagttcgaagcgaacaagaggaggaccattgcacatgctccatctccaagtctttcaaatgggatgcacactctaacgccgcccacctgtaacaatggtgctgccacttcagactccaatatacatgtatatgtaaggtgcagatcgcgtaataagcgagaaatagaggaaaaaagtagtgtagttatatctacactaggcccacaagggaaagaaatcattctgtccaacggttctcaccaatcgtattcgtcctcgaagaaaacttaccaatttgatcaggtgttcggcgcagaatctgaccaggaaacagtgtttaatgccactgcaaaaaactacattaaggaaatgttgcacgggtacaattgtacaatatttgcatacggtcaaacgggaacaggtaaaacctacactatgtctggcgatataaatattctcggtgatgtgcaatctaccgataatctattattaggagagcatgcaggtatcataccacgggttctggtcgatttgtttaaagaattgagctccttaaataaagagtactccgtaaaaatatcctttttagagttgtacaatgaaaatttgaaagatctgctctctgatagtgaggacgatgatcctgcagtcaacgatcccaagaggcagattcgtatttttgacaataacaacaataattcatccatcatggtcaaggggatgcaggaaatctttattaactctgcacacgaaggcttgaatttgctaatgcagggttcgttaaaaaggaaagtggccgctactaaatgcaacgatctttcatcaaggtctcacaccgtctttacaatcacaacaaacatagttgagcaagatagcaaagaccatggacaaaacaaaaattttgttaaaattggcaaattgaatttggtggatttggcaggcagtgaaaacatcaacagatcgggtgcggagaataaaagggctcaagaagctggcctaataaacaaatcgctgctaacactaggccgtgttatcaacgcactcgttgatcattctaaccatataccttacagagaatctaagctaacaagattgctacaagactctttaggtggtatgacgaaaacatgcattatcgcaactatatcacctgcgaaaatatccatggaagagactgcaagtacgctagaatatgcaacgagagccaaatcaattaagaatactccacaagtaaatcagtctttatcgaaggatacatgtctcaaagactacattcaagagattgaaaaattaagaaatgatttgaaaaattcaagaaacaaacaaggtatatttataactcaagatcagttggacctttacgagagcaattctatcttgattgatgagcaaaatctaaaaatacataacctgcgagaacaaattaaaaaattcaaagaaaactacctgaaccaattagatatcaataatcttttacagtctgaaaaggaaaaactaattgccataatacagaattttaatgtcgatttttctaacttttactcggaaatccaaaaaattcaccatactaatctcgaactaatgaatgaagtcatacaacagagagatttttcactagaaaattctcaaaaacagtataatacgaaccagaacatgcaattaaaaatctctcaacaagttttacagactttgaacactttacagggctctttaaataattataactctaaatgttccgaagttatcaaaggcgtcaccgaagaactaaccaggaacgtaaatacccataaggcgaaacacgattctactctcaaatcgttattaaacattactactaacttattgatgaatcagatgaacgaactggtgcgtagtatttcgacttcattggaaatatttcagagtgattctacttctcactatcgtaaagatttgaatgaaatctaccaatcacatcaacaatttctaaaaaatttacaaaacgatattaaaagctgtcttgattcgataggcagttcaattctaacttccataaacgaaatatcgcaaaattgcaccactaacttgaatagtatgaatgttttaatagaaaaccagcagtcaggatcatcgaaattaattaaagagcaagatttagaaataaaaaaactgaaaaacgatctgatcaatgagcgcaggatttctaaccaattcaaccaacagttggctgaaatgaagcgatattttcaggatcacgtttccaggacgcgtagtgaattccacgacgaacttaacaaatgtatcgataacctaaaagataaacaatctaagttggatcaagatatctggcagaagacggcctctattttcaacgaaacagatatcgtagttaataaaattcattccgactcaatagcatccctcgctcataatgctgaaaacactttgaaaacggtttctcagaacaatgaaagctttactaacgatttaatcagtctatcacgcggaatgaacatggacatatcctccaaactgagaagtttgcccatcaatgaatttttaaacaagatatcacaaaccatttgtgaaacctgtggcgatgataacacaatcgcatcaaatccagtattgacctctattaaaaaatttcaaaatataatttgttcagacattgccctaacaaatgagaagatcatgtcattaatagatgaaatacaatcacaaattgaaaccatatctaatgaaaacaatatcaatttgattgcaataaatgaaaattttaattctttgtgcaattttatattaactgattacgatgagaatattatgcaaatctcaaaaacacaagatgaggtgctttctgaacattgcgagaagctacaatcactgaaaatactgggtatggacattttcactgctcacagcatagaaaaaccccttcatgagcatacaagacctgaagcgtcagtaatcaaggctttacccttattggattatccaaaacaatttcagatttatagggatgctgaaaataagagcaaagacgacacatctaattctcgtacttgtataccaaacttgtcaactaatgaaaattttcctctttcacaattcagtccaaaaaccccagtgccagtgcctgatcaacctctaccaaaagttcttataccgaaaagcataaactcggccaagtccaatagatcaaagaccttaccaaatacagagggtactggacgagaatcgcagaacaatttgaagagaagatttaccaccgagccaatattgaagggagaagaaactgaaaataatgacatactgcaaaataaaaaacttcatcaataa

SEQ ID NO: 25101 - DNA, 2091 bp, Saccharomyces cerevisiae
atggcaagttcaccgcaggtacatccatataagaagcatttaatgcaatcacagcatataaattttgataacaggggcctacagtttcaaaacagttcgttgaaggtaggtcaagatttttcagataataaagagaatagggaaaacagggacaatgaagacttcagtaccgcagaccttcctaagcggtcggcaaaccaaccgcttatcaatgagcatcttagagctgcgtcagtacctctactatcaaacgatataggcaatagtcaagaggaagatttcgttccagtcccacccccacagcttcatcttaataattcaaataatacttccttaagttctttgggaagtactcctacaaattctccgtcaccgggagcattaagacagacaaattcgagtacatctcttacgaaggagcaaataaagaaaagaactcgttctgtagatttgtctcacatgtacctgttgaatggtagcagtgatacccaattaacggctactaatgaatctgtagcagatttgtcacatcagatgatcagtcgatatttgggtggtaaaaataatacttccttagttccaaggctaaaaacaatagaaatgtatagacaaaacgttaaaaaatctaaagatcctgaagtgttattccagtatgcgcaatatatgttacaaaccgcactgactattgaatcttccaatgctcttgttcaagatagtgacaaggaaggaaatgtcagccaatctgacttaaaacttcagtttttgaaagaagcgcaaagttatttgaagaaactgagcataaagggttattcagatgcccaatacttattagcggacggctactcatccggagcatttgggaagattgaaaataaagaagcatttgtcttatttcaagcagctgcaaagcatggtcatatagaaagtgcttacagagcatcgcattgcttagaagaaggactaggaacaacaagagattctcgtaagtcagtcaattttttaaagtttgcggctagcaggaatcatccctcagcaatgtataaattgggactttattcattctacggcagaatgggtcttccaaccgacgttaatactaaattaaatggggtaaaatggttatcaagggctgcagcaagagctaatgagttgacggccgcagcaccatacgaattggctaagatttatcatgaagggttcttagatgttgtcattccggatgaaaagtatgcaatggaactatatattcaagcagcaagtttagggcatgttccttcagcaactttgttggcacagatttatgaaacaggtaatgatacagtagggcaggatacatcactttctgtacactattatacgcaggcagcgttaaaaggcgattctgtggcaatgttaggtttatgtgcatggtacttactgggagcagaacctgcttttgaaaaagatgaaaatgaggcttttcaatgggccttgcgtgcagctaatgctggtttgccaaaggcccaattcactctgggctacttctatgagcatggcaagggctgtgatcgtaacatggaatacgcatggaaatggtacgagaaagctgcagggaacgaggacaagagggcgattaataagctacgctcaagggacggtggactagccagcattggtaaaaaacagcataaaaaaaataaaagtatcagtactttgaatttattctctactgtggacagtcaaacaagtaacgtagggtcaaattcaagagtttcttcaaaatctgaaacattctttactggaaatccaaaacgtgatcgtgagccacaaggtttgcaaattaacatgaattcaaacacgaatagaaatggtattaaaacgggttctgatacaagcatcaggaaaagttcttcctcagcaaagggaatgtcaagggaagttgctgagcagtcgatggcagcaaagcaagaagttagtttatcaaatatgggcagttcaaacatgattcgtaaagattttcctgcagtaaaaactgagtcaaaaaaacctacaagcttgaagaacaagaaggataaacaaggtaaaaaaaaaaaagactgtgtaattatgtaa

SEQ ID NO: 25102 - DNA, 1272 bp, Saccharomyces cerevisiae
atggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgttggtgggttatgtccaaaaccaggatcctcacaaggtagcaacgagtacttgaaaaggaaaggttctacctctcctgaaccaaccaagggtagtagccgctctggaagtggtaacaactccaggtttatgagcttttcggatatggtaagaggtcaagctgatgatgacgatgaagatcaaccgagaaatacttttgctggtggtgaaacatccggcttagaggttacagatccttcagatcctaattcattactgaaggatttgctggaaaaagcgagaaggggtggtcaaatgggcgctgaaaacggattccgtgatgacgaagaccatgaaatgggtgccaataggtttactggaagaggttttagattagggtcaaccatcgacgcagcagatgaagtcgtagaagacaacacttcacaatcacaacgtagaccagaaaaagtcacaagagaaattacattttggaaggaaggttttcaagtggccgatggtccgctttatcgctatgatgatcctgcgaacagtttctatttgagcgagttaaatcaagggagggctccattaaagctcttagatgtgcaatttggacaagaagttgaagttaatgtatataaaaaattagatgagtcttataaagctccgacgagaaaactgggcggtttttcaggccagggccaaagactaggatctcctatcccgggtgaatcgtcacctgcggaggttccaaagaatgagacacccgctgctcaggaacaacccatgccggacaatgagccaaaacaaggcgacacctccatccaaattagatacgcaaatggcaaaagagaagttttgcactgcaattccacagatacagtaaagtttttgtatgagcatgtgacatcaaatgcgaacactgacccatcgaggaatttcaccttgaattatgcctttcctatcaaaccaataagcaacgatgagacaacattgaaggacgctgatctgctgaactccgttgtcgtgcaaagatgggcatga

SEQ ID NO: 25103 - DNA, 1407 bp, Saccharomyces cerevisiae
atgggtcaaatattgtccaatccaattatcgacaaagagcatcattctggtacggactgtttgacagcgtttggactatgtgccatgcaaggctggcgtatgtccatggaagatgcccatattgttgagccgaaccttttggctgagtctgacgaggaacatctcgcattttatggtatatttgacggtcatggtggttcttctgtagcggagttttgtggctctaaaatgatatctatactgaaaaaacaggagagcttcaagagcggtatgttagagcagtgcttaatagatacctttttagctacagatgttgagttgttgaaagatgaaaaattaaaagatgaccatagtggttgtacagcaactgtgatattggtatctcaattgaaaaagctactaatttgcgccaattccggtgatagtagaacagttctatctactggtggtaatagtaaagcaatgtcatttgatcataagcccacattgttaagtgaaaaatctcgtattgtagctgctgatggttttgttgagatggaccgtgttaatggaaatttagcgttatcaagagccataggtgattttgaattcaaatctaacacaaaattgggacctcatgagcaagtcgttacatgtgttcctgatatcatttgtcacaatttgaattatgatgaggatgaatttgttattttagcatgtgatggtatttgggattgtttaacttctcaagagtgtgttgacttggttcactacggtataagtcaaggtaatatgacgttgagcgacatttcatctagaatcgtagatgtttgttgttcacccacaactgaaggctcaggaattggctgtgataatatgagtatttccattgttgctttactaaaggaaaatgaatctgagtcacaatggtttgagcgtatgagatcaaaaaattacaatatccaaacgtcttttgtccaaagaaggaaaagtatttttgatttccatgatttttcggatgatgataacgaagtgttcgcaataaccaccaaaaaattacaagaccgcttgaatcgtagtaaagataatgacgacatggaaattgatgatcttgataccgaattggacagcagtgctactccctcaaagttatcaggtgaggatagaactggccctattgacttgttttcgttggaggctctattagaagccgggattcaaataaggcagaggcccagctccgacagtgacggcaacacttcttatttccatggtgcttctttatcagatatgttggcatctttaagcaatgcggctgcaggagaaacagaacctaatgatgctgatgataacgatgataacgacggcgaagaaaacggcaagaatgaaaatgcgaagaagggttccaagattgaagaaattgaataa

SEQ ID NO: 25104 - DNA, 4143 bp, Saccharomyces cerevisiae
atggcatctattacttttagaactccattatcctctcaggaacaagccttttataatcagaaatttcaccaattggatacggaagatctcggggtggtcactggcgaggcagtcagaccgctcttcgcgtcttctggtcttccagggcaattactatcgcaagtgtgggctaccgtcgatatagacaataaagggtttttgaacttgaacgagttttcggctgctttgagaatgatcgctcaattgcaaaatgctcccaaccaaccaatttccgctgccctatatgagagcacacctactcaactggcttctttttctataaatcagaacccagcccctatgcaaagcggtagtgcaaccggcaatacaaacaacactgatattcctgccttatcctcaaatgatattgctaaattttcacaactgtttgataggacagcaaagggtgctcaaactgttgctggtgataaagccaaggatatatttttaaaggcaagattaccaaatcaaactttaggtgaaatttgggctctttgtgatagagacgcatccggtgtcttagacaaatctgagtttataatggccatgtatttgatccaactatgtatgtctcatcatcctagtatgaacacaccaccggccgtgttgcctactcagctgtgggattctattcgtttagaacctgttgttgttaatcaaccaaacaggactactcctttgagtgctaactccactggcgtatcttcactaacaagacactctactatatcacgtctatctactggtgcattcagtaatgctgcttcagattggtctttaagttttgaaaaaaaacaacagtttgatgcaatttttgattcattagataagcaacatgctggttcgctaagctctgctgtgttggttccattcttcttatcctctagattaaaccaagagacgttagccaccatctgggacttagctgacatccacaacaatgctgaattcaccaaattggaatttgctattgccatgttcttaattcaaaaaaagaatgctggtgtcgaattaccggatgttatccccaatgaattattacagtcccccgctttaggactttatccgccaaacccacttcctcaacaacaaagtgcacctcaaattgccatcccctcaagagcaagtaagccttctttacaggatatgccacaccaagtttctgccccagcagttaatactcaaccaacagttccacaagttcttcctcaaaactcaaataacggttctttgaatgatttactggctttgaacccttcattcagctctccttctcccactaaagcacaaactgtggttcaaaacaacacaaataatagtttttcatatgataataacaatggccaagcaacattacaacaacaacagccacagcagcctccacctttaactcactcctcctctggattgaagaaatttactcccacctcaaacttcggtcaaagtataatcaaggaagaaccagaggaacaagagcaactaagggaatccagtgatacttttagcgctcagcctccgccagttccaaaacatgcttcaagtccagtcaaacgtacagcttcaacaacactgccacaagttcccaacttttctgtgtttagcatgccagcaggcgctgccactagcgctgccactggtgctgctgtaggcgccgcagtgggtgctgctgctttaggcgcatccgctttttcaagatcttccaataatgcattcaagaaccaggatttatttgcagatggtgaagcttctgctcagttatctaatgctaccacagaaatggctaatttatctaaccaagtaaactccctgtccaagcaggcaagtataactaatgacaaaaagtcaagagcgacccaggagttgaaacgtgttactgagatgaaaaattccattcaaatcaaattgaacaatttacgttctacccatgaccaaaatgttaaacaaacggaacaactggaagcacaagtacttcaagtaaacaaagaaaacgaaacattagcgcaacagttggctgtatccgaagcaaactaccatgccgctgagtccaaactcaatgaactaactactgatttgcaagaatctcaaacaaagaacgcagaattaaaagaacaaattacgaatttgaactcgatgacagcctccttacagtcacaattaaatgaaaaacaacaacaggtcaagcaagaaaggtcaatggtagatgttaattcaaaacagctagagttgaatcaagtcacagtagcaaacttgcagaaggaaatcgatggtcttggcgaaaagataagcgtttacttaactaaacaaaaggagttaaatgactaccaaaagaccgtggaggagcaacacgcacaattacaagctaaataccaggatctgtccaacaaggatactgatttaacggaccgtgaaaaacaattggaagaacgtaacagacaaattgaagaacaagaaaatctctaccatcagcacgtttctaaattgcaagaaatgttcgacgatctatcacagagaaaagcttcttttgaaaaagctgatcaagagttaaaggagagaaacatcgaatacgctaacaatgtgagagagttatccgaaagacaaatgaatttagctatgggacaattacctgaggatgctaaggacattattgcgaaaagcgcctctaatacagatacaacaaccaaagaagccacatcaagaggaaatgttcacgaagacactgtatccaaatttgtcgaaactactgttgagaattcaaacttgaatgttaatcgggttaaagacgatgaagaaaagacagaaagaaccgaaagtgacgtatttgatagagacgttccaactttgggatctcaaagcgatagtgaaaatgccaatacaaacaacggcacccagtcaggaaatgagacagcaaatccaaacttaactgaaacattaagtgataggtttgatggtgatttgaatgaatatggtattccaagaagtcaatccttgacatcgtctgttgcaaacaatgctcctcaatccgtaagagatgatgttgagctaccggaaacgttggaagaacgtgacaccatcaataatactgcgaatagagataatactggaaacttatctcacattcctggtgaatgggaagctaccccagctaccgcttctactgatgttttgagcaacgaaactacagaagttattgaagacggaagtaccacaaaaagggctaattcaaatgaagacggtgagtcggtcagttctatccaagaatctccaaaaatctctgctcaaccaaaagcaaagacaataaatgaagagtttccaccaattcaggaattgcatattgacgaaagcgattcatcctcttcagacgatgatgagtttgaagataccagagaaattccatcagcaacagtgaagacccttcaaactccctataatgcccagcccacatcaagtttggaaatccacacggaacaagtcataaaatatcccgctccaggcacttctccttcacataatgaaggtaactcaaaaaaggcaagcaccaattccattttgcctgttaaggacgaatttgatgatgaattcgcagggttagaacaagcggctgtggaggaagataatggtgctgattcggaatctgaatttgagaatgttgcgaatgctgggtcgatggagcaatttgaaaccatagaccataaggatctcgatgacgaactacaaatgaacgcttttacagggacgttaactagttcctctaacccaactatcccaaaaccacaagtacaacaacagtcaaccagtgaccctgctcaagtaagcaacgatgagtgggacgagatttttgctggatttggtaactccaaagctgaaccaaccaaagtagctaccccaagcattccacaacaaccaattccattgaagaatgatcctatcgttgatgctagcttgtcaaaaggtccaatagttaaccgcggggttgcaactactccaaagtctctagccgtcgaggagttaagtggcatgggatttactgaagaagaagcgcacaatgccttggaaaagtgcaactgggatctagaagccgccactaactttttgttggatagtgct

SEQ ID NO: 25105 - DNA, 1371 bp, Saccharomyces cerevisiae
atgctaagaacagtaacttcaaagactgtatctaaccagttcaagaggtctttggctacagctgtagcaacccccaaggccgaagtaacgcaattatctaacggtatagttgtagccactgagcataatccttccgctcacacagcctctgtcggtgttgtcttcggctccggtgctgccaacgaaaacccttataacaacggggtttccaatttatggaagaacatctttctatccaaagaaaactctgctgttgccgccaaggaaggtttggcattgtcttccaatatctccagagacttccaatcttacattgtatcttctttgccaggttctaccgataaatcactagacttcttgaatcagtctttcatccaacaaaaggctaatttgctatcttcttctaacttcgaggccacgaagaaatctgtcttgaagcaagttcaagattttgaagaaaacgaccatcccaacagagttttggaacatttacactccaccgccttccaaaacactccattatctttgcctactagaggtactttggagtccttggagaatttagttgttgctgatctggaatcttttgccaataaccatttcttgaattcaaatgctgttgttgttggtaccggtaatatcaaacatgaggatttagtaaattccatcgaatccaaaaacctaagtttgcaaaccggtaccaagcccgtactcaagaaaaaggccgctttcttgggttccgaagttagattgagagacgacaccttgccaaaggcgtggatttcgctggctgtggaaggtgaacctgtcaattcaccaaattattttgttgctaaattagccgcccaaattttcggctcatacaacgccttcgaacccgcttctagattacaaggtatcaaattgttagacaacatacaggagtaccaattatgcgacaatttcaatcatttctctctttcttacaaagattccggtttatgggggttctctacggccacgagaaacgttaccatgattgacgacctcatccatttcactttgaaacaatggaacagattgaccatttctgtcactgatactgaagttgaacgtgccaaatcgctgttgaaattacaattagggcagttatacgaatctggtaatcccgtcaatgacgctaacttgttaggcgcagaagtcctaatcaagggctccaaactgtctctgggtgaggctttcaagaaaattgatgcaatcacagtcaaagatgttaaggcttgggccggtaagagattatgggaccaagatattgctattgctggtacaggccaaattgaagggttattagattacatgagaatcagaagtgacatgtccatgatgagatgg

SEQ ID NO: 25106 - DNA, 726 bp, Saccharomyces cerevisiae
atggccactattgcatcagaatactcttcggaggcgtcaaatacacccattgaacatcaattcaatccttacggtgataatggtggtacaatcctgggcattgcaggtgaagatttcgcagtgttagcaggcgatacaagaaatatcaccgattactcaattaattctcgttatgaacccaaggtttttgattgtggtgataacatagtcatgtcggcgaatggatttgcagcagacggcgacgctttagtaaaaagattcaaaaatagtgtaaaatggtaccatttcgaccacaacgacaaaaaactatctataaactctgcagcaaggaacattcaacatcttctgtacgggaagaggtttttcccttactacgttcatacgatcattgcgggtcttgacgaagatggtaagggcgctgtctattcgttcgacccagttggctcctacgaaagagaacagtgtagagcaggtggtgctgcggcatcattgatcatgccatttttggacaatcaggttaatttcaaaaatcaatatgagccaggtacaaacggtaaagtcaaaaagcctttgaaatacttgtccgtggaagaagtcatcaaactggtgagagactcgttcacttctgctacagaaagacatatacaagtgggtgatgggctggaaatccttattgtcaccaaggatggtgtaaggaaagaattttatgagctaaaaagagattaa

SEQ ID NO: 25107 - DNA, 2115 bp, Saccharomyces cerevisiae
atgagcggatctatcgatgtcatcactcattttgggcctgatgcagacaagccggaaatcatcactgcattagagaatttaactaaactgcatgcattgtccgtcgaggatctatacattaaatgggagcagttctccaatcaaaggcgtcaaactcacacagatctgacttccaagaacatagatgagtttaaacaatttttacaattacaaatggaaaagcgtgctaaccaaatttcatcgtcctctaaggtaaacacatccacaaaaaaaccagtgattaaaaaaagtttgaattcaagtcccttgtttggccttagtattccaaagactccgactttaaaaaaaagaaagttacatggtcccttttcactcagtgattccaagcaaacatataatgtaggctctgaggcagaaacaaatgaaaaaggaaatagttctttaaaattggagtttactccaggcatggcagaagatgctgtgggtgacagtgctccattgtcccacgctaaaagctcggatgccaagactcccggctcgtcgacattccaaactccaacaacaaacactcctaccacatcgaggcaaaatgttcctgctggtgaaattttggattctttgaaccctgaaaatattgaaatatcatctggtaatccaaatgtaggccttctttcgactgaagaaccatcatataaccaggtcaaagtagaaccattttatgatgctaaaaagtataaattcagaacaatgaggcaaaacttacaggaagcgtctgatgtcctcgatgatcaaattgaatcgtttactaagattattcaaaatcactataagttatctccaaacgacttcgctgatccaactattcaatctcagtccgaaatttatgctgttggaaggatagttccagattcgccgacctacgacaagtttttgaatccagaatcgctttccctagagacctcaagaatgggcggcgttggaagaagggtaaggttagatctatcgcaggtcaacgagctttcgtttttcttaggccaaattgtggcattcaaaggtaaaaatgctaatggggattacttcaccgttaactctattttgccgctaccttatccaaactccccagtgtccacatcgcaggaactgcaggagtttcaagcaaatttggaaggttcttctttgaaggttatcgtgacctgtggcccatactttgcaaatgataacttctccctcgaattgttgcaagaatttatcgatagtataaataatgaggtaaaacctcacgtcttgataatgtttggcccatttatagatatcacccatcctctgatagcgagtggtaaattgccaaattttccccagttcaagacacagcccaaaacattggacgagctttttttgaagttatttactcctattctaaaaaccatatcaccacatatccaaaccgtattgataccctccacaaaagatgcaatttctaatcacgccgcatatccacaagcttctttaattagaaaggctttacagctgcctaaaaggaacttcaaatgcatggctaatccttcatcttttcaaataaatgagatatacttcggttgctcaaacgttgatacattcaaagatctaaaggaagtcataaaaggcggtactacctcatcaagatatagattagatcgtgtttctgagcatattttacaacagcgcaggtattaccccatatttccaggtagtattcgtacaagaataaaaccaaaagacgtatctacgaagaaggaaaccaatgatatggaaagcaaagaagaaaaagtttatgaacatatatctggtgcagatttagacgtgagttatctgggactaacagagtttgttggtgggttctcgcctgacataatgattatacccagtgaattacaacactttgcaagagttgtccaaaacgtagttgttataaatcccggaagatttattagagcaacaggtaacaggggatcctatgcacaaattactgtccaatgccctgatcttgaagacgggaaattgacgcttgttgaaggtgaagagccagtttatctacacaacgtgtggaagcgcgctagagttgacttgattgctagt

SEQ ID NO: 25108 - DNA, 954 bp, Saccharomyces cerevisiae
atgtcttccaacgcccaagtcaaaaccccattacctccagccccagctccaaagaaggaatctaactttttgattgatttcttaatgggtggtgtcagtgccgctgtcgccaaaactgctgcatctcccatcgaaagagttaaacttttgatccaaaaccaagatgaaatgttaaaacaaggtactttggacagaaaatacgcaggtatcttagactgtttcaagagaaccgctacacaggaaggtgttatctcattctggagaggtaacactgctaacgttatccgttatttccccactcaagctttgaatttcgccttcaaggacaagatcaaggccatgtttggtttcaagaaggaagaaggttacgccaaatggtttgccggtaacttggcatctggtggtgctgctggtgccttgtcattactatttgtttactctttggattatgcaagaactagattggctgctgactccaagtcctctaaaaagggtggtgctcgtcaattcaacggtttgatcgatgtctacaagaagaccttaaaatctgatggtgttgctggtctttacagaggtttcttaccttctgtcgttggtattgttgtctacagaggtctatacttcggtatgtacgattctttgaagcctctattgttgactggttctttggaaggttcattcttggcttcattcttgttgggttgggttgttactactggtgcttctacatgttcttacccattggataccgttagaagaagaatgatgatgacctccggtcaagctgttaagtacgacggtgcctttgactgtttgaggaagattgttgctgctgaaggtgttggttctctattcaagggttgtggtgctaacatcttaagaggtgtcgcaggtgctggtgttatctcaatgtacgaccaactgcaaatgatcttgtttggtaagaagttcaaa

SEQ ID NO: 25109 - DNA, 2604 bp, Saccharomyces cerevisiae
atgtctgataatagaagacgtagacgtgaggaagatgattcggactcagaaaatgagctaccgccatcctcacctcagcaacattttagaggggggatgaacccagtttcatcacctattggttctccagatatgattaaccctgaaggtgacgataatgaagttgacgatgtaccagatattgatgaagttgaagaacaaatgaacgaagtagatttgatggacgataatatgtatgaggattatgcggctgatcataatagagatagatatgatccagatcaagttgacgacagggaacaacaagaactatctttaagcgaacgtcgccgcattgatgctcaactaaatgaaagagataggctattgagaaatgttgcctacatagatgacgaggacgaagaacaagaaggtgcagcgcaacttgatgaaatgggccttcctgtgcaaagacgaagaaggagaaggcagtatgaggacttagagaatagtgatgacgatctattgagtgacatggacattgacccattaagagaagaacttactttagaatctctgagtaacgttaaggctaacagttactcggaatggataacacaacctaatgtctcaagaactattgccagagagttaaaatcattcctgctggaatatacagatgaaacgggtcgttctgtatatggtgcacgtattagaacattaggtgaaatgaattctgaatctttggaggttaattatagacacttagcggagtccaaagccatcctggcactatttttagctaaatgtccagaagaaatgttgaaaatattcgatctcgtggctatggaggcaacagaattgcattacccagattatgcccgtattcactccgaaattcacgtaagaatctctgattttccaacaatatacagtttacgtgaattgcgtgagtctaatttgtcctctctagtacgcgtcactggggtggtgacaagaagaacaggagtcttccctcaattaaaatatgtcaaattcaattgtttgaaatgtggctccattttgggcccattttttcaagattctaatgaagaaattagaatctcattctgtacaaactgcaaatcaaaaggtccctttagagtcaatggagaaaaaactgtgtaccgaaattatcaaagggttacgctccaggaagctcccggaaccgttcctccaggccgtctaccaagacatagagaagtcattttgttggcggatttggtagatgtatccaagccaggtgaagaggtagaagttaccggcatctacaaaaataactacgatggtaacttgaatgcaaagaacggattccccgtttttgcaacaattatcgaggcaaattctataaaaagaagagagggcaatacagctaacgaaggcgaagaagggttggatgttttcagttggactgaagaagaagaacgtgaatttagaaagatttctagggatcgtggtataattgataaaattatatcatcgatggcaccgtctatctatggtcatagagatattaaaactgcagtcgcgtgctcattatttggaggtgttccaaaaaacgtcaatggaaaacattctattcgtggtgatatcaatgtgttattattaggtgatccaggtactgccaaatctcaaatcttaaaatacgtcgagaaaacagcgcatagagcggtctttgcaactggtcagggtgcttcggctgtcggtctgacagcatccgtcagaaaagatcctattactaaagaatggaccttagaagggggggcgctagtattggctgataagggtgtttgtttaattgatgaattcgataagatgaacgatcaggatcgtacatctattcatgaggctatggaacagcaaagtatttccatttccaaggccggtattgttactacattacaagcgcgctgctcaattattgctgcggcaaatcctaatggtggtagatataattcaaccttgcctttagctcagaatgttagtttgaccgagcctattctgtctagatttgatattttatgtgttgtcagagaccttgttgatgaagaggcagacgaaagattggccacatttgttgtcgattctcatgtaagatctcatccagaaaacgatgaagatcgagaaggcgaagagcttaaaaataatggcgaatcggcgatagaacaaggagaagatgaaataaatgagcagcttaatgcaaggcaaagaagacttcaaagacaaaggaagaaggaggaagagatctcgcctattccacaggaattattgatgaaatatattcactatgcgaggacaaaaatataccctaaattgcatcagatggatatggataaggttagcagggtatatgcggatttgagaagagaaagtatttctacaggttcgtttccaatcacagttcgtcatttagaatctattctaagaattgcagaatcttttgctaaaatgagattatctgaatttgtgtcttcttatgatttggatagagctatcaaagttgtagttgattcctttgttgatgcccaaaaagtcagtgttcgccgccaactccgcaggtctttcgcaatttataccttgggtcac

SEQ ID NO: 25110 - DNA, 3399 bp, Saccharomyces cerevisiae
atgctaagaacaagaaccacaaagacccttagcacagtggcgaggaccacaagagctatccaatattaccgatctatcgctaagactgctgcagtttctcaaagaaggttcgcatcgaccttgaccgtgcgtgacgtagagaatatcaaacctagccatattattaagagtccaacatggcaagagttccagcatcaattgaaggatccaaggtacatggaacactttgcacaacttgatgcacagtttgctcggcatttcatggctacaaacagcggcaaaagtattctggcgaaagatgatagtacatctcagaaaaaggatgaagatgtcaagatagtacctgatgaaaaagatacagacaatgatgttgagcccacgcgagatgatgaaattgttaataaggaccaagaaggtgaagcttcgaaaaactccagaagctccgcttctggaggtggacagtcatcatccagtcgatcggattctggagatggaagttcgaaacaaaagcctccaaaggatgtaccagaagtatacccgcaaatgctagcattaccaatagccagacggcccttatttccagggttctacaaggcggttgtgatatcggacgaaagagttatgaaggcaatcaaggaaatgttagaccgccagcaaccctacattggcgctttcatgttgaagaactcggaagaagatactgatgtaatcacagataaaaatgatgtatacgatgttggtgttctggctcaaataactagcgctttcccgagtaaagacgaaaagacgggcactgaaacaatgactgctcttttatatcctcacaggagaataaaaattgatgaattatttccaccaaacgaggaaaaggaaaaatcaaaagaacaagcaaaggatacggatactgaaacgaccgtcgttgaagacgctaacaacccagaagaccaagaaagcaccagccctgctacgcctaagttggaggatattgtggtggagaggataccagactcagaattgcaacatcataagagagtagaagccactgaagaagagtctgaagaattagacgatattcaagaaggtgaggacattaaccccacagaattcttaaaaaattataatgtttcccttgtcaatgtgttgaatttagaagatgaaccgtttgatagaaagtcacccgttattaatgcgctaacatcagaaatattgaaggtatttaaagaaatttctcaattgaacacgatgttcagagaacaaattgcaactttttctgcttcaattcaatctgcgaccacgaacatttttgaggaaccagctagattggcagattttgccgctgctgtttctgccggcgaagaagacgaattacaagacatactgtcatctttaaacattgagcacagactagaaaagtcgctactagtccttaagaaagaattgatgaatgccgaattacagaacaaaatctccaaagatgtagagacaaagattcaaaagagacaaagagaatactatttgatggaacaattaaagggcatcaaaagagaattaggtattgacgacggccgtgacaaattgattgacacttataaagaaagaatcaagtcattaaaattgcctgatagcgttcaaaaaattttcgatgatgagataactaaattaagtaccttggagacttctatgtccgaatttggcgttatcagaaactatttggattggttaacatcgatcccatggggaaaacattccaaagaacagtattccattccgagagcaaagaaaattttagatgaagatcattatggtatggtagatgtcaaggatcgtatcttggagtttattgccgtcggtaaactattgggtaaagtcgatggtaaaatcatatgtttcgtaggacccccaggtgttggtaaaacgtccataggtaaatctatcgctagagctcttaacaggaaattcttccgattttctgtaggcggtatgacggacgtggcagaaataaaaggtcataggagaacgtatattggtgccttacctggcagagtagttcaagcattaaagaagtgccaaactcaaaatcctttgattttgatagatgaaatcgataagattggacacggcggcatacacggcgatccgtccgcggcattgttagaagtattggaccctgaacaaaacaacagcttcttggataactacttggatattcctattgacttatcaaaagtgcttttcgtttgcactgctaactctttggaaactattccaagacctttactggatcgtatggaagtcattgagttgacaggatatgttgctgaagacaaggttaagattgccgagcagtatttagttccaagtgccaagaaaagcgctggtctagaaaactctcatgttgatatgacagaagatgcaataacagcgttaatgaagtactactgtagagaaagtggtgtaaggaatttgaaaaaacacatcgagaaaatataccgtaaagcagccctacaagtggtaaagaagttgagtattgaagattccccaacgtcatcagccgacagcaagcctaaagaaagcgtttcttccgaagaaaaggcggaaaataacgccaaaagctcatcggagaagactaaggacaataattcggaaaagacaagcgatgacattgaagccttaaagacctctgaaaagatcaatgtttccatatcccagaaaaacctaaaagattacgttgggcctccagtctacactacagaccggttatacgaaacaactccaccaggggtagttatggggttggcgtggactaatatgggaggttgctcactttatgtagaatctgtccttgaacaacctttacacaactgcaagcatccaacatttgaaaggaccgggcaactgggagatgttatgaaggaatcatcaaggcttgcttattcattcgccaagatgtatttagcacaaaaattccctgagaacagattttttgaaaaggcgtctatccacttgcattgtcctgaaggtgctacccctaaagatggtccatctgcaggtgtcactatggccacttccttcctttccctagcattgaataagtcgattgacccaacggttgcgatgaccggtgaattgacacttaccggtaaagttttacgtatcggtgggttgagagaaaaagctgtggccgctaaaagatctggtgccaagactattattttccctaaagataacttaaatgattgggaggaacttccagacaatgtaaaggaagggttggaacctttagctgctgattggtataatgatatattccaaaaattattcaaggatgtgaatacgaaagaaggtaattcagtatggaaggctgaatttgagattttggatgctaaaaaggaaaaggac

SEQ ID NO: 25111 - DNA, 1062 bp, Saccharomyces cerevisiae
atgccaaagagaattgtatacaatatatccagtgacttccagttgaagtcgttactgggagagggtgcatacggtgtggtatgttctgcaacgcataagcccacgggagaaatcgtggcaataaaaaagatcgaaccattcgataagcctttgttcgcattacgtacgctgcgtgaaataaagatcctgaagcacttcaagcacgaaaatatcataacaatcttcaacattcaacgccctgactcgttcgaaaacttcaatgaggtctacataattcaagagctaatgcagacagatttacaccgtgtaatctccacccagatgctgagtgacgatcatatacaatattttatataccaaaccttgagagcagtgaaagtgctgcatggttcgaacgtcatccatcgtgatttaaagccctccaaccttctcataaactccaactgtgacttgaaagtatgtgatttcggtttagcaagaatcattgacgagtcagccgcggacaattcagagcccacaggtcagcaaagcggcatgaccgagtatgtggccacacgttggtacagggcgccagaggtgatgttaacctctgccaaatactcaagggccatggacgtgtggtcctgcggatgtattctcgctgaacttttcttaagacggccaatcttccctggcagagattatcgccatcaactactactgatattcggtatcatcggtacacctcactcagataatgatttgcggtgtatagagtcacccagggctagagagtacataaagtcgcttcccatgtaccctgccgcgccactggagaagatgttccctcgagtcaacccgaaaggcatagatcttttacagcgtatgcttgtttttgaccctgcgaagaggattactgctaaggaggcactggagcatccgtatttgcaaacataccacgatccaaacgacgaacctgaaggcgaacccatcccacccagcttcttcgagtttgatcactacaaggaggcactaacgacgaaagacctcaagaaactcatttggaacgaaatatttagttag

SEQ ID NO: 25112 - DNA, 3732 bp, Saccharomyces cerevisiae
atgactgtgtttctgggcatctatagggccgtctatgcctatgagccgcagacaccagaagaactggccatccaagaagacgatctgttgtacctcttacagaagtcagacattgacgattggtggacagtaaagaaaagagtcattggttccgatagcgaagaaccggtgggtctagtgccctccacttacattgaagaagctcctgttttgaagaaggtaagagccatttatgattatgaacaggtgcaaaatgctgatgaagaattgacgtttcatgaaaatgacgtttttgatgtattcgatgataaagatgctgattggctgttggttaagtctaccgtttccaatgaattcggcttcattccaggcaattacgtcgaaccagagaatgggtccacttccaagcaggaacaggctcccgctgccgctgaagctcctgcagctactcctgcagccgctcctgcttctgctgccgtactacccaccaactttttaccacctcctcaacacaatgatagagctcgtatgatgcaaagtaaagaagaccaagctccagatgaggatgaagagggccctcctcctgccatgcctgcaagaccaacggctactaccgaaactactgatgccaccgctgcggctgttcgatctcgtacaagactatcatacagcgataacgataatgacgatgaagaggatgattactattacaacagcaacagcaacaacgttggaaatcacgaatacaatacagagtatcactcttggaacgttaccgaaatcgagggaaggaaaaagaagaaggccaagctatcaatcggtaacaacaagataaacttcataccccaaaaggggactcctcatgagtggtcaattgataaattggtctcttatgataacgaaaagaaacacatgttcttggaatttgttgatccatatagaagccttgaattacacactggtaataccaccacatgtgaagagatcatgaacattattggtgaatataaaggtgcttcccgtgatcctgggttgagagaagtcgaaatggcttccaaatccaaaaagagaggtattgttcaatatgacttcatggctgaatcacaggacgaattaaccataaaatcaggcgataaagtctacattttagatgataaaaaatctaaggactggtggatgtgccaactggttgattcagggaaaagcggtctcgttcctgcacagtttattgagcctgttcgtgacaaaaaacatactgaatctacagcaagcggtatcatcaagtctatcaagaaaaacttcaccaaatctccatctaggtcgagatctagatcaagatctaaatccaatgccaatgccagttggaaagatgatgaactacaaaacgatgttgtaggtagtgctgccggtaaaaggtcaagaaaaagttcattgtcctctcacaaaaaaaactcttcggcgaccaaagatttccccaatccaaaaaaatcgcgtctatgggttgatagaagtggtactttcaaagtggatgcagaattcattggatgtgctaaggggaaaatccacttgcacaaggctaatggtgtcaagattgctgtcgccgctgataaactatccaatgaagatttagcgtatgtggaaaaaattactgggttctccttagagaaatttaaggcgaatgatgggtctagttcccgtggcactgattcaagagactctgaaagagaaagaagaaggagattgaaggagcaggaggaaaaagaacgcgataggagattgaaagagcgtgaattatacgaattgaaaaaagccagagaactcctagatgaagaaagatcaaggttgcaagaaaaggaattgcctccaataaaaccaccaagaccaacctctactacctccgttccaaatacgacgtccgtaccaccagccgaaagcagcaataacaacaactccagtaacaaatatgattggttcgaatttttcttgaattgcggcgttgatgtaagcaattgtcaaagatatacaataaattttgatagagaacagcttactgaagacatgatgcctgacatcaataactcaatgttaagaaccttgggtctgcgcgaaggtgatattgttagagtaatgaaacatcttgacaagaaatttggaagagaaaatattgcatcaattcctacaaatgccactggaaatatgttttcacaacctgatggttcattgaacgttgctacaagtccggaaacctcactgcctcagcaattgttgccacaaacaacaagtcctgctcaaacagctccttccacatcagctgagacagatgatgcttggactgttaaaccggcttctaagtctgaatctaatttactctctaagaaatcagaatttactggttccatgcaggatttattagacttgcaacctttagaacctaaaaaggcagctgcctcgacacctgaaccaaacctaaaagatttggaacccgtgaaaactggcggcaccactgttcctgctgctccggtttcatctgctccggtttcatctgctcccgctccattggatccattcaaaaccggtggcaacaatatcttacccttatctactggctttgtgatgatgccaatgattactgggggcgatatgctgcctatgcaaagaaccggcggcttcgttgtaccacaaacaacttttggtatgcaatcgcaagttactggtggtatcctacctgttcaaaagacaggaaatgggttaattcctatctctaacactggcggcgcaatgatgccacaaactacgttcggcgcagcagctaccgtcttacctctgcaaaaaactggaggtggcctaataccaattgccaccacaggaggtgcgcaattcccgcaaacttcattcaatgttcaggggcaacaacaacttccaacaggttcaatattacctgtccaaaaaactgctaatggattaatttcagctaatactggtgtctcaatgccaactgtacaaagaacaggcggcactatgattccacaaacatcatttggcgtttcacagcaattaacaggtggtgcaatgatgacccaacctcaaaatacagggagtgccatgatgcctcaaacatccttcaatgctgtaccacaaattactggaggagcaatgatgcctcaaacgtccttcaatgctttaccacaagttacagggggagcaatgatgcctttgcagagaactggtggtgctttgaatacatttaatactggaggcgccatgattccccagacttcgttcagctctcaagctcaaaacactggcgggttccggccgcaatcccaattcggtttgactttacaaaaaaccggaggtattgcgccattaaaccagaaccagttcactggtggagccatgaatactttaagtacagggggcgttcttcaacaacagcaaccacaaacgatgaataccttcaatactggtggtgttatgcaagagctccaaatgatgactactttcaatactggtggtgctatgcaacaaccacagatgatgaacacattcaacaccgatggaattatgcaacaaccacagatgatgaacacttttaacactgggggtgctatgcaacaaccacaacaacaagcattacagaaccaacctactggatttgggtttggtaatggacctcaacaatcaaggcaagccaacatattcaatgctactgcatcaaatccgtttggattc

SEQ ID NO: 25113 - DNA, 2340 bp, Saccharomyces cerevisiae
atggtagattttttaccaaaagtaacggaaataaatcctccatccgaaggtaatgatggtgaagataacataaagccactttcaagtggttcagagcagcggccgttgaaagaagaggggcaacaaggtggtagaagacatcaccggcggttgtcctctatgcatgagtattttgacccgttttccaacgcagaggtctattatggaccaataacagatccaagaaaacagtcaaaaattcatagactaaatagaaccagaactatgagtgttttcaataaagtttctgacttcaaaaacggaatgaaggattataccctgaaaaggaggggttctgaagacgacagcttcctcagcagccaaggtaaccgtagattttatattgataatgtggatctcgctttagatgagctgctcgctagtgaggacacagacaagaatcaccaaattaccatagaagacactgggcccaaagttattaaagtcgggacggccaattccaacggtttcaaacatgtaaatgttaggggaacatatatgctttctaacttgttgcaggaactaaccattgcaaaaagtttcggacgacaccaaatatttttggatgaggcgcgtataaatgaaaaccctgttgatagattatcaagattgataacgactcaattttggacgagtttaacgagaagagttgatctttataatattgcagaaattgctagagactcaaaaatagatacgccaggcgctaaaaatccaagaatttatgttccatataactgcccagagcagtacgaattttacattcaggcatctcaaatgaacccgtccttaaaacttgaagtggagtacttaccaaaagatattacagcagagtatgttaaatcattaaatgatacaccgggtttgttagccctggctatggaagaacacgttaatccatctactggtgaaaggtccctagttggttatccttatgcggtacctggcggtagattcaatgaattgtatggctgggattcatatttaatggcactgggactcatagaaagtaataaggttgatgttgcaagaggtatggtggagcattttatattcgaaattgatcactatagtaaaattttgaatgctaataggagttattatctttgcagatctcagccaccattcctaaccgatatggctctgctcgtatttgaaaagataggaggtaagaataatccaaacgctattcagttgttaaaacgcgcgttcagagctgctattaaagaatataaagaggtgtggatgtcgagccctaggttagattctctgacagggctgtcttgttatcattctgatggtattggtatccctccggaaactgaaccagatcattttgatactatattattaccgtatgctgaaaagtacaatgttactctggaaaagcttaggtacctttataacgaaggcatgattaaagaacccaaactggatgcattttttttacatgatcgtgccgtgagagagtcaggacatgacacgacttataggtttgaaggtgtatgtgcatatttagcgacaattgatctaaactccttgctctataaatatgagaaagatattgctttcgtcattaaggagtattttggtaatgaatataaagatgagaatgatggaacggtaaccgattctgaacactgggaggagctagctgaactgaggaaaacaaggattaataagtatatgtgggacgaagattcagggtttttcttctattataacacgaaactgaaatgcagaacgtcttatgagtctgcaacgactttttggagtttgtgggctggtcttgcaactgaagagcaagcaaaaatcacagtagaaaaagctcttcctcagttagaaatgctcggcggactagttgcatgcacagaaaaatcaagaggtcctatttctattgatagaccgatcaggcaatgggattatccttttggttgggcgccgcaccaaatattagcctggaaaggtttatctgcatatggttatcaacaagtagctacaagattggcttataggtggctgtacatgattacaaaatcatttgttgattataacggaatggtggtagaaaaatatgatgtgacaagagggactgatccgcatcgcgttgatgcggaatatggtaatcaaggtgctgattttaagggcgtcgctacagaaggctttggttgggtgaacacaagttatttgctcggattgaaatatatgaataatcatgcaagaagggctctcgctgcttgtagtccaccattgccatttttcaatagtttgaaaccctctgagaaaaaattgtattaccta

SEQ ID NO: 25114 - DNA, 1422 bp, Saccharomyces cerevisiae
atgtttcaaaggtctggcgctgctcatcacatcaaattgatttcatctcgaagatgccgctttaaatcctcctttgcagttgctttaaacgctgccagtaagttggtaactcccaagattctttggaataatcccatatcattagtctcgaaggagatgaacacattggccaaaaatatagttgccctcatcgggtctggccatccggtgctaaacaaggttactagttactattttgaaacagaaggcaaaaaagtacgtcccttgttagtgttgttgttgtcaagagcactttctgaaattcccatgacagaaagaaatcacttgaaaattgacaagtcggatgttcctgaggacccaatttactctaaacctagtcaaaatcaactatttcaacgtcctgcaagtagcatatccccactacatattcttcacggtattaaaccactaaatcccttgacaaaaggtcctgagcctttgccagaagaaacttttgacaaacaaagagggattttacccaaacagagaagattagcagagattgtagagatgatacacactgcgtctttacttcatgatgacgttattgatcattctgatacaagaagaggaaggccaagcggaaatgctgcctttaccaacaagatggccgttttggcgggtgattttctcttagggagagcaacagtgtcaatttcaagattacacaaccccgaagtcgtagaactaatgtctaatagtattgcgaatcttgtcgaaggtgagttcatgcaactgaaaaatacttccattgacgcggatatcgataccatcgaaaatggccataagctacttccggttccttctaaaaagcttgaagttaaagagcacgactttcgtgttccaagccgccaacaggggctgcaattatctcatgatcagattatagaaactgcatttgaatactacatacacaagacctatctgaagactgctgctttgatatcaaaatcttgcagatgtgctgctatattatctggggcatcacctgccgttatcgacgaatgctatgatttcggtagaaatctaggtatatgtttccaactcgtagatgatatgcttgattttactgtgtctggaaaagatttagggaagccatccggcgcggatctaaaattaggtattgctactgctccagtcttgtttgcatggaaagaagacccatctttaggtccactaatttcacgcaatttttcagagaggggtgatgttgaaaaaactattgattctgtgagactccataatggtatagcgaagacgaaaatactagcggaggaatatagggacaaggcattacaaaatctacgggattctcttcctgaatctgatgctcgttctgccctagagtttttaactaatagtatactaacaagaagaaagtaa

SEQ ID NO: 25115 - DNA, 1308 bp, Saccharomyces cerevisiae
atgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctcgcaaccatcattactttagaaaatggtaaagctctaggggaagctaaaggagaaatcaaatacgcggcttcgtattttgagtggtacgccgaggaagcaccccgcttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacacttaa

SEQ ID NO: 25116 - DNA, 1098 bp, Saccharomyces cerevisiae
atgactgctgaagaatttgatttttctagccattcccatagacgttacaatccactaaccgattcatggatcttagtttctccacacagagctaaaagaccttggttaggtcaacaggaggctgcttacaagcccacagctccattgtatgatccaaaatgctatctatgtcctggtaacaaaagagctactggtaacctaaacccaagatatgaatcaacgtatattttccccaatgattatgctgccgttaggctcgatcaacctattttaccacagaatgattccaatgaggataatcttaaaaataggctgcttaaagtgcaatctgtgagaggcaattgtttcgtcatatgttttagccccaatcataatctaaccattccacaaatgaaacaatcagatctggttcatattgttaattcttggcaagcattgactgacgatctctccagagaagcaagagaaaatcataagcctttcaaatatgtccaaatatttgaaaacaaaggtacagccatgggttgttccaacttacatccacatggccaagcttggtgcttagaatccatccctagtgaagtttcgcaagaattgaaatcttttgataaatataaacgtgaacacaatactgatttgtttgccgattacgtcaaattagaatcaagagagaagtcaagagtcgtagtggagaatgaatcctttattgttgttgttccatactgggccatctggccatttgagaccttggtcatttcaaagaagaagcttgcctcaattagccaatttaaccaaatggtgaaggaggacctcgcctcgattttaaagcaactaactattaagtatgataatttatttgaaacgagtttcccatactcaatgggtatccatcaggctcctttgaatgcgactggtgatgaattgagtaatagttggtttcacatgcatttctacccacctttactgagatcagctactgttcggaaattcttggttggttttgaattgttaggtgagcctcaaagagatttaacttcggaacaagctgctgaaaaactaagaaatttagatggtcagattcattatctacaaagactg

SEQ ID NO: 25117 - DNA, 2097 bp, Saccharomyces cerevisiae
atgacagctcagttacaaagtgaaagtacttctaaaattgttttggttacaggtggtgctggatacattggttcacacactgtggtagagctaattgagaatggatatgactgtgttgttgctgataacctgtcgaattcaacttatgattctgtagccaggttagaggtcttgaccaagcatcacattcccttctatgaggttgatttgtgtgaccgaaaaggtctggaaaaggttttcaaagaatataaaattgattcggtaattcactttgctggtttaaaggctgtaggtgaatctacacaaatcccgctgagatactatcacaataacattttgggaactgtcgttttattagagttaatgcaacaatacaacgtttccaaatttgttttttcatcttctgctactgtctatggtgatgctacgagattcccaaatatgattcctatcccagaagaatgtcccttagggcctactaatccgtatggtcatacgaaatacgccattgagaatatcttgaatgatctttacaatagcgacaaaaaaagttggaagtttgctatcttgcgttattttaacccaattggcgcacatccctctggattaatcggagaagatccgctaggtataccaaacaatttgttgccatatatggctcaagtagctgttggtaggcgcgagaagctttacatcttcggagacgattatgattccagagatggtaccccgatcagggattatatccacgtagttgatctagcaaaaggtcatattgcagccctgcaatacctagaggcctacaatgaaaatgaaggtttgtgtcgtgagtggaacttgggttccggtaaaggttctacagtttttgaagtttatcatgcattctgcaaagcttctggtattgatcttccatacaaagttacgggcagaagagcaggtgatgttttgaacttgacggctaaaccagatagggccaaacgcgaactgaaatggcagaccgagttgcaggttgaagactcctgcaaggatttatggaaatggactactgagaatccttttggttaccagttaaggggtgtcgaggccagattttccgctgaagatatgcgttatgacgcaagatttgtgactattggtgccggcaccagatttcaagccacgtttgccaatttgggcgccagcattgttgacctgaaagtgaacggacaatcagttgttcttggctatgaaaatgaggaagggtatttgaatcctgatagtgcttatataggcgccacgatcggcaggtatgctaatcgtatttcgaagggtaagtttagtttatgcaacaaagactatcagttaaccgttaataacggcgttaatgcgaatcatagtagtatcggttctttccacagaaaaagatttttgggacccatcattcaaaatccttcaaaggatgtttttaccgccgagtacatgctgatagataatgagaaggacaccgaatttccaggtgatctattggtaaccatacagtatactgtgaacgttgcccaaaaaagtttggaaatggtatataaaggtaaattgactgctggtgaagcgacgccaataaatttaacaaatcatagttatttcaatctgaacaagccatatggagacactattgagggtacggagattatggtgcgttcaaaaaaatctgttgatgtcgacaaaaacatgattcctacgggtaatatcgtcgatagagaaattgctacctttaactctacaaagccaacggtcttaggccccaaaaatccccagtttgattgttgttttgtggtggatgaaaatgctaagccaagtcaaatcaatactctaaacaatgaattgacgcttattgtcaaggcttttcatcccgattccaatattacattagaagttttaagtacagagccaacttatcaattttataccggtgatttcttgtctgctggttacgaagcaagacaaggttttgcaattgagcctggtagatacattgatgctatcaatcaagagaactggaaagattgtgtaaccttgaaaaacggtgaaacttacgggtccaagattgtctacagattttcc

SEQ ID NO: 25118 - DNA, 1587 bp, Saccharomyces cerevisiae
atgactaaatctcattcagaagaagtgattgtacctgagttcaattctagcgcaaaggaattaccaagaccattggccgaaaagtgcccgagcataattaagaaatttataagcgcttatgatgctaaaccggattttgttgctagatcgcctggtagagtcaatctaattggtgaacatattgattattgtgacttctcggttttacctttagctattgattttgatatgctttgcgccgtcaaagttttgaacgagaaaaatccatccattaccttaataaatgctgatcccaaatttgctcaaaggaagttcgatttgccgttggacggttcttatgtcacaattgatccttctgtgtcggactggtctaattactttaaatgtggtctccatgttgctcactcttttctaaagaaacttgcaccggaaaggtttgccagtgctcctctggccgggctgcaagtcttctgtgagggtgatgtaccaactggcagtggattgtcttcttcggccgcattcatttgtgccgttgctttagctgttgttaaagcgaatatgggccctggttatcatatgtccaagcaaaatttaatgcgtattacggtcgttgcagaacattatgttggtgttaacaatggcggtatggatcaggctgcctctgtttgcggtgaggaagatcatgctctatacgttgagttcaaaccgcagttgaaggctactccgtttaaatttccgcaattaaaaaaccatgaaattagctttgttattgcgaacacccttgttgtatctaacaagtttgaaaccgccccaaccaactataatttaagagtggtagaagtcactacagctgcaaatgttttagctgccacgtacggtgttgttttactttctggaaaagaaggatcgagcacgaataaaggtaatctaagagatttcatgaacgtttattatgccagatatcacaacatttccacaccctggaacggcgatattgaatccggcatcgaacggttaacaaagatgctagtactagttgaagagtctctcgccaataagaaacagggctttagtgttgacgatgtcgcacaatccttgaattgttctcgcgaagaattcacaagagactacttaacaacatctccagtgagatttcaagtcttaaagctatatcagagggctaagcatgtgtattctgaatctttaagagtcttgaaggctgtgaaattaatgactacagcgagctttactgccgacgaagactttttcaagcaatttggtgccttgatgaacgagtctcaagcttcttgcgataaactttacgaatgttcttgtccagagattgacaaaatttgttccattgctttgtcaaatggatcatatggttcccgtttgaccggagctggctggggtggttgtactgttcacttggttccagggggcccaaatggcaacatagaaaaggtaaaagaagcccttgccaatgagttctacaaggtcaagtaccctaagatcactgatgctgagctagaaaatgctatcatcgtctctaaaccagcattgggcagctgtctatatgaattataa

SEQ ID NO: 25119 - DNA, 3495 bp, Saccharomyces cerevisiae
atgaccggcttgaatggagatgatcctgatgactactatctgaaccttaatcaagatgaagagtctctacttaggtcaagacacagtgtcggctcaggagcacctcatagacaaggctctttagtgcggcccgaaagaagccgactgaacaatcctgataatccacatttttattatgcgcagaaaacgcaggagcagatgaatcacctggatgttttaccatcaagtaccggtgtaaacccaaatgcaactcgtcggagtggctccctgcgctccaaaggctcagtgagaagcaaatttagtggccgcgaaacggatagctatcttttacaagatatgaatactactgacaagaaggcttccgttaaaataagtgatgaaggtgttgcggaagacgaatttgataaagatggtgatgtggacaatttcgaagaaagctccacgcagcccataaataagtctatcaaaccattaagaaaggaaacgaatgatacattgtcattttggcagatgtactgttatttcattacgttttgggcacctgctccaattcttgctttctgcgggatgccaaagaaggaaagacaaatggcgtggagagaaaaggttgctttaatttctgtcatcttgtacattggtgcgattgtggctttcctgacttttggtttcactaaaaccgtttgtagtagttcgaaactacgtttgaaaaacaacgaagtatcaacagaatttgtcgtaattaacggtaaggcttatgaattggatacttcctcgcgttccggtatacaagacgttgaagtagattcagacaccctttatgggccctggtcagatgctggtaaagatgcttcgttcttgtttcaaaatgtgaatggtaactgtcataaccttataactccaaagagtaattcttccattccccatgacgatgataataatttagcatggtattttccttgtaagttaaagaatcaagatggctcttcgaagccaaacttcacagttgaaaattacgcaggatggaactgtcatacgtctaaagaagatagggacgcattttacggtttaaagtcgaaagctgatgtttacttcacttgggatggtataaagaactcttctagaaacttgattgtttataatggcgacgttttggatttagatcttcttgattggttggaaaaggatgacgttgactatcccgttgtattcgatgacttgaagacttcaaatttacaaggttatgatctttcgttggttttgtcaaatgggcatgaaagaaaaattgcgagatgtttgagcgaaattattaaagttggtgaagtagactccaaaaccgtcggttgtattgcctctgatgtcgttttgtatgtttctctggtatttattctttcagtggtgataattaaattcataattgcctgctacttccgttggactgtagctaggaaacaaggtgcatatatcgtggacaataaaacaatggataaacacacaaacgatatcgaggattggtctaataatattcaaacaaaagctcctctaaaggaagtagatcctcatttgaggccaaagaaatactcaaaaaagtcgttgggacacaagcgtgcttcaacctttgacttgctgaaaaaacacagctccaaaatgtttcaatttaacgaatctgtgatagatctagacacctccatgagcagttcactacaatcttctggttcatacagaggaatgacaacaatgaccactcaaaatgcttggaaactctcgaatgaaaacaaagctgtacattcccgtaatccatctactttgttgcctacatcctcgatgttttggaataaagcgacttcctctcctgtaccaggatcatcgctgattcagagtcttgattcgacgattatacatcccgatatcgttcaacaaccaccactggattttatgccatacgggttcccattgattcatactatctgttttgttacttgttattctgaggatgaagagggtttaagaaccactttagactctctttctaccacagattatccaaattcccataaactactgatggttgtttgtgatggtttaattaagggctcgggcaacgataagactactccagagatagcgttaggaatgatggacgactttgtcaccccacctgatgaagttaaaccttactcctatgtggcagtggcatcaggctctaaaagacacaatatggccaagatatatgcgggtttttacaaatatgacgattctacaattccaccagaaaatcaacaacgtgtcccaatcattacaattgtgaagtgcggtactcctgcagagcagggggccgccaaacccggtaacagaggtaagcgtgattctcaaattattctgatgtcctttttagaaaaaataacatttgatgaaagaatgactcaattggaatttcagcttttaaaaaatatttggcagattacggggctaatggcagacttctacgaaacggtacttatggttgatgctgatactaaagtctttcccgatgctttaactcatatggtcgctgaaatggttaaagatcctttgattatgggtctttgtggtgagaccaagatcgctaataaggcacaatcttgggtaactgcaattcaagtgtttgagtactatatttcgcatcatcaggctaaagcttttgaatctgtcttcggttcggtaacttgtttgccgggatgtttctcaatgtatcgtataaaatctcctaaaggttcagatggttattgggtacctgtattggcaaatccagatattgttgaaagatattcggataatgttacaaacactttgcataagaagaacttattattacttggtgaagatagatttttatcttcattaatgttaaagactttccctaagagaaagcaagtatttgttccaaaagctgcttgtaaaactattgcccctgataaattcaaagtcttactttcccagcgtcgaagatggattaattctacggtacataacctttttgaattagttctaatcagagacttatgtggcactttctgtttttccatgcaatttgtgattggtattgaattgattggtactatggtactgccgttagccatttgctttactatttatgtcattatttttgccattgtatcaaaacctacacccgtaatcactttagttttactggcaattattcttggtctgcccggcttaattgttgttataactgctacgagatggtcgtacctatggtggatgtgcgtatatatttgtgctttgcctatttggaatttcgtactaccttcatatgcgtactggaaatttgatgacttctcatggggtgatacgagaactattgcgggaggtaataaaaaggcacaagacgagaatgaaggtgaatttgatcactcaaagattaaaatgaggacatggagggaatttgaaagggaagatattctcaatcggaaggaggaaagtgactccttcgttgca

SEQ ID NO: 25120 - DNA, 1575 bp, Saccharomyces cerevisiae
atgattttctcactagatgaagaacttcatcgtgtgtcactagatgataaaaagaatgacattaaagtagattattcctcggcaatatacaatgatatcaatcatgaacaaggcagctccatcacatatgaggagagtataaatcacctctcggttcattcaaatgcgattccgctaaatggcatgagtcctgcacataggatgagaagaaggtcctcagcttattccaaattccctattctcactccaccaaatacgagaagattttctattacaggttcggacgcaatgcgaactaatacgaatagactatccataacacctcaggacattatttcctctaatattggagaaaatgaattatcaaggaacctgcacgattttaagcccgtgagagtcctaggccaaggtgcctacggtaaagttcttcttgttaaggacgtcaatacatccaagctgtatgctatgaagcaattacggaaagcagaaattttaatttctcaaacagccacagattccaagagagaagacgaagataaaaatgatggtaataacaacgataatgacgatggattatcaaagaggcttgagagaacatttgccgaacggtctattctatctgaaatagaacatccaaacattgtcaagttattttattcttttcacgataactcaaagttatatttactgctacaatatatccctggcggtgaactattttaccacttgaaggaacacgggaccctagatgagacgacagtttcgttttacgcggcagaaatcagctgtgccttgagatttttgcatacgaaaggtgttgtctatagagatttaaaacctgaaaactgtttattgaatcaacgtggacatttagtattgacagattttggtctgagtaaaaaaagtgctaatgattccgcggttgatgaggaggatccagagaacgtcaatgccctatactcgattatcggtacgcctgaatactgtgcgcctgaaatattattaggtaaagcttacagtcagaattgtgattggtattctttgggatgtctgttgtatgacatgttagtaggtaagcctccatatactggtagcaatcataaggtgatcattaataagattcaacaaaacaagcaaggccccaaaattccattttatctgagcgagggaatgaaagatatattaaacgcgctgttgaagaaggaaactgccaaaaggtggaatgttgacaaatactgggccaaaaccggggctaataataagcctactaagtctaagaagaagaaatcaggggctgcaagaactagtcttttcactgaacattttatctttagaaaaatagactggaagttattagaatctggacaattgcaaaaaaccactctaggcccaattgttccagttattacggatttggaactagcggaaaattttgacacagaatttacttctatgtcatatgaggaaacctatacggatagcaagccgattaatatcaattcggtgagcaagtccccggatatgttcaagggatttagttataaagcaagtggtagctatttggagaagtacttt

SEQ ID NO: 25121 - DNA, 1371 bp, Saccharomyces cerevisiae
atgtctgacaaccctgagatgaaaccacatggtacgagcaaggagattgtggagtcggttactgacgccacctcaaaggcgattgataaattgcaagaagaactccacaaggacgccagcgaatccgtcacgccggtgaccaaggaaagcactgctgctacaaaggaaagcaggaaatacaactttttcattagaacagtttggacgtttgttatgatcagtggtttcttcatcaccttagcatcgggtcatgcatggtgtatagtgctgattttgggctgccaaattgctacttttaaagagtgtattgccgtaacaagtgcatctggtcgcgaaaagaatttgccattgacaaagacgttgaactggtaccttctcttcaccactatctattacttagatgggaaatcactcttcaagtttttccaagctactttttacgagtatcctgtattgaactttatcgtaacaaatcataagtttatctgctattgtctctatcttatgggatttgttctgttcgtttgtagtttaagaaagggatttttgaaattccagttcggatcattgtgcgttactcatatggttcttcttctggtagtatttcaggctcatttgatcatcaaaaacgtgctcaatgggctattctggttcttattaccatgcgggttggtaattgttaatgatatcttcgcctacctgtgcggcattacattcggtaagactaaactaatagaaatctcgcccaagaaaactttagaaggtttccttggtgcctggtttttcactgctctagctagtattatattaacaaggattctgagcccttatacttacttgacgtgccctgttgaagatctccataccaattttttctctaatttgacatgtgaactaaacccagttttccttccacaagtttacagacttccacccatctttttcgataaagttcaaatcaattcaattacagtaaaaccaatttatttccatgctttaaacttagctacctttgcatcattatttgcgccatttggaggctttttcgcatctggtctaaagagaacttttaaagttaaagactttggccactccatcccaggccatggtggtatcacagacagggttgattgccaattcataatgggttcttttgccaatttgtactatgaaacattcatcagcgaacacagaataacagtagatacagttttatccactattttaatgaacctgaacgacaagcagattatagaattgattgatatcttgattagattcctatctaaaaaaggtataatatcagcgaagaattttgaaaagttggctgacatctttaatgtgaccaagaaatcattgaccaatcactct

SEQ ID NO: 25122 - DNA, 2760 bp, Saccharomyces cerevisiae
atgtcacaccatgttcctaatttatatggtacacctattcgcgaccctcacgaacgcaaacgcaattcagcgtcaatgggcgaagtaaatcagtcagtttcttcgaggaattgtgaaagaggaagtgaaaagggcacgaagcaaaggaagaaagcctctcacgcttgtgaccaatgtagaaggaaaagaatcaagtgcaggtttgataaacataccggcgtatgtcaagggtgcttagaagtcggtgaaaagtgtcaatttattagagttccattgaaacgtggtcctgcaaaaaaaaggggcagtgtagtatccattgaaaaattcagctcggataatgatcctcttcaataccgaccaagaacacattcatacccaatgaactcgggaaataactacttaccatcactcgccaggaattcctcttttccttccataagcagtctatttgttccctcgataactgctcaatcgcaacaatttgtaaaggtgccgtacgatgacatcaagcgtaggagctctctggcaatattaggcagcgattcatcgatatctaccgaatttgggggaaactatcgcttagatgaaaacttaaatgtcaggcaagaggggaaggatattgtagcgaaaggaatgataacgcccgtggaggaaatgggcgcatgttcatctaacgttcgtcgtcagggttcacaatctcttccaattcaagaacagcgcgctagcccgtacattaacccttttatctctgggagatccaggctaagcagcctttcctatacaagtgaggctacaacttcagaaggtaatacgcaaggtaaaaaccaatgcatgcttactcccaatagtgtacgttccattgaaaaggaacgattaaactcgttaactgcgggatttccgaacaaaaaattaggcacagatggtagaagtgacaaatgggacaaaaattcgacttggaagcctgtatatcgatcgtcgaatccttctcatcctagcactgaaaaaaatgtttccttgaatcaggaagccagtgctaaaccacttatgcttggaacctacagacagtttgatgcaacctcgttctacaaggttttaggcatctactataactttttccatattaattttcctgtaataccaattaacaaaagtaaatttactgacatgcttgatcctgaaaagccaaacgtgattgatgagatcagacaaattaacaatgaaattatccagtgttttaaaaccgcgctagaggtattggtattttgcaaaataaaacaaagaaggtcatcgaaatcaacaaaatcatggtctcgtgacagtttatgcgattttcaaaaaggtctgtattacattcagaatttcaacaaatgtatagccgactgcttccaaagtttaataactataaaacccgtattaaaacaaaattccagtgttattccttcaagaataaagttcatttacttttcgacaataatagtgttaaattttatcttaatattggccggtgaggaaagctcgcttttgctaggcccctctgttggggtttttaacgaatttcaagctcataagttatttctaccttttcaaaatacgtccccaatgctattattaaattcaaacgaggaaagtggtgacgagatactggattatgctgtgttgttcaaaaggttgtacatccttttaaacattctggatacgctacaaagctttcggctaggtcaaccaaaattaattaatctaaattttggtagcgccattgaaacatattttagcgataaaacaggtcataaccaagtcgtcgaaaaagctcccgtagctttggataacattctacgaaaccttaaacttggtgaatttataacatattttgtccttaacagaaaatcattgcaagtaaatgtacctcaccacttgctgttcacaaatcaaacggattacggagagttcgctgttgaaaaaggggaacatgataatatagctggcaaatttgagacccttttgaagaaaaaggaaattttaatcagaaaattactaaatattgaacagaaaaatgaccatattctagaaaattgctgcaattcggatgctgaaatgaaaaatatcggagagctagtctgctcaatgatcactctggtatcaggcatattagattcaattactaatatgaacgcagaaaactctgttgatttggattcaaagccccttccgaacgcctattttgctcaggacagtgaagaagaattaatgtcgccaacacaaagtattacgtcaaatcttgccagtgaagaaaatacacgttgcacaaccaaagacttgatgggaactgtttctattttcatgctgccaatggtggaagaatgctataatatcattagtttgataggacccatacctaccacattaataagtttatacatccgtaatggaaatatggccaagggaataaatgacagaattatgacgttgtcaactgcgctgaacgaattggtgcaaataaccgcactatttaataccctagaaccttttaggaagaatgcacatgaccgtgctaagcgttactatgtaagtgctacaagtagtaccggatgctacgaatcggtaatgaagagcatgtattccggaaaatgtgcagctagtaacgcctcaaacgttgcgccatcggaggaagaaaacaaaaagatattgaaaaagtttgccgacataggttggaaattgatggatgattcagaattgggttgttgctgttgcttctttaactaa

SEQ ID NO: 25123 - DNA, 2892 bp, Saccharomyces cerevisiae
atgacgagaaacccgtttatggtggaaccttcgaatggctctcctaatagacgtggtgcttcaaacctctccaaattttacgcaaacgctaacagcaactctcggtgggctaatcccagtgaggagagtttggaggatagctatgaccaatctaacgttttccaaggccttccggcatctccttcgagagctgcactaagatactccccagaccgtcgccatagaactcaattttaccgcgatagtgcccataactctccagttgctccgaacaggtatgctgctaatctacaagagtctcccaaaagagcaggcgaggctgtcatacatctaagtgaggggagtaacctttacccccgcgataatgcagatctaccggtagacccctaccatctatcaccccagcaacagcccagtaacaatctgtttggaagtggcagattgtattctcaaagctcgaaatacacgatgtctactacttccacaacggctccctctctggcagaagcagacgatgaaaaggaaaaatacctcacttcgactacttcctatgatgatcagtctacaattttctctgcagacactttcaatgaaacaaaatttgaactgaaccatccaacaagacagcagtatgtaagacgtgccaattctgagagtaagagaagaatggtctcagacttgcctcccccaagcaagaagaaggcactattgaaactagacaacccgataccaaaaggtctgttggatactttgcctcgtaggaactcccctgagtttacggaaatgagatatacagcctgcactgtggaacctgacgattttttgagagaaggttacactttgagattcgcagagatgaacagagaatgtcaaattgccatttgtattaccatgtacaatgaagataaatattcattggcaagaaccatccactccattatgaagaatgttgctcatctttgtaagcgtgaaaaatctcatgtttggggccccaatggctggaagaaagtctctgtaattctgattagtgacggtagagcaaaagtcaaccaagggtctctcgactatttagctgctttgggtgtttatcaagaagatatggccaaggcgtctgtgaatggtgatccggtaaaagcgcacatttttgaattgacaactcaggtctctatcaacgccgatctggattatgtttcaaaggacattgttcctgtgcaattggttttttgtctaaaagaagaaaataagaaaaagatcaattcccatcgttggctattcaacgcgttttgtcccgttttgcaacctactgtagttactttggttgatgtcggtacacgtttaaacaatacagcaatttacaggttatggaaggtttttgatatggattcaaatgtggctggtgcggctggtcagattaagactatgaaggggaagtggggactgaaacttttcaatccattagttgcatcgcaaaattttgaatataagatctcgaatattttagataaaccattagaaagtgtttttggttatatctctgttcttcctggtgccctgtccgcatataggtatagagccttaaaaaatcatgaagatggcactggccctctcagatcgtatttccttggtgaaactcaagaaggcagagaccatgatgttttcactgcaaatatgtacttggctgaagatagaattctttgttgggaattggtcgccaagcgagatgcaaaatgggttctaaaatatgttaaggaagccactggtgaaacggatgttcccgaagacgtttctgaatttatttctcaaagaagacgttggttaaatggtgcaatgtttgccgcaatttatgctcaattgcatttctaccaaatttggaaaactaaacattctgttgtacgcaagttctttcttcatgttgaattcctttatcaatttattcagatgcttttttcctggttttctattgcaaatttcgttcttaccttttattatttagcaggatcaatgaatttagttattaaacatggtgaggccttattcattttttttaaatacctgatcttttgtgacttggcaagtttattcattatttccatgggtaatagaccccagggcgcgaaacatttattcattacctccatggttatactgtctatatgtgccacatattctctaatttgtgggtttgtttttgctttcaagtcgttagcttctggaacggaatcccacaaaatatttgtcgacatcgttatctcattgctctccacctatggcctatactttttctcatcactgatgtacctagatccttggcacatgtttacatcatccatacaatactttttgacacttcccgcctttacgtgtactttacagatttttgccttctgtaatacacacgacgtttcctggggtactaaaggttccacacaggagtccaagcaattgtccaaggccattgtcgttcaaggtccagatgggaaacagattgtggaaacagattggcctcaggaagttgataagaagtttttggaaataaaaagtcgtttgaaagaaccagaatttgaagaatcaagcggcaatgaaaaacaatccaagaatgattattatagagatataagaaccagaattgtgatgatttggatgctatcaaatctaatactgatcatgtctataattcaagtctttacaccacaagatactgacaatggttatttgatattcattttatggtctgtggccgctttagctgcctttagggtggttggttccatggcctttttgttcatgaaatacttgcgtataatagtgagttacagaaataaagttgaaggtagcggctcatgggaagtctctaaattagacttaccaaatgttttccacaaaaagggctaa

SEQ ID NO: 25124 - DNA, 936 bp, Saccharomyces cerevisiae
atgttgtcaagaattgtatcaaacaatgcaacacgctccgtaatgtgccaccaagcgcaagtgggtattctttataagactaacccagtgagaacttatgctactttgaaagaagtggaaatgcgtttgaaatctatcaaaaatattgagaagatcacaaaaactatgaagattgttgcatctacaagattgagtaaagctgaaaaggctaaaatttccgcaaagaagatggatgaagcagagcagttgttttacaagaacgccgaaaccaaaaatttggatgttgaggctactgaaacaggtgctcctaaagagttgattgttgctatcacctctgataaggggttgtgtggttctatccactctcaattggctaaagctgtgagaagacatttgaatgatcaaccaaacgccgatatagtcactattggtgataaaattaaaatgcagctattgagaacccatcctaacaacattaaattgtctattaatggaattggtaaagatgccccaactttccaagaatctgctttgattgccgataagttattgagtgtcatgaaggccggcacttacccaaagatttccattttctacaatgacccagtgtcttccctatcttttgaaccatctgaaaaaccgatctttaacgccaagaccattgaacaatccccatcattcggcaaatttgagatcgacacggacgcaaacgttccaagagatttgtttgaatatactttggctaaccaaatgttgacagcaatggctcaaggttatgctgctgaaatttccgccagaagaaacgctatggataacgcttccaagaatgccggtgatatgatcaatcgttactctatcttgtacaacagaacaagacaagctgtcattactaatgaactggttgatattattactggtgcttcctctttgggatga

SEQ ID NO: 25125 - DNA, 1872 bp, Saccharomyces cerevisiae
atgtctcccatacaggttgttgtctttgccttgtcaaggattttcctgctattattcagacttatcaagctaattataacccctatccagaaatcactgggttatctatttggtaattattttgatgaattagaccgtaaatatagatacaaggaggattggtatattattccttactttttgaaaagcgtgttttgttatatcattgatgtgagaagacataggtttcaaaactggtacttatttattaaacaggtccaacaaaatggtgaccatttagcgattagttacacccgtcccatggccgaaaagggagaatttcaactcgaaacctttacgtatattgaaacttataacatagtgttgagattgtctcatattttgcattttgattataacgttcaggccggtgactacgtggcaatcgattgtactaataaacctcttttcgtatttttatggctttctttgtggaacattggggctattccagcttttttaaactataatactaaaggcactccgctggttcactccctaaagatttccaatattacgcaggtatttattgaccctgatgccagtaatccgatcagagaatcggaagaagaaatcaaaaacgcacttcctgatgttaaattaaactatcttgaagaacaagacttaatgcatgaacttttaaattcgcaatcaccggaattcttacaacaagacaacgttaggacaccactaggcttgaccgattttaaaccctctatgttaatttatacatctggaaccactggtttgcctaaatccgctattatgtcttggagaaaatcctccgtaggttgtcaagtttttggtcatgttttacatatgactaatgaaagcactgtgttcacagccatgccattgttccattcaactgctgccttattaggtgcgtgcgccattctatctcacggtggttgccttgcgttatcgcataaattttctgccagtacattttggaagcaagtttatttaacaggagccacgcacatccaatatgtcggagaagtctgtagatacctgttacatacgccaatttctaagtatgaaaagatgcataaggtgaaggttgcttatggtaacgggctgagacctgacatctggcaggacttcaggaagaggttcaacatagaagttattggtgaattctatgccgcaactgaagctccttttgctacaactaccttccagaaaggtgactttggaattggcgcatgtaggaactatggtactataattcaatggtttttgtcattccaacaaacattggtaaggatggacccaaatgacgattccgttatatatagaaattccaagggtttctgcgaagtggcccctgttggcgaaccaggagaaatgttaatgagaatctttttccctaaaaaaccagaaacatcttttcaaggttatcttggtaatgccaaggaaacaaagtccaaagttgtgagggatgtcttcagacgtggcgatgcttggtatagatgtggagatttattaaaagcggacgaatatggattatggtatttccttgatagaatgggtgatactttcagatggaaatctgaaaatgtttccactactgaagtagaagatcagttgacggccagtaacaaagaacaatatgcacaagttctagttgttggtattaaagtacctaaatatgaaggtagagctggttttgcagttattaaactaactgacaactctcttgacatcactgcaaagaccaaattattaaatgattccttgagccggttaaatctaccgtcttatgctatgcccctatttgttaaatttgttgatgaaattaaaatgacagataacctcataaaattttga

SEQ ID NO: 25126 - DNA, 1719 bp, Saccharomyces cerevisiae
atgctgaggaattgtttgaggaaattgggaaatcatcaaacgaaatgttcggtaaaaacgttacacaccccaatctatagaacaaaaaaccttcaggttctcagagatacgctctctggtattaagctgttggaaaaaataataacttcatcctcctacaataaaacattgatatatgaacctaagtataaatccaagccacaggtcgttagttctcatgataccatgagacttcacaatgtaatgcgtgagttactagattccctacaagtagatgaagctaccaacacacgacttcaatcaaacaggcctcgaaagctggggagggttggtctacaattattcatggattgcattcaggacaacttaacagcaacttcaacatctttgacatgctctttactggagcactatttcaagtatcccgaaaaagaagtgaccaatgggatcaaggccggattacgatatatcagagattttcttgcgaagaacaagattatagtgaaaagtcaaaacgatgttgatgctctggtcgagcaattgactatgtcctcctcagacagccaaagcatcaaaagggttttgaaagccattaattatgaattgttttcggatgacattgtgcgggtcataaacggcaacaaaacttacgatgaggttgatgtatccaagggttggaaatatccagctggtattttagatagtaatgaagcctatttaaggtccctggagttgcctactaagaaattagtttccattgataaagatatgctagttcttatgtatgatgggacgttacgagacgctaataaaattctacccacgataacgtatgcaagaaagttgagaaaatctgttctcttaatcgttaacggagattgcacaggtgatgcattaacatccgttacaattaacaataacagaaacaagagagaaaataatgaaagccgaatagtggttttgaagtactctaaaaaggcgaacaatgacttagcgccacaggagaatcttgattttataaagttcttacggttgccttgcggatatgacagcatctactcaccagaatatagtcctttagtgccaagcaaaatgtgtgcggataaatattacggcagtatcgaatccataaaagcgaccacaggggaggcattcttatataactccattgatgctgaagcgattccaaataaagttccgaaatccttcctccaaaatacggtcactttaagcattggtggacataacgaaatcgaaatcgacagaagaagaaatgcaatagataattgcttaaataacgtcctatgtcatgggctggccaaaggtttcatcccaggttacggcatctccctactgaaggcaattccaggtttgaatgaactgaaagcaaatgaacccaatttcatgactaaggtaggcatcaatgctgttttatcagcagttattctcccatcagaagtggcgtttaagaatgcatatgggtacaactattatgagatcaatagcctgatagcaggcgctataaacgaaaaatcgtttccaatggccaagttttctccaaattcagaaccggtgaacacagtaaaggatggaaacttggagccatggagcaaaatggattcttgtttagccggtgtagaaacgttcattgaattacttacaagctgtaatacaattatcacatgtgtatacaaaagcctgaacggcacaaagcctaga

SEQ ID NO: 25127 - DNA, 1035 bp, Saccharomyces cerevisiae
atgtctgattatgttgaactattgaaaagaggtggtaacgaagccatcaaaattaatccaccaaccggtgctgatttccacattacatctcgtggttcagactggcttttcaccgttttttgtgttaacctactattcggtgtgattttagtcccactaatgtttagaaaaccagttaaggacagattcgtatattatacggccattgctccaaatttgttcatgtcaattgcttatttcaccatggcttctaacttgggttggatcccagtcagagcaaagtacaaccatgtacaaacttctacccaaaaggagcacccaggttacagacaaattttttacgctagatacgttggctggtttttggctttcccatggccaattattcaaatgtctctacttggtggtactccattatggcaaattgctttcaatgttggtatgactgaaatatttactgtctgctggttgattgctgcctgtgtccactctacttacaaatggggttactacaccattggtattggtgctgccattgttgtttgtattagtttgatgacaactacattcaacctggtcaaggccagaggtaaggatgtctctaacgttttcattactttcatgagtgtcatcatgtttttgtggctgattgcttacccaacctgttttggtatcacagatggtggtaacgttttgcaaccagattctgctaccattttctatggtattattgatttgttgatcctatctatcttgccagttcttttcatgccattggctaactatttggggattgaaagattaggtttaatcttcgacgaagaacccgctgaacatgttggtccagttgctgaaaagaagatgccatctccagcttctttcaagtcatctgattctgactctagtatcaaggagaagttaaagctaaagaagaagcacaagaaggacaagaagaaggctaagaaggctaagaaggccaagaaggccaagaaagcccaagaagaggaggaggatgtagccaccgactctgagtaa

SEQ ID NO: 25128 - DNA, 2409 bp, Saccharomyces cerevisiae
atggcagtagagatgacaggtaaattcatccaaaaagagagcccgaagtctttctcacattcagaaatggcagaagcagtactagaaaacgttaacgttcctgcagtcgtttcaaaagatgagtgtatttattgctttgaatccccttataatgaaccattggccctcaatgcatcacctaaacattcattgaatatatgcttaaactgtttccaagctacgtgcaacagacatgttccactccatatccgagtcacagaatatgcttgcgataccatacattccaattatttaactattgctaaagtggagaaacctaagcaagaaaatgtagaagaaaataataacaacaaaaaaataaagctacaggtaattgagacgtcagaagacgacacccacaacactatttggagtttacaaaggttcaatggtgaaaatgttcccaggaccgtactttcgaagtcgacagactctgacatttcttctacggccttggagaagattgaaaagatattaaaggcgaagtcacaagacttcgaggataagaagaactcctgggtgttagaaatcagcacctgtccacatacagaaaactttcaaattccatctaagcccgaaaatactgtgaatttaaaccaatgctcttcctgtgatttgactcaaaatctctggttatgcctacattgtggtaatatcggatgtggcagggaacaaatcgggattgatggtcactcgcatgctttggatcattatcggagtaataataatcacccattagctatcaaattagggtctttaagctcttcaacctatgatctgtattgttacgcatgtgacgacgaaactagatttccagataatgttaatttaggcagtgcactacaaatatacggaattaacatacaagaaaagattgcggatgaaaagactctagttcaattacaagtggaacagaacgaaaattggcaatttagaatggtcgattctagcggtaaagaatttgaaaaattatccgctagtaagaattatggctgtggtctgatcaatttgggtaattcctgttacttaaattcggttatacaaagcttggtgaatggtggcgtcccgaattggtccttggattttctaggaagtaaatttccactggatgttgtatatccggacaataatttaaagtgccaatggatcaagctactcaatgccatgaaatgtgaacccgaactatatccaaatggtatcaaacctactactttcaagaaatgcattgggcaaaatcatcaggaattcagttccaatagacaacaggatgcgatggaatttctaaccttccttttagacttgttagacaagaaatttttttcaagtagttcttcaggtattccaaatcccaacgatttagttagatttatgatggaggataggctccaatgtaacatttgcgggaaggttaaatattcttatgaacccacagaggctatacagattcccttagaggagaatgatgaacctcaagatatgttagagagaatcaaggcgtattttgaagggcagacgattgaatttaaatgtgctaattgtaaggaaaaggttaccgcaaataaaaaacctggtttcaaatctcttcctcaaacacttattttgaacccaataaggattagattacagaactggattcctgttaagacaagtaatgagctttctttaccaggtttaatagacagggatgatatgctagatgtttcgtcttatttatcacaaggatttgatcctcaaactgaaaacttattgcctgatgaggacgaaaaccgtagctcttttacgccaaaccaatgcagtatttctcaattaattgaaatgggctttactcaaaatgctagcgtgcgcgccctatttaacaccggaaaccaagacgctgagagcgctatgaattggctattccagcatatggatgaccctgatttaaatgatccctttgtcccgcctcctaatgtccccaagaaagataagagagaagtggatgaggtatcattgacttcaatgttatccatgggactaaatcccaacttatgtcgtaaagccttgatactcaacaacggagatgttaatcgtagtgttgaatgggtatttaacaacatggatgatgatggaacatttcccgaacctgaagtgccaaatgaagaacagcaacaaaaaaaggatcttggatattcgaccgctaaaccgtacgctttaactgcagttatttgtcataagggaaattctgtccattctggtcactatgttgtttttattcgtaaactagtggcagacaaatggaagtgggttctttataacgatgagaaactagttgctgccgacagcattgaagatatgaaaaaaaatggttatatttatttctatacaagatgc

SEQ ID NO: 25129 - DNA, 1860 bp, Saccharomyces cerevisiae
atgctaaatggggaagactttgtagagcataatgatatcctatcgtctccggcaaaaagcaggaatgtaaccccaaaaagggttgacccacatggagaaagacaactgagaagaattcattcatcaaagaagaatttgttggaaagaatctcgcttgtaggcaacgaaaggaaaaatacatctccagatccggcactcaaacctaaaacgccaagtaaagctccccgtaaacgtggaagaccaagaaagatacaggaagaattaactgataggatcaagaaggatgagaaagatacaatttcctctaagaaaaagaggaaattggacaaagatacatcaggtaatgtcaatgaggaaagcaagacttctaacaacaagcaggtgatggaaaagacggggataaaagagaaaagagaacgcgaaaaaatacaggtagcgaccacaacatatgaagataatgtgactccacaaactgatgataattttgtatcaaattcacccgagccaccagaacctgcaacaccatctaagaagtctttaaccactaatcatgattttacttcgcccctaaagcaaattataatgaataatttaaaagaatataaagactcaacctccccaggtaaattaaccttgagtagaaattttactccaacccctgtaccgaaaaataaaaagctctaccaaacttcggaaaccaagtcagcaagctcgtttttggatacttttgaaggatatttcgaccaaagaaaaattgtcagaactaatgcgaagtcaaggcacaccatgtcaatggcacctgacgttaccagagaagagttttccctagtatcaaactttttcaacgaaaattttcaaaaacgtcccaggcaaaagttatttgaaattcagaaaaaaatgtttccccagtattggtttgaattgactcaaggattctccttattattttatggtgtaggttcgaaacgtaattttttggaagagtttgccattgactacttgtctccgaaaatcgcgtactcgcaactggcttatgagaatgaattacaacaaaacaaacctgtaaattccatcccatgccttattttaaatggttacaaccctagctgtaactatcgtgacgtcttcaaagagattaccgatcttttggtccccgctgagttgacaagaagcgaaactaagtactggggcaatcatgtgattttgcagatccaaaagatgattgatttctacaaaaatcaacctttagatatcaaattaatacttgtagtgcataatctggatggtcctagcataaggaaaaacacttttcagacgatgctaagcttcctctccgtcatcagacaaatcgccatagtcgcctctacagaccacatttacgctccgctcctctgggacaacatgaaggcccaaaactacaactttgtctttcatgatatttcgaattttgaaccgtcgacagtcgagtctacgttccaagatgtgatgaagatgggtaaaagcgataccagcagtggtgctgaaggtgcgaaatacgtcttacaatcacttactgtgaactccaagaagatgtataagttgcttattgaaacacaaatgcagaatatggggaatctatccgctaacacaggtcctaagcgtggtactcaaagaactggagtagaacttaaacttttcaaccatctctgtgccgctgattttattgcttctaatgagatagctctaaggtcgatgcttagagaattcatagaacataaaatggccaacataactaagaacaattctggaatggaaattatttgggtaccctacacgtatgcggaacttgaaaaacttctgaaaaccgttttaaatactcta

SEQ ID NO: 25130 - DNA, 1827 bp, Saccharomyces cerevisiae
atgctatcttcagaagattttggatcttctgggaaaaaggaaacttctcctgattcgatatcgatacgttcctttagtgccgggaataatttccaatcatcatcaagtgagaaaacttattctaagcaaaaatccgggagtgacaaacttatacatagatttgcggattcattcaaaagagccgagggtagcactacaagaactaagcaaataaatgaaaatacgtctgatttagaggatggcgttgagtctatcacgtcggattccaagttgaaaaagtccatgaagtcgcgccatgttgtcatgatgtctttagggacaggtattgggactggtcttttggtagctaatgcaaaaggtctacattacggtggtcctgctgcgctaataattggttacatcttggtttctttcgagacgtacttcatgatccaagctgcaggtgagatggcggtaacctatccgactttaccagcaaatttcaacgcatactcctccatattcatttccaaatcatttggattcgccacagtatggctttactgtttccaatggctaacggttttgcctttagagttaataaccgcgtctatgactattcaatttgggaatgataaaataaatccggacatttatattcttattttctatgttttcttagtattcattcatttcttcggtgtaaaagcctatggtgaaacggaattcatcttcaattgctgtaaaattttaatgattgcaggtttcattattctttctattgttatcaactgtggtggggccggaaatgacggttatatcggggccacttattggcataatccaggtgcttttgcaggtgacacatcgattggtaggttcaaaaacgtttgctatattttagttactgcttacttctcctttggtggtatggaattatttgcactaagtgttcaggaacagtctaaccctagaaaatctactccggtggcagccaagagaagcatttatcgtatcgttgtgatttatcttttgactatgatcctcattggattcaatgttccatataatgatgaccaactaatgggcgcaggcggatccgctacacatgcatctccctatgtcttagccgcttctattcacggtgtgaaaattgttccacatattatcaacgctgttattttgatttctgtggtttcagtggcaaattcctctttgtatgctggtccaagactgatttgctctttggcccaacaaggctacgcacccaagtttttagattacgttgacagagagggcaggcccttgagagctcttattgtgtgttgcgttttcggcgtcattgcttttgttgcagcttcatcaaaggaagagatcgtgtttacatggttagcagctatcgcaggcttgagtgaattattcacatggacttccataatgttgtcccatctgcgattcagacaagcaatgaaagtacagggaaggtctctagacgagttgggatacaaggccacaacagggatttggggttccatatacggtgtcttttttaatattttagtctttgttgcccaattttgggtagcattggcccccttaggtaatgggggcaaatgcgatgcggaatccttctttcaaaattatttagcttttccaatatggttggccttttacttcggatatatggtttacaaccgagattttacgctattaaatcccctcgacaagattgaccttgacttccacagacgcatttatgatccagagctaatgagacaagaggacgaagaaaataaagaaaaactaaggaatatgtctttgatgagaaaagcttatcatttctggtgt

SEQ ID NO: 25131 - DNA, 1857 bp, Saccharomyces cerevisiae
atggacgatagtgtcagtttcattgccaaagaggccagtccagcacaatattcgcacagtttgcatgaaagaacacacagtgaaaaacaaaagagagactttacaataacagaaaaacaagatgaggtatctggacaaacagcggagcctcgaaggacggacagcaaatccatattacagaggaaatgcaaagaattcttcgactcttttaaaaggcagctgccaccagaccgtaattccgaactagagtcccaagaaaaaaacaacctgacaaagtcgatcaaatctcgtcacttagtcatgatcagtctcggtaccggtataggtactggtttactggtcggtaatggtcaggtgctgggaacagctggtcctgccgggttagtccttggttacggaatagcatcgatcatgctttactgtatcatccaagcggcaggcgagttaggtctctgttatgcaggactaaccggcaattacaccagatatccttctattttagtcgacccttcgttgggttttgcagtttctgtggtttacaccattcaatggctaactgttctgcccttacaattggtcactgcggcaatgacagttaagtactggacgagtgtaaatgcagacatctttgttgccgtggttttcgtttttgtaattatcattaatctatttgggtccagaggctatgctgaagccgagttcattttcaattcctgtaagatattgatggtaatcggattcgtcattctggcgattatcatcaattgtggtggtgcaggtgacagaagatacatcggtgctgagtactggcacaatcctggtccatttgcccacggtttcaaaggtgtatgtacggttttctgttatgctgcattcagctacggtggaattgaagttctacttctatctgccgctgagcaggaaaacccaacaaaatctattcccaatgcctgcaaaaaagtggtataccgtattctgctgatttacatgctcaccaccattttggtttgctttcttgttccatacaacagtgacgaattattagggtctagtgactcctctggatcccatgcctccccatttgtcattgctgttgcatcacatggtgtcaaagttgtgcctcactttataaatgctgttattttgatttctgtcatttctgttgcaaactcttcgttatattctgggccaagattgttattatcattggcagaacaaggcgtcttacctaaatgcttagcatatgttgatagaaacggcaggcctttactttgtttttttgtttcccttgtctttggatgcattgggtttgtagccactagtgacgctgaagaacaggttttcacctggttattggcaatttctagtctttcgcaattatttatctggatgtcaatgtccttgtcacatataagatttagagatgccatggcaaagcaaggtcgttcgatgaacgaagttggatacaaagcacaaactggctattggggttcatggcttgcagttttaattgcaatcttcttccttgtgtgccagttctgggtagccatcgcacctgttaatgaacatggaaaacttaacgtcaaagtgtttttccaaaattatttggcaatgcccatcgttttgtttgcctattttggtcacaagatatacttcaaatcatggagcttttggattccagccgaaaaaattgatttggactcacatagaaacatatttgtgtctccatcgcttacagagatcgacaaagttgacgataacgatgatcttaaagagtatgaaaattcagaatcgtcggaaaatccaaacagctcgcgttcaagaaagttttttaagaggatgaccaatttctggtgc

SEQ ID NO: 25132 - DNA, 645 bp, Saccharomyces cerevisiae
atgtcatttaacagtccattttttgatttctttgacaacatcaacaacgaagttgatgcctttaacagattgctgggtgaaggcggcttaagaggctacgcaccaagacgtcagttagcaaacacacccgcaaaggattctactggcaaggaagttgctagaccaaataactatgctggcgctctttatgatcccagagatgaaaccttagatgattggttcgacaatgacttgtccctgttcccatctggtttcggtttccctagaagtgtcgcagttccagttgatattttggaccatgacaacaactacgagttgaaagtcgtggttcctggtgtcaaaagcaagaaggacattgatattgagtaccatcaaaacaagaaccaaattttggtttctggtgaaattccatctaccttgaatgaagagagtaaagacaaggtcaaggtcaaggagagcagctctggtaagttcaagagagtcatcactttgccagactacccaggtgtggatgcagacaacattaaagcagactacgcaaatggtgttttgacattaacagttccaaaattgaagcctcagaaggatggtaagaaccacgtcaagaagattgaggtttcttctcaagaatcgtggggtaactaa

SEQ ID NO: 25133 - DNA, 2877 bp, Saccharomyces cerevisiae
atggcggtaataagcgttaaacctcgacgaagagagaagatcctacaggaggtaaaaaacagctcggtatatcaaacggtatttgattccggtactactcaaatgcagataccgaaatatgagaacaagccattcaagcctccaagaagggttggatcaaataagtacacacaactcaaaccaaccgccactgcagtcacaacagcccctatatctaaagccaaagttactgtcaacttgaaaagaagcatttcggcgggacctactttaaatcttgccaagaagccgaataatctgtcctcaaatgaaaacactagatattttactatcatgtacaggaagcctactaccaaaaagcacaagacttggagtggtgatggctacgctaccttaaaagccagtagcgataagttatgcttttataacgaagcagggaaatttcttgggtcaagtatgctaccaagtgattcagattctctcttcgaaactcttttcaaagcaggctccaatgaagtacaattggattacgaattgaaggaaaatgcagaaatacgtagcgccaaagaagccttatcacaaaacatgggaaatcccagcccaccgaccacaagcacaacagaaacagtgccttctacgaagaatgacggtggcaaataccaaatgcctctgtctcagctgttttcactaaacactgtgaaaagattcaaatcagtaacaaagcaaacaaatgaacacatgaccacagtacctaaaaccagtcaaaattccaaagccaaaaaatattatccagtatttgatgtcaacaaaatcgataatcctatagtaatgaacaaaaatgcagccgctgaagttgacgtaattgttgatccattactgggcaaattcttgcgccctcatcagagggaaggggtgaagttcatgtatgattgcttaatgggcttggcaagaccaactattgaaaatccggatatcgattgtactactaaaagtttagtgttagaaaatgactcagatattagtggatgccttttggctgatgatatgggtttaggtaaaacactaatgagtataactttgatttggacattaattaggcaaactccttttgcatcaaaagtttcatgttcgcaatcaggcataccattaactggactttgtaagaagattttagtcgtttgtcccgttactttaataggaaattggaaaagagaatttggaaaatggttaaatttgtcaagaataggtgttttgacattaagctcaaggaattctcctgatatggataaaatggctgtcagaaattttttaaaagtgcaacgaacttatcaagtcttgattattggctacgaaaaactcttgagtgtttctgaagaattagagaaaaataaacatttgattgacatgctggtgtgtgacgaaggccatcgactaaaaaacggggcttctaaaattttaaatacgctgaagagtttagacataagaaggaagcttttgcttacgggaactcctatacaaaatgatcttaatgagtttttcactattatagatttcataaacccaggaatccttggaagcttcgcttctttcaaaagaagattcattatccctataactagagccagagacactgcaaacagatacaacgaagaattgttggaaaagggggaagaaaggtcaaaagagatgatagaaattacgaaaagatttattttgagacgaacaaatgcgattttagaaaagtaccttcctccaaagacggatataattttattctgtaaaccatacagccaacagatattggcattcaaagatattttgcagggcgcacgtttagattttggacaattgacgttcagttcttcgctaggactaataacattactgaaaaaggtttgtaactctcctggattggttggctcagatccctattacaaatcacatataaaggatacccaatctcaggacagctatagtcgttctttgaactctggtaagttaaaggtattaatgacattactagaaggtattaggaagggtaccaaggagaaggtcgtcgtagtgtctaactacactcaaacattggatataattgaaaatttgatgaatatggctgggatgtcacattgcagactcgacggttccatacctgctaaacaaagggactctatcgtcacatctttcaatcggaatccagccatatttggattcttgttgagtgcaaaatcgggaggtgtaggattgaatctagtcggtcgttcgcgacttattttatttgataatgattggaatccttcagtagatttgcaagcgatgtcacgaattcatagagatggtcaaaaaaagccgtgcttcatatatagacttgtcacaactgggtgtatcgatgagaaaatattgcaaaggcaattaatgaagaacagtttgagccaaaaatttctaggtgactcggagatgagaaataaagaatcttctaatgatgatcttttcaataaagaggacttgaaggacctgttttctgtccatacagataccaagagtaacacacatgacttaatttgttcttgcgatggtttaggtgaggaaattgaatatcctgaaacaaatcaacagcagaacaccgtagagctgagaaagcgtagcactacgacatggacaagtgcgctggatttacaaaagaaaatgaatgaagcagccaccaacgatgatgccaaaaagtcacaatacattaggcaatgtctcgttcattataagcatatcgatccagcaagacaagatgaattatttgatgaggttatcacagattcgttcaccgaattgaaagatagtattacctttgcgtttgtaaagcccggcgagatatgtctcagagaacaatga

SEQ ID NO: 25134 - DNA, 2274 bp, Saccharomyces cerevisiae
atgttcaagatacctggttttggaaaagctgctgcaaatcatactccaccagatatgacaaacatggatacccgtacacgccatttaaaggtgtcaaactgtccaaataactcctatgcactcgcaaacgtagctgctgtctcaccaaatgatttccctaataacatttatattattatcgataatttatttgttttcacaactagacactccaacgacattccaccgggaaccattggatttaacggtaaccagcgtacctggggtggttggtccctaaatcaagacgtgcaagcaaaagcatttgatttattcaagtattccggtaagcaatcgtatcttggttcaatagatatagatatctcattcagagctagaggtaaggcggtaagcacggtattcgatcaagatgagttagccaaacaatttgttcgttgctacgaatctcaaatattttctcccacccagtaccttatcatggagttccaaggccatttctttgacttaaaaattagaaatgtccaagcaatcgatttgggtgatattgaaccaacctccgctgttgcaactgggatagagacaaagggaattttgacaaaacaaacacaaattaattttttcaaaggaagagatggtttagttaatttgaaatcatcaaattcattaagaccaagatcaaatgctgtgatcagaccggatttcaagtttgaagatttgggtgtcggtggtttggataaagagtttactaaaattttcagaagagcgtttgcaagtcgaatctttcctccttcagttatagaaaaactgggtatttctcatgttaaaggtttgctattgtacggtcctccaggtactggtaagaccttaattgcaagaaagattggtacaatgctgaatgccaaagagcccaaaatcgtcaatggtccagaaattttgagtaagtacgttggttcttcagaagaaaacattcgtaatttatttaaggatgcagaagcagaatatagggccaagggtgaggaatcttccttacatattattattttcgatgagctggattctgttttcaagcagagaggttcaagaggtgatggtaccggtgtaggggacaatgtagttaatcaattgttagctaaaatggatggtgttgatcaattgaataatattttggttattggtatgaccaatcgtaaagatttaatagacagtgctcttttgcgtccaggtagatttgaagtccaagttgaaattcatttacccgatgaaaaaggaagactccaaattttcgacattcagacgaagaaaatgagggaaaataatatgatgagcgacgatgttaacttagctgagttagctgcgttaacaaaaaacttctctggtgctgagattgagggtttagtgaagagtgcaagttcttttgcaatcaacaaaaccgtcaacatcgggaaaggtgccacaaaacttaacactaaagatatagcaaaacttaaagtaacaagagaagactttttaaatgcactcaacgatgttactcccgcttttgggattagtgaagaagatttgaaaacatgtgtggaaggtggaatgatgctttattccgaacgagttaactcaatattgaagaacggagcccgttacgtccgccaagttcgcgagagtgataaatccaggttagtatctctattaatccacggccctgcagggtccggtaaaacagctttagccgctgaaattgctttaaaatctggattcccattcatcaggttaatttctcccaacgagttgtcaggcatgtcagaaagcgcaaaaattgcctatattgataacactttcagagatgcgtataaatctccactaaacattcttgttattgattcgttagagactctagttgattgggtaccaattggtccaagattctctaataacattttacaaatgctaaaggttgcattgaagcgtaaacccccacaagaccgtcgtttattgatcatgactactacatcagcttattcggtacttcaacaaatggatatcttgagttgcttcgacaatgagatagcagttccaaatatgaccaatttagatgaattgaacaacgtcatgatagaatcaaactttcttgacgatgctggtagagttaaagttattaatgaattatcaaggagctgtcctaacttcaatgtcggtattaaaaagaccttgaccaacattgaaaccgcaaggcacgatgaagatcccgtgaacgagcttgttgagttgatgacccaatccgca

SEQ ID NO: 25135 - DNA, 539 bp, Saccharomyces cerevisiae
atgtcttcttctaaacgtattgctaaagaactaagtgatctagaaaggtatgtctaaagttatggccacgtttcaaatgcgtgctttttttttaaaacttatgctcttatttactaacaaaatcaacatgctattgaactagagatccacctacttcatgttcagccggtccagtcggcgatgatctatatcactggcaagcatccatcatgggacctgccgattccccatatgccggcggtgttttcttcttgtctatccatttcccaaccgactacccattcaagccaccaaagatctccttcacaaccaagatatatcatccaaatatcaatgccaatggtaacatctgtctggacatcctaaaggatcaatggtctccagctctaactctatcgaaggtcctattatccatctgttctttgttaacagacgctaatcctgacgatcctttagtaccagaaatcgctcatatctacaagactgacagacccaagtacgaagctacagccagagaatggacaaagaaatacgctgta

SEQ ID NO: 25136 - DNA, 1461 bp, Saccharomyces cerevisiae
atgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtctggaagaagaccatacaaaacaaaatcaaggactcgctgaccctatcatcaaaggagaaggagcttctacaccttatcgaacatggcgctgaacaaactactgaaaactcaaacctgttttatgacatatttgaagaaattatcgactctctaccttcagtcagtgattctggaagtttaacccctaaaaacctctatgtaagtaataatagcagtggattgtcagtacattcaaaactgcttacgccaatcactgcttccaacgagaaaaaaattgaaaatttcataaaaactaatgctgcatctcaagccaaaacccccctcatttacgctaagcacatttatgaaaacatagacggctacaagtgcgttccgtcaaagaggcctcttgaacaactttcccccacggaactccaccagggagatcgccccaataaggctagcttttccaacaagaaggcaatcctggagagtgcaaaaaaaatcgaaatagagcagagaaagataatcaacaaataccaaagaatttcccgcatacaagaacatgaaagtaatcctgagttcagttccaattccaattccggttcagagtacgaatcggaggaagaagtagtcccaagatcagccacagtcacacaactccaaagcagaccagtgccatactacaagaataatggaatgccctactcactctccaaagtacgaggaaggcccatgtatccaagacctgctgaagatgcttacaatgccaattatattcaaggtctgccccagtaccaaacatcttatttttcgcagctgttattatcatcaccccagcattacgaacattctccacatcaaaggaactttacgccatccaaccaatcgcatgggaacttttattaa

SEQ ID NO: 25137 - DNA, 924 bp, Saccharomyces cerevisiae
atgagtagcgacgctaagcaacaagaaacaaactttgccattaatttcttaatgggtggtgtgagtgcggccatcgctaaaactgctgcctcaccaatcgaaagagtcaagatcttgatccaaaatcaagatgaaatgatcaagcaaggaactttagataaaaagtattccggtatcgtggattgtttcaagagaactgcaaagcaagagggactaatatccttttggcgaggaaatactgccaatgttattcgttattttcccactcaagctttgaacttcgccttcaaagataagattaagttgatgtttggtttcaagaaagaggaaggctatggtaaatggtttgcaggtaatctggcttctggtggtgcagctggtgctctttcgttattatttgtttattctttagattttgccagaaccagacttgctgctgatgcaaaatcgtcgaaaaagggtggcgctcgccaattcaatgggttgactgatgtttataaaaagaccttgaaatcggatggtatcgcaggattatacagaggattcatgccatcagtagtgggtatcgtggtttatagaggactatatttcggtatgtttgattctctcaagccactggtgctaactggttcattagatggttcattcttggcttcatttttattgggatgggtggtcactacaggtgcctcaacatgttcttatccattagacacagtgagaagaagaatgatgatgacttcaggtcaagcagtaaagtacaacggtgctatagattgtctcaaaaaaatcgtagcttctgaaggtgtagggtcattgttcaaaggctgcggggcaaatatcttgagaagtgttgctggagctggtgttatttccatgtatgaccagttgcaaatgatattgttcggtaaaaaattcaaatga

SEQ ID NO: 25138 - DNA, 1065 bp, Saccharomyces cerevisiae
atgtcattgtgggtagataaatacagacctaagtccttgaatgctctttcacataatgaagagttgacaaattttctaaaatcgttatctgatcagcctcgtgatttacctcatcttttactgtatggaccaaatggtacaggtaagaaaacgcgttgtatggcattattggagtccatatttggacctggagtctatagattgaaaattgatgtcagacaatttgtcactgcttcgaacagaaaactagaactgaatgtggtcagctcgccataccatttagagatcacgccaagtgatatgggtaacaatgatagaattgtcatccaagaactattgaaagaagtggctcaaatggaacaagtggactttcaagattctaaggatggacttgcccatagatataagtgtgttattatcaacgaggcgaactcgttaacaaaagatgctcaagctgctttaagacgtaccatggaaaaatactccaaaaacattaggttgataatggtctgcgattcgatgtcgcctataattgctcctatcaaatcccgttgtctgttgattcgttgtcctgcaccaagcgatagcgaaatttcaactatcttgtctgatgtggtgacaaatgaaagaatacaactagaaacaaaggatattttaaaaagaattgctcaggcatcgaatggaaacttgcgagtctccctattaatgcttgaatctatggcactgaacaacgaattagcattgaaaagcagtagccctataataaaaccagattggattatagtgatccataaattaacgaggaaaatcgttaaagagagatctgtcaattctttaatcgaatgcagagctgtcctatacgatttactagctcattgtatacctgccaatatcatcttaaaggaactaacgttttctttgttggatgtggaaaccctgaataccacgaataaatcgtccataattgaatactcaagtgtttttgacgaaagattatcacttggaaacaaagcaatattccatttggaagggttcatagcaaaagttatgtgctgtctagattaa

SEQ ID NO: 25139 - DNA, 774 bp, Saccharomyces cerevisiae
atgttagaagcaaaatttgaagaagcatcccttttcaagagaataattgatggtttcaaagattgtgtccagttggtcaatttccaatgtaaagaagatggtatcattgcacaagctgtcgatgactcaagagttctattggtctccttggaaataggtgtcgaagccttccaagaatatagatgtgaccatcctgttacgttaggtatggatctaacctcactaagtaaaatcctacgttgtggtaacaacaccgatacattaacactaattgctgacaacacaccggattccatcatcttattatttgaggataccaagaaagaccgtatagccgaatactctctgaaattgatggatatcgatgctgatttcttaaagattgaagaattacagtacgactccaccctgtcattgccatcttccgaattctctaaaattgttcgtgacttgtcccaattgagtgattctattaatatcatgatcaccaaagaaacaataaagtttgtagctgacggtgatatcggatcaggttcagtcataataaaaccattcgtggatatggaacatcctgaaacaagcatcaaacttgaaatggatcaacctgtcgacttgacgttcggagctaaatatttattggacatcattaagggctcctccctttctgatagagttggtatcaggctctccagcgaagctcctgctttattccaatttgatttgaagagtgggttcctacagtttttcttggctcctaaatttaatgacgaagaa

SEQ ID NO: 25140 - DNA, 1401 bp, Saccharomyces cerevisiae
atgtttaagtctgttgtttattcggttctagccgctgctttagttaatgcaggtacaattcccctcggagagttagccgatgttgccaaaattggcactcaggaagacatattcccattcctgggtggtgccgggccatacttctctttccctggcgactatggtatttctcgtgacttgcctgaaggttgtgaaatgaaacaattgcaaatgcttgccagacatggtgaaagatacccaacttacagtaaaggtgctaccatcatgaaaacatggtataagttgagcaattacacacgtcaattcaacggctcattgtcattcttgaacgatgattacgagtttttcatccgtgatgacgatgatttggaaatggaaaccacttttgccaactcagacaatgttttgaatccatacactggtgagatggatgctaagagacatgctcgtgagtttttagcgcaatatggctacatgttcgaaaatcaaaccagtttcccaattttcgccgctagttctgaaagggttcatgacactgctcaatatttcattgatggtttaggtgaccaattcaacatctccttgcagactgtcagtgaagccatgtccgccggcgcaaacactttgagtgctggtaatgcgtgcccaggatgggatgaagatgctaacgatgacattttggacaaatacgataccacatacttggatgacattgccaagagattaaacaaagaaaacaagggtttgaatttgacctcaaaggacgccaacactttgtttgcatggtgtgcatacgaattgaacgctagaggctacagtgatgtttgtgatatcttcaccgaagatgaattggtacgttactcatacggccaggacctggtatcgttttaccaggatggaccaggttatgatatgatcagatccgtcggtgccaacttgtttaacgctactttgaagttgttaaagcaaagtgaaactcaagacttaaaagtctggttgagttttacccacgataccgatatcctaaactatttgaccaccgctggtataattgacgacaaaaacaacttaactgccgaatacgttccattcatgggcaacaccttccataagtcctggtacgttcctcaaggtgctcgtgtctacaccgaaaaattccaatgttctaacgacacctacgtcagatacgtcattaacgatgctgtcgttccaattgaaacctgttccaccggcccagggttctcttgtgaaatcaatgatttctacgactatgctgaaaagagagtagctggtactgacttcctaaaggtctgtaacgtcagcagtgtcagtaacgtcaccgaattgaccttctactgggactggaatactactcactacaacgataccctattaaaacaa

SEQ ID NO: 25141 - DNA, 1401 bp, Saccharomyces cerevisiae
atgtttaaatctgttgtttattcaattttagccgcttctttggccaatgcaggtaccattcccttaggcaaactagccgatgtcgacaagattggtacccaaaaagatatcttcccatttttgggtggtgccggaccatactactctttccctggcgactatggtatttctcgtgatttgcctgaaggttgtgaaatgaagcaactgcaaatggttggtagacatggtgaaagataccctactgtcagtctggctaagactatcaagagtacatggtataagttgagcaattacactcgtcaattcaacggctcattgtcattcttgaacgatgattacgagtttttcatccgtgatgacgatgatttggaaatggaaaccacttttgccaactcggacgatgttttgaacccatacactggtgaaatgaacgccaagagacatgctcgtgacttcttggctcaatacggttacatggtcgaaaaccaaaccagtttcgccgtttttacctctaattctaagagatgtcatgacactgctcaatatttcattgatggtttaggtgaccaattcaacatcaccttgcagactgtcagtgaagctgaatccgctggtgccaacactttgagtgcttgtaactcatgtcctgcttgggactacgatgccaatgatgacattgtaaatgaatacgacacaacctacttggatgacattgccaagagattgaacaaggaaaacaagggtttgaacttgacctcaactgacgctagtactttattctcgtggtgtgcatttgaagtgaacgctaaaggttacagtgatgtctgtgatattttcaccaaggatgaattagtccattactcctactaccaagacttgcacacttattaccatgagggtccaggttacgacattatcaagtctgtcggttccaacttgttcaatgcctcagtcaaattattaaagcaaagtgagattcaagaccaaaaggtttggttgagttttacccacgataccgatatcctaaactttttgaccaccgctggtataattgacgacaaaaacaacttaactgccgaatacgttccattcatgggcaacactttccacagatcctggtacgttcctcaaggtgctcgtgtctacaccgaaaaattccaatgttctaacgacacctacgtcagatacgtcattaacgatgctgttgttccaattgaaacctgttccactggtccagggttctcttgtgaaatcaatgacttctacgactatgctgaaaagagagtagccggtactgacttcctaaaggtctgtaacgtcagcagcgtcagtaactctactgaattgaccttctactgggactggaacactactcattacaacgccagtctattgagacaa

SEQ ID NO: 25142 - DNA, 1359 bp, Saccharomyces cerevisiae
atgacagcatctcctgcaaaaaagaggttgagaaacaaatatctcagctgttgcttcttgttgatcgagatgactattaggagcagtatgaaaaacaacgcagaattggaaagcaagagtgtgttagctaatgaatcgaatataattagcacatttactagaaggataataaaggaaaaaagcggtaactatcaggtactgaaaagatcccttgatggaaaactaatctatcctgaggccactggcatatcctctaacagaggtaacaaacttttgcagagaagcgaagtagtaacaagaagagacttgaacaattctaagccaatgattgagcaaactgtgttctataacggttcggagcatcgccttctgcaaacaaatattgtcactgatagtagacgcaaaagaataaaattcacacctgacatcaacgtcgagcctgttttagtcggtgatgaaaacgacatcgatggtagtgagaaggaagacgaaaatatcactgatgagtattacggcgaagaagacgatgacgacctatcaaaactagtgaatgtaaaggagattttgactcccattctttccctaggggatataataaatcataaaactatctcaaggacattttcaagcccaattttgaaaaatttagccttgcaaataattctaatgattgaaaaagaacagatgtcagttgttagatattcccagtttttggaggtttttttaggagatcatcctgaaccaatttatgaatctaacttgaacctaccatcttataatcacaatttgacccttccagaggatagaggggcaagcgacgaggatgacattaacaacaaaaacaatatcaacgaggttaactcgaatagtttgtctactgaagctggtcatatcaataatggcatggaagaatttggagaggaagatcctttttttgcattgccaaggttggaacaatctaatgcgctgttatcgttgctgccatcttcttccggttctgcttctatatcaacattaacagcggccgaacaacaacagttaaatgaggaaattgagtctgcccgacagctgtcgcagattgcactacagaggaataaagaattcataagaaacttacaaaaaatcagaaagtctgtaataaaagccaatagaataagaggtaggattttaaattggagtcgggaatatttgggtatatctgacgatgatattactatcccggtggctctacgtgttgtgaagagaggtctgatcagtgctacaacaaataagacaacaaattttgaggaagaaattgaaaataccatggaagacggtgttgtagacgataatgaacctgatgaagaagctaatagagcc

SEQ ID NO: 25143 - DNA, 1416 bp, Saccharomyces cerevisiae
atgagccagatcgttgattttgttgaggacaaagattcaagaaacgatgccagtattcagatcatcgatggaccctcaaatgttgaaattatcgctctctcggaatcaatggatcaagatgagtgcaaaagggcacatgtaagctctgcagagatgattccatcatcaccgcaaagaaaatctgtttcgaatgatgttgagaatgttgacctaaacaaatctatcgaactttctgcgccgttcttccaagatatcagtataagcaagctagatgacttttctacaacagtaaattccatcatagattcgtctctcagaaatgagaataatgcaaaaggaaacgcgaaaaaacttttggatgatctaataagtgatgaatggtcagctgatcttgagtcgagtggaaagaagcacaacaaatcacaatacaatttgagggacatcgcagagaaatggggagtacagtctttaaaaaatccagagcctattgctgttgactgcgaatataagacacaaggaatcggaaaaaccaatagtgacattagtgatagtccgaaatcacagataggagcagctgatatactgttcgattttccactgtctccagtaaaacatgagaacccaactgaagaaaagcacaattcgattgctaatgaaaattcttcaccagataatagcctgaaaccagcaggaaaacaaaatcatggtgaagatgggacatccatggcaaaaagggtatacaataaaggtgaagacgagcaagaacaccttccgaaaggaaagaagagaaccatagcgttatcaagaacactaatcaacagcaccaaactacctgatacagtagaactaaatctttctaaatttctcgattcctcagatagtattactactgatgtactttcaacccctgcaaaggggtctaacatagtaaggacaggtagtcaaccaatctttagcaacgctaattgttttcaggaagcaaaacgctcgaaaacattaacggctgaggatcccaaatgtactaaaaatactgccagagaggtatcacaactagagaattatattgcctatgggcaatactatactagagaagactcaaaaaacaaaatacgacacttgttaaaagaaaacaaaaatgcttttaagcgagttaaccagatatatcgagataatataaaagcacgctctcaaatgattatagagttttcgcctagccttctccagttatttaaaaaaggagacagtgatctgcaacaacaattggcaccagcagttgtgcaatcaagctataacgattctatgccgcttttaagatttcttcgaaaatgtgacagtatttacgactttagtaacgatttctattacccctgtgatcccaaaatagttgaagaaaaccgttttgattctatattatga

SEQ ID NO: 25144 - DNA, 2259 bp, Saccharomyces cerevisiae
atggttgagttttctttgaagaaggccagaaacaattggaagcatgtaaagaagtctgcaagctctcctgctaagcaaaagacacctccatcgcctgctaagcctaaacaaaaaacaaaaaagaacccttatagtgatctcaaggatccggctaccagttatacgctaccaacaatcaatgcaagggagagaagtagggtagcaacttcaatgcagagaagactatcaattcataatacaaattatgctccacctacactagattactcaatgcccctacctgatatgccaaacatgatagttcccaatgataatgtggatagtagtcataataatagtagtttcaccactgagaacgaatcggtaagctctaaaggcccttccaacagtttaaatctttcaactgccgatctctccctgaacgacagctcctataataaggtgcctgctagatcagcaatgcgaaatactgtcaatccttccggcagtaatgatcctttcaataatagcacgtcgctaagaaagatgttggcaaacccgcattttaatgctaaagattttgttcatgataaactaggcaatgcgagtgccattactattgataaatttacctcaaatttaacagatttatcgatacaggtccaagaagaagtaaagttaaatatcaataaatcatataacgaaatcatgacggtaaacaacgacctaaatgttgctatgttggagcttaaaagggttagagcaaatataaatgatttaaacgaggttttggatcagtgcaccaaaatagctgaaaaaaggttacaattgcaggatcaaatagatcaagagagacaaggcaattttaacaatgttgaaagtcattctaatagtccagcgttacttccgcctttgaaagcaggacaaaatgggaatctcatgaggagggacagatcgagcgtcttgatattagagaaattttgggatacggaactggatcagctgtttaagaacgttgaaggtgctcagaagtttatcaattctacgaaaggaagacatattttaatgaatagtgccaattggatggaattaaatactaccactggtaaacccttgcagatggtacagattttcattttgaatgatttggtacttatcgccgataaatcaagagataagcaaaatgactttatagtaagccagtgctatcctttaaaggatgtcactgtcacgcaagaggaattttccactaagaggctacttttcaagtttagcaattcgaattcaagtttgtatgaatgtagagacgcagacgaatgctctaggttgttggacgttataagaaaggctaaggatgatttgtgcgacatattccatgtagaagaggagaactctaaacgtattagagagtcctttagatatttgcaatctacgcaacaaaccccaggtagagaaaacaacagaagccctaacaaaaacaaaagacgtagtatggggggttcaatcactcctggccgaaatgtaacaggcgcaatggatcaatatcttttgcagaacctaactctatcaatgcattcgaggccaaggtccagagatatgagttcaaccgcccagaggcttaaattcctggatgaaggcgtggaagagatagatattgaattagctaggcttaggtttgaaagtgccgtggaaacattattggatattgaatcacaattggaggatctttctgaaagaatttctgatgaagagttaatgttacttaacctgatatctttaaaaatcgaacaaagaagagaggccatttctagcaaactttctcagagcattttatcatcgaatgaaatagtgcatttgaaaagcggtactgaaaatatgattaagttaggattaccagagcaagctcttgacctattcttacagaatagatctaatttcattcaagatttgattctacagattggatcagtggacaatcctacgaactatttgactcaattggctgttatcaggttccaaaccattaaaaaaacagtggaggacttccaggatattttcaaagaactcggggctaagatttcttccatcctagtagattggtgtagcgacgaagtggataatcacttcaaattgatagacaagcaattactgaatgatgaaatgttatccccagggtccattaagtcatccagaaaacagatagatggattgaaggccgtaggtttggattttgtctacaaattggacgagtttatcaaaaagaacagtgataaaattcgc

SEQ ID NO: 25145 - DNA, 990 bp, Saccharomyces cerevisiae
atgagtgaagaatttcctacgccgcagcttttggatgaattggaagatcaacagaaagttaccacgccgaatgagaagagagagttaagttctaatcgtgtgttgaaggatatttttgcgggtaccatcggtggtattgcacaagttcttgtagggcaaccgtttgatacaacaaaagttaggcttcaaacagccaccacaagaacaacaacgttggaggtattgcgtaacttggtaaagaatgagggtgtgtttgcattctacaaaggtgcgttaacaccgttattgggtgttggtatatgtgtctcagtacaatttggtgtgaatgaggcgatgaaaagatttttccaaaattacaacgcttctaagaacccgaatatgagctcacaggacgtagatctttcacgttcaaatactctgccactatcccagtactacgtttgtgggttgacaggtggtgtagtcaattcattcttggcatcgcccattgaacaaataagaattcgtttgcagacgcaaacatctaatggtggagacagagaattcaaaggtccttgggactgtattaaaaaattgaaagctcaaggtggattgatgaggggtttatttcccacaatgataagagccggacatgggcttggtacatattttcttgtctacgaagcattggttgccagagaaattggtacgggactaacaagaaacgaaattcctccttggaaattatgcttatttggtgcattttccgggacaatgttgtggttgacagtatacccattggacgttgtgaaatccattatacaaaacgatgatttacgaaaacctaaatacaagaattccatttcttacgtagcaaagaccatttatgcaaaagaaggtatcagagcctttttcaaagggtttgggccaacaatggttaggtccgcgcccgttaatggtgcgacattcctgacgtttgaattagtcatgagatttctgggggaagagtag

SEQ ID NO: 25146 - DNA, 441 bp, Saccharomyces cerevisiae
atgtcctccaatcttaccgaagaacaaattgctgaattcaaagaagcctttgccctctttgataaagataacaatggctctatctcatcaagtgaattggccactgtgatgaggtcattgggtctttcgcccagtgaagcagaagtaaatgatttgatgaacgaaatagatgttgatggtaaccatcaaatcgaatttagtgaatttttggctctgatgtctcgtcaactcaaatcaaatgactctgaacaagaactactagaagcttttaaagtattcgataagaacggtgatggtttaatctccgccgctgagttgaaacacgtgctaacatccattggtgaaaaattgactgatgccgaagtagatgatatgctaagagaggttagtgatggatcaggcgagatcaacattcaacaattcgctgctttgttatctaaa

SEQ ID NO: 25147 - DNA, 2373 bp, Saccharomyces cerevisiae
atgcaagaagggggctttatccgtagaaggcgtacgagaagtacgaaaaaaagtgttaattataatgaactaagcgatgacgatacagctgtgaaaaactcaaaaactctgcagctgaaagggaacagcgaaaacgtaaatgacagccaagatgaagaataccgtgatgatgctacgctcgtgaaatcacccgacgacgatgacaaagattttatcatagacctaacaggttcagataaagagcggaccgccaccgatgagaatactcatgcgatcaagaatgataatgacgagataatagaaatcaaggaggaacgtgatgtttcggatgacgacgaaccgttaacaaagaaaaggaagacaactgctaggaagaagaagaaaaaaacgagcaccaagaaaaagtcaccgaaggtaaccccatatgaaagaaacactttgcgattatatgagcatcatcctgaactaaggaatgttttcacggatttgaaaaatgcacctccctatgtcccccaaagatccaagcagccggatggtatgaccatcaaactgctacctttccagttagaaggtcttcattggctaatatctcaagaggagagcatttatgcgggcggtgttttggcagacgaaatgggtatgggtaagaccatccaaactattgccctattaatgaacgatttgactaagtctccgtctttagttgttgcccctaccgtggcgctgatgcagtggaaaaacgaaatagaacaacatacaaagggacaactgaaaatatacatttatcacggtgcttccagaaccacggatatcaaagatttgcaaggctacgatgttgtactaaccacttacgcagtgctggaatcggtattcagaaagcaaaactacgggtttagaaggaaaaatggacttttcaagcagccttccgtattgcataatattgacttttatagagttattctggatgaggcacacaatatcaaggatagacaaagcaatactgctagggctgtaaacaacttaaaaacgcaaaagcgatggtgcctgtcgggtactccgctgcaaaatagaattggtgagatgtattctttgatcagattcttaaatatcaatcctttcacaaagtacttttgtaccaagtgtgattgcgcttcgaaggactggaaatttacggatcgcatgcattgtgaccattgtagtcacgtcattatgcaacacacgaatttcttcaaccatttcatgttgaagaacattcagaaatttggtgtggaaggtcctggtttagagtcttttaataacattcagacattattgaaaaacatcatgctgcgaagaactaaagtggaaagagcggatgacttgggtctaccgcccagaattgttaccgtgaggagagacttcttcaatgaagaggaaaaagatctttacagaagtttatacacagattctaaaaggaagtataattcctttgttgaggagggtgttgttctaaacaattatgcaaacattttcaccctaatcacaagaatgaggcaactggcagatcatcctgatttagttttgaaaagattaaacaattttcctggcgatgatatcggcgtcgtgatctgccaattatgtaacgatgaagctgaggagcccattgaatctaaatgtcaccataagttctgtcgtttatgcatcaaagaatatgtggaatctttcatggaaaacaacaataaacttacttgtcctgtttgtcatatcgggctaagtatcgatttgtctcaacctgctttggaagtggaccttgattccttcaaaaagcaaagtattgttagccgtctaaacatgagtggcaagtggcaatcatcaacgaaaatcgaagcacttgtggaagaactatacaaactgagaagcaacaagagaacgattaaatccattgtgttttcccagtttaccagtatgctggatctggtagagtggagattgaaaagagctggatttcaaacagtgaagcttcagggtagtatgtcaccgacgcaaagagatgaaaccatcaagtatttcatgaacaacattcaatgcgaggttttcttggtcagtttaaaggcgggcggtgttgctttgaatctttgtgaagcttcgcaagtattcattttagacccatggtggaaccctagtgttgaatggcaaagtggtgatagagttcatagaattggtcagtatcgacctgtgaagatcacaaggttttgcattgaggatagtatagaagcaagaatcattgaattacaggaaaaaaaggcaaatatgattcatgctacaataaaccaagatgaagctgccattagcagactaacgccagctgatttacagttcttattcaataactaa

SEQ ID NO: 25148 - DNA, 1377 bp, Saccharomyces cerevisiae
atgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagatcggtggtattggtactgtgccagtcggtagagttgaaaccggtgtcatcaagccaggtatggttgttactttcgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataa

SEQ ID NO: 25149 - DNA, 1179 bp, Saccharomyces cerevisiae
atgggtcaattgctttcccatccgttgacggagaagaccatagaatataatgaatataaaaacaaccaggcgtcaactggtattgttccacgattttacaattgtgtggggtccatgcaaggctatcgtttgactcaggaagatgcacatctaattagaaatgaaaactctgttgtgtacgtacgatttttcaacccattcatagacaaatacgaaaccctgtcattgaacgtcttcgcagtattcgatggtcatggtggagatgattgttcgaaatttctaagcggcggccgccaccatcgcgatggtaacggcagtagcaacggtaatggtgaacccaacgctggcctgatcaaatggattgcgtatagtttcgaaaaccaccattacacatctacaactaataacgactcatcaaaatttaaaagatccttcaatacgttggaaggacttgtttctcaaatttttaaagacgctttcatattgcaagatgaagagttatatcgacattttgccaacagttcgtgtggatctacagcagtagtagcatgcatcataaacgaggaatcactgtatgtggctaactgtggtgattcgcgatgtattctttcctccaaatcgaatggcataaagacgatgtctttcgatcataagccacaacacataggagaattgatacgtataaacgataatggtggtactgtctctcttggaagagtgggtggagtactggctctcagtagggcatttagtgatttccaattcaagagaggtgtcacttatccacatagaaggacaaaactaacaaatattacccagaatttaacttatggaaccccaccacaagaagcacaagttaccgttgaaccagacgtattgatgcacaagattgactattctaaagatgagtttttagtactggcttgcgacggtatatgggatatttataacaacaaacagttaattcactttataaagtatcacctggtatcagggacgaagttggatacaataataacaaaattgttggaccacgggatagcgcaggcaaatagcaatactggtgtcggctttgacaatatgactgccatcattgtagtgctaaaccggaaaggcgaaacattgcaagactggtttaataaaatgaagacccgtttggaaagagaaaggggcctagtg

SEQ ID NO: 25150 - DNA, 1485 bp, Saccharomyces cerevisiae
atgactacggataacgctaaggcgcaactgacctcgtcttcagggggtaacattattgtggtgtccaacaggcttcccgtgacaatcactaaaaacagcagtacgggacagtacgagtacgcaatgtcgtccggagggctggtcacggcgttggaagggttgaagaagacgtacactttcaagtggttcggatggcctgggctagagattcctgacgatgagaaggatcaggtgaggaaggacttgctggaaaagtttaatgccgtacccatcttcctgagcgatgaaatcgcagacttacactacaacgggttcagtaattctattctatggccgttattccattaccatcctggtgagatcaatttcgacgagaatgcgtggttggcatacaacgaggcaaaccagacgttcaccaacgagattgctaagactatgaaccataacgatttaatctgggtgcatgattaccatttgatgttggttccggaaatgttgagagtcaagattcacgagaagcaactgcaaaacgttaaggtcgggtggttcctgcacacaccattcccttcgagtgaaatttacagaatcttacctgtcagacaagagattttgaagggtgttttgagttgtgatttagtcgggttccacacatacgattatgcaagacatttcttgtcttccgtgcaaagagtgcttaacgtgaacacattgcctaatggggtggaataccagggcagattcgttaacgtaggggccttccctatcggtatcgacgtggacaagttcaccgatgggttgaaaaaggaatccgtacaaaagagaatccaacaattgaaggaaactttcaagggctgcaagatcatagttggtgtcgacaggctggattacatcaaaggtgtgcctcagaagttgcacgccatggaagtgtttctgaacgagcatccagaatggaggggcaaggttgttctggtacaggttgcagtgccaagtcgtggagatgtggaagagtaccaatatttaagatctgtggtcaatgagttggtcggtagaatcaacggtcagttcggtactgtggaattcgtccccatccatttcatgcacaagtctataccatttgaagagctgatttcgttatatgctgtgagcgatgtttgtttggtctcgtccacccgtgatggtatgaacttggtttcctacgaatatattgcttgccaagaagaaaagaaaggttccttaatcctgagtgagttcacaggtgccgcacaatccttgaatggtgctattattgtaaatccttggaacaccgatgatctttctgatgccatcaacgaggccttgactttgcccgatgtaaagaaagaagttaactgggaaaaactttacaaatacatctctaaatacacttctgccttctggggtgaaaatttcgtccatgaattatacagtacatcatcaagctcaacaagctcctctgccaccaaaaac

SEQ ID NO: 25151 - DNA, 1551 bp, Saccharomyces cerevisiae
atggttttgtctgataaggagttgtttgccataaataagaaagccgtcgaacaaggtttcaatgtgaagcctagattgaactataatacggtcagtggtgtgaacggtccattagtcattttggaaaaggtcaagttcccacgttacaacgaaattgttaatttgacattgccagatggaaccgtgagacaaggtcaagttttggaaattagaggagatagagccattgtgcaagtgtttgaaggtacatctggtattgatgtcaagaagactaccgtggaattcactggtgagagtttgagaattcctgtgtctgaagacatgttgggtagaatttttgacggttctggtagacccattgacaacggtcctaaagttttcgcagaggattacttggacattaacggttctcctatcaacccatatgctcgtatttatccagaagaaatgatttctactggtgtttctgctattgacacaatgaactccattgccagaggtcaaaagatcccaattttctccgcatcaggtttaccacacaacgaaattgcagcacaaatttgtagacaggctggtttggtgagacctaccaaggatgttcatgatggtcatgaagaaaatttctccatcgtttttgctgccatgggtgtcaacttggaaaccgctagatttttcaaacaggatttcgaagaaaatgggtctttggaaagaacttcattatttttgaacttggctaatgaccctaccattgaaagaattatcactccaagattggccttgaccaccgctgaataccttgcttaccaaacggaacgtcatgtgttgaccatcttgaccgatatgtcatcgtatgctgatgctcttagagaagtttccgctgctagagaagaagttccaggtagaagaggttatcctggttacatgtatacagatttgtccacaatttatgaaagagcaggtagagtagagggtcgtaacgggtccatcactcaaatacctatcttgacaatgcctaacgatgatattacgcatccaattccggatttgaccggttatattaccgagggtcaaatcttcgttgaccgtcaattacataacaagggtatctacccaccaatcaacgtcttgccttcgttgagtagattgatgaaatctgccatcggtgaaggtatgaccagaaaggaccacggtgacgtttctaaccaattgtatgccaagtacgccatcggtaaggacgctgctgctatgaaggccgttgtcggtgaagaggcgttatccatcgaagataagttatctttggaatttttggaaaaattcgaaaagacctttatcacacaaggcgcctacgaggacagaaccgttttcgaaagtttggaccaggcatggagtttgctaagaatctaccctaaggagatgttgaatagaatctccccaaagattcttgatgaattttacgatagagccagagacgatgccgacgaagatgaagaagatcccgacacaagaagctccggtaagaagaaggacgccagccaagaagaatctctaatc

SEQ ID NO: 25152 - DNA, 1788 bp, Saccharomyces cerevisiae
atgacaaaggaacgtatgaccatcgactacgaaaatgacggtgattttgagtacgataagaataaatacaagacaataaccactcgaataaagagtatcgaacctagtgagggatggttggaaccttctgggtcagtgggtcacataaacacgatacccgaagcgggcgatgttcacgtggatgaacatgaggatagagggtcttctattgatgatgactcaaggacttacctgctatatttcacagaaactcgacgtaaactagaaaacaggcacgtccagttgattgctatttccggtgtcattggtacggcgctattcgtggcgatcggaaaagctttataccgtggagggcccgcctctttattattggcatttgctctttggtgtgttccaatactttgcattactgtgtctacagcggaaatggtctgctttttccctgtaagttccccctttttgagattagcaacgaagtgcgttgacgattcattggctgtcatggctagctggaatttctggtttcttgaatgcgtacagatccctttcgagattgtttctgttaatacaattatacattattggagagatgattattcagctggtattccgctcgccgttcaagtagttttgtatctgcttatttccatttgtgcagtcaaatattacggtgaaatggaattttggttggcttctttcaaaattatccttgcactcggcctatttacattcacgttcattaccatgttgggtggaaatcctgaacatgatcgttacgggtttcgtaattatggtgaaagtccattcaagaaatactttcccgatggcaatgatgtggggaagtcttcgggctacttccaggggtttctcgcttgcttgattcaggcatcgtttaccatagctggtggcgagtatatttctatgttagcgggagaggtcaaacgaccaagaaaagtattacccaaggcgtttaagcaggtgtttgtgagattaacatttttgtttttagggagttgtctgtgtgttgggattgtttgttcgccaaatgatcctgacttgacagcagcaattaatgaagcaaggcctggcgccgggtcttcaccttatgtcattgcaatgaataatctgaaaattagaatattacctgacattgttaatatagctttgattacagccgccttttctgctggtaacgcttacacttattgctcatccagaacattttatggtatggcattagatggctacgcgccaaaaatcttcactagatgcaataggcatggtgtgcccatttactctgtggccatatctttggtatgggctttagtgagccttttgcaactgaattctaatagtgcggtcgtattgaattggttaattaacttgattactgcctctcaattgattaattttgtcgtcctttgtatcgtctatttatttttcagaagggcttaccacgtccaacaagattcgttacccaagttgccattccgttcgtggggtcaaccatacactgctattatcggccttgtttcatgttccgcaatgattttaatacagggctacaccgttttctttcccaaattatggaacacacaagattttttgttttcgtatttaatggtgtttatcaacatcggtatatatgtgggctacaaatttatttggaaacgtggtaaagatcacttcaaaaacccacatgaaattgacttttctaaagagctaacagaaattgaaaaccatgagattgaaagctccttcgaaaaatttcaatattatagcaaagca

SEQ ID NO: 25153 - DNA, 2481 bp, Saccharomyces cerevisiae
atgcatagcaacgtatttgttggtgtcaaaccaggctttaatcataaacagcacagcaaaaagtcacgtttcctagaaaatgtctctagtcattcaccagaactgcctagtaactatgattacgttttgcttcctataacaacgccaagatataaggaaatagttgggcaagttttcaaagatttccaaagacaatccatacagaactggaaaccgcttcaaattcctgaaccgcagttgcaggatatctgtatacccccgttcaacgtcaagaagctagacaatgacgatacgccgtcttacatagggctgttatcctcttggctggagctggagagtcgcgatccaaatgtaagagatcttggcttaaaggtccttctaaacgaatgtaagtacgcgaggtttgttggaatcaataagctaatattggcgcctccacgggacctgtccaacctgcaattgtatggacagatgatttacaggctcctgcaaaatcgcatcgtctttgctgcgcctgcgttaaccatatccatttctctgccactttacgaagacagcgatccattggccacttgggaactgtggaataccgtgcggaaacaatgcgaatatcatccctctttgactatctctttggctttgccaagaaccaggactccttcgtatgtgctgaatagatggttagccgaacccgtctcgtgtcttttggtatcttcatccatctttgccagtaatcagtacgattatcccgttttacacaagtttaaccagaatttgattttaaagttccaaaaggttaatggagattcacaaattttgggtaatgaattatgcgtgatattgcatgggatggagaaatatgccaataatgttaagggcggagaatctgcctatttggaatatataaactacttattgaaaaagggcgacaaagtattaaattccaatagtaatcaccaatttttgctccaagaggactctcggataatgccgcctctgaaacctcattcagataatttattaaattccacatatttgacttttgaaaaagatttggtgaagtacgatctttacgaatctgccatattagaggcgcttcaagatcttgctcctcgagcgagtgccaagagaccgttggtgatcctagtagccggtgcgggaagaggacctttagtggatcgaacttttaagataatatcaatgttgtttatggatagtaaggtttctataattgccattgaaaaaaatccacaggcatatctgtacttgcaaaaaagaaatttcgactgttgggataatagagtgaaattaatcaaggaggatatgaccaaatggcaaatcaacgagccgtcggaaaagcgtattcagatagatctgtgcataagtgaactgctgggttcgttcggttgcaatgaattatcaccagaatgtctctggtctattgaaaaatatcattcccacaatgacacaattttcataccgaggtcatactcttcatacatagcacccatttcgtcaccattattctaccaaaaactctcacaaacaaatcgctctttggaggcgccctggatagtccatagagtgccatactgtatattatcctcaagggtaaatgaagtgtggcggttcgagcatcccatggcccaaaaagatactgtccaagacgaagatgattttacagttgaattttctcaaagttcattaaatgagttcaagataaagcaccgcggcgaaatccatggctttatcggattcttctcggcaaacttatataacaatatattcttgtcaactttgcccaatgacagcacagtccgtttaaaatttagcgaagaaacgttgatgaataccagacgagaagaaaatctaatcaagaaatgtgaccatacaccaaatatgacctcgtggtctccaattatctttcctttgaagcaaccaatatcctttatagatgactccgaactttctgtgctgatgtctcggatacactccgatacagaacaaaaagtttggtatgaatggtctttggagagtttcatataccttatgttgtcaaattacacttcggcggtaactgctgcaagcatgactattccgaggtctatagttacagatgacactaaaactttagcccataatcgacattattcagcgactaccaatcaaaagctagataatcaaattgatcttgaccaagacattgaaaacgaagaagaacagggattcctatccaatctagaaactggttggcaaagcgtacaagatattcacggactcagcgaaaccgccaaaccggaccatttagattctatcaataagcctatgtttgatctcaaatctactaaagcgcttgaaccctctaacgaattgccaaggcacgaagacctcgaggaagatgttccagaagttcatgtcagagtcaagactagtgtttccacgctacataatgtctgtggcagagccttttccctgcctctg

SEQ ID NO: 25154 - DNA, 453 bp, Saccharomyces cerevisiae
atgtaccatcactatcacgccttccaaggcagaaagcttactgaccaagaaagagcacgcgtgttggagtttcaagattccattcactattctccgcggtactcagacgataactatgagtacaggcatgtgatgttacctaaggccatgctaaaagttatcccatctgattacttcaattcggaagtggggaccctgcgtatattaacagaagacgaatggagaggcctcggcatcacacagtctttggggtgggaacattatgaatgccatgcgccagaaccacacattttgctattcaaaaggccgctgaactacgaggccgagctgagggcagcgaccgctgctgctcaacagcaacagcaacagcagcaacagcagcaacaacaacaacagcaacatcaaacacaatcgatttcgaacgatatgcaagttccaccccaaatctcctag

SEQ ID NO: 25155 - DNA, 7107 bp, Saccharomyces cerevisiae
atggaatcacacgtcaaatatcttgacgaattgatattggcaataaaagacctgaactcgggggtggattcaaaggtgcagattaaaaaagtgcccacggatccatcttcttctcaggagtacgccaagagtttaaagatcctgaacaccctcataagaaacctaaaagatcaaagaaggaacaatatcatgaaaaatgatactatattttcgaaaacagtttccgcccttgccttattgttggagtacaaccccttcttgcttgttatgaaggattccaacgggaactttgagatacaaaggctgatagatgatttcctcaacatatccgttctgaactatgataattaccacagaatatggtttatgaggcgaaaattaggcagctggtgcaaagcatgtgtcgaattttacggaaaacctgctaagtttcagcttactgcacattttgagaacaccatgaatctttacgaacaggccttgactgaagtcttgttgggcaagactgagcttctcaaattttatgacaccttgaagggtctatacattcttttatactggttcacttcggagtatagtacttttgggaactctatagcattcttagattcttctttggggttcacgaaatttgactttaacttccaacgattaatcaggattgttctttacgtctttgattcctgcgaactagcagcactagaatatgccgaaatccaactcaaatatatttctctagttgtggactatgtttgcaatagaacaatttccacagccctggatgccccagcgttagtttgttgtgaacaattaaagtttgtattgactactatgcatcattttttggataacaagtatgggctcttggataatgaccccactatggccaaaggaattcttcgactatattctctttgcatttctaacgatttctcaaaatgctttgtagaccacttcccaattgaccagtgggcagatttttcacaaagtgaacattttccgttcacgcagttgactaataaagctctctcgattgtatattttgatttgaaaagaaggtccctacctgttgaagctttaaagtacgataataagttcaacatctgggtataccaatcggagccggactcgagcttgaaaaatgtcacttctccctttgatgatcgatataagcagctggaaaagctaaggttgctagtactaaagaagtttaacaagacagaaagaggaactttgctcaaataccgcgtgaaccagctaagtcctggattttttcaaagagctggaaacgatttcaagctaattttaaatgaagcatctgtatccattcaaacttgtttcaagacaaacaatataacaaggctaacatcatggactgtaattctcggacgtctagcctgtctagaatcagagaagttttccggcactctgccaaattccacaaaggatatggataattggtatgtttgtcatttatgcgatattgagaaaactggcaaccctttcgtgcgaataaatccaaatagaccagaggctgcgggtaaatcagaaatcttcaggatacttcattcaaactttctatctcacccaaatatagatgaatttagcgaatctttgttaagtggcatcttattttctctacataggatattttcacactttcaacctccaaaacttacagatggaaacggtcaaatcaataagagctttaaactggtacaaaagtgctttatgaattctaacagatacctacgtttattaagtactagaattatacctttattcaatatatcagactctcataattccgaagatgaacacactgccacgctgataaagtttctacaatctcaaaaattgccagtggtgaaagaaaatttagtcattgcttggacacaattaacattgacgacttctaatgatgtatttgatacactacttttgaaactgattgatattttcaattctgatgattatagtttacgaataatgatgactttgcaaattaaaaatatggccaaaattttaaagaaaacaccatatcaattactatcgcctattttacctgtattactaagacagttgggaaaaaacctcgtggaaagaaaagttggctttcaaaatttaatagaattattgggatattcttcaaaaacaattctcgatattttccagagatatatcatcccttatgcaattattcaatataagagcgatgtgctaagtgaaattgctaagattatgtgtgatggcgatacaagtttaattaaccaaatgaaggttaatttactgaaaaaaaacagtaggcaaatatttgccgtagctttggtaaaacacggattattttctttggatatcttggaaaccctttttttaaatagggctccaacttttgacaaaggatatataactgcataccttcccgattataaaactttagctgaaataacgaagctctacaaaaacagcgttactaaagatgcaagtgacagcgagaatgctaatatgattttatgctctttgcgatttttaatcaccaattttgaaaaagacaaaaggcatggttcgaagtacaaaaatatcaataactggacggatgatcaggaacaagcgttccaaaagaaactacaggataatatcttaggtattttccaagttttttcgagtgacatacatgatgttgaaggccgcaccacttactacgaaaagttaagggttatcaatggcatttcttttcttatcatatatgcccccaaaaaatcaataatttccgcattagcccagattagtatttgtttgcaaacaggacttgggcttaaggaagttcgatacgaggcctttagatgttggcatctgttagttcgccatctaaatgatgaagaactctctactgttatagatagcttaattgcattcatacttcaaaagtggtctgagttcaacggaaaacttcgaaatatagtgtacagtatactggataccttaatcaaagagaaatcggacctgattttgaaattaaaaccttacactactttggctttagtaggcaagcctgaattaggtattttagctcgtgatggccaatttgcaagaatggtgaataaaataagaagtaccacggaccttatacccatatttgctaataacttgaaaagtagtaacaagtatgtcataaaccaaaatttagacgatatagaggtatatcttcggagaaagcagacagaaagatcgattgattttacaccaaagaaggttgggcaaacttctgatataacattagttttgggtgctttattagacacttctcataagtttagaaatttagacaaggacctatgcgagaagtgcgccaaatgtatcagtatgattggtgttttagacgttacaaagcatgagtttaaaagaacaacatattcagaaaacgaagtttatgatttgaatgatagtgttcaaactattaagttcttgatatgggtcataaatgatatcctcgttcctgcgttttggcaaagtgagaatcccagcaagcaattgtttgttgcccttgtcatacaggaatcattaaaatattgcgggctaagttcagagtcatgggatatgaaccataaagaattatatccaaatgaagccaaactatgggaaaagtttaactctgtctccaagacaaccatctatccgcttttatcttccttgtatcttgcgcaatcatggaaagaatatgtcccgctaaaatatccttctaataacttcaaggaaggatacaaaatttgggtgaaaaggtttacattggatttattgaaaacaggtacaacagaaaatcatccattacacgtgttttcctctttgattagggaagatgatggctcactatcaaattttttgctaccttatatttctctggacattattatcaaggcagaaaaaggaactccatacgctgatattttaaacgggattattattgaatttgacagcattttcacgtgcaatctggaaggaatgaataacttgcaagtggattcgttaagaatgtgctatgaatccatcttcagagttttcgaatattgcaaaaaatgggcaactgagtttaaacaaaattacagtaaactacacggcacttttatcattaaagatacgaaaacaactaacatgcttttgagaatagatgagtttttgcgaacaaccccttcagatttgctagctcaacgctccttagagacggattcttttgaaaggtctgctctataccttgaacagtgctatcgacagaatcctcacgataagaaccaaaatggacaactactgaaaaatttacaaatcacatacgaagaaataggagacattgactcactcgatggtgtactgagaacctttgctacaggaaacttggtttctaaaattgaagaattgcaatattctgaaaactggaaactcgcacaagactgctttaatgtcctcggcaaattttcagatgaccccaaaactacaaccaggatgctaaagtctatgtatgaccaccaattgtattctcaaataatatcgaactcttcgttccattcttcagacggaaaaatttctttgtctccagatgtgaaggaatggtacagcataggtcttgaagctgcaaatctagaaggcaatgttcaaactttgaaaaattgggtagaacaaatagagagtttaagaaatattgacgatagagaagtacttttgcagtacaatattgcgaaagctttaattgccatctcaaacgaggatccattaaggactcaaaaatacatccacaattcctttaggcttatcggaacaaattttataacgtcatctaaagagacgacgctgctaaagaaacagaatttattgatgaaattacacagtttatatgacctcagttttttatcttctgcgaaagataagtttgaatacaaaagtaacactaccatactcgattatcgaatggaacgtattggggctgacttcgtgccaaatcattacatattgtcaatgagaaagtcatttgaccaattgaaaatgaatgaacaagcagacgctgacttaggaaaaacattcttcactttagcccaattggcgagaaacaacgctaggctagatatagcctccgaatcattaatgcattgtttggaaaggcggttgcctcaggcagagttggagtttgctgaaatactatggaagcaaggtgagaatgatagagccttaaagatagtgcaagaaatacatgaaaagtatcaagaaaattcctcggttaatgctcgcgatcgtgccgccgtgctattaaagtttactgaatggttagacctttcgaacaattcagcgtccgaacaaattattaaacaatatcaggatatttttcagattgattctaaatgggataaaccatattactctattggcttatactatagtagactacttgagcgcaaaaaagcagagggttatattactaatggtcgttttgagtacagggcaatatcttactttttattggcatttgaaaagaacactgctaaagtaagagaaaatttgcccaaagttatcacgttttggctagatattgcggccgcatcaatttctgaagctcctggaaacagaaaggaaatgctgagtaaggctacggaagatatatgtagtcatgttgaagaagcgctgcagcattgtcccacttatatttggtactttgttttgactcagttgttatctaggttattacattctcatcaatcatcggcccagataataatgcacatactgctaagtttggctgttgaatacccctctcatattttatggtatatcacagcccttgtaaattccaattcttcaaaaagagttcttcgtggtaagcatattttagaaaagtatagacaacattcgcaaaatcctcatgatctagtttctagtgcattggatttaacgaaagcattaactcgtgtctgtttgcaagatgtcaaaagcattacaagtagatcaggcaaatctttagaaaaagacttcaaatttgacatgaacgtggccccatctgcaatggttgttccagtaagaaaaaatttagacatcatttcaccactagagtctaactcaatgaggggctatcaaccatttaggccggttgtttctataattagattcggatcatcttataaagtgttttcttcattaaagaagccaaaacaattgaacataataggttcagatggcaacatttatgggatcatgtgtaagaaggaagatgtccgacaagataaccaatatatgcagttcgccacaacaatggattttcttctgagtaaggacatagcttcaagaaaaagaagcctgggcataaatatttactccgtactatctcttcgagaagactgtgggatattggaaatggtaccgaatgttgtaactttaagatctattctttctacaaagtacgaaagtctgaaaattaagtatagcctgaaaagtctacatgataggtggcagcacaccgcagtagatggaaaactcgagttttacatggaacaggtagataaatttcctccaatcttgtaccaatggtttttagaaaactttcctgatccaatcaattggttcaacgccaggaatacgtatgccagatcttacgccgtcatggcaatggttggccatatattaggtctaggtgataggcactgtgaaaacatattactagatatacagacgggtaaagttcttcatgtagacttcgactgtttatttgagaaaggcaaaaggttacctgtcccagaaattgttcccttcagactaacaccaaatttattggatgcgttgggcataattgggacagaaggaacatttaagaagtctagtgaagtcacgttggctttaatgagaaaaaatgaagtagcgttgatgaatgtgatcgaaacaattatgtacgatagaaacatggaccactcaattcaaaaagcgctaaaggtcttaagaaacaaaatccgcggtatagatccgcaggatggcctggtattgagtgttgctggccaaacagaaacattgatccaagaagcaacatcagaagacaatctaagcaagatgtatattggttggcttccattttggtaa

SEQ ID NO: 25156 - DNA, 1527 bp, Saccharomyces cerevisiae
atgaagtatctaaacttagttttcgtgcttcagcttcttattagcatcaaatacgcctcattcggccgagccttttctctttttgaagatgataccacctttgccaatttggataaacagctaaagcttccacagaatacacagcaaacccttaaattggaccgtttgaatcacgatgatccgctgtttacaacttttatttcttctgtggacacagattacagtttgagacttagaacagtagatccttctaaactaggaattgacaccgtaaaacaatggtcgggttacatggactataaggattccaaacactttttttactggttttttgaaagtaggaacgatcctgctaacgacccaattattctttggttaaatggtggacctggttgttcctcgtttactgggttgctatttgaactaggcccctcatcaattggcgccgatatgaaaccaatccacaatccctattcttggaataataacgcttcaatgatcttcttagaacagccactcggagtcggcttttcctatggtgatgaaaaagtctcctctacaaaattagcaggcaaagatgcgtacattttcctggaattgttttttgaagcttttcctcatttacgctccaacgatttccacattgcaggcgaatcctatgcaggacattatatccctcaaattgcacatgagatcgttgtcaagaaccctgaaagaacgttcaatttaacttcagttatgattggtaatggtatcacagaccctttgattcaagcagattattatgaaccaatggcatgcgggaaagggggctatcaccctgttctctcatcagaagaatgtgagaaaatgagtaaagctgcaggtcgttgtcgtaggttgaacaagttatgttatgcttctaaatcaagtttaccatgcatagtcgccactgcttactgtgactctgcacttttggaaccgtacattaacacaggactcaacgtctatgacattagagggccctgtgaagataatagtactgatggtatgtgttatacaggtctccgctatgtcgaccagtatatgaattttcctgaagttcaagaaacgctagggtccgacgtgcataattattctggctgtgataatgacgtgttcaccggatttttgtttacgggcgatggaagtaaaccatttcaacaatatattgctgaattattaaatcacaacattccggtattaatatatgcgggtgataaggattatatttgtaattggctgggaaaccatgcttggtccaatgagttggaatggatcaataaacgtaggtatcagagaaggatgttaagaccatgggtcagtaaagaaacaggtgaagagttgggacaagtcaagaactatggccctttcacctttttgagaatatacgatgccggtcatatggtgccctatgatcaaccggaggcaagtttggaaatggtcaacagttggatttccggtaatcgtgctttttcggatctttccaccttggaaaatgctagttag

SEQ ID NO: 25157 - DNA, 9276 bp, Saccharomyces cerevisiae
atgaatcaaagcgatccgcaagacaaaaaaaatttcccaatggaatactctttgaccaagcatcttttttttgataggcttctacttgttcttcccatagaatctaatttgaaaacatatgctgatgtggaggcagattcagttttcaattcgtgtcggtccatcattttgaatatagccatcactaaggacttgaacccgattatcgaaaacacattaggtttaattgacttgattgtgcaagatgaagaaattacgtctgacaatattacagatgatattgcccattctatattggttcttttgagattactgagtgatgtttttgagtattactgggatcaaaacaatgacttcaagaaaattagaaacgataattacaaaccgggattttcaagtcacaggccaaacttccatacatctaggccaaagcacacgagaatcaatccagctttggcgacgatgttactatgtaaaatttctaagctgaagttcaatacaagaactttaaaggttttacagaacatgtctcaccatctttctggcagcgctactatctcaaaatcgagtattttacccgattcacaggaatttttacaaaagagaaactatccagcatataccgagaaaatagatttaacaatagattatatccagagattcatatctgcttccaatcatgttgaattcacaaagtgtgtcaaaacaaaagttgttgcacctttattgatatcacacacctcaaccgaattgggcgtagtaaaccacttggatttatttggttgtgagtatttgactgataagaatctgctagcatatctggacatactacaacacctgtcaagttacatgaagaggaccatttttcattcgcttttgttatattatgcttccaaagcttttttattttggataatggcaaggccaaaagaatacgtcaaaatttataacaatctaatatcatcagattataatagtccgtcttcttcatctgataatggtggttcgaataattctgataaaacgtctatatcccaactagtctcactgttattcgatgacgtttattccacttttagtgtatcatcattattaacaaatgtcaataatgaccaccactaccatcttcatcattcatcttcttcatcaaagacgaccaacactaatagtccaaactctatatcaaaaacgtcgataaagcagtcgagtgtgaatgcttctggcaatgtttctccgtctcagttttctactgggaatgatgcatcgcctacttcccctatggcatcattgagttcacccttaaacacgaacatcctagggtatccgttatctccaatcacttcaacactaggacaggcgaatacttccacatcgactacggctgcaactaccaaaacagatgcagatacgccctctactatgaatactaacaacaataataacaataacaacagcgctaatcttaataatattccacaacgcatattttccttagatgacatttcatcctttaactcgagtagaaaatcactcaatctagatgatagtaactccttgtttctttgggatacttctcagcattctaatgcatcgatgacaaatacaaatatgcatgcaggagttaataattctcagtctcagaacgatcagtcttctttaaactatatggaaaatattatggagctgtattccaactataccggatcagaactatcctcccatactgccatattaaggtttttggtggttctgaccttattagacagtgaagtatatgatgagatgaactcaaattcgtatagaaaaatttcggaaccgataatgaatattaatccgaaggactctaatacttcaagttggggctcagcatccaaaaacccaagtatcaggcacctcacccatggcttaaaaaaacttactttacagcaaggcaggaaacgtaacgttaaatttttgacatatttgattagaaatttgaatgggggacagttcgtttcagatgtttccttgattgactctatcaggtccattctattcttaatgacaatgacgtcttctatatcccaaatcgattcaaatattgcttctgttattttttcgaagagattctacaacttgttgggtcaaaatttagaggtcggcaccaattggaattctgccactgcaaatacttttatttctcattgtgttgaaaggaatccccttacacataggcgtttacaattagagttttttgcaagcggtttacagctggattctgatttatttttaagacatttacaactggaaaaagaactcaatcacatagaccttcccaaaatatcgttatacactgaaggatttagggtattttttcacctagtaagcaccaaaaaacttcatgaggatattgcagaaaaaacctcctctgtgttaaagagacttttctgcataattgctgatattttgttgaaagcaacgccttattttgacgataatgtaaccaagattattgcttctatattggatgggcatattttagatcaatttgacgctgcgcgaacactttctaatgatgatcatgtcagttttgatgctgccacaagcgtttacactgagccaaccgaaattattcataactcatcggatgcctcgttagtctcttcactttcccaatcacccttatcaattaactcaggaagcaatatcaccaatacgcgcacctgggatattcaatcaatcttaccaaccttatcgaacagatcaagtgcttctgatttgagcttgtctaacattttgactaatccgttggaggcacaacaaaataataatgcaaacttgttagcccatagattatctggggttcctactactaagagatacgcttcaccgaacgactctgaaagatcacgacaaagtccatattcttctccgccgcaattgcaacaaagtgacttgccttctccgctctcagtcctctcgtcaagtgcaggattttcttctaatcattcgattacggcaaccccaactattttgaaaaacatcaaatctccaaaaccaaacaaaacaaaaaaaattgctgatgataaacaattgaaacagccttcttattcaagagtaatactgagtgacaatgatgaagcaagaaagattatgatgaacattttcagcattttcaaaagaatgaccaactggtttatacgcccagatgctaatacagaattcccgaagacttttacggatattataaaaccactttttgtctctatattggattctaatcaaagactacaagttacagcgcgggcttttattgaaatcccattaagttatatagctacttttgaagacattgataatgatcttgacccaagagtactgaatgaccattatttgttatgtacatatgccgttactttgtttgcttcatcattgtttgatttgaagttagaaaatgcgaagagagagatgctactagacattattgttaaatttcaacgagtccgttcttatttatcaaatttagcagaaaaacacaacctagtccaggcaataattacgacggagaggttgacgctgccattattagttggtgctgtaggaagtggaattttcatttcattatactgcagtcgtggaaatacgccacgcttaataaaaatttcatgttgtgaatttctacgatccttgagattttatcaaaaatacgtaggcgctttggatcaatattccatttacaatattgatttcatagatgctatggcccaggacaatttcactgcctcaggatcagtggctttgcaacggcgtctaagaaataatattttaacttatatcaaaggatccgactcaatccttttggattcaatggacgtgatttacaagaagtggttttacttcagctgttcgaaatcagttacgcaagaggaactagtagattttagaagcttggcaggcattctagcttctatgtcaggtattctgtctgatatgcaagagttggaaaaaagcaagagcgctccagataatgaaggagacagcttatcatttgagtcacgaaatcccgcttatgaggtgcacaaaagtcttaaactcgagttaacgaaaaaaatgaatttctttatttcaaaacaatgtcaatggttgaataatccaaatctattaacaagagaaaattcgagagatatattaagtattgagttgcatcctctatcttttaacttattgtttaacaacctaggactgaaaatagatgaactgatgtcaattgatctttcaaagtcacatgaggattcatcgtttgttttactagagcagataataattataataagaactatactaaagagggatgatgatgaaaagataatgctactcttttcgacggacttgcttgatgcggtcgataagttgatcgaaatagtggagaaaatttccatcaagtcctccaaatattataagggaattatccaaatgtcgaaaatgtttagagcatttgagcactctgaaaagaacctgggcatttcaaatcatttccatttaaagaataaatggttgaagttagttattggttggttcaaactatctattaataaggattatgattttgaaaacctgtcaagaccattaagggaaatggatttgcagaaaagggacgaagattttttgtatatcgacacttctattgaatctgcaaaagcattggcttacctaacacataatgttcctttagaaataccgccttcaagctcaaaagaagattggaacagatcttctacagtatcatttggcaatcactttactattttgttaaaaggtctggagaaaagcgcggacctgaatcagtttccagtttcattaaggcataagatcagtatacttaatgaaaatgtaataatagcgctaacgaacttatctaatgccaatgtcaacgtttctttaaaattcactttaccaatgggttattctccaaataaagatatcagaatcgcctttttaagagttttcatcgacatagtaaccaactatccagttaaccctgagaaacatgaaatggataaaatgctagctatagacgacttcctgaaatatataatcaagaacccaatattagcatttttcggaagtttagcgtgttctcctgctgatgttgatttatatgctggtggattcttaaacgcctttgacactagaaatgcgtctcatatccttgttactgagctccttaaacaagaaatcaaacgggccgcaagatcagacgatattctcagaagaaatagttgtgcaacaagggctttgtcactttacactagatctagaggtaacaaatatttgataaaaactttgagacccgttttgcaagggatagtggataacaaggagtcttttgaaattgataagatgaaaccaggatccgaaaactccgaaaagatgttagacttatttgagaagtacatgacaagattaattgacgcaattacaagttctattgatgatttcccaatagaattagttgatatctgtaaaacaatttacaatgctgctagtgtaaattttccagaatacgcatatattgccgttgggtcattcgttttcttgaggtttatcgggcctgctttagttagtcctgattcggaaaatatcattattgttacgcacgcccatgacagaaagccctttattacactagctaaagttattcaaagtttagctaatggcagggaaaatatattcaagaaagatatcttagtttcaaaagaagagtttttgaaaacctgtagtgataaaatattcaattttttgtctgaattgtgcaagataccgactaacaatttcaccgtcaatgtaagagaagatccgacaccaataagctttgactactcatttttgcataaattcttttacctcaatgagtttaccataagaaaagaaattattaatgaatccaaattaccaggggagttcagctttttgaaaaatactgttatgctcaacgacaaaattcttggtgtattgggacaacctagcatggaaataaaaaatgaaattcctccttttgtagtcgagaatcgggaaaaatatccttcattgtatgaattcatgagtcgctatgccttcaaaaaagtggacatgaaagaagaagaagaggataatgcgccatttgtacatgaagcaatgacattggatggcatacaaatcattgtcgtaacttttaccaattgcgagtacaataattttgtaatggactcactggtctataaagttctgcagatatatgcaagaatgtggtgctctaaacattatgtagttatcgattgtaccaccttttatgggggtaaggctaatttccaaaaattgactactctatttttcagtttgataccagagcaagcatcaagtaattgtatgggatgttattacttcaacgtcaacaaatcatttatggaccaatgggcctcatcatatactgtagaaaatccgtacttggtcactacaattccccgttgtttcatcaacagcaatactgaccaaagtttgataaagtccttaggattgagtggtaggagtttggaagttttgaaagatgtaagagttactttgcatgatattaccctttatgacaaggaaaaaaagaagttttgtcccgtgtccttgaagataggaaacaaatacttccaagttttacatgagattccgcagttgtacaaggttaccgtatcaaacaggacattcagcatcaaattcaacaatgtttacaagatatcaaatttaatttcagtcgatgtctctaacaccacaggcgtttcctcggaatttacgttaagtcttgataatgaagaaaagttggtattttgcagtccgaagtacctagaaattgtgaaaatgttttattatgcccagttaaagatggaagaagactttggtacggatttttcgaacgatatttcattttcaacatcctcttcagcagttaatgcttcttactgcaatgttaaagaagttggtgaaattatatcacatttgtcattggtgatccttgtaggtttattcaatgaggatgatctcgtcaaaaacatatcatacaaccttctcgtggcaacgcaagaagcatttaatttagattttgggacaaggcttcacaaatccccagagacatatgtacccgatgataccaccacgttcttggccctaattttcaaggctttttcagaatcttcaacggaactaactccatatatatggaaatatatgctggatggccttgaaaacgacgtgattcctcaagaacatattcctacggttgtctgttcattgtcatactgggtaccaaacttatatgaacatgtatatttggcaaatgacgaagagggaccagaggcgatttcacgtataatctatagcttaatcaggttgacggtcaaagagccaaatttcacgacagcttaccttcaacagatttggtttttactggcattggatggtcgtctcacgaacgtgatagttgaagaaatagtaagtcatgcgctggatagagattcagaaaacagagactggatgaaagctgtgtcaatactaaccagttttccaacgacagagattgcttgtcaggtaatagagaagctaataaatatgatcaaatcttttctaccttctctagcagttgaggcttccgcacacagttggtctgagcttactattttatcaaaaattagtgtgtcaattttctttgaatcacccttactttcccagatgtatttaccggagattcttttcgctgtgtctctgttaattgatgtcggtccttcggaaataagagtctcattgtacgagttgttgatgaatgtttgtcattctttaaccaacaatgagtccttacctgaaaggaataggaaaaatttggatatcgtctgtgcaacattcgcacgtcaaaagttgaactttatctccggttttagccaagaaaaaggtagagttttaccaaattttgccgcttcctccttctccagtaaattcggaacattagatctcttcactaaaaacattatgctattgatggaatatggttctatttcagagggtgcacaatgggaggcaaaatataagaaatatttgatggatgcgatttttggccatcggtcgttcttctctgcgagagctatgatgattctaggtataatgagtaagtcgcacacgtcccttttcctttgtaaagaacttttagttgaaaccatgaaggtcttcgcagagccagttgtggatgatgaacaaatgttcatcattatagctcatgtctttacttacagcaaaattgtcgaagggttagatccttcttcagaattaatgaaagagctattttggcttgctacaatatgtgttgaatcccctcatcctttactctttgaaggtggtctcctgttcatggtaaattgtttgaagcgactgtacacggtccatcttcaacttggattcgatggcaaatcgctagccaaaaaattaatggaatctagaaattttgctgctacgcttttggctaagttagagtcatacaatggatgcatatggaacgaagataattttcctcatattattttaggtttcattgcaaacggtttatccattcctgtcgtaaaaggagccgcattagattgtctacaggcccttttcaagaatacatattacgaaagaaagtccaacccaaaatcctccgattatctttgttaccttttcttactccatttggtcttaagtcctgaacaactttctaccttgttacttgaagtcggcttcgaagatgaactggtacctttaaataatacactaaaagtgccacttactttgatcaactggctaagttcagactcagataaatctaatatagtcttataccaaggagcacttttgtttagctgtgttatgtcagacgaaccatgtaaattccgttttgctctattgatgaggtatttgctcaaagtcaaccctatttgtgtattcaggttctatacgctgactagaaaggaattcaggaggttatcaaccctagaacaatcatctgaagcggttgctgtctcttttgaattgattgggatgcttgttacacacagtgagtttaattacctagaggaatttaatgatgaaatggtcgaacttttaaaaaagagaggcttgtcagttgtgaagcctctggatatttttgatcaggaacatatagaaaagttaaaaggagagggtgaacatcaagtggcaatttatgagagaaaaagattagcaacaatgatactggcaagaatgtcgtgctcc

SEQ ID NO: 25158 - DNA, 2322 bp, Saccharomyces cerevisiae
atgggtaagaaaagggctcctcaaaaaggaaaaacggtcacaaagccacaggagataattgtagatgaatccaaattgaactggaaaccagtagatattccggacactttagatgactttggtggattttatggcttggaagaaattgacggagtggacgttaaagtcgtggatggtaaagtaactttcgtcaccaaaaaagattcaaaagtgttaaaagatagcaataaggaaaaagtcggagatgatcaggaatctgtggaaaatgaatcagggtcagattcggagtccgagctccttgaattcaagaacttggacgatattaaagaaggagagttgagtgcagcatcttattcatcatccgacgaggatgagcaaggtaatattgagagttcaaagttaaccgatcccagtgaggatgtggatgaggatgtggatgaggatgttttgaaagaaaacgtctttaacaaagacattaatatcgatgatatttctcctgtaaatttacctgaatggacgaatcttgcacctctctcaatgactattttgcagagcttgcagaatttaaattttctcagacctacagaaattcaaaaaaagtctattccagttattatgcaaggcgtagacgtcatggggaaagcctctacaggttcaggtaaaactttagcctatggtattccaattgtagagaaactgatcagtaacttctctcagaaaaacaagaaaccaatatcgttaatctttactcctacaagagaactggcgcatcaagtcacagaccacttaaaaaagatctgtgagcctgttctagcgaaatctcagtactcgatattatctttgacaggtggactctctatccaaaaacaacaacgtctattaaagtacgataatagtggccaaattgtcatcgcaacaccaggtagatttttggaactgttggaaaaagacaacactttaatcaaaagattctcgaaagtaaatacgctaatccttgatgaggctgataggctgttacaagacggtcatttcgacgagttcgaaaaaatcattaaacatttattagtagaaagaaggaaaaacagagaaaactccgagggcagtagcaaaatttggcaaactttgatcttttctgcaacattctccatcgacttgtttgataagctatcttcttcccgtcaagttaaggatagaaggtttaaaaacaacgaagatgagctaaatgccgtaatacaacacttaatgagcaaaattcacttcaactcaaagccggttataatagatacaaatcctgagtcaaaagtgagctctcaaatcaaagaatccttaattgaatgtcctccattagaacgtgacctatactgctattactttttaaccatgttcccaggtacaactttgatcttttgtaatgccattgactccgtgaagaaattgaccgtatacttaaataacctaggcatcccagcttttcaaattcattcttccatgacacaaaagaaccgtttgaaaagcttagaaaggttcaagcaacaaagcgctaaacagaaaacaataaatcattcgaatccggattccgttcaactctcaacagtattgattgcaagtgatgttgctgctagaggtttagatattccgggtgttcaacacgttattcattaccacttaccaagatctactgatatttatattcatagatcaggcagaactgcaagagcaggttctgaaggtgtctctgccatgatatgctcacctcaagaatctatgggcccattaagaaagttaagaaaaactctcgctacaaaaaatagtgtttcgacggatttgaactctagatcaactaacagaaaacccatcaagtggcaaaacactgtgcctttgttaccaattgaaaccgatatactttcacaactcagagaaagaagtagattagcaggcgaactggctgatcatgaaattgcttctaattccctaagaaaagatgacaattggttaaaaaaggctgctgatgaattaggtattgacgttgattccgacgaagacgatatatcaaagagtaattcggacactttcttactaaaaaataaaaataaaaaaatgcagaagactataaataaggacaaggtaaaagccatgagagctacgttgaacgaattgttatcagtgcctatacgtaaagatagaagacagaaatatttgacaggtgggctagtgaatttagctgataacttggtcaaaaaaagaggtcataattctatcattggtcatgaaaagacaaacgccttagaaactttgaagaaaaagaaaaagagaaataattaa

SEQ ID NO: 25159 - DNA, 1056 bp, Saccharomyces cerevisiae
atgccttcgcaagtcattcctgaaaaacaaaaggctattgtcttttatgagacagatggaaaattggaatataaagacgtcacagttccggaacctaagcctaacgaaattttagtccacgttaaatattctggtgtttgtcatagtgacttgcacgcgtggcacggtgattggccatttcaattgaaatttccattaatcggtggtcacgaaggtgctggtgttgttgttaagttgggatctaacgttaagggctggaaagtcggtgattttgcaggtataaaatggttgaatgggacttgcatgtcctgtgaatattgtgaagtaggtaatgaatctcaatgtccttatttggatggtactggcttcacacatgatggtacttttcaagaatacgcaactgccgatgccgttcaagctgcccatattccaccaaacgtcaatcttgctgaagttgccccaatcttgtgtgcaggtatcactgtttataaggcgttgaaaagagccaatgtgataccaggccaatgggtcactatatccggtgcatgcggtggcttgggttctctggcaatccaatacgcccttgctatgggttacagggtcattggtatcgatggtggtaatgccaagcgaaagttatttgaacaattaggcggagaaatattcatcgatttcacggaagaaaaagacattgttggtgctataataaaggccactaatggcggttctcatggagttattaatgtgtctgtttctgaagcagctatcgaggcttctacgaggtattgtaggcccaatggtactgtcgtcctggttggtatgccagctcatgcttactgcaattccgatgttttcaatcaagttgtaaaatcaatctccatcgttggatcttgtgttggaaatagagctgatacaagggaggctttagatttcttcgccagaggtttgatcaaatctccgatccacttagctggcctatcggatgttcctgaaatttttgcaaagatggagaagggtgaaattgttggtagatatgttgttgagacttctaaatga

SEQ ID NO: 25160 - DNA, 1035 bp, Saccharomyces cerevisiae
atgtcttcttcagtagcctcaaccgaaaacatagtcgaaaatatgttgcatccaaagactacagaaatatacttttcactcaacaatggtgttcgtatcccagcactgggtttggggacagcaaatcctcacgaaaagttagctgaaacaaaacaagccgtaaaagctgcaatcaaagctggatacaggcacattgatactgcttgggcctacgagacagagccattcgtaggtgaagccatcaaggagttattagaagatggatctatcaaaagggaggatcttttcataaccacaaaagtgtggccggttctatgggacgaagtggacagatcattgaatgaatctttgaaagctttaggcttggaatacgtcgacttgctcttgcaacattggccgctatgttttgaaaagattaaggaccctaaggggatcagcggactggtgaagactccggttgatgattctggaaaaacaatgtatgctgccgacggtgactatttagaaacttacaagcaattggaaaaaatttaccttgatcctaacgatcatcgtgtgagagccattggtgtctcaaatttttccattgagtatttggaacgtctcattaaggaatgcagagttaagccaacggtgaaccaagtggaaactcaccctcacttaccacaaatggaactaagaaagttctgctttatgcacgacattctgttaacagcatactcaccattaggttcccatggcgcaccaaacttgaaaatcccactagtgaaaaagcttgccgaaaagtacaatgtcacaggaaatgacttgctaatttcttaccatattagacaaggcactatcgtaattccgagatccttgaatccagttaggatttcctcgagtattgaattcgcatctttgacaaaggatgaattacaagagttgaacgacttcggtgaaaaatacccagtgagattcatcgatgagccatttgcagccatccttccagagtttactggtaacggaccaaacttggacaatttaaagtattaa

SEQ ID NO: 25161 - DNA, 1044 bp, Saccharomyces cerevisiae
atgacttttatgcaacagcttcaagaggctggggaaagatttaggtgtatcaatggtcttttatgggttgtttttgggcttggtgtcttaaaatgtacaacgttatcacttagatttttagctcttatttttgatctttttttactaccagcagtcaatttcgacaagtatggtgctaaaactggtaaatactgtgctatcactggtgcaagtgacggtattggtaaagaatttgctagacaaatggcgaaacgtggcttcaacttggtattgatctcgagaacgcaatctaaattggaggctttacaaaaagaactagaagatcaacatcatgtcgttgtaaagattctagccattgacattgcggaggataaagaatccaactatgaatccattaaggaattgtgtgcgcagttaccaatcaccgttttggtcaataatgttggtcaatcacactccattcctgttccatttttggaaacagaagagaaggagcttagaaatattatcactatcaataacactgctacattattaattacacaaatcattgcaccaaagattgtggaaactgtgaaagctgaaaacaagaagtcgggtactcgtggtttgatcttaaccatgggctcatttggtggtctgattcccaccccacttttggctacatacagtggttcgaaatcattcttacaaggttggtctaactctttggctggggaattatctaaagatgctatcgatgttgaattaatcatttcatatttggtcactagctcgatgtctaaaatcagaagatcatctttaatgatcccaaatccacaacagtttgtaaaatccactttaagaagcgttggcagacgctgcggctctcaagaaagatacgctactatgaccccttactgggcgcacgcagtgtatcaatttgtaattacagagacctttggcgtttactctaagattgttaactccattaattattccttccataaatctatcagaattagagccttaaaaaaagccgcaagacaggttaaaaaggaatag

SEQ ID NO: 25162 - DNA, 897 bp, Saccharomyces cerevisiae
atgagcggtgaattagcaaattacaaaagacttgagaaagtcggtgaaggtacatacggtgttgtttataaagcgttagacttaagacctggccaaggtcaaagagtagtcgcattgaagaaaataagactagagagtgaagacgagggtgttcccagtacagccatcagagaaatctcattattgaaggaattaaaagacgataatattgtcagattatacgatattgttcactctgatgcacacaagctatatcttgtttttgagttcctcgatttggacctgaaaagatatatggagggtattccaaaggaccaaccgttaggagctgatattgttaagaagtttatgatgcaactttgtaagggtattgcatactgccactcacaccgtattctgcatcgtgatttaaaaccgcagaacttattgattaacaaagatgggaatctaaaactaggtgattttggcttagcgcgtgcttttggtgttccgttgagagcttacacacatgaaattgttactctatggtatagagctccggaggtattactgggtggaaaacaatatagtacaggtgtcgatacatggtccatcggctgtatatttgccgaaatgtgtaacaggaaaccaatcttcagtggcgatagtgagatcgatcagattttcaagatattcagagtattgggaacgccgaatgaagctatatggccagatattgtctacttgcctgatttcaagccaagctttcctcaatggcgcagaaaagacctatcacaagtggtaccaagtctagatccacgcggtattgatttgttggacaaactcctcgcgtatgaccctattaaccggattagcgccagaagagcagccatccacccctacttccaagaatcataa

SEQ ID NO: 25163 - DNA, 1131 bp, Saccharomyces cerevisiae
atgaagaaggagttgaaaattcttataatagcgaacattgcattacttatctctataatacattacacatttgatttgttgacgttatgtatagatgatacttccaaagatgcgctaacagatgaacagctgaacccccccaatggcttcaattcaacattctatgagtctcctcctcaactcataccgaaaatcattcatcaaacctacaaaacaaacgatatcccagaacagtgggtaaaagggaggcagaagtgcattgatttacatccggattacacttacattttatggacggatgaaatgtctgatactttcattaaacaggaatacccgtggtttcttgacacctttaggagttatgaatatccaattgagagggcggatgcaatacggtatttcatcctttcgcattatggtggtatttacattgacttggatgatggttgtgaaagaaggctagaccctttgttgaaagtaccagcatttctaaggaaaacttcgcctacaggagtgtcaaatgatgtgatgggctctgttccaaggcaccccttcttcttgaaggtcatcaaatcgttgaaacactataagaaaaactggtacattccatatatgacaatcatgggctctacgggccccttattcattagtgtggtttggaagcaatataagagatggtctaatacggccgaaaatggtgcggtaagaattttacaacctgcagattataaaatgcataataattcttttttctcaatatctaaaggttcctcctggcatacgggtgatgccaattttatgaaaactctagagaatcacatcttgtcttgcgtggttaccggattcatttttggctttttcatattatacggtgaatttacattttatacttggctgtgctcgggaccatttaacaacaaacgctattacattcagtggttgagtgacaagttcaagttacacaagtggaaactaacatcgtcttacaagaataaggaaaagaggcggaatcctactcgtcacgaatataattcgaggggtaagagattaagaaaagattctaatatcccctacgacagcgttttccttgatatagaaaagaatcacgcaaaatttaccgacttaacctga

SEQ ID NO: 25164 - DNA, 549 bp, Saccharomyces cerevisiae
atgggtaacatttttagttcaatgtttgacaaactatggggttcaaacaaagaattgcgtatattgattttgggtttggatggtgcaggtaaaactaccatcttatatcgtttacaaattggcgaagtagtcactacaaagccaaccattggtttcaatgtagagacgctaagttataaaaacttaaaattgaacgtctgggatcttggtggtcaaacaagtatcaggccctactggaggtgttattatgcagacactgctgcagttattttcgttgttgattcgactgataaagatcgtatgtctacagcctctaaggaacttcatttgatgttacaggaagaagaattgcaagatgcagcactgctggtttttgcaaataaacaagaccaaccgggtgcattaagtgccagtgaagtctccaaagaactgaatcttgtagaattgaaggacagaagttggtctatcgtagcatccagtgcaattaaaggcgaaggtattaccgaaggtttagattggttgattgatgttataaaagaggaacagtta

SEQ ID NO: 25165 - DNA, 1356 bp, Saccharomyces cerevisiae
atggtatcagaggataagattgagcaatggaaagccacaaaagtcattggtataattggtctgggtgatatgggcctattatacgctaataaatttacagatgctggatggggtgttatatgttgtgatagggaagaatattatgatgaactgaaagaaaaatatgcctcagctaaattcgaactggtgaaaaatggtcatttggtatccaggcaaagcgactatattatctatagtgttgaagcatccaatattagtaagatcgtcgcaacgtatggaccatcttctaaggttggaacaattgttgggggtcaaacgagttgtaagctgccggaaatcgaggctttcgaaaagtatttacccaaggactgcgacatcattaccgtgcattcccttcatgggcctaaagttaatactgaaggccaaccactagttattatcaatcacagatcacagtacccagaatcttttgagttcgttaattctgttatggcatgtttgaaaagtaagcaagtttatttgacatatgaagagcatgacaagattaccgctgatacacaagctgtgacacatgctgctttcttaagtatgggatctgcgtgggcaaagataaagatttatccttggactctgggtgtaaacaaatggtacggtggcctagaaaatgtgaaagttaatatatcactaagaatctattcgaacaagtggcatgtttacgcaggattagccataacaaacccaagtgcacatcagcaaattcttcaatatgcaaccagtgcaacagaactatttagtttaatgatagataacaaagaacaagaacttactgatagactattaaaagctaagcaatttgtatttggaaagcatactggtctcttactattggatgacacgattttagagaaatattcgctatcaaaaagcagcattggtaacagcaacaattgcaagccagtgccgaattcacatttatcattgttggcgattgttgattcgtggtttcaacttggtattgatccatatgatcatatgatttgttcgacgccattattcagaatattcctgggtgtgtccgaatatctttttttaaaacctggcttattagaacagacaattgatgcagctatccatgataaatcattcataaaagatgatttagaatttgttatttcggctagagaatggagctcggttgtttcttttgccaattttgatatatacaaaaagcaatttcagagtgttcaaaagttctttgagccaatgcttccagaggctaatctcattggcaacgagatgataaaaaccattctgagtcattctagtgaccgttcggccgctgaaaaaagaaataca

SEQ ID NO: 25166 - DNA, 2079 bp, Saccharomyces cerevisiae
atgagcactccatttggcttagatttaggtaacaataactcagtactagcagttgccagaaataggggtattgatgtcgttgtcaatgaagtttctaataggtctacaccatccttggtcggctttggccccagaaataggtacttaggtgaatctggtaaaactaagcaaacatcgaatgttaaaaacactgtggaaaacttgaaaagaatcattggactaaagttcaaagaccctgaatttgatatcgagaataagttcttcacttcgaaattggtacagctaaaaaatggtaaagttggtgtggaagtggagttcggcggtaaaacacacgtattttcagctactcaactgactgctatgttcattgataaggtgaagcacaccgttcaagaggaaacgaagtcatcaattaccgatgtctgcctcgcagttcctgtatggtattcggaagaacaacgttataacatagccgatgctgccagaattgcaggattaaatcctgtaaggattgtcaacgatgtgactgcagccgccgtttcgtacggcgtcttcaagaatgatctgccaggtcctgaagaaaagccaagaatcattggcttagtggacattgggcattctacctacacctgttctattatggctttccgcaaaggcgaaatgaaagtattaggtactgcttatgacaagcactttggtggtagagatttcgatcgcgcaatcacagaacattttgctgatcagtttaaggacaagtacaagattgacattaggaaaaatccgaaagcttataacagaattttaatcgctgctgaaaaattaaaaaaagtgctttctgcgaacactactgcccccttctccgttgaatctgttatggatgatatcgacgtttcctctcaattgagccgtgaagagctggaagaattagtagagcccttgttgaagcgtgtgacgtatccaatcaccaatgcattggctcaagctaaattaactgtcaatgatattgacttcgtagaaataattggtggtacaacccgtatcccagttttaaagaagtcaatttctgatgtttttggaaaacctttgtcatctactttaaatcaagacgaagctgtggccaagggggccgctttcatatgtgccattcactctccaactttaagggtcaggccgtttaaatttgaagatattgatccgtattcagtgtcatacacttgggataagcaggtcgatgacgaagaccgtttggaagtattccctgctaattcatcatatccatcaactaaactaattactttacatcgtactggagatttcagcatgaaagcggtgtacactcatccttcgaaactgccaaaaggtacttccaccactattgcaaaatggagcttcactggggtcaaggttcctaaagatcaagattttattcctgtaaaggtcaagttaagatgcgatccttccggcttgcatattatcgagaacgcttacacaacggaagatattacggttcaagagccagtgcctttaccggaagacgcaccagaagatgccgagccccagtttaaagaagttactaaaacaattaagaaagatgtgctaggtatgactgcaaaaacattcgcgctaaacccggttgagttgaacgatctaattgaaaaagagaatgaattaagaaaccaggataagttagttgccgaaaccgaggatcgcaaaaatgcccttgaagagtatatttatacccttcgtgccaaactcgatgatgaatactccgattttgcgtctgacgcagaaaaagaaaagctaaaaaacatgttagccactactgaaaattggttatatggtgatggtgacgattctaccaaggcaaaatacattgctaaatatgaggagctggcatcgttggggaatattattagaggtagatatttagcaaaggaggaagaaaaaagacaagcactcagagcgaatcaagaaacttctaaaatgaatgatattgctgaaaaattggctgagcaaagaagggcacgcgctgcaagtgatgatagcgatgacaacaatgatgaaaacatggaccttgat

SEQ ID NO: 25167 - DNA, 621 bp, Saccharomyces cerevisiae
atgtccgaatttaatgaaacaaaattctccaacaacgggacgttttttgaaacggaagagccaattgtggagacgaaatcaatctccgtttataccccactcatatatgtctttattctggtggtgtcccttgtgatgtttgcttcaagctacagaaagaagcaggccaaaaaaattagtgagcaaccatccatatttgacgaaaacgatgcccatgatctgtatttccaaataaaggaaatgagtgaaaatgaaaaaattcacgagaaggtgttgaaggccgctttattgaacagaggagcagaatctgttagacgatcattaaagttaaaagagttggctcctcagataaaccttctatataaaaatggctctattggggaggattactggaagagatttgaaactgaagttaaattaattgaattggaatttaaagatactttacaagaagctgaaagattgcaaccgggctgggttcaattgttcgttatggtttgtaaagaaatttgctttaatcaagctctctctagacgttatcaatcaatcttgaaacggaaagaagtgtgtattaaagagtgggagctgaaaataaataatgatggaagattagtcaattag

SEQ ID NO: 25168 - DNA, 2565 bp, Saccharomyces cerevisiae
atgtctgaaggaaaacaacaattcaaagacagcaataaaccgcacaaggactccacagatcaggacgatgatgccgccacaatagtaccacaaactcttacttactcacgcaacgaaggtcattttttaggcagtaatttccatggagtaactgatgaccgtaccactttgtttgatggtgaagaggggcgtagggaggatgatttgttgccctcattgcgttcctccaactcaaaagcacacttaatttcttcacaacttagccagtggaattataacaacaatagagtacttttaaaaagatctatattaaagacacaagcttttatggatcaacttcaagaagaaaataatattcgcccgatttttattgctgcaaatgatgaacgggaaaaattacatgttctacaactgaatatcaagctagatggtcagtacaataccaaagaaaagaacggtttcaacattgagaaaaaagctttatcaaaattatttcactctcagatcgtatcagtgacaaatcatttaaacgctttgaaaaaaagagtggatgacgtttcatctaaagtattcatcacaggtgatgtaaatactggtaaatcagctctttgcaactctctattaaagcagcgtttgctacctgaggatcagctaccatgtaccaatgtattttccgaaatactagaggctcgggaaaatgacggcatagaggaggttcatgccataccactaaacattgctccgactctcaaggaagccattgatatgtattcaatacaaaatcccaagacttatgaaatacacactttgaaagaacttcccgatttggttccccaaaacggaaaatatgctttactgaagatttacataaaggacgataaaaggcctgcctctactagtctattaaggaatggtactgttgatatttcattaattgactcccctgggttgaacatggactcgttacaaaccgccgaagtaatgtcccgacaagaagaaatcgacttagttatatttgttgtcaatgcagagaaccagctaacactatctgccaaggagtttatttctttagcatctcgtgagaaaaaattaatgttttttgttgtgaaaaaatttgacaaaatcagggacaaacaacgttgtaaggagttgatcctaaagcaaatccgtgacctgtccccagaaacatataaacgtgcagctgattttgtccactttgtttccaaaaacggagatgaattgccacattatcataatgaaaatgacaatgaagatcatggtgaccgaaaacctgacgacgacccatattctagcagcgatcccgatccggattttgacagtctggaagattctctacgcaattttgttttgaagaaaagatcactttctaaattgttacctgccaagacttatctatcgaaattattaagcgatataataatgatctccaaatctaatatgaaaatgtatagtgaagaagaaataaaaattaacgaacaactggaaacattgagacctgaaattttgagcgctagagcaaagtgcaatgatttaacaacttccgttgatcaaatggccgagcaaacaattacaatgacttataacaatactaaagaagcacttctcaatgcgttggatgttccgctacacgaatatccgaaatatcagggcctcggtcaaatttatgacttcatattttcaacagaagcgttcatagcaaatcagattgatgagtcaataggatcaagtgaattatttgccaagcaaaagacagatttactggtaaaaaaaatttatgagattggaaaaaatgaacttggtgatgatttcatgtgtgaacgtgttttcagaagcgaactaatgtttagaaaaaggaagcatttgataggaaaaaggcttaaagtatctttgtcaataactgatttgtttgctccaacttggaaaggctttttgtcttacttaagctggcagaaacctgtcacagcaccactgccggatatagaaggacaaactaacgagggtcagattggcctaatgaagtatttgggtttgaaaaattatcctttgacacaatattggtcaagaccatcattgctcttcacatcaaaaattcccactctaacgctgtactttctaggaagtacaaaggttgtggggaacattatattaaacggcattaaattatcgtcgtggagctcactcaagaagttatcagttccggttatagtggtaggttccttgttgggacttacgtatttaattcatgacctcccccgtgccttaccaatgaatctttccattaaatacaaaagaaagttgcaagaactggattacattcatcttaacgctcaaagaacctcaaatgaagtacgtgatgttttgcgtgtacctacacgtgaaattctaaggtcgtgtgaaataattatggataaaaaacaaatcactaagaaagaattggaaaacaaaaaagaaagtaacttgttgtcaatcaaattcttccaatctctatacgaaggaaccgtggctcaaaaattgatggtggaagaaataaatttagacatcgat

SEQ ID NO: 25169 - DNA, 1134 bp, Saccharomyces cerevisiae
atgcctaaaaaatccattgaagaatgggaagaggatgccattgaatcagttccatatttagcaagtgatgaaaagggctctaattataaggaagctacacaaattccactaaatttgaagcaatctgaaattgaaaatcatccaacagtaaaaccatgggttcattttgttgctgggggtattggaggaatggcgggtgcagttgttacgtgtccctttgatttggtgaagacccgattacaaagtgatatatttttgaaagcatacaaatcacaagctgttaatatcagtaaaggatctactcgtccaaagagtattaattatgtcattcaagcaggaacccatttcaaggaaacactgggaatcataggcaatgtgtacaaacaagagggttttagaagcttgtttaagggtttgggccccaatttagtcggggttattccagcaagaagtattaatttttttacctatggaactactaaagatatgtatgctaaagcgttcaataatggccaagaaacacctatgattcatctgatggctgctgcaaccgcaggttgggcaacggcgacggcaaccaatcctatttggttgattaaaacaagagtacagcttgataaagctgggaaaacatcggtccgacagtacaagaactcttgggattgcttaaaaagtgttataagaaatgagggtttcactggcttgtacaaagggttgagtgcctcttatttgggttctgttgaaggtatacttcaatggctattatatgaacaaatgaagaggttaataaaggaaaggtctattgagaaatttggatatcaagccgaaggtacaaaaagcacatcagagaaagtcaaggagtggtgtcaaagatcaggaagcgctggtcttgcaaaatttgtggctagtatagcaacatatccgcacgaagttgtcaggacgagattgagacaaacgcccaaggaaaatggtaaacgaaagtatacaggtttagtacaaagtttcaaagttataattaaagaagagggactcttttcaatgtatagtgggttgaccccgcatttgatgagaacagttccgaacagtataattatgtttggtacatgggaaattgttataaggctactatcgtag

SEQ ID NO: 25170 - DNA, 1266 bp, Saccharomyces cerevisiae
atgaatcagtgcgcgaaggacataactcatgaagcctccagtatacccatcgatttgcaagaaagatactcgcactggaagaaaaacactaaactactttatgattacctaaacacgaattcaacaaagtggccgtccttaacgtgccagttctttcctgatttagataccacttcggatgagcatcgcatcttgttatcctcatttacatcttcccaaaaacctgaagatgagaccatatatattagcaaaatatccacgttgggtcatataaaatggtcatctttaaataatttcgacatggacgaaatggaattcaaaccggagaactcgacaaggtttccctccaaacacttagtaaatgacatcagtattttcttcccaaacggggaatgcaatagggcaagatatttgcctcaaaatccagatattatagccggcgcctcttcagatggtgcaatctacatattcgatagaacaaaacacggctctactagaataagacagtccaaaatttcacatccctttgagacaaagctgtttggttcacatggtgttattcaagacgtggaggcaatggatacttcttcggcagatataaatgaggcgacttctttagcctggaacttgcagcaggaggcccttttactttcttctcactccaacggccaagttcaagtttgggacattaaacaatattcgcatgagaaccctataatagatttacccttagtgtcaataaacagcgacggaacagcggtgaatgatgtaacttggatgccaacacacgattccctctttgctgcttgtactgaaggaaatgcggtctccctattagatctgaggactaagaaagagaagctccagagtaaccgtgaaaaacacgatggtggagtaaactcctgtagatttaactataagaactctttaattctagcatctgcagattcaaatgggaggctaaatttatgggatattagaaacatgaacaaaagcccaatcgctaccatggagcacggtacttccgtttcaactttagaatggagtccaaatttcgatactgtattggcaacggctggccaagaagatgggttagtcaagctatgggatacctcctgcgaagaaactatatttacccatggtggtcatatgctcggtgtgaacgacatttcgtgggacgctcatgacccttggttaatgtgcagtgtggcaaatgataattcagttcacatatggaaacctgcaggaaaccttgttggacattcg

SEQ ID NO: 25171 - DNA, 1662 bp, Saccharomyces cerevisiae
atgtccaataactcattcactaacttcaaactggccactgaattgccagcctggtctaagttgcaaaaaatttatgaatctcaaggtaagactttgtctgtcaagcaagaattccaaaaagatgccaagcgttttgaaaaattgaacaagactttcaccaactatgatggttccaaaatcttgttcgactactcaaagaacttggtcaacgatgaaatcattgctgcattgattgaactggccaaggaggctaacgtcaccggtttgagagatgctatgttcaaaggtgaacacatcaactccactgaagatcgtgctgtctaccacgtcgcattgagaaacagagctaacaagccaatgtacgttgatggtgtcaacgttgctccagaagtcgactctgtcttgaagcacatgaaggagttctctgaacaagttcgttctggtgaatggaagggttataccggtaagaagatcaccgatgttgttaacatcggtattggtggttccgatttgggtccagtcatggtcactgaggctttgaagcactacgctggtgtcttggatgtccacttcgtttccaacattgacggtactcacattgctgaaaccttgaaggttgttgacccagaaactactttgtttttgattgcttccaagactttcactaccgctgaaactatcactaacgctaacactgccaagaactggttcttgtcgaagacaggtaatgatccatctcacattgctaagcatttcgctgctttgtccactaacgaaaccgaagttgccaagttcggtattgacaccaaaaacatgtttggtttcgaaagttgggtcggtggtcgttactctgtctggtcggctattggtttgtctgttgccttgtacattggctatgacaactttgaggctttcttgaagggtgctgaagccgtcgacaaccacttcacccaaaccccattggaagacaacattccattgttgggtggtttgttgtctgtctggtacaacaacttctttggtgctcaaacccatttggttgctccattcgaccaatacttgcacagattcccagcctacttgcaacaattgtcaatggaatctaacggtaagtctgttaccagaggtaacgtgtttactgactactctactggttctatcttgtttggtgaaccagctaccaacgctcaacactctttcttccaattggttcaccaaggtaccaagttgattccatctgatttcatcttagctgctcaatctcataacccaattgagaacaaattacatcaaaagatgttggcttcaaacttctttgctcaagctgaagctttaatggttggtaaggatgaagaacaagttaaggctgaaggtgccactggtggtttggtcccacacaaggtcttctcaggtaacagaccaactacctctatcttggctcaaaagattactccagctactttgggtgctttgattgcctactacgaacatgttactttcactgaaggtgccatttggaatatcaactctttcgaccaatggggtgttgaattgggtaaagtcttggctaaagtcatcggcaaggaattggacaactcctccaccatttctacccacgatgcttctaccaacggtttaatcaatcaattcaaggaatggatg

SEQ ID NO: 25172 - DNA, 2394 bp, Saccharomyces cerevisiae
atgtcacagaagcaaagtacgaatcagaatcaaaatggcacgcatcagccacaaccagtaaagaatcaacgaactaataatgctgctggcgccaattccggccagcagccacagcaacagagtcaaggccagtctcaacagcaggggaggtccaatggtccgttttcggcgtcagacttgaatagaattgtcctagagtacctgaataaaaagggataccaccgtacagaggccatgctgagagccgagagtggacgtacactaacacctcaaaacaaacaatcaccagcaaatactaaaacaggtaaatttcctgaacaatcatcaattcctccgaaccccgggaagacagctaaacccataagcaatccaactaatttgtcatccaagagagatgcagaaggtggtatagtatctagcgggcgactagaagggctcaacgcacctgaaaattatatacgtgcatattcaatgttgaaaaactgggtagattcgtcgctggaaatttacaagccggaactaagctacatcatgtacccaatattcatttatttatttttaaatttggtggccaaaaatcctgtttacgcccgtcgtttctttgatagattttctcccgattttaaggacttccatggctcagaaattaatagacttttcagtgtcaattctatagatcacatcaaggaaaatgaggtcgcaagtgctttccaatctcacaagtacagaattactatgtctaaaaccactttaaatcttctcttatattttttgaatgaaaatgagagtattggaggttcattaataattagtgtaataaatcagcacctagatccaaatattgtagaatcagtaaccgcaagggaaaaattggctgatggaataaaagttctcagtgatagtgaaaacggaaatggtaaacaaaatttagaaatgaattctgttcctgtcaagctgggacctttcccaaaagacgaggagtttgttaaggagattgaaactgaattgaaaattaaggatgatcaagagaaacaactaaatcaacaaactgcaggtgacaattacagtggagccaacaatagaaccttattgcaagaatataaagctatgaataacgaaaaatttaaggataatactggcgacgatgataaagacaaaattaaagataaaatcgccaaagatgaggaaaaaaaagagagcgaattgaaggtggatggtgaaaaaaaagacagcaatttatcttcgccagcacgtgatattttacctttaccaccaaagacggcactagatttgaagttggagattcagaaggtcaaggaatctcgtgatgccatcaaactagataatttacagttggccttaccaagcgtgtgcatgtatacattccaaaacacaaataaagacatgtcatgtttagatttcagtgatgattgtaggatagcggctgctggctttcaagacagttatatcaagatctggtcactcgacggctcatcacttaataatcctaacatcgcgttaaataacaacgacaaggatgaagacccaacgtgtaaaactttggtggggcacagtggtacagtatattcaacaagtttcagtccggataataagtatttactttctggttctgaagataaaaccgtcaggctatggtccatggatactcacaccgcgctagtaagctataagggccataatcaccctgtgtgggatgttagtttctccccgctaggccattatttcgccactgcatcgcacgaccaaaccgcaaggttatggtcatgcgatcacatatatccattaagaatatttgcaggacatttaaatgatgttgattgtgtgtcatttcatccgaacggttgctatgtgtttacgggatccagcgataagacgtgtcgaatgtgggacgtttctacaggcgactcggttaggttatttcttggacatactgcgcccgtcatttctattgctgtttgtccagatggtaggtggttgtccactggtagcgaagatggtattattaatgtatgggatattggtaccggcaaaaggttgaaacaaatgcgtggccatggtaagaatgccatttattccttatcatatagcaaagagggaaacgtacttattagtggaggtgccgatcatacagtccgtgtatgggatttgaaaaaggccactactgagccaagcgcagaaccagatgagccattcattggatacttgggtgacgttactgcatctataaaccaagatataaaagaatatggtcgcagaagaacagtaatacctacaagcgatttagtagcgtcgttctacaccaaaaagacgcctgtttttaaggtcaagttcagcagaagcaatttagcccttgcaggaggtgctttcaggcca

SEQ ID NO: 25173 - DNA, 1395 bp, Saccharomyces cerevisiae
atgaggtttctttcaaaaaggatactgaaacctgtactttcagtgatcattctaatatcgattgccgtaaccgttgttctttactttttaacggcgaatgagaactatttgcaagcagtcaaggatagtgccaagtcccagtatgcttctctccgggagagctacaaaagtattacaggtaaaactgaaagcgctgatgaacttcctgatcatgatgctgaggtgttagatagcataatggacaggctacacgagcccctttatgaaaaggacacttttgacccgaatgaagtccttgctgaaaataaacagttgtacgaggagtttttacttcaagaaatttctgagccaaaggtggacaatttggtacgtagcggggatccgttagccggcaaggcaaaaggaactattttgagtttggtgagaaattctgatttagaggatataatttcttctattcaacagctagaagaggagtacaataagaattttggatatccctataccttccttaacgatgaggaatttactgacgaattcaaagatggaataaaaagtattcttcctaaggaccgtgtagtagaatttggcactattggtccagataactggaatatgcctgatagcatagatagggagagatacgaccaagaaatggacaaaatgagtaaagagaacattcagtatgcagaggtggaatcctatcataacatgtgtcgtttctattctaaagaattttaccatcatcctctgctatctaaatataaatatgtgtggagattagagccaaacgtgaatttctattgcaaaattaactatgacgttttccaatttatgaacaagaatgacaagatttatgggtttgttttgaacctctatgatagtccgcaaaccatcgaaacgctatggacttcaactatggattttgtcgaggaacacccaaactatttgaacgtcaacggagccttcgcatggctaaaagataactctcaaaatccaaaaaattatgattatactcaagggtattcaacttgtcatttctggaccaattttgaaatagtcgatttagactttttgaggtcagaaccttatgaaaaatatatgcaatatcttgaagaaaagggaggattctactatgaaaggtggggtgatgcccctgtaagaagtttggcacttgctttatttgcggataagtcaagcatccattggttcagggatataggttatcaccatactccgtacacgaactgtccaacttgtccagcagattcagataggtgtaatggaaattgtgtaccaggcaaattcactccttggagtgatctagacaaccaaaattgccaggcaacctggataagacactctatgtctgaggaagagttagaaatgtattga

SEQ ID NO: 25174 - DNA, 2538 bp, Saccharomyces cerevisiae
atgagtgcggcacttccatcaattcagcttcctgtcgactataataatctttttaatgaaatcaccgattttttggtgactttcaagcaggatacgttgtcttctgatgcaacacgaaatgagaacgaagatgaaaatttggatgctgagaatatcgaacaacatctattggaaaaggggcccaagtacatggcgatgctacagaaagtggctaatagggaactgaattccgtgattattgatttagatgacattctacagtatcaaaacgaaaagtttctccagggcacacaggcagacgaccttgtgtctgccattcaacaaaacgctaatcacttcactgaattattttgccgtgccattgacaacaacatgccgctaccaacaaaagaaattgactacaaggacgacgttcttgatgttattttaaaccaaaggagactgaggaatgagagaatgctctcggacaggaccaatgagatccgaagcgaaaacctcatggataccacgatggatccaccctcttccatgaatgatgcgttaagagaagttgtcgaggatgaaactgagttatttcctcctaatttaactagacgctatttcctttattttaagcctctatcgcaaaattgtgctcgtcgttacaggaagaaagcaattagttctaaaccattatctgttaggcagattaaaggtgacttcctaggccaattgattaccgtcagaggtattatcaccagagtttctgatgtcaaaccagctgtggaagttatcgcatatacctgcgatcaatgtgggtacgaagttttccaagaggtcaactctcgtacttttactccgttgtcagaatgtacttccgaagaatgttcccaaaatcaaacaaagggtcaattgtttatgagtacacgagcttccaaatttagtgcctttcaggaatgtaaaattcaggagttatcacaacaagtgccagtgggtcatattcctaggtcgctaaatatccacgttaacgggacgctggtaagatctttatcgcctggtgatatcgtcgatgtaactggtatattcttgccagcgccctacaccggtttcaaagctttgaaagctggcttactgacagaaacttatttagaggcacagtttgtccgtcaacacaagaagaaatttgcgtctttcagtctgacttctgatgtagaagagagagttatggaattaatcacctctggtgatgtttataataggctggcaaaatctattgcaccggaaatctacggtaacttggacgtaaagaaagcgttgctgctattacttgtcggaggtgttgataaaagggtaggtgacggtatgaaaatcagaggtgatatcaatgtttgtctgatgggtgatcccggtgttgccaaatctcaactgctgaaggccatttgcaaaatatcacctcgaggagtgtataccactggtaagggttcctcaggcgttggtctgaccgctgccgtcatgaaagatcctgtcacggatgaaatgattctagaaggtggtgccttagtactcgctgataacggtatttgttgtatcgatgaatttgataagatggatgaaagtgacagaacggcaatccatgaagttatggaacaacaaacaatttcgatatccaaggcggttatcaatacaaatccgggcgccagaacctcaatcttagcggcagcaaatccgttgtatggtagaattaatcctagattatcacctctggacaatataaatctaccagctgctttactatccagatttgatattctcttcttaatgttagatataccaagtagagatgacgacgaaaaattagccgagcacgttacatatgtgcatatgcataataaacaaccggatttggacttcactccagtagaaccctctaaaatgagagagtacattgcctatgctaagacaaagaggccagtgatgagtgaagctgtaaacgattatgtggtgcaagcttacatcagattaagacaagactccaagagagaaatggattccaaattttcctttggtcaagccactccgagaactttactaggtattataagattatctcaagcgctagcaaagttaaggttggctgatatggtggatatagatgatgtggaggaagccttgaggttggtccgagtctccaaggaatcattgtatcaagaaaccaacaaatctaaagaagatgaaagccccacaacgaaaatctttacgatcatcaagaaaatgttacaagaaactggtaaaaacacgctatcatatgaaaatattgtgaaaactgtaagactaagagggtttaccatgctacaattaagcaactgtatccaagaatattcttacttaaacgtctggcatttaattaatgagggtaacactttgaaattcgtggatgacggtaccatggacacagaccaggaagactcactagtgagcacgcctaaactcgcaccacaaacgaccgcttccgctaatgtgagcgcccaagattctgatatcgatctacaagacgcttga

SEQ ID NO: 25175 - DNA, 1215 bp, Saccharomyces cerevisiae
atgtctgtgcaccacaaaaagaagctaatgcccaaatcggcattgctgattagaaaataccaaaagggaatcagatcatcattcattgggctcatcatagtgttatcctttttatttttcatgagtggctcaaggtccccagaggtaccaatagctcagggcaccagtgtcagtcgtgtagccagtaaggattatttgatgccgtttactgacaagtcacaaggagtaatccatcccgtggacgatggaaagaaggaaaagggtgttatggtcacattggccaggaattcagatttatggaacttggtaaaatctattagacatgttgaagacaggttcaataacagatatcactacgattgggtgttcttgaatgaccaaccatttagtgatgagtttaaacgtgttaccagtgcattggtttcaggcaaggcaaaatatgggacaatcccaaaggaccattggtccattccatcttggatcgatactgaaaaattcgatgagaaaaggcttgcaatgggaaaattggatattccatatggtagttccgtgccttaccgtcacatgtgccgtttccagtcagggttcatatggagacacccactactggaggagtacgaatggttttggagagtggataccgatatcactttattctgtgatattcagtatgacatattcaagtttttaaaagtaaataacaagaaatatggattcattctttcggtaagtgaatatgagcgcacaatcccaaccttgtgggaaacgacaaagaaattcatcaagaaaaatcctaaattcttacacaaaaataacctcatgaaattcatttcgaatgatgatggtgacacttataatatgtgtcatttctggaccaacttcgaaatcggctctttagacttcttcaggtccgatgcatacagagaatactttgattacttagacagttctggtggattcttctacgaaagatggggggatgcgccagtgcactccatcgctgcctctttgttcttggacaagtcagaaatccatttctttgacggtcttggattccatcatccagatttcacctcttgtcctatcgaacagaagattagactacaaaacaagtgtatctgcgaacctagcaaggacgtcacctggactcctgactacttctgtactagaaagtacttttcagcaggaaattacaagcttccaccaggaatttaa

SEQ ID NO: 25176 - DNA, 5505 bp, Saccharomyces cerevisiae
atgacagttagttccgatacaactgctgaaatatcgttaggttggtcaatccaagactggattgatttccacaagtcatcaagctcccaggcttcactaaggcttcttgaatcactactagactctcaaaatgttgcgccagtcgataatgcgtggatatcgctaatttcaaaggaaaatttactgcaccaattccaaattttaaagagcagagaaaataaagaaactctacctctctacggtgtccctattgctgttaaggacaacatcgacgttagaggtctacccaccaccgctgcatgtccatcctttgcatatgagccttccaaagactctaaagtagtagaactactaagaaatgcaggtgcgataatcgtgggtaagacaaacttggaccaatttgccacaggattagtcggcacacggtctccatatgggaaaacaccttgcgcttttagcaaagagcatgtatctggtggttcctccgctgggtcagcatcggtggtcgccagaggtatcgtaccaattgcattgggtactgatacagcaggttctggtagagtcccagccgccttgaacaacctgattggcctaaagccaacaaagggcgtcttttcctgtcaaggtgtagttcccgcttgtaaatctttagactgcgtctccatctttgcattaaacctaagtgatgctgaacgctgcttccgcatcatgtgccagccagatcctgataatgatgaatattctagaccctatgtttccaaccctttgaaaaaattttcaagcaatgtaacgattgctattcctaaaaatatcccatggtatggtgaaaccaagaatcctgtactgttttccaatgctgtcgaaaatctatcaagaacgggcgctaacgtcatagaaattgattttgagcctcttttagagttagctcgctgtttatacgaaggtacttgggtggccgagcgttatcaagctattcaatcgtttttggacagtaaaccaccaaaggaatctttggaccctactgttatttcaattatagaaggggccaagaaatacagtgcagtagactgcttcagttttgaatacaaaagacaaggcatcttgcaaaaagtgagacgacttctcgaatcagtcgatgtattgtgtgtgcccacatgtcctttaaatcctactatgcaacaagttgcggatgaaccagtcctagtcaattcaagacaaggcacatggactaattttgtcaacttggcagatttggcagcccttgctgttcccgcagggttccgagacgatggtttgccaaatggtattactttaatcggtaaaaaattcacagattacgcactattagagttggctaaccgctatttccaaaatatattccccaacggttccagaacatacggtacttttacctcttcttcagtaaagccagcaaacgatcaattagtgggaccagactatgacccatctacgtccataaaattggctgttgtcggtgcacatcttaagggtctgcctctacattggcaattggaaaaggtcaatgcaacatatttatgtacaacaaaaacatcaaaagcttaccagctttttgctttgcccaaaaatggaccagttttaaaacctggtttgagaagagttcaagatagcaatggctctcaaatcgaattagaagtgtacagtgttccaaaagaactgttcggtgcttttatttccatggttcctgaaccattaggaataggttcagtggagttagaatctggtgaatggatcaaatcctttatttgtgaagaatctggttacaaagccaaaggtacagttgatatcacaaagtatggtggatttagagcatattttgaaatgttgaagaaaaaagagtcccaaaagaagaagttatttgataccgtgttaattgccaatagaggtgaaattgccgttcgtattatcaagacattaaaaaaattgggtattagatcagttgcagtttattccgaccctgataaatattctcaacacgttactgatgcagatgtttctgtaccccttcatggcacaaccgcagcccaaacttatttagacatgaataagatcatagatgccgctaagcaaactaatgcacaggccattattcctggttatggtttcttgtcggaaaatgcggatttttctgatgcgtgcaccagtgctggcattacctttgttggtccttcgggagatattatcagaggtttagggttaaaacattctgctagacagattgcacagaaggctggcgttcctctagtgccaggctctttgcttatcacatcagttgaagaggctaagaaagtcgcagcggaattggaatacccagttatggtgaagtcaactgctggtggcggtggtattggtttgcagaaagtcgattctgaagaggacatcgagcatatttttgagactgtgaaacatcaaggtgaaacatttttcggtgacgctggtgtatttctggaacggtttatcgaaaatgccaggcatgttgaagtccaacttatgggagatggttttggtaaggccattgctttgggcgaacgtgattgttctttacagcgtcgtaaccaaaaagttatcgaagaaactcctgcaccaaatttgccagaaaagacgaggttggcgttaagaaaggcagctgaaagtttgggatctttattgaattacaagtgtgctggtacggttgaatttatttacgatgagaaaaaggacgagttttactttttagaagttaatacaagattacaagttgaacatccaataacagaaatggttacagggttagacttggtcgagtggatgatcaggattgccgctaatgatgcacctgattttgattctacaaaggtagaagtcaatggggtttcaatggaggcacgtttatatgctgaaaatccattgaaaaatttcagaccttctccaggtttacttgtcgatgtgaaatttcctgattgggcaagagtggatacttgggttaagaaaggtactaatatttctcccgaatatgatccaacattggccaaaattatcgttcatgggaaagaccgtgatgatgcaatttccaagttaaatcaagcgttagaagaaacaaaagtttacggatgtattactaacattgactacctgaagtctatcattaccagtgatttctttgctaaagcaaaagtttctacaaacattttgaactcttatcaatatgagcctaccgccatcgaaattactttgcccggtgcacacactagtattcaggattaccccggtagagttgggtactggagaattggtgttccgccctctggtccaatggacgcatattcgtttagattggcgaacagaattgttggtaatgactacaggactcctgccattgaagtaacgttgactggtccatccatcgttttccattgtgaaactgtcattgccattactggtggtaccgctctatgtacattagacggccaagaaattccccaacacaaaccggtcgaagttaagaggggatctactttatccattggcaagttgacaagcggctgtagagcatacttaggtatcaggggtggcattgatgtgcctaaatacttgggctcttattctactttcactctaggaaatgtcggtggatacaatggaagggtgctaaaacttggagacgtactattcttaccaagcaatgaagaaaataaatcagttgagtgccttccacagaatattcctcaatcattaattcctcaaatttccgaaactaaggaatggagaattggtgtaacatgtggtccccatgggtctccagatttttttaaacctgagtccatcgaagaatttttcagtgagaagtggaaggttcattacaactccaatagatttggtgtccgtttgattggacctaaacctaagtgggcaagaagtaatggtggtgaaggtggtatgcatccttcaaacactcacgattacgtttattctctgggtgcaattaatttcacgggtgatgagccagttattattacttgcgatggtccttccttaggtggttttgtgtgtcaagctgttgtcccagaagcagaactgtggaaggttggacaggttaaacccggtgattccattcagtttgtgccactttcttacgaaagctcgagatccttaaaggaatctcaggatgttgcaattaaatcattggatggtactaagttaaggcgcttagactctgtttcaattttaccatcattcgaaacgcctattcttgcacaaatggaaaaagtgaatgagctttcaccaaaggttgtatacagacaagcaggtgatcgttatgttttggtggaatacggtgataatgaaatgaattttaatatttcctatagaattgaatgcctgatctcccttgtgaaaaagaataagactattggtattgttgaaatgtcccaaggtgttagatctgtattgatagaatttgatggttacaaagtcactcaaaaagaattgcttaaagtattggtggcatatgaaacagaaatccagtttgatgaaaattggaagataacttctaatataataagattaccgatggctttcgaagactcgaagactttggcatgtgttcaaaggtatcaagaaacaattcgttcgtctgctccatggttgccaaataacgttgatttcattgccaatgtaaatggaatttcaaggaatgaagtttatgatatgttgtattctgccagatttatggttttaggtttaggtgatgtcttcctagggtcgccttgtgctgttccattagatcctcgtcacagatttttgggaagcaagtacaacccaagtagaacatatacagaaagaggtgcagtcggtattggcggtatgtatatgtgcatatatgctgctaacagtcctggtgggtaccaattagtgggtagaacaataccaatttgggacaaactatgtctggccgcatcttctgaggttccgtggttgatgaacccatttgaccaagtcgaattttacccagtttctgaagaagatttggataaaatgactgaagattgtgataatggtgtttataaagtcaatatcgaaaagagtgtttttgatcatcaagaatacttgagatggatcaacgcaaacaaagattccatcacagcattccaggagggccagcttggtgaaagagcagaggaatttgccaaattgattcaaaatgcaaactctgaactaaaagaaagtgtcacagtcaaacctgacgaggaagaagacttcccagaaggtgcagaaattgtatattctgagtattctgggcgtttttggaaatccatagcatctgttggagatgttattgaagcaggtcaagggctactaattattgaagccatgaaagcggaaatgattatatccgctcctaaatcgggtaagattatcaagatttgccatggcaatggtgatatggttgattctggtgacatagtggccgtcatagagacattggca

SEQ ID NO: 25177 - DNA, 429 bp, Saccharomyces cerevisiae
atgtcaggaaccggattatcgctattcgtgacgggtcttatactgaattgtttgaattccatttgccagatatactttactatattatatggtgatcttgaagcagactatatcaactcaatcgaactgtgtaagagggtgaataggttgagtgtaccagaggcaattctacaagctttcatttctgcattgtttctttttaacgggtactggttcgtatttctcttgaatgtccctgttctagcatataacgcaagtaaagtctacaagaaaacacatctactggacgccacggatattttcagaaaattgggtagatgcaaaattgaatgctttttaaaattgggattttaccttctcatattctttttctacttctacagaatggtcacagcgttacttgaaaatgatgcaaatttgataagctaa

SEQ ID NO: 25178 - DNA, 3540 bp, Saccharomyces cerevisiae
atgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaatggacgagatcatcgaaattgcaaagaagcataaggtggatttcatccatccaggttatgggttcttgtctgaaaattcggaatttgccgacaaagtagtgaaggccggtatcacttggatcggccctccagctgaagttattgactctgtgggtgacaaagtctctgccagacacttggcagcaagagctaacgttcctaccgttcccggtactccaggacctatcgaaactgtgcaagaggcacttgacttcgttaatgaatacggctacccggtgatcattaaggccgcctttggtggtggtggtagaggtatgagagtcgttagagaaggtgacgacgtggcagatgcctttcaacgtgctacctccgaagcccgtactgccttcggtaatggtacctgctttgtggaaagattcttggacaagccaaagcatattgaagttcaattgttggctgataaccacggaaacgtggttcatcttttcgaaagagactgttctgtgcaaagaagacaccaaaaagttgtcgaagtcgctccagcaaagactttgccccgtgaagttcgtgacgctattttgacagatgctgttaaattagctaaggtatgtggttacagaaacgcaggtaccgccgaattcttggttgacaaccaaaacagacactatttcattgaaattaatccaagaattcaagtggagcataccatcactgaagaaatcaccggtattgacattgtttctgcccaaatccagattgccgcaggtgccactttgactcaactaggtctattacaggataaaatcaccacccgtgggttttccatccaatgtcgtattaccactgaagatccctctaagaatttccaaccggataccggtcgcctggaggtctatcgttctgccggtggtaatggtgtgagattggacggtggtaacgcttatgcaggtgctactatctcgcctcactacgactcaatgctggtcaaatgttcatgctctggttctacttatgaaatcgtccgtaggaagatgattcgtgccctgatcgaattcagaatcagaggtgttaagaccaacattcccttcctattgactcttttgaccaatccagtttttattgagggtacatactggacgacttttattgacgacaccccacaactgttccaaatggtatcgtcacaaaacagagcgcaaaaactgttacactatttggcagacttggcagttaacggttcttctattaagggtcaaattggcttgccaaaactaaaatcaaatccaagtgtcccccatttgcacgatgctcagggcaatgtcatcaacgttacaaagtctgcaccaccatccggatggagacaagtgctactggaaaagggaccatctgaatttgccaagcaagtcagacagttcaatggtactctactgatggacaccacctggagagacgctcatcaatctctacttgcaacaagagtcagaacccacgatttggctacaatcgctccaacaaccgcacatgcccttgcaggtgctttcgctttagaatgttggggtggtgctacattcgacgttgcaatgagattcttgcatgaggatccatgggaacgtctgagaaaattaagatctctggtgcctaatattccattccaaatgttattacgtggtgccaacggtgtggcttactcttcattacctgacaatgctattgaccattttgtcaagcaagccaaggataatggtgttgatatatttagagtttttgatgccttgaatgatttagaacaattaaaagttggtgtgaatgctgtcaagaaggccggtggtgttgtcgaagctactgtttgttactctggtgacatgcttcagccaggtaagaaatacaacttagactactacctagaagttgttgaaaaaatagttcaaatgggtacacatatcttgggtattaaggatatggcaggtactatgaaaccggccgctgccaaattattaattggctccctaagaaccagatatccggatttaccaattcatgttcacagtcatgactccgcaggtactgctgttgcgtctatgactgcatgtgccctagcaggtgctgatgttgtcgatgtagctatcaattcaatgtcgggcttaacttcccaaccatcaattaatgcactgttggcttcattagaaggtaacattgatactgggattaacgttgagcatgttcgtgaattagatgcatactgggccgaaatgagactgttgtattcttgtttcgaggccgacttgaagggaccagatccagaagtttaccaacatgaaatcccaggtggtcaattgactaacttgttattccaagctcaacaactgggtcttggtgaacaatgggctgaaactaaaagagcttacagagaagccaattacctactgggagatattgttaaagttaccccaacttctaaggttgtcggtgatttagctcaattcatggtttctaacaaactgacttccgacgatattagacgtttagctaattctttggactttcctgactctgttatggacttttttgaaggtttaattggtcaaccatacggtgggttcccagaaccattaagatctgatgtattgagaaacaagagaagaaagttgacgtgccgtccaggtttagaattagaaccatttgatctcgaaaaaattagagaagacttgcagaacagattcggtgatattgatgaatgcgatgttgcttcttacaatatgtatccaagggtctatgaagatttccaaaagatcagagaaacatacggtgatttatcagttctaccaaccaaaaatttcctagcaccagcagaacctgatgaagaaatcgaagtcaccatcgaacaaggtaagactttgattatcaaattgcaagctgttggtgacttaaataagaaaactgggcaaagagaagtgtattttgaattgaacggtgaattaagaaagatcagagttgcagacaagtcacaaaacatacaatctgttgctaaaccaaaggctgatgtccacgatactcaccaaatcggtgcaccaatggctggtgttatcatagaagttaaagtacataaagggtctttggtgaaaaagggcgaatcgattgctgttttgagtgccatgaaaatggaaatggttgtctcttcaccagcagatggtcaagttaaagacgttttcattaaggatggtgaaagtgttgacgcatcagatttgttggttgtcctagaagaagaaaccctacccccatcccaaaaaaag

SEQ ID NO: 25179 - DNA, 1098 bp, Saccharomyces cerevisiae
atgttttccagactgccaacatcattggccagaaatgttgcacgtcgtgccccaacttcttttgtaagaccctctgcagcagcagcagcattgagattctcatcaacaaagacgatgaccgtcagagaggccttgaatagtgccatggcggaagaattggaccgtgatgatgatgtcttccttattggtgaagaagttgcacaatataacggggcttataaggtgtcaaagggtttattggacaggttcggtgaacgtcgtgtggttgacacacctattaccgaatacgggttcacaggtttggccgttggtgccgctttgaagggtttgaagccaattgtagagtttatgtcgttcaatttctctatgcaagctatcgatcatgttgtcaattccgctgcaaagactcactacatgtctggtggtactcaaaaatgtcaaatggtcttcagaggtcctaatggtgctgcagtgggtgttggtgctcaacattcacaggacttttctccttggtacggttccattccagggttaaaggtccttgtcccttattctgctgaagatgctaggggtttgttaaaggccgccatcagagatccaaaccctgttgtatttttagagaacgaattgttgtacggtgaatcttttgaaatctcagaagaagctttatcccctgagttcaccttgccatacaaggctaagatcgaaagagaaggtaccgatatttccattgttacgtacacaagaaacgttcagttttctttggaagccgctgaaattctacaaaagaaatatggtgtctctgcagaagttatcaacttgcgttctattagacctttagatactgaagctatcatcaaaactgtcaagaagacaaaccacttgattactgttgaatccactttcccatcatttggtgttggtgctgaaattgtcgcccaagttatggagtctgaagcctttgattacttggatgctccaatccaaagagttactggtgccgatgttccaacaccttacgctaaagaattagaagatttcgctttccctgatactccaaccatcgttaaagctgtcaaagaagtcttgtcaattgaa

SEQ ID NO: 25180 - DNA, 1629 bp, Saccharomyces cerevisiae
atgacaagtgccgctactgttactgcttcgttcaacgatacttttagcgtatccgataatgtcgccgttattgttcctgaaacggacactcaggtgacctacagggatctatcccacatggtgggtcacttccagaccatgttcacaaatcctaattctccattgtacggagctgttttcagacaagatacagtggcgatatccatgcgtaatgggctggaatttatcgtcgctttcctcggtgctactatggacgctaaaattggcgcgcccttgaatcccaattataaggaaaaggagttcaatttttatttgaatgacctgaaatctaaggcgatttgcgtcccaaagggtaccacaaagttacagagttctgaaattctaaaatctgcctccacgtttggatgttttatcgtagagctggccttcgatgcgaccaggtttagggtagagtatgatatatactctccagaggacaactacaaaagggttatttaccggtctttgaacaacgccaaatttgtcaacacaaatcccgttaaattccctgggtttgcccgttccagtgacgttgccctgattttgcataccagtggtaccacctccactccaaaaacggtgcctttgttacatttgaacattgtgagaagcacgttgaacattgctaacacttacaagctaacgcccttggacagatcttatgtcgtgatgcctcttttccacgtccatgggttaattggtgttttactttccacttttagaactcagggttctgttgtggttcccgatggattccatccaaagttattctgggaccaatttgttaagtacaactgtaattggttcagttgcgttcccacaataagcatgattatgctgaacatgcccaaaccaaaccctttcccacacattagattcatcagatcgtgttcttctgctttggctccagcaacgttccataagctggagaaggaattcaatgcacctgtcttggaggcctatgcgatgaccgaagcatcacatcaaatgacctcaaacaatctgcctccaggaaagagaaagcctggtactgtgggccagccacaaggagtcaccgtcgtcattctagatgacaatgacaatgtcttgcccccgggcaaagtcggcgaagtttccatcagaggcgaaaacgtcactttggggtatgctaataatccaaaagctaacaaggagaacttcaccaagagagagaactatttcagaaccggtgaccaaggttatttcgaccctgaggggtttttggtccttacaggcagaatcaaagagcttatcaacaggggtggtgaaaagatttcacccattgagctcgacggcattatgctatcgcatccaaagatcgatgaagccgttgcatttggtgttcccgacgatatgtacggccaagtagttcaagccgccattgttttgaagaagggagaaaaaatgacctacgaagaactggtgaacttcttaaagaagcacctagcctctttcaaaattccaaccaaggtgtactttgttgataagctaccaaaaaccgctacaggtaaaatccagagaagagttatcgcagaaacttttgctaagagcagcagaaataagagtaagttg

SEQ ID NO: 25181 - DNA, 2862 bp, Saccharomyces cerevisiae
atggtccttttgaaatggctcgtatgccaattggtcttctttaccgctttttcgcatgcgtttaccgactatctattaaagaagtgtgcgcaatctgggttttgccatagaaacagggtttatgcagaaaatattgccaaatctcatcactgctattacaaagtggacgccgagtctattgcacacgatcctttagagaatgtgcttcatgctaccataattaaaactataccaagattggagggcgatgatatagccgttcagttcccattctctctctcttttttacaggatcactcagtaaggttcactataaatgagaaagagagaatgccaaccaacagcagcggtttgttgatctcttcacaacggttcaatgagacctggaagtacgcattcgacaagaaatttcaagaggaggcgaacaggaccagtattccacaattccacttccttaagcaaaaacaaactgtgaactcattctggtcgaaaatatcttcatttttgtcactttcaaactccactgcagacacatttcatcttcgaaacggtgatgtatccgtagaaatctttgctgaaccttttcaattgaaagtttactggcaaaatgcgctgaaacttattgtaaacgagcaaaatttcctgaacattgaacatcatagaactaagcaggaaaacttcgcacacgtgctgccagaagaaacaactttcaacatgtttaaggacaatttcttgtattcaaagcatgactctatgcctttggggcctgaatcggttgcgctagatttctctttcatgggttctactaatgtctacggtataccggaacatgcgacgtcgctaaggctgatggacacttcaggtggaaaggaaccctacaggcttttcaacgttgatgtctttgagtacaacatcggtaccagccaaccaatgtacggttcgatcccattcatgttttcatcttcgtccacatctatcttttgggtcaatgcagctgacacttgggtagacataaagtatgacaccagtaaaaataaaacgatgactcattggatctccgaaaatggtgtcatagatgtagtcatgtccctggggccagatattccaactatcattgacaaatttaccgatttgactggtagaccctttttaccgcccatttcctctatagggtaccatcaatgtagatggaattataatgatgagatggacgttctcacagtggactctcagatggatgctcatatgattccttacgattttatttggttggacttggagtatacgaacgacaaaaaatattttacttggaagcagcactcctttcccaatccaaaaaggctgttatccaaattaaaaaagttgggtagaaatcttgtcgtactaatcgatcctcatttaaagaaagattatgaaatcagtgacagggtaattaatgaaaatgtagcagtcaaggatcacaatggaaatgactatgtaggtcattgctggccaggtaattctatatggattgataccataagcaaatatggccaaaagatttggaagtcctttttcgaacggtttatggatctgccggctgatttaactaatttattcatttggaatgatatgaacgagccttcgattttcgatggcccagagaccacagctccaaaagatttgattcacgacaattacattgaggaaagatccgtccataacatatatggtctatcagtgcatgaagctacttacgacgcaataaaatcgatttattcaccatccgataagcgtcctttccttctaacaagggctttttttgccggctctcaacgtactgctgccacatggactggtgacaatgtggccaattgggattacttaaagatttccattcctatggttctgtcaaacaacattgctggtatgccatttataggagccgacatagctggctttgctgaggatcctacacctgaattgattgcacgttggtaccaagcgggcttatggtacccattttttagagcacacgcccatatagacaccaagagaagagaaccatacttattcaatgaacctttgaagtcgatagtacgtgatattatccaattgagatatttcctgctacctaccttatacaccatgtttcataaatcaagtgtcactggatttccgataatgaatccaatgtttattgaacaccctgaatttgctgaattgtatcatatcgataaccaattttactggagtaattcaggtctattagtcaaacctgtcacggagcctggtcaatcagaaacggaaatggttttcccacccggtatattctatgaattcgcatctttacactcttttataaacaatggtactgatttgatagaaaagaatatttctgcaccattggataaaattccattatttattgaaggcggtcacattatcactatgaaagataagtatagaagatcttcaatgttaatgaaaaacgatccatatgtaatagttatagcccctgataccgagggacgagccgttggagatctttatgttgatgatggagaaacttttggctaccaaagaggtgagtacgtagaaactcagttcattttcgaaaacaataccttaaaaaatgttcgaagtcatattcccgagaatttgacaggcattcaccacaatactttgaggaataccaatattgaaaaaatcattatcgcaaagaataatttacaacacaacataacgttgaaagacagtattaaagtcaaaaaaaatggcgaagaaagttcattgccgactagatcgtcatatgagaatgataataagatcaccattcttaacctatcgcttgacataactgaagattgggaagttattttt

SEQ ID NO: 25182 - DNA, 3363 bp, Saccharomyces cerevisiae
atggttagtaggttttatcagattccaggtacgcatcggccatcgtcggcaatatcttcttcaaatgaatcttcttcactgttgtctgcaaggagaataagtcaaacatatttcaattatcaggcgacccctgaatgccaaaaagtttcctctaagtatgatcctgataacccaaacaaagataagttgggaacatacgatggggtatttgtgcctactgctttaaacgtattgtctatccttatgtttcttcgttttggcttcattttgggtcagttaggtattatatgcaccatcggtcttctgctattgagttacactattaatcttctcaccacgttaagtatatctgctatatctacaaacgggactgttaggggcgggggtgcttattatatgatttcaagaagtttaggacctgaatttggtggatccattgggcttgtctttttcttagggcaggtgttcaatgcaggtatgaacgcagtgggtattatcgaacctttactctataacttgggttattctgctcaaggcgagccacctgcagctttgggagagctactaccaagagggcattggcacgaatttacatatgccacggtcattcttttcttatgtttttctgtggcttttgttggctcgcaaacagtgtcaagagcagggaatattctttttttggtactggcagcttctatattttccattccactttctgcattgataagatcgccattcactgaaggcggtatcagttatacaggtccttcatggcaaacttttcatgataacctgctccctcacttaacaaaaggtgcagcaggttcgttactcaaaggtaaggaaacattcaatgatttatttggcgttttttttcctgctacagctggtatattcgcgggcgcaggaatgtcaagtgaattgagaaagccctctaaatcaattcctaagggtaccttatggggtttacttttcacttttatctgttatgccgttgttgtcttctccatgggttgttccattcccagaagatcgttatatgatgaagtacaaattatacagacgatcagttccgttcagtgggttatattcatgggtgaaatggctacttctcttttctccatcatagtggggatgctcggtgctgcttatgtattagaagcaattgcaaaggataacattattcctggtttggagatttttgctcattcaccgttatattcattgatttttacttggattctaacacagctatgtttgttttcagacgtcaataaaatcgccacatttatcacaatgacattcttaatgacgtttgtggtcatgaatttggcgtgcttcctattaggtatttcctctgctcccaatttcaggccctctttcaaatactttaacaggtatactacagcaattggcgcattactttctgttgttgcgatgttaatagttgatggcatctcagcgtctgtcttgtttttggctatgattttgctatttttattcattcattatttttcaccaccgaagtcttggggtgatgtgtctcaaagtttaatatatcatcaagtgagaaagtatttgcttcgcctacgtcaagacaatattaaatactggaggcctcaaatattgctgtttgtagataatccaaggacgagctggaacttaataaggttttgcaatcatttgaaaaaaggtggtttgtatattttaggccatgttgcagtaactgcggattttccgaagcaactaaatgaattaaaaactcagcagaaagcttggatgaagatcagagacatggcagcaataaaggcttttgtccaagttgggactggtccctcccttatatggggaattaggaatgtttttattggttccgggcttggaggtatgaaaccaaacattactgttgtcggtttttttgacctcgaaagttatagaaagcacatcccacaaagtcgcagccaaaataaccttcagaaacaggtggaaataaaagctacagtgccacgtagtacatgctctgatgtcaaaatcaatgttccattgcctacggatgagtgtaaaaatgaaaccaaagttaatgtacaacaatgggttcaaattgtagaagatctatcactgatgcaatccaatattgccatagcgcatggattcaaaaatttagagataccgaacaaaagggacagctgctttccaaaaaaaactatagatctttatcccatccaaatgtgcggaaaagttgaggcaaagggtgaccagcctgcggctatcactactaactttgatacgtatacactgattctacaattagctgccattttggttactgttcctgaatggaagcgcacacattcgcttcgagttattttatttgtggaacaagaatatcatagaacgaacgaaactcaacgaatgaaaaagctattacaggttctaagaattgacgcagaggttttggtagtatctttagatcaattcagagtatacaacacaattgtcaagggagacccaatcgtgtttgattatgtcaactcgaaattggccgataatgaatggtggaaagatttggttgaagctcgtgatacattaaaaccgaagcggaggttttccactattgaacctcaaacgatagcaaagcaatttacacaatcaagaaaatatacgtctggggttcagaaattgggtgtctcatttacaatgaatacgagaatgccaactaaccgcattgataccccatgcgagagtgaggactccgatttggatacagatcttacgtcaattcgtgatgccttctcggcatcgactaatatttcagtaggtaaggacttaacgaccaaatcgaagaccggttccgacagaacaaatttactcgtaaagaatttacaaagcgatgtgtcaacacagtcgttaagacccgttttctcgagtaatactttgccgaggacgagagtcgtggaagatggcacgggtgaacagccgacactgatcccaattgccgaacctgacctttcgaatgggaacggtactgggagcggtattggcaacggcaacaaattaaagaaaccggttcttcccgaattatcaccttgttgttcaaaagatagtttagtcacagcgatgcaaaatttaggtttcaatgatcttcccagcactgctcaacatttggttctgaatgatgtgatgacacaaatgtcaaagagttcggatttaattttttcaaccttgccagttccagctcttggaacacatgaagatcacgatgcaagtttacaatatgtcgaggacttggatatttggttggagggcttacctccatgcatgttaatcaattcgcaaaccatgacagtaactactgcattatag

SEQ ID NO: 25183 - DNA, 2550 bp, Saccharomyces cerevisiae
atggaaactattgattcgaagcaaaatattaatagggagtctttattggaggaaaggaggaaaaaactagcaaaatggaaacaaaaaaaagcacaatttgatgctcagaaagagcatcaaacttcacgcaatgacattgttactaacagtttagaaggtaagcagactactgaaaagtttacggaaagacaggaacgtgtaaaagaagagcttcggaagagaaaaaatgaatttaggaaatctgacgaacctgtatcggttaagccttcgaagaaaaagtcgaagagaagtaaggtaaagaagaaaatatccttcgacttcagtgatgacgatgattctgaaataggagtttcttttagatcgaaggagcacattcaaaaagctccagagcatgataatgaaaaagatccactggatgagtttatgacgtcattgaaggaggagaaaatgagtaatagtaaaggcatgtacgacagaggcgacattcttgatgtagaggatcaattgtttgaacttggaggaaccgacgatgaggatgttgaagataatacggataattctaatatagcgaaaattgctaaactcaaagcaaaaaaacgtgtaaagcaaatttattactctccagaagagcttgagccgttccaaaaaaatttttatatagaatctgaaacagtttcctcgatgtcagagatggaagttgaggagcttagacttagtctggataatatcaaaataaagggaacaggttgccccaaaccagtcacaaagtggtctcaactgggactatcaacggacaccatggttttaattacagaaaagttgcactttggctccttaacgcctattcaatcccaggctcttcccgctattatgtcaggtcgtgatgttataggaatatcaaaaactggctccggcaagaccatctcctatcttttaccattgctaagacaagtaaaagctcaacggccattatcaaaacatgaaacagggcccatgggtttaattctggctccaactagagagctagctttacaaatacatgaagaagttactaaattcacagaagcagatacatccattagatcagtatgctgtacaggaggttctgaaatgaaaaagcagattactgatcttaaaagaggcactgagattgttgttgccacaccgggacgatttattgatatattaacactaaatgatgggaaattacttagtactaaaagaataacgttcgtagtaatggatgaggcagacaggctgttcgatttaggttttgaacctcaaataacgcaaatcatgaaaactgttcgaccggataaacagtgtgttctatttagtgcaacttttccgaacaaactacgcagttttgccgtaagagttttgcattccccaatatctattacgattaattcaaagggaatggttaatgaaaacgtaaaacaaaagtttagaatatgccattcagaagatgaaaaatttgacaatctggtgcagcttatccatgagcgcagtgaattttttgacgaggttcaaagtgaaaatgacggacagtcaagcgatgttgaagaagttgatgctaaagccattatatttgtatcaagtcagaatatttgcgacttcatttcaaaaaagctgttaaatgctggaattgtgacctgtgctattcatgcaggtaagccatatcaagaaaggcttatgaacttagaaaagttcaaacgagaaaagaacagtattcttctctgtacagaggttctctcaagaggtttaaatgttcccgaagtgtcgttggttattatctataacgccgtcaaaactttcgcgcaatatgttcatactactggaagaactgccagaggtagtcgctccggtactgctattactcttctattgcatgatgaactgtcaggtgcttatatcttgagcaaggcaatgcgcgatgaagaaataaaagctttagaccctctgcaagcaaaagaacttcaggaaatgagtgccaagtttgaatccggtatgaaaaagggtaagtttaggttgtcgaaagggttcggcggcaaaggactggaaaatatcaaaagtaaaagagaggaagctcaaaataaagatttggagctcaaaaagaatgataagaggagcgatgacttggaaaagaaaatcagcaatccacgcgaagggcatgacagtgtgtctgagtcttctgcgcttattccgagactcaattatgaactattcaaagagtctacagacgggtcgatcatcttttacgccaaggtttatattaatgatttaccccagattgtaagatgggaggctacaaagaatacaaccttattatttatcaagcatgaaaccggatgtagtattactaacaagggtaaattttaccctgaagggaaggaaccaaagaatgaaaacgatgagcctaaactatacttattgatcgaaggccaagatgagaaagacatacaattaagtatagaattgctggagcaaaaagttaaagagggggtcgtaaaggctgcaagcttgtctttgaagagtactaaatactag

SEQ ID NO: 25184 - DNA, 1464 bp, Saccharomyces cerevisiae
atggctgaaactgaaagactaatgcctaacggtggttcccgcgaaacaaaaccgttaattacgggccatttaatcttgggcacgatagttgcttgtttggggtcgatccagtacggataccacatcgcagagttgaatgcgcctcaagaattcttatcgtgctccagatttgaggcaccagacgaaaacatctcatacgatgacacttgggttgggcaacacggactcaagcaatgcattgcgttaaccgattctcaatacggcgcaattacgtctatattcagcataggcggactgtttgggtcgtactacgccggtaactgggccaaccgatacggaagaaagtacgtgagcatgggcgcctcggccatgtgcatggtttcttctctgctgcttttcttttccaactcctacttgcagttgctatttggcaggttcctggtaggcatgtcctgcggcaccgccattgtgatcacacccttatttatcaacgagattgcccccgtggagtggagaggcgctatgggatctatgaatcaggtttctatcaatctaggtatcctgctgacccaaaccttggcactcaagtacgcagactcctataactggaggtggcttctcttttccggatccgtgattgcggtagcgaatattttagcttggctcaaagtggacgaatctccaaggtggctggtgagccacggattcgtctcggaagctgaaactgctctgttcaagttgcgtccaggaacgtaccaacaagcgaagcaagaaattcaggattggcagcgtagccatgggcacaaccgcgacccggagtcaagcgaagagactcattcaggacccacactatggcaatatgttaccgatccctcatacaagaaaccgcgcacagttatactcgccatcttgtcgtgccagcaattttgcggcatcaactctattatcttctacggtgtaaaagtgatcggcaagattctaccggactactcgattcaggtaaattttgccatttccatcctcaatgtcgttgtcactctagcagcatctgcgatcatcgaccacgtcgggcgccgtccattattgcttgcctcgactacggtgatgaccgccatgtcgctgctgatcagtgtaggtctcaccttgagcgtatcctttttactggtcacggccacttttgtctatattgccgcattcgccatcggtctgggacccatccccttcttgatcattggtgagctatcctacccgcaggatgccgctacagctcaaagttttggtactgtgtgcaactggcttgccaccttcatcgtcggatacctcttcccgataggccacggcctcatgggcggctacgtatttgcgatcttcgccgccatcgctgccatgtttgctacatatgtgtacaagcgtgtacccgagacaaagggcaagactacatacagcgaggtttgggctggctac

SEQ ID NO: 25185 - DNA, 1344 bp, Saccharomyces cerevisiae
atgttgcgacttttttcactggcacttatcacatgcttaatctactattccaaaaatcagggcccatctgctcttgttgcggccgtgggatttggtatagcaggctatttagctacagatatgttgattccacgtgtgggcaaatccttcatcaaaataggcctattcggtaaggacttgagtaaacctggccgtccggtgcttccagaaacaataggtgctatccctgctgcagtttatttatttgtaatgttcatttacattcccttcattttctacaagtatatggtcataaccacttcaggtgggggccatcgcgatgtctcagtggttgaagataacggtatgaattctaatatttttcctcatgataaactatctgaatatttgagcgctatcctatgcttggaaagtacggtcctcttgggtatcgctgatgatttatttgatttacgttggagacataagtttttcttgcctgccattgcagccatcccactgctaatggtttattatgtggattttggagttacgcatgtacttattcccggattcatggaacgctggttgaaaaagactagtgttgatttggggctgtggtattatgtttatatggcatcgatggcaattttttgccccaactccatcaacatcctggcaggtgttaatggtttagaggttggccaatgtatagtgttggccatcttagcgctattgaacgatttgctgtacttctcgatggggccattagccacaagagactcccataggttttccgctgttttgattatcccatttttgggtgtatccttggcgctatggaaatggaatcgttggcccgccacagtgtttgtgggagatacatattgttatttcgctggaatggtattcgcagtcgttggtatactgggtcatttttcaaagacgatgcttttgctattcattcctcaaatcgttaattttatttattcatgtcctcagctattcaaattggtcccctgcccgagacataggttacctaaatttaatgaaaaagacggtttaatgtatccatcaagagcaaacttaaaagaagaaccgccaaagagcatttttaaaccgatcttgaagttactatactgtctccatttgattgacctggaatttgatgaaaataatgagattattagcacctctaatatgacgttaataaacttgacattagtatggtttggccctatgagggaagacaaattgtgcaatacaatcttgaagttgcaattctgcattggaattttggctttacttggaagacacgctataggcgctatcatctttggccacgacaacctatggacagtacgt

SEQ ID NO: 25186 - DNA, 3429 bp, Saccharomyces cerevisiae
atgcaaaaaccagctagaggtggatgtagaaataccctattatggcctaatatgttagctattgcaaattttcactttttcaagttctatactagaatgagaaaaaaacacgaaaacaattcttgcaatgaaaaggacaaagatgagaacctattcaaaattattctcgccatatttttgcaagaaaaaaaaaaatacgattgtatttcatctggttcaattatgactgcttcagaagagtacttggagaatttaaaaccgttccaggtcggtctccctccacatgatcctgaatcgaataaaaaacgttacctgctgaaggatgctaatggtaaaaagtttgatctggaaggcactacaaaaagatttgaacatctgctatccttgagtggtttattcaagcattttattgaaagtaaagccgctaaagatcccaaattcaggcaggtcttagatgtattagaagaaaataaagcaaatggcaaaggcaaaggcaaacaccaagatgttcgtagacgaaagactgaacacgaagaagatgcggaattattgaaagaagaagactcggatgatgatgagagcattgaattccaattcagagaatcacctgcttacgttaatggtcaattgagaccttatcaaatccaaggtgtcaactggttggtgtctctgcataagaacaaaatagcgggtatccttgctgatgaaatgggtttaggtaagaccctgcaaactatttcatttctgggatatcttaggtacattgaaaaaattccaggtccatttttagtcattgcgcctaagtctaccttaaataattggctgagagaaataaatagatggacgccagacgtaaacgcctttattttgcaaggagataaagaagaaagagctgaactgatccaaaaaaaacttttaggttgtgactttgatgttgtgattgcttcttatgaaattattataagagaaaagtcgccccttaagaagattaactgggagtatattatcattgatgaggctcacagaatcaagaatgaagagtcaatgctttcgcaagtcttaagggaatttacctcacgtaataggctgttgattactggtactcctttgcaaaacaatttgcatgaactatgggcgttattaaattttttgttaccagatatcttttccgatgcacaagatttcgacgattggttttcttctgaaagcacagaggaagatcaggataaaattgtcaagcaactccacactgttttacagccttttctactacgtcgtatcaaaagcgatgtggaaacatccttactgcctaaaaaggaactgaatttatatgtcggtatgtctagcatgcagaagaaatggtacaaaaagattttggaaaaggatctggacgctgtgaacgggtctaatggcagcaaggaatccaaaacaagacttttaaatatcatgatgcaacttagaaaatgttgtaatcatccatatttattcgatggtgctgagccaggtccaccgtacactacggatgagcacttggtttataacgctgccaaacttcaagttttggataagttattgaagaaattgaaggaagaaggttctagagttctgattttcagtcaaatgtcaagattattggatattctcgaggattattgctacttcagaaactatgaatattgcaggatcgacggttccaccgctcacgaagatagaattcaagccattgatgattataatgctcctgattctaagaagtttgttttcttattaacgacacgtgcaggtgggttaggtatcaatttaacgtcagcagatgtcgttgtcttgtatgattcagattggaacccacaagcagatttacaagcaatggatagagcgcatcgtattggtcagaagaagcaggtcaaggtattccgtttggtcacagataactccgtggaagagaaaattttagaaagggctacccagaagttaagattagatcaattagttatccagcaaaacaggacttctttgaaaaagaaggaaaataaagcagattccaaagatgctttattatccatgattcaacatggtgccgccgatgtattcaaaagtggtacatctaccggttcagctggtacgccggaacctggttcaggagaaaaaggagatgatattgatctggacgaacttttactgaaatcagaaaacaaaactaagtcattaaatgcaaaatatgaaactttaggtcttgatgatttgcaaaaattcaaccaagattcggcctatgaatggaatggtcaagatttcaagaagaaaatacaaagggatattataagtccgctactgctcaaccccaccaaacgtgaacgtaaggaaaattactctattgataattattataaagatgttttgaatacaggaaggtcctcgaccccatcacaccccagaatgcctaagcctcatgtcttccattcccatcaattacaacctccccaattgaaagtcctgtacgaaaaggaaagaatgtggacggcgaagaagactggttatgtaccgaccatggatgacgtaaaagcagcatatggcgatatttcagatgaagaagaaaagaaacaaaaattggaattgttaaaattgtcggttaacaactcgcaaccattaactgaagaggaagaaaagatgaaggctgattgggagtctgaaggatttacaaattggaataaattagaatttagaaaattcatcacggtatctggtaaatacggtaggaactccattcaagccattgcgagagaattggcccctggcaaaacactagaggaagttcgcgcatatgctaaggccttctggtctaacattgaaagaattgaagattatgagaaatatctgaaaataattgagaatgaagaagagaagatcaagcgtgtcaaaatgcaacaagaggctttacgtcggaagttgtctgagtataagaatccattcttcgatttgaaattaaaacatcctccttcttctaacaacaaaaggacgtactctgaagaagaagatcgttttatccttctcatgttattcaagtatggcttggatagagatgacgtatacgaattagtgcgtgatgaaattagagattgtcccctattcgaattagacttttacttcagaagcaggacacctgtagagctagccagaagaggaaatacattactgcaatgcttggaaaaggaatttaacgcagggattgtattggatgacgccactaaagatagaatgaagaaagaagatgaaaatggtaaaaggataagggaagaatttgcagatcagaccgctaatgagaaggagaacgttgatggagtagagagcaaaaaagcgaagattgaggatacgtcgaatgttggaactgaacagttggtagcagagaaaattccggaaaacgaaaccactcat

SEQ ID NO: 25187 - DNA, 1656 bp, Saccharomyces cerevisiae
atgccggtcgttcacgtgattgacgttgaaagtggtaacctacagtcactaaccaatgcaattgagcatttaggttacgaagtacaactggtgaaatcaccaaaggattttaacatatcaggcacgtcaagattgattttgcctggtgtcggaaattatggccatttcgtcgacaatttatttaatagaggattcgaaaagccgataagagaatacattgaatctggaaaaccaataatgggaatttgcgtcgggctacaagcgctctttgccggttccgtggaaagccctaagagtacgggtctgaactacattgattttaagttgtccaggttcgatgattcagaaaagccagtaccagaaataggttggaattcttgcattccctcggaaaacctattctttggattggatccatacaagaggtactatttcgtccattcttttgctgccattctgaattcagaaaagaaaaaaaacctagaaaatgacggttggaaaattgcaaaagctaagtacggttcagaggaatttattgcggcagtcaacaagaataatatattcgctactcagttccatcctgaaaaatcaggtaaagctggtttgaacgtcattgagaattttttgaagcaacaaagtcctccgattccaaactatagtgcggaagagaaggaactcttaatgaatgactattcaaattatggtctaacacgcagaattattgcttgtcttgatgtacgtactaatgaccaaggtgatttggtggttactaaaggtgatcaatacgatgtacgtgaaaaaagtgatggtaaaggtgttagaaaccttggtaagcctgttcagttggcacagaaatattaccaacagggtgcggatgaagtaacatttttgaatataacttcttttagagattgtcctttgaaggatactccgatgctagaggttctgaaacaagccgcaaagacagtctttgttccattgacagtcggtggggggatcaaggatattgtcgatgttgatggaaccaaaatacctgctttagaagttgcaagtctatacttcagatctggtgctgataaagtatcgatcggtacggatgcagtctatgcagccgaaaaatactacgagttgggtaacagaggagatggaacgtcaccaatagagacaatctcgaaagcatacggtgctcaggcagttgttatttctgtcgaccctaagagagtatatgtaaattcacaagcagatacgaagaacaaagtcttcgagacagaatatccgggccccaatggagagaaatactgctggtaccaatgtacaatcaaaggtggaagagaatctagagaccttggtgtgtgggaattaacaagggcatgtgaagctctaggtgctggggagattttattgaactgcatagacaaggatggctctaattctggttatgatctggaattgatagaacatgttaaagatgcggtcaagattcccgtcattgcatccagtggcgccggtgtacccgaacatttcgaagaggccttcctaaagacccgcgcagatgcttgcttgggtgcaggtatgttccacagaggtgaattcactgttaacgatgtaaaggagtatttactagagcacggattaaaggttagaatggatgaagag

SEQ ID NO: 25188 - DNA, 1110 bp, Saccharomyces cerevisiae
atgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatctagaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctcaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaa

SEQ ID NO: 25189 - DNA, 654 bp, Saccharomyces cerevisiae
atgatagtaaaattactccaggaaatacaagtagcacaaaatacggaggaatacgatatggaagcaaccatcaaagtggtactgctaggagattcatcagtggggaaaaccagtatagtgactaggctcaaatcaggtaagtttctagcaaaacatgcggctacgataggtgcggcgttcatcaccaagacaatcgaggttccttctaacgactcctctacggagaaacgtatccatatggagatatgggacacggcgggtcaggaacggtataaatcactggtgccaatgtattatcgagatgcgaatattgctttgattgtattcgaattgggagacgtatccagtctgcaatgtgcaaagacatggtttcaagatttacaggaccgtgctcagggaacgcaggtaattatcgtgggcaataagtacgatttagtctgcgaagagcattcaggggaagtgactataccggcggagttacagggtctgccgtatgtggccgtaagtgcaaagacagggtacaatttcgatacattgaataaaataataatcagtttggttcccgaaagtcaattcaagacattgtcaaagaacaatgaacagggaaatatactggaaataaataaaaaaaaaagcggcagtggctgtatatgt

SEQ ID NO: 25190 - DNA, 1584 bp, Saccharomyces cerevisiae
atgagtctctcgcaggtgtcacctttaccccatatcaaggatgttgttttaggagatacagtaggccaaggcgcattcgcctgcgttaaaaatgctcatcttcaaatggatccctccattattctagctgttaaattcattcatgttcccacttgcaaaaaaatgggactcagtgacaaggatatcacaaaagaggttgttttgcaatcgaagtgttctaagcatcctaatgttttgagacttatcgattgtaatgtctctaaagaatatatgtggataattctggagatggcagatggtggtgatctatttgataagattgagcctgacgttggagttgattccgacgtggcccaattttactttcaacagctcgttagtgctattaattatctgcatgtagaatgtggagttgctcacagagacatcaagcctgaaaacatcttactcgataagaacggaaatctgaagctagctgattttgggctcgcctctcaatttaggaggaaagatggtacattacgtgtatccatggatcaaaggggttctccaccctacatggctcctgaagtattatattctgaagagggttattacgcagatcgaacagatatatggtctattggcatcctcttgttcgtattgttgactggtcaaacgccttgggaattaccttcattagagaacgaagatttcgtcttttttattgaaaatgatggaaatttaaactggggaccctggtcaaagatagaatttactcacttgaacctactccgaaaaattttacaacctgacccaaataagagggtgacattgaaggctttaaagttacatccttgggtattacgtcgagcttcattttctggggatgatggtctctgtaatgaccctgaactcttggctaagaaactgttttctcacttaaaagtctcactgagtaacgaaaattatttgaaattcactcaagatacaaactctaataataggtacatttctactcagccaattggtaacgaattggctgagcttgaacacgactcaatgcatttccagacagtttcgaatacacaacgtgcatttacctcgtatgattcaaatacgaactataatagcggaacaggtatgacacaagaggctaagtggacgcaattcataagctatgatatcgctgccttacagtttcattctgatgaaaatgattgtaatgaattagtaaaacgacatttacaatttaatccgaataaacttaccaagttctacacgttgcaacctatggatgttttgttaccgattttggagaaagccttgaatttatcacaaattagagtaaaacccgacctttttgcgaattttgaaagattgtgcgaattattgggttatgataacgttttcccacttattataaatattaaaaccaaaagtaatgggggttatcaattatgcggtagcatttccatcataaagattgaagaagagttgaaaagtgtcggatttgaaagaaaaactggtgatcctttagaatggagaagattgttcaagaaaatttcaactatctgtagggatattatcctaattcccaactga

SEQ ID NO: 25191 - DNA, 897 bp, Saccharomyces cerevisiae
atgtccagtaaagctaccaaaagtgacgtagatccattgcactcgtttctggcagggtccctagccggtgctgctgaagcatgtataacatatccttttgagtttgccaaaacaaggctgcagctgattgataaggcctccaaggcatcaagaaatcctctggtattgatatataaaactgcaaaaactcagggcattggttccatttatgtcggatgtcccgcatttattattggaaacaccgctaaggcgggtattagatttcttggctttgataccattaaagacatgctaagagatagtgaaactggagaactaagtggtacaagaggggtgatagctgggttaggtgcgggactattagaaagtgttgccgcagtgactccttttgaagcaatcaaaactgctttgatcgatgataaacaatctgctacaccaaaataccataataatgggcgcggtgtagtacgaaactattcatcattagtccgtgataaaggattttctggtctttatcgtggtgttttgccagtttccatgagacaggccgcaaaccaagccgttagattgggttgttacaataagattaagaccttgatccaagattatacggattcgccaaaagacaaacctttatcatccgggttaaccttcttagtgggtgcatttagtggtattgtgacggtctattccaccatgccccttgatactgtgaaaacaagaatgcaaagtttggattccaccaaatactcctctacaatgaattgttttgcaaccattttcaaagaagaagggttaaagacgttttggaaaggtgctacgcctagacttgggagattggtcttgagtggtggtattgttttcactatctatgaaaaggtcttagttatgctagcc

SEQ ID NO: 25192 - DNA, 3651 bp, Saccharomyces cerevisiae
atgaagccggaaaaactcttctccggtttaggtaccagcgatggcgagtatggagtggtaaatagcgagaacatatcaatagatgctatgcaagataatagaggcgagtgtcatcgtagatccatagaaatgcatgctaatgacaatctgggattggtctcccagcgagactgtaccaatcggcccaaaattactcctcaggaatgtttgagtgagactgagcagatatgccatcatggcgagaataggactaaggctgggttagatgtagacgatgctgaaaccggtggtgatcacaccaatgaatcccgtgtagatgaatgttgtgctgagaaagtgaacgacactgagactggcttggatgtggacagctgttgcggcgatgctcaaacaggtggtgaccacaccaatgaatcctgtgttgatggatgctgcgttagagattcttcagtgatggtcgaggaagttacaggcagctgcgaagctgtatcttctaaagaacaattgctgaccagctttgaagttgttccaagcaaatctgaaggtctgcaatctattcatgatattagagagacaactcgctgcaataccaattccaaccaacacacagggaagggtaggctttgcatcgaatcaagtgactctacactcaagaaaagaagttgtaaagttagcagacagaaaattgaggtttccagtaagcctgagtgctgcaacatttcatgtgttgagcggattgcatctcgtagctgtgaaaagaggacttttaaaggtagcaccaatgttggaatttctgggagtagctctaccgacagtttaagcgagaagttcttcagcgaacagtactctagaatgtacaatcgttactcctcaattttgaaaaatttaggttgtatctgtaactatttgcgtactttgggaaaagaatcttgttgtctcccaaaggtgcgtttttgtagcggggagggtgcttctaaaaagacaaaatactcctaccgcaacagttctggatgtttaacaaagaaaaagacccatggagacaaagaaaggttgagcaatgacaatggccatgctgattttgtttgttctaaaagttgttgcactaaaatgaaggattgtgctgttacctcaactatttctggaacctcttcgagtgaaatttcaagaatcgtatcaatggaaccaattgaaaatcatcttaatcttgaggcaggatctaccggtaccgagcacattgttcttagtgtttcaggaatgtcctgtactggttgtgaatcaaaacttaagaaatcatttggcgcgctcaaatgtgttcacggtttgaagaccagtttaatattatcgcaagctgaatttaatctggatcttgctcagggatctgtcaaggatgttatcaagcacttgagcaaaactactgaattcaagtacgaacagatttcaaatcatggttcaactatagatgttgttgttccttatgcagcaaaagattttattaatgaggaatggccacaaggtgtcacagagctgaaaattgttgagagaaatatcattcgtatttactttgacccaaaggttataggtgccagagatcttgtcaatgaaggatggagcgtgcctgttagtattgctccattcagttgtcatccaaccattgaagtgggaaggaagcatttagttcgtgtaggctgcacgaccgctttatccataatattgacgatcccgattctcgtgatggcttgggctccacagcttcgtgaaaaaatttccactatctccgcgtcaatggtgctagcaactattattcaatttgttattgcaggaccgttttacttaaatgccttgaagagtttgatattttccaggctcattgaaatggatctactaatagttttaagcactagcgctgcctacatattttcgattgtatcatttggatatttcgttgttggacgcccgttatctacggagcagttttttgaaaccagctctttgcttgtaactctcatcatggttggtcgctttgtgagtgaactagctagacatagggctgtaaagtcaatatcagtacgttccttacaggcctcttctgctattctggtggataaaactggtaaagagacggaaattaatattagacttctccaatatggcgatatttttaaggttttacctgattcaagaatcccaactgatggaacagtcatttctgggtcttctgaagtcgacgaagcgttaatcacaggtgaatctatgccagtcccgaaaaagtgtcaatcaattgttgttgcaggatcggtgaatggcactggtactttgtttgtgaagctgagcaagcttccagggaacaatactattagtaccatagccacgatggttgatgaagcaaaattaactaagccaaagatccaaaatatcgctgataaaattgcaagttatttcgtgccaactatcattggaatcactgtcgtcaccttttgcgtttggatagcggttggaatccgtgtggaaaagcaatcccgctccgatgccgtaattcaggccattatatatgccattacggtacttatcgtttcgtgtccctgcgtgattggacttgccgttcctatcgtatttgttattgcaagtggcgtcgctgcgaaaagaggggtaatcttcaaatcagcagagagtatagaagttgctcacaacacttcgcatgttgtcttcgataaaacgggtaccctaactgaaggaaaacttactgtagtacatgaaactgttaggggtgatcgtcataattctcaatctttgttgcttggattaactgaaggaataaaacacccagtttccatggcaatagcatcctatctcaaagaaaaaggtgtttctgctcaaaatgtttctaatacaaaagctgtgactggtaagcgggtagaaggaacatcatactctggtttgaagttacaaggagggaactgtcgttggcttggtcataacaatgatcctgacgttcgaaaagcccttgaacaaggatattctgtattctgttttagtgttaatggttcagtcactgcagtttatgcattagaggactctttacgggcagatgctgtctccactattaacttgttacgccaaagagggatttcactacacattttatcaggggatgacgatggagccgttcgttctatggcagcccgtcttggaattgaaagctccaatattcgttctcacgcaacgcctgcagaaaagagtgaatatattaaggatattgtcgaaggaagaaattgcgatagttcttcgcagtcaaaaagaccggttgttgttttttgcggtgacggaacaaacgacgcaattggtttgactcaagcaacgattggagttcatatcaatgagggaagtgaggttgccaagctagctgctgatgtagttatgttaaagccaaagctcaacaatattttgactatgataactgtaagtcaaaaggccatgtttagggtcaaattgaatttcttatggagttttacttacaacttatttgctatccttttggcggctggtgcctttgttgactttcatattccaccagagtatgcgggtttaggggaactagttagtatcctccctgtaatttttgtagctatacttctgcgttatgcaaagatttag

SEQ ID NO: 25193 - DNA, 1842 bp, Saccharomyces cerevisiae
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttatatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaataccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaaacacctcatctgttgtgaacaaa

SEQ ID NO: 25194 - DNA, 1755 bp, Saccharomyces cerevisiae
atgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatctaactacgaaaaggtctggcccacatacggtaccaacgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaaaggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaacttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttttcttgaatgaatcttttgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttgaatttcagtggcgaagaaattgaattcagcctcccaagagaaggtgcttctttatcttttattcttggaaattatgatgatactgacgtttcctccagagttttgaaaccatgggaaggtagaatctacctcgtcaaataa

SEQ ID NO: 25195 - DNA, 2139 bp, Saccharomyces cerevisiae
atgcgattgttgctgtgcaagaattggtttgcgtcacctgtaatctcaccactactgtatacccgctccttatattcaatggctaacactactagtttccctattgctccccaggccccgcctaattggtcgttcactcccagcgatattagtgggaaaaccaacgaaatcatcaacaacagcaacaatttctatgattctatgagtaaggtagagagcccttccgtgagtaattttgtggagcctttcatgaagtttgaaaatgaattgggcccaataattaaccaattaactttcttacagcatgtgtcgtctgataaagaaattagggacgcatctgtgaactcctcaatgaaactggatgagttgaacatcgatctatctctgcgtcacgacatctttttgcaattcgcccgcgtctggcaggatgttcaatcgaaggcagattctgtggaaagagaaactttcaaatacgttgagaagtcttacaaggactacattcattctggtttggaacttgacgagggaaaccgattgaaaatcaaagagatcaaaaagaagatctccgttaactctattaatttttcgaagaatctgggagaacaaaaggaatacatcactttcaccaaagaacaattggaaggtgtgccggattctattttgacgcagttcgagacaataaaatctgacaaagatagcaatgaaaccttgtataaagtcaccttcaaatatccggacatttttcccgtgatgaaattggcatcctcagctcagactagaaagcaggcctttttggccgaccaaaataaggtccctgaaaatgaagctatactgttggatacattgaagctgcgtgacgaattggcctcgttattgggctatgacacgtatgcgaactacaacctgtatgataaaatggctgaagatagcactacggtaatgaactttttgaatgatttgaaggacaagctaattccgctgggcagaaaggaactacaggtcttgcaagatatgaaagccgaagatgttaagaaacttaaccagggtgcagatccaaactactacatttgggaccaccgttactacgataacaaatatttgttagaaaacttcaatgtggacctagaaaagatttctgaatattttccactagaggctacgattactggtatgctggaaatatacgaaacattgtttaatttgaagtttatcgagacgaaagattctcaaaacaaatctgtttggcatgacgacgtcaaacaaatcgccgtttggaatatggatgatccaaagtctccaaactttgttggttggatttatttcgatttacatcctcgtgatggtaaatatggccacgctgccaattttggtttatcgtcatcattcatgattgatgacaccacaagatcgtatccggttactgcgttggtttgcaatttctccaaatctacgaaggataaaccttctctactgaagcataacgaaatagtgacctttttccatgaattgggccatggtatccatgacctggtgggacaaaacaaggaatcgaggtttaatggccccggatctgttccatgggattttgtggaggcaccttcccaaatgttagaattttggacttggaataagaatgaattaatcaacctctcatcacattacaaaacgggcgaaaaaattccagaatctttgatcaattcattgatcaaaactaaacacgtaaatggtgctttattcactctaagacaattacattttgggttatttgatatgaaagtacatacttgtaaagacttgcaaaacctgtcaatttgcgatacctggaaccaattgagacaggatatttctttgatttctaatggtggtacgttatccaagggttatgattcatttggccatataatgtcagactcttactctgccggttattacggttatctatgggcggaagtctttgcaactgatatgtatcacaccaaattcgctaaggatccgttaaatgccaagaatgggatacaataccgtgatattgtgttggctcgtggtggcctttatgatattaatgataatctgaaagaatttttgggtagggaaccttctaaggatgctttcttgaaggagctgggcttacagaactaa

SEQ ID NO: 25196 - DNA, 1008 bp, Saccharomyces cerevisiae
atggcattccaagatccaacttacgaccagaataaaagcagacacatcaacaacagtcacttgcaagggccaaaccaggaaacaatagaaatgaaatctaaacacgtatcattcaaaccctctagagacttccatacaaacgattactcgaataactacattcatgggaagtcgctaccgcaacagcatgttactaatattgagaatagggttgatggctatccaaaacttcagaaattatttcaggcgaaagctaaacaaataaatcaatttgccactacgccatttgggtgtaaaatcggaatagattccattgttccaacgttgaatcactggatacagaacgaaaatttgactttcgacgtggtgatgattggctgcttaacagaaaatcagtttatttacccaattttaacccaattgccattggatagattgatctccaaaccaggtttcctgttcatctgggccaattctcaaaaaatcaatgaacttactaaacttttgaataatgaaatatgggctaaaaagtttagaagaagtgaagaattggtttttgttcctattgacaagaaatcaccgttttatccaggtttagatcaggacgatgaaacgttgatggaaaaaatgcaatggcactgttggatgtgtatcacaggtacagtaaggaggtctacagatggacatcttattcattgtaacgtagacactgacttgagtatcgaaacgaaggacaccactaatggtgctgtaccatcccatttgtatcgtattgcagaaaacttctctaccgcgactagacgattacatattattcctgcaaggactggttacgagacacccgtcaaagtaagacctggctgggttatagtgagcccagatgttatgttggataacttctcacccaagagatataaagaagagatagctaatttaggttcgaatatcccattaaaaaatgagattgagctgttaagaccaagaagtccagtacaaaaagcacaataa

SEQ ID NO: 25197 - DNA, 1503 bp, Saccharomyces cerevisiae
atgtcattcgacgacttacacaaagccactgagagagcggtcatccaggccgtggaccagatctgcgacgatttcgaggttacccccgagaagctggacgaattaactgcttacttcatcgaacaaatggaaaaaggtctagctccaccaaaggaaggccacacattggcctcggacaaaggtcttcctatgattccggcgttcgtcaccgggtcacccaacgggacggagcgcggtgttttactagccgccgacctgggtggtaccaatttccgtatatgttctgttaacttgcatggagatcatactttctccatggagcaaatgaagtccaagattcccgatgatttgctagacgatgagaacgtcacatctgacgacctgtttgggtttctagcacgtcgtacactggcctttatgaagaagtatcacccggacgagttggccaagggtaaagacgccaagcccatgaaactggggttcactttctcataccctgtagaccagacctctctaaactccgggacattgatccgttggaccaagggtttccgcatcgcggacaccgtcggaaaggatgtcgtgcaattgtaccaggagcaattaagcgctcagggtatgcctatgatcaaggttgttgcattaaccaacgacaccgtcggaacgtacctatcgcattgctacacgtccgataacacggactcaatgacgtccggagaaatctcggagccggtcatcggatgtattttcggtaccggtaccaatgggtgctatatggaggagatcaacaagatcacgaagttgccacaggagttgcgtgacaagttgataaaggagggtaagacacacatgatcatcaatgtcgaatgggggtccttcgataatgagctcaagcacttgcctactactaagtatgacgtcgtaattgaccagaaactgtcaacgaacccgggatttcacttgtttgaaaaacgtgtctcagggatgttcttgggtgaggtgttgcgtaacattttagtggacttgcactcgcaaggcttgcttttgcaacagtacaggtccaaggaacaacttcctcgccacttgactacacctttccagttgtcatccgaagtgctgtcgcatattgaaattgacgactcgacaggtctacgtgaaacagagttgtcattattacagagtctcagactgcccaccactccaacagagcgtgttcaaattcaaaaattggtgcgcgcgatttctaggagatctgcgtatttagccgccgtgccgcttgccgcgatattgatcaagacaaatgctttgaacaagagatatcatggtgaagtcgagatcggttgtgatggttccgttgtggaatactaccccggtttcagatctatgctgagacacgccttagccttgtcacccttgggtgccgagggtgagaggaaggtgcacttgaagattgccaaggatggttccggagtgggtgccgccttgtgtgcgcttgtagcatga

SEQ ID NO: 25198 - DNA, 2400 bp, Saccharomyces cerevisiae
atggttttgccgattctaccgttaattgatgatctggcctcatggaatagtaagaaggaatacgtttcacttgttggtcaggtacttttggatggctcgagcctgagtaatgaagagattctccagttctccaaagaggaagaagttccattggtggctttgtccttgccaagtggtaaattcagcgatgatgaaatcattgccttcttgaacaacggagtttcttctctgttcattgctagccaagatgctaaaacagccgaacacttggttgaacaattgaatgtaccaaaggagcgtgttgttgtggaagagaacggtgttttctccaatcaattcatggtaaaacaaaaattctcgcaagataaaattgtgtccataaagaaattaagcaaggatatgttgaccaaagaagtgcttggtgaagtacgtacagaccgtcctgacggtttatataccaccctagttgtcgaccaatatgagcgttgtctagggttggtgtattcttcgaagaaatctatagcaaaggccatcgatttgggtcgtggcgtttattattctcgttctaggaatgaaatctggatcaagggtgaaacttctggcaatggccaaaagcttttacaaatctctactgactgtgattcggatgccttaaagtttatcgttgaacaagaaaacgttggattttgccacttggagaccatgtcttgctttggtgaattcaagcatggtttggtggggctagaatctttactaaaacaaaggctacaggacgctccagaggaatcttatactagaagactattcaacgactctgcattgttagatgccaagatcaaggaagaagctgaagaactgactgaggcaaagggtaagaaggagctttcttgggaggctgccgatttgttctactttgcactggccaaattagtggccaacgatgtttcattgaaggacgtcgagaataatctgaatatgaagcatctgaaggttacaagacggaaaggtgatgctaagccaaagtttgttggacaaccaaaggctgaagaagaaaaactgaccggtccaattcacttggacgtggtgaaggcttccgacaaagttggtgtgcagaaggctttgaggagaccaatccaaaagacttctgaaattatgcatttagtcaatccgatcatcgaaaatgttagagacaaaggtaactctgcccttttggagtacacagaaaagtttgatggtgtaaaattatccaatcctgttcttaatgctccattcccagaagaatactttgaaggtttaaccgaggaaatgaaggaagctttggacctttcaattgaaaacgtccgcaaattccatgctgctcaattgccaacagagactcttgaagttgaaacccaacctggtgtcttgtgttccagattccctcgtcctattgaaaaagttggtttgtatatccctggtggcactgccattttaccaagtactgcattaatgcttggtgttccagcacaagttgcccaatgtaaggagattgtgtttgcatctccaccaagaaaatctgatggtaaagtttcacccgaagttgtttatgtcgcagaaaaagttggcgcttccaagattgttctagctggtggtgcccaagccgttgctgctatggcttacgggacagaaactattcctaaagtggataagatcttgggtccaggtaatcaatttgtgactgccgccaaaatgtatgttcaaaatgacactcaagctctatgttccattgatatgccagctggcccaagtgaagttttggttattgccgatgaagatgccgatgtggattttgttgcaagtgatttgctatcgcaagctgaacacggtattgactcccaagttatccttgttggtgttaacttgagcgaaaagaaaattcaagagattcaagatgctgtccacaatcaagctttacaactgccacgtgtggatattgttcgtaaatgtattgctcacagtacgatcgttctttgtgacggttacgaagaagcccttgaaatgtccaaccaatatgcaccagaacatttgattctacaaatcgccaatgctaacgattatgttaaattggttgacaatgcagggtccgtatttgtgggtgcttacactccagaatcgtgcggtgactattcaagtggtactaaccatacattaccaacctatggttacgctaggcagtacagtggtgccaacactgcaaccttccaaaagtttatcactgcccaaaacattacccctgaaggtttagaaaacatcggtagagctgttatgtgcgttgccaagaaggagggtctagacggtcacagaaacgctgtgaaaatcagaatgagtaagcttgggttgatcccaaaggatttccagtag

SEQ ID NO: 25199 - DNA, 1323 bp, Saccharomyces cerevisiae
atggatagatatcaaagaaagataggatgtttcatacaaatcccaaatttggggcgcggacaactgaaatacgtgggtccagtggacacgaaagctggaatgtttgctggtgtagacttacttgccaacattggtaagaacgatggatcattcatggggaagaagtattttcaaacagagtatcctcaaagtggactatttatccagttgcaaaaagtcgcatcattgatcgagaaggcatcgatatcgcaaacctcgagaagaacgacgatggaaccgctatcaatacccaaaaacagatctattgtgaggctcactaaccagttctctcccatggatgatcctaaatcccccacacccatgagaagtttccggatcaccagtcggcacagcggtaatcaacagtcgatggaccaggaggcatcggatcaccatcaacagcaagaatttggttacgataacagagaagacagaatggaggtcgactctatcctgtcatcagacagaaaggctaatcacaacaccaccagcgattggaaaccggacaatggccacatgaatgacctcaatagcagcgaagttacaattgaattacgagaagcccaattgaccatcgaaaagctacaaaggaaacaactacactacaaaaggctactcgatgaccaaagaatggtcctcgaagaagtgcaaccgacttttgataggtatgaagccacaatacaagaaagagagaaagagatagaccatctcaagcaacaattggagctcgaacgcagacagcaagccaaacaaaagcagttttttgacgctgagaatgaacagctacttgctgtcgtaagccaactacacgaagagatcaaagaaaacgaagagagaaatctttctcataatcaacccactggtgccaacgaagatgtcgaactcctgaaaaaacagctggaacaattacgcaacatagaagaccaatttgagttacacaagacaaagtgggctaaagaacgcgaacaattgaaaatgcataacgattcgctcagtaaagaataccaaaatttgagcaaggaactatttttgacaaaaccacaagattcctcatcggaagaggtggcatccttaacgaaaaaacttgaagaggctaatgaaaaaatcaaacagttggaacaggctcaagcacaaacagccgtggaatcgttgccaattttcgacccccctgcaccagtcgataccacggcaggaagacaacagtggtgtgagcattgcgatacgatgggtcataatacagcagaatgcccccatcacaatcctgacaaccagcagttcttctag

SEQ ID NO: 25200 - DNA, 1902 bp, Saccharomyces cerevisiae
atgtcgtcgtcgaagtctctatacgaactgaaagacttgaaaaatagctccacagaaatacatgccacggggcaggataatgaaattgaatatttcgaaacaggctccaatgaccgtccatcctcacaacctcatttaggttacgaacagcataacacttctgccgtgcgtaggtttttcgactcctttaaaagagcggatcagggtccacaggatgaagtagaagcaacacaaatgaacgatcttacgtcggctatctcaccttcttctagacaggctcaagaactagaaaaaaatgaaagttcggacaacataggcgctaatacaggtcataagtcggactcgctgaagaaaaccattcagcctagacatgttctgatgattgcgttgggtacgggtatcggtactgggttactggtcggtaacggtaccgcgttggttcatgcgggtccagctggactacttattggttacgctattatgggttctatcttgtactgtattattcaagcatgtggtgaaatggcgctagtgtatagtaacttgactggtggctacaatgcatacccagtttccttgtggatgatggtttttgggtttgcagtcgcttgggtttattgtttgcaatggctgtgtgtgtgtcctctggaattggtgaccgcatccatgactatcaaatattggacgacatctgtgaacccggatgtgttcgtcattattttctatgttttggtgattactattaatattttcggtgctcgtggttatgcagaagctgagttcttcttcaactgttgcaaaattttgatgatgactgggttcttcattcttggtattatcatcgatgttggtggcgctggtaatgatggttttattggtggtaaatactggcacgatccgggcgctttcaatggtaaacatgccattgacagatttaaaggtgttgttgcaacattagtgactgctgcttttgcctttggtggttcagagtttattgccatcaccactgcagaacaatctaatccaagaaaggccattccaggtgcggccaaacaaatgatctacagaatcttattcctattcttggctaccattattctactgggtttcttggtgccatacaattccgatcaattattgggttctaccggtggtggtactaaagcctcgccatatgtcattgctgttgcatcccacggtgtccgtgtcgtcccacacttcattaacgccgttattctactttccgtgctgtccatggctaactcctccttctactccagtgctcgtttatttttaactctatccgagcaaggttacgctcctaaggttttctcctacatcgacagagccggtagaccattgattgccatgggtgtttctgcattgtttgccgttattgccttctgtgctgcatctcccaaggaagaacaagttttcacttggttattggccatttctggtttgtctcagcttttcacatggactgccatttgtttatcccatcttagatttagaagagccatgaaagtccaagggagatctcttggagaattgggtttcaaatctcaaactggtgtttggggatctgcctacgcttgcattatgatgattttaattcttattgcccaattttgggtcgctatcgcccccattggtgaaggtaagctggatgcacaagcctttttcgaaaactacttggctatgccaatcttgattgcactatatgtcggctacaaggtctggcacaaggattggaaactgttcatcagggccgacaagatcgacctagattctcatagacaaatctttgatgaagaattaatcaagcaagaagacgaagaatatagggaacgtttgaggaacggaccttattggaaaagggtcgttgccttctggtgttaa

SEQ ID NO: 25201 - DNA, 2451 bp, Saccharomyces cerevisiae
atgactgtggcgaataccgagacccattctgctgctaaaccatcgagtactataggcccatggaagcttggtgaaacactgggctttggtagcaccggcaaggtccaacttgcgcaacatgagcgcacgggccatagaacagccgtcaaagtaatctcaaagtccattttcaacaacaacggaaaccacagtaacgacgattcagtgctgccatacaacatcgagcgtgagattgttattatgaaacttttgagccacccaaacgttctgagtctttacgacgtttgggaaaccaacaataacctgtaccttatcctggaatacgccgaaaagggagaactgttcaacttgcttgtggaccacggtcccttgcccgagcgtgaggccatcaattgcttcagacagataattataggcatttcatactgccatgcgctaggaatagtacatcgggatttaaagccagaaaatcttttgctcgatagtttctataatatcaaaattgcggattttggtatggcagctttacagacagacgccgacctgctagaaacttcttgtgggtctcctcattatgccgctcctgagatcgtatcaggtctgccctatgaaggatttgccagcgacgtttggtcttgcggtgtaatcctctttgcccttttaacgggtagactacccttcgatgaagaaaacggtaatgttagggatttgttattgaaagtccaaaagggccagtttgaaatgcccaatgacaccgaaatttccagagatgcacaagatttaatcggcaagattctcgttgtagatcccaggcaaagaataaaaatcagagacatccttagtcatccactgctaaaaaaatatcaaaccattaaggattccaaaagtatcaaagatttacctcgtgaaaatacctatctatatccactggctgactcgaacaaccatactagcgcctctatcgatgattcaatcctacaaaacttggtggtactttggcatggtagacacgccgatgacatcgtatctaaactgaaagagaatggaaccaacaaagaaaaaattctatatgcgctactataccgtttcaaactggactctgtaaggggatcgaataagaagaaccgcaataagataaagaaaaccaaaaaaaataaaagatctagcacactttcgtcatcgtcatcattattattgaacaaccgaagcatacaatctacgccacgcagacgtacatccaagaggcattccagggaattctcttctagcaggaagagatcgtcctttttactgtcctcgaatcctaccgatagttctccaatacctttgagaagtagtaaaagaattacacatattaacgtagcgtctgcaaatacccaagcaacgccaagtggtgtcccgaatcctcacaagaggaactcaaaaaaacggtcaagcaaaagattatcttatatgcctaatacaaaaagaagctcactaacatcaaaatcattatcaaactttactaacctaatagatgatgatgattgggagtacattgaaaaggatgcaaagagaacaagttccaacttcgctacactgattgatgaaatatttgagcctgagaaatttgaattggcgaaaagagaaaaggctgaacttcaaagaaaagttcaggaagcaaaaaggcaatcagtgaatgcacagaagattaatgaggacgagtttggatccgaagtttctgatggaatgaaagagctgaaaaaaataaatgacaaagtgtcgtccccgttgataaattacgaattttcgcaacaagaactattgcaagatatagacaccttactaacgaatcgttatcaactttcgtcatatactaggcctatttcgagactggatcccggattaacgcctgttactgagacacttcctaacaacctaaaagaaaaaacagctctgctgcaggatactgaaaagaaaataatagaaacgatacgcagatccaaatttttaggatcgctactaaatgttagagggggactatcgccagggaaaagtgaactggcacctatcgaagagtctcccatagtttcaaccacaccactaatatataatgatcgaatggaacctcgtaggatatccgatgtggaagtcccacatttcacgaggaaatcaaaacactttactactgctaataatcggcgctcagtcttatctttgtatgcgaaggattcaatcaaagacttaaacgaatttttaataaaggaagatcctgatttgcctccacaaggaagcactgataacgaaagtaggagcgaagatcccgaaatagccgagagtatcactgattcaaggaatatacaatatgatgaggatgatagtaaggatggtgataatgtgaataatgataatatattgagcgactttccctcaaggcgttggcatatcacaggaatacgacatgaaggataa

SEQ ID NO: 25202 - DNA, 1095 bp, Saccharomyces cerevisiae
atgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaa

SEQ ID NO: 25203 - DNA, 2985 bp, Saccharomyces cerevisiae
atggagaaagacctgtcgtctctttactctgaaaagaaagacaaagagaacgatgaaaccttatttaacatcaaactatccaaatctgttgtcgagaccacaccgctaaatggtcattcattgtttgatgatgataaatcactttcagactggacggataatgtgttcactcaatcagtattctatcacgggtcagatgacttgatatgggggaagttctttgtctgcgtgtacaagtcccccaacagcaataagttgaacgctataatattcgacaaattaggaacatcatgcttcgaatccgtcgatatatcttccaactcgcaatactatccggccattgagaatttgagtccaagtgatcaggaaagcaatgttaagaaatgcattgctgtcattctgttacagcgctatccattactttcaccatcagacttatcacaaatattgtccaataaatcggaaaattgcgactatgaccccccttatgctggagatttggctagtagttgccagttgataacagcagttcctccagaagatctggggaagcgcttctttacatcaggacttctgcaaaatagatttgtcagctctaccctgttagatgttatttatgaaaacaatgaatccaccatcgaactaaataataggttggtattccatctgggtgaacaacttgaacaactttttaacccagtcacagaatactcaccggaacagacagaatatggttataaggcgccagaggacgaattacccacagaatcggatgatgatcttgtcaaggccatttgcaacgagttattacaactacaaacaaattttactttcaatttggtagaatttttgccaaaattcctgatcgccttgagagtcagagtactcaatgaagaaattaatgggttatccacaaccaaattaaatcgactcttcccacctacaatagatgaagtcacaagaatcaattgtatttttctagactcgctaaagacagcaatcccttacggttccctcgaagtactgaaggcatgcagcattactattccttatttctacaaagcatatacaagacacgaggcggccacaaagaacttcagcaaagatattaaattgtttattaggcatttcagcaatgtaattccagaaagagaggtctacacggaaatgaaaatcgagagtataattaagggacctcaggaaaaactactgaagctaaacttaattatagagagattgtggaagtcgaaaaaatggagaccgaaaaatcaagaaatggcaaaaaaatgctacaacaatatcattgatgtcattgattcgtttggaaaattagattccccacttcattcttatagtaccagagtatttactccatcgggaaaaatccttacagaattagccaaatgctggcccgtagaactgcaatacaaatggctgaagagaagggtagtcggtgtgtatgatgtagtggatttgaatgatgaaaataagagaaatttattagtcatattcagtgattatgtggttttcatcaatatactggaggcagaaagttactacacttcagatggatcaaacaggcccttaatctcagatattttaatgaactcattgatcaacgaagttccgttgccctccaagatccctaagttgaaagtggagcgtcattgctatatagatgaggttctagtttctatattagacaaaagcactctacgttttgatcgattgaagggaaaagattctttctcaatggtatgtaaattatcctctgcatttatctcttcttcgtcagttgctgacttgattacgaaggctagaattttggaaaaagacactgcatttcatttatttaaagctagtagaagccattttacattatattctactgctcacgagctttgcgcttatgattccgaaaaaataaaatcaaaatttgccttattcctgaacataccaccatccaaggagatattggaggtcaacaaccttcatttggctttttttgcaagattttgcagtaacgatggtagagataacatcgtaatcttagacgtcttaaccaaacatgacgataaacatatagaagttacatccgataacattgttttcaccataattaatcaattggccattgaaataccgatatgcttttcttccttaaactcatcgatggccaaagatttactctgtgtaaatgagaatttgataaaaaacttagaacatcaattggaagaggtcaagcacccttcaacagacgaacatagggctgttaatagcaaactttccggtgcatccgatttcgatgctactcacgagaagaaaagatcatacggtaccataacaacatttagaagctatacaagcgacttgaaggacagtccatcaggcgataatagtaatgtcaccaaggaaactaaggaaattttaccagtgaaacctacgaaaaagtcttcaaaaaaaccaagagaaattcaaaagaagaccaagacaaacgcctctaaagcagagcacatagaaaagaagaagcctaacaaaggcaaagggttttttggcgtgttaaaaaatgtttttggaagtaaaagcaagagcaagccttcaccagttcaaagagtgcctaaaaaaatatcgcagaggcatcctaagtctccagtgaagaagccaatgacctcagaaaagaaatcctcccctaaaagggcagtcgtttcatctcccaaaattaaaaagaaaagtacttctttttccacaaaagaatcacaaactgctaaatcttctcttcgagcagttgaattcaaatctgatgacttgatcggaaaaccacctgatgttggaaatggcgcacatcctcaagaaaataccagaatatcttcagtagtaagggatacaaaatatgtctcctacaatccctctcagcctgtgacagaaaataccagtaacgaaaaaaaatgtcgaaccaaaagcggatcaatccacaaagcaggataa

SEQ ID NO: 25204 - DNA, 969 bp, Saccharomyces cerevisiae
atggatcctctcagctcagtacagcctgcttcttatgttggttttgataccatcacgaatcagatcgaacatcgtctgttgaagaaaggttttcaatttaatataatggttgttggccaatccggattgggtaaaagtactctaataaatacgttatttgcctcacatttgattgattctgctactggtgatgatatttctgccctgcctgttacaaaaacaactgaaatgaaaatttctactcatactcttgtggaggaccgcgttcgcttgaatattaatgttatagatacacctggatttggtgactttattgacaattctaaagcttgggagcctattgtgaagtacattaaggaacaacattctcaatacttacgtaaagaattgacagcccaacgtgaaaggtttattactgatacaagagttcatgcaattctttatttcctgcaaccaaatggaaaggagttgagccgccttgacgttgaagccttgaaaagattgacagaaatagcaaatgttataccagttattggcaagtcggatacattgactttagatgaaagaacggagtttagggagcttattcaaaatgaattcgaaaaatacaatttcaagatttatccttatgattcggaagaactaactgacgaggaattagaactaaacagaagtgttagatctatcattccgtttgcagtggttggttctgagaatgagattgaaataaacggtgaaaccttcaggggaagaaaaactcgttggagcgctattaatgttgaggatatcaaccagtgtgattttgtatatttaagggaatttttgattcgaactcatctccaagacttaatcgaaacaacttcctacattcattatgaagggttcagagcaagacaattaattgccttgaaagaaaatgcgaatagtcgttcctcagctcatatgtctagcaacgccattcaacgttga

SEQ ID NO: 25205 - DNA, 1383 bp, Saccharomyces cerevisiae
atgacagttccttatctaaattcaaacagaaatgttgcatcatatttacaatcaaattcaagccaagaaaagactctaaaagagagatttagcgaaatctaccccatccatgctcaagatgtaaggcaattcgttaaagagcatggcaaaactaaaattagcgatgttctattagaacaggtatatggtggtatgagaggtattccagggagcgtatgggaaggttccgttttggacccagaagacggtattcgtttcagaggtcgtacgatcgccgacattcaaaaggacctgcccaaggcaaaaggaagctcacaaccactaccagaagctctcttttggttattgctaactggcgaggttccaactcaagcgcaagttgaaaacttatcagctgatctaatgtcaagatcggaactacctagtcatgtcgttcaacttttggataatttaccaaaggacttacacccaatggctcaattctctattgctgtaactgccttggaaagcgagtcaaagtttgctaaggcttatgctcaaggaatttccaagcaagattattggagttatacttttgaagattcactagacttgctgggtaaattgccagttattgcagctaaaatttatcgtaatgtattcaaagatggcaaaatgggtgaagtggacccaaatgccgattatgctaaaaatctggtcaacttgattggttctaaggatgaagatttcgtggacttgatgagactttatttaaccattcattcggatcacgaaggtggtaatgtatctgcacatacatcccatcttgtgggctcagcactatcatcaccttatctgtcccttgcatcaggtttgaacgggttggctggcccacttcatgggcgtgctaatcaagaagtactagaatggttatttgcacttaaagaagaggtaaatgatgactactctaaagatacgatcgaaaaatatttatgggatactctaaactcaggaagagtcattcccggttatggtcatgctgtgctaaggaaaactgatcctcgttatatggctcagcgtaagtttgccatggaccattttccagattatgaattattcaagttagtttcatcaatatacgaggtagcacctggcgtattgactgaacatggtaaaactaaaaatccatggccaaatgtagatgctcactctggtgtcttattacaatattatggactaaaagaatcttctttctataccgttttatttggcgtttcaagggcatttggtattcttgctcaattgatcactgatagggccatcggtgcttccattgaaaggccaaagtcctattctactgagaaatacaaggaattggtcaaaaacattgaaagcaaactatag

SEQ ID NO: 25206 - DNA, 798 bp, Saccharomyces cerevisiae
atgagttgggaaggttttaagaaagctatcaacagagctggtcacagtgtgataattaagaatgtcgacaagaccattgataaagagtatgacatggaagaacgtcgttataaagttcttcaaagagcaggtgaggcattacaaaaggaagccaaaggtttcttggactcattgagagctgtgacagcatcacagactaccattgccgaggtcatctctaacctctatgacgattcaaaatatgttgctggtggtggttacaacgttggtaactattatttgcaatgtgttcaagattttgatagcgaaactgttaagcaattagacgggcccttaagagaaaccgtactagatccaataacaaagttttcgacgtatttcaaagaaattgaggaggccataaaaaagagagaccataagaaacaagacttcgatgctgcgaaggcaaaagttcgtagattagtggacaaacctgctaaagatgcctctaaactgccaagggctgaaaaagaattgagcttagctaaagatattttcgaaaatcttaataaccaattgaaaactgaactaccacagttagtttcattaagagtaccttactttgacccaagttttgaagctttaatcaagattcagctaaggttctgtactgatggttacactcgtttagcgcagattcaacaatatttggaccaacaatcaagagacgactatgccaatgggttattagacactaaaatcgaagaactattaggacaaatgacaagcctagatatttgtgcgctcgggataaaataa

SEQ ID NO: 25207 - DNA, 3150 bp, Saccharomyces cerevisiae
atgggaagtcatcgacgttatctctactatagtatattatcatttctattattatcctgctcagtggtacttgcaaaacaagatgagaccccattctttgaaggtacttcttcgaaaaattcgcgtctaactgcacaagataagggcaatgatacgtgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttctattgtggcttaagtgattgtgcctttgaatacgacttggaacagaatacctcccattataagtgtaatgacgttcaatgcaaatgcgttcccgacactgtgttgtgtggtgctaaggggtctatagatatctcggatttcctgacagagacaataaaagggccaggagatttcagctgtgatttagaaacaaggcaatgtaaattcagtgagccttctatgaatgatttgatattgaccgtgtttggtgacccttatattactttgaagtgtgaatccggtgaatgtgttcattatagtgagattccaggttacaaatctccttcaaaagatccaacagtgtcatggcaagggaaattggtgttggcattgactgctgtgatggtcctggcactttttacatttgctaccttttacatttctaaatctccgttattcagaaatggattgggttcctcaaagtctcccattcgtttgccagatgaagatgcggtgaataatttcttacaaaatgaagatgacacactggcgacattaagttttgaaaatatcacttatagtgtcccctcgataaattcagatggtgttgaagaaactgtgctgaatgaaataagtggtatcgtgaagcccggccaaatattagctatcatgggtggatctggtgcgggtaaaactactttattagatatcctagcaatgaaacggaaaacaggtcacgtttcgggttccataaaagttaacggtattagtatggaccgtaaatctttctcgaaaataatcgggttcgtcgatcaagatgactttttgctgcccactttgactgtttttgaaaccgtattaaatagtgcgctgttaagattgccaaaagcattgtcattcgaggccaagaaggcaagagtttataaggtgttggaagaactaagaattattgatatcaaagatcgtattattggtaatgaatttgatcgtggtattagtggaggtgaaaaacgccgagtttccattgcatgtgaattagtgacatctccattggttttatttttggatgaacctacatctggtttagatgctagtaatgccaataatgttattgaatgtttggtaaggttatccagcgactataacaggacattggtgctatctattcatcagccaagatcaaatatattttatttattcgataaattggtcctgttaagtaaaggtgagatggtctattccggaaatgccaaaaaagtgtcagaatttttgagaaatgagggatatatctgtccggacaactataatattgctgattatttgattgatattacttttgaagccggtcctcaggggaaaaggagaagaatcagaaacatttccgatttagaagctggtacggatactaacgatattgataatacgatacaccaaacaacatttactagcagtgatggtacaacacagagagagtgggctcatcttgcagctcatagagatgagatcagatctttactcagagatgaagaagatgtagagggaacagatggaaggcgaggtgctactgagattgacttaaataccaaactactacacgataaatataaagatagcgtctattatgcagagctttcacaggagatcgaggaagttttaagcgaaggtgatgaggaaagtaacgttttgaatggagatttacccacaggtcaacaatctgctggttttctgcaacagttatcgatattgaattcaagaagttttaaaaacatgtacagaaaccctaaactattattgggtaattatttactgacgatcctattgagtttattcttgggaacactatattacaacgtctccaatgatatcagcggttttcagaacagaatggggctgttcttctttatactaacgtacttcggttttgttacattcacaggtctcagctcgttcgctctggaaaggatcattttcataaaagaaagatccaataactattactcgccacttgcatactacattagtaagataatgagcgaagtggtcccgctacgtgttgtaccacctatactcttgtcattgattgtttacccaatgactggtttaaacatgaaagacaatgctttttttaaatgtattggaatccttatactgtttaaccttgggatatcgttggaaatcctaaccatcggcataatttttgaagacttgaataactccataatattaagcgtgctggtgcttttgggctcactactgtttagcggactatttatcaatactaagaatattacaaacgtggccttcaagtacctgaaaaacttctctgtgttttactacgcctacgaatctttattgatcaatgaggtcaaaacattgatgctgaaagagagaaagtacggcttaaatattgaagttccaggcgctactatcttgagcacatttggatttgttgtccaaaaccttgtatttgacatcaagatcctggctctgtttaatgtggtgtttttaataatggggtatctagcccttaagtggatagttgtggaacaaaagtag

SEQ ID NO: 25208 - DNA, 1251 bp, Saccharomyces cerevisiae
atgtctttatcttcaaagttgtctgtccaagatttggacttgaaggacaagcgtgtcttcatcagagttgacttcaacgtcccattggacggtaagaagatcacttctaaccaaagaattgttgctgctttgccaaccatcaagtacgttttggaacaccacccaagatacgttgtcttggcttctcacttgggtagaccaaacggtgaaagaaacgaaaaatactctttggctccagttgctaaggaattgcaatcattgttgggtaaggatgtcaccttcttgaacgactgtgtgcgtccagaagttgaagccgctgtcaaggcttctgccccaggttccgttattttgttggaaaacttgcgttaccacatcgaagaagaaggttccagaaaggtcgatggtcaaaaggtcaaggcttccaaggaagatgttcaaaagttcagacacgaattgagctctttggctgatgtttacatcaacgatgccttcggtaccgctcacagagctcactcttctatggtcggtttcgacttgccacaacgtgctgccggtttcttgttggaaaaggaattgaagtacttcggtaaggctttggagaacccaaccagaccattcttggccatcttaggtggtgccaaggttgctgacaagattcaattgattgacaacttgttggacaaggtcgactctatcatcattggtggtggtatggctttcaccttcaagaaggttttggaaaacactgaaatcggtgactccatcttcgacaaggctggtgctgaaatcgttccaaagttgatggaaaaggccaaggccaagggtgtcgaagtcgtcttgccagtcgacttcatcattgctgatgctttctctgctgatgccaacaccaagactgtcactgacaaggaaggtattccagctggctggcaagggttggacaatggtccagaatctagaaagttgtttgctgctactgttgcaaaggctaagaccattgtctggaacggtccaccaggtgttttcgaattcgaaaagttcgctgctggtactaaggctttgttagacgaagttgtcaagagctctgctgctggtaacaccgtcatcattggtggtggtgacactgccactgtcgctaagaagtacggtgtcactgacaagatctcccatgtctctactggtggtggtgcttctttggaattattggaaggtaaggaattgccaggtgttgctttcttatccgaaaagaaataa

SEQ ID NO: 25209 - DNA, 999 bp, Saccharomyces cerevisiae
atgaacgatacgctatcaagctttttaaatcgtaacgaggctttagggcttaatccaccacatggcctggatatgcacattaccaagagaggttcggattggttatgggcagtgtttgcagtctttggctttatattgctatgctatgttgtgatgttcttcattgcggagaacaagggctccagattgactagatatgccttagctcctgcatttttgatcactttctttgaattttttgctttcttcacttatgcttctgatttaggttggactggtgttcaagctgaatttaaccacgtcaaggttagcaagtctatcacaggtgaagttcccggtattagacaaatcttttactcgaaatatattgcctggttcttgtcctggccatgccttttatttttaatcgagttagccgctagtactactggtgagaatgacgacatttccgccttggatatggtacattcgctgttaattcaaatcgtgggtaccttattctgggttgtttcgctattagttggttcattgatcaagtccacctacaagtggggttattacaccattggtgctgtcgctatgttggttacccaaggtgtgatatgccaacgtcaattcttcaatttgaaaactagagggttcaatgcacttatgctgtgtacctgcatggtaatcgtttggttgtactttatctgttggggtctaagtgatggtggtaaccgtattcaaccagacggtgaggctatcttttatggtgttttggatttatgtgtatttgccatttatccatgttacttgctaattgcagtcagccgtgatggcaaattgccaaggctatctttgacaggaggattctctcatcaccatgctacggacgatgtggaagatgcggctcctgaaacaaaagaagctgttccagagagcccaagagcatctggagagactgcaatccacgaacccgaacctgaagcagagcaagctgtcgaagatactgcttag

SEQ ID NO: 25210 - DNA, 630 bp, Saccharomyces cerevisiae
atggaatacgccactatgtcttcttcgaactccacacataactttcagagaaagattgctcttataggagctagaaatgtcggcaaaaccacattaacggttcgcttcgtagaatcgcggttcgttgaatcctattatcccactattgaaaatgaatttaccaggataattccttataaaagtcatgactgtactctggaaattctagatactgcaggccaagatgaagtttctctattaaacattaaatcgttgacgggcgtacgaggcataatgctgtgctatagtataataaatcgtgctagctttgatcttattcccattctctgggacaagctggtagatcagctgggtaaggataacctcccggtaatacttgtgggtaccaaagctgatttgggaaggagtacaaaaggtgtaaaaaggtgtgtcacgaaagctgaaggagagaaactagcttcgacaattggcagtcaagataagaggaaccaggcagcatttatagaatgcagtgccgagttagattataatgttgaagaaacttttatgctccttttgaaacaaatggaacgtgtcgaaggaactctggggcttgatgccgaaaataataataaatgttctataatgtga

SEQ ID NO: 25211 - DNA, 1539 bp, Saccharomyces cerevisiae
atgatgaaggaatcgaaatctatcactcaacatgaggttgagagagaatctgtttcttccaaacgtgccattaaaaagagattacttctgtttaaaatagacttgtttgtgctatcatttgtttgcttgcaatactggattaattatgtcgaccgtgtcggtttcaccaatgcatatatatcgggtatgaaggaagatcttaagatggtcggaaacgatttgaccgtgtctaacacagttttcatgattggttacattgtaggtatggtccccaataatttaatgttattgtgtgttccacctaggatatggctaagtttttgtacgtttgcctggggtttattgaccttgggaatgtacaaagttacatcgttcaaacatatttgcgcaattagattctttcaagccttatttgagagttgcacattttcaggaacacattttgttttgggttcgtggtataaagaagacgaattgcccattagaagtgctatttttacaggtagcggtttggtgggatctatgttcagtggatttatgcaaacaagtatctttactcatttgaatgggcggaatggcttggcgggttggagatggttattcattattgatttttgtatcacattacccattgcaatttatgggtttattttcttccccggccttcctgatcaaacaagtgctgttagcaaattttctatgacgagatacatttttaatgaacaagagctacattatgctaggagaaggctccccgctagggacgaaagcacccggttagactggtcgactattcctagagtcctaaaaaggtggcactggtggatgttctctcttgtttgggttctgggaggtgagaatttgggtttcgcatctaattctacatttgcattatggttacaaaaccaaaaatatacgttggcgcaaagaaataattatccttcggggatatttgccgtaggtatagtttctacgctttgttctgctgtatatatgagtaagatcccaagagctaggcattggcatgtttctgttttcatatcattggtaatggttattgttgcggtactaatacgtgcagacccactaaatccaaaagtcgtcttttctgcacagtatcttggaggcgtagcatacgctggacaagcggtttttttttcgtgggcaaacattatttgtcatgcagatcttcaagaacgtgctatcgttcttgcttcaatgaatatgttttcaggggccgttaacgcatggtggtctatattattctttgcttcagatatggtgcccaagtttgagagaggttgctacgccctcttggctacggcaatatcaagcggaattgtctcggtcgtcatacgctcactacagataaaagagaatttgtctaagaaacaggttccttatatagatgctaatgacatgcccggggaagatgacgatgacgacaaccaggataatgaaaatgatggcgacgacgagagtatggaagttgaacttcataatgaggaaatggccgaaatttcaaatcctttccgataa

SEQ ID NO: 25212 - DNA, 1044 bp, Saccharomyces cerevisiae
atgaattcactcgttactcaatatgctgctccgttgttcgagcgttatccccaacttcatgactatttaccaactttggagcgaccattttttaatatttcgttgtgggaacatttcgatgatgtcgtcactcgtgtaactaacggtagatttgttccaagcgaattccaattcattgcaggtgaattaccattaagcactttgccccctgtgctatacgccatcactgcctattacgttattatttttggtggcaggtttttgttaagtaagtcgaaaccatttaaattaaatggccttttccaattgcataatttggttttaacttcactttcattgacgcttttattgcttatggttgaacaattagtgccaattattgttcagcacgggttatacttcgctatctgtaatattggtgcttggactcaaccgctcgttacattatattacatgaattacattgtcaagtttattgaatttatagacacctttttcttggtgctaaaacataaaaaattgacatttttgcatacttatcaccatggcgctactgccttattatgttacacccaattgatgggcaccacatctatttcttgggtccctatttcattgaaccttggtgttcacgtggttatgtattggtactatttcttggctgccagaggcatcagggtctggtggaaggaatgggttaccagatttcaaattatccaatttgttttggatatcggtttcatatattttgctgtctaccaaaaagcagttcacttgtatttcccaattttgccacattgtggtgactgtgtgggttcaacaactgccacctttgcaggttgtgccattatttcttcatatttggtactatttatttcattttacattaacgtttataaacgtaaaggcaccaaaaccagtagagtggtaaagcgtgcccacggcggtgttgccgcaaaggttaatgagtatgttaacgttgacttgaaaaacgttcctactccatctccatcaccaaaacctcaacacagaagaaaaaggtaa

SEQ ID NO: 25213 - DNA, 1002 bp, Saccharomyces cerevisiae
atgggtattacagtaataggttctctaaactatgatttggacacatttacggatagattacctaacgctggagaaactttcagggctaaccacttcgaaacacatgctggtggtaagggattgaaccaagctgcggccattggtaaattaaaaaaccccagcagcagatatagtgttcgaatgattggtaatgttggaaatgatacatttggtaaacaattgaaggacactttatccgattgcggagtcgatatcactcacgtcggtacttacgaaggcattaatacgggtaccgctaccatattaattgaagagaaagctggtggccaaaataggatattgattgtagaaggtgctaacagcaagactatttatgacccgaaacagttgtgtgaaatttttccagagggcaaggaggaagaagagtatgttgtttttcaacacgaaattcctgatcctctttccattattaaatggatacatgcgaacaggccgaattttcagatcgtatataacccctcacctttcaagaccatgcctaagaaagattgggagttggtagaccttttggtcgttaatgaaattgagggtcttcaaatcgtggaaagtgtatttgataatgaacttgttgaagaaataagggagaagataaaggacgactttttaggagaatatcgtaaaatttgtgagcttttgtatgaaaaactcatgaatcgaaagaaaagaggaattgtggttatgactttgggttcgagaggggtgcttttctgttcgcacgaaagccctgaagtacaattccttccggctattcaaaatgtttcggttgttgatactacaggagctggagatactttcctgggcggtttggttactcaattgtatcaaggagagaccttgtctatggctataaagttctctacattagctagttcattgaccattcaaagaaaaggtgctgctgaaagcatgccactgtataaagatgttcagaaagatgcataa

SEQ ID NO: 25214 - DNA, 1617 bp, Saccharomyces cerevisiae
atgagaacggccgtaccgcagttgctggaagcaactgcctgtgtctctagagaatgccccctcgtcaaaagaagtcaggacataaaaagagcaagaaaacgtctactcagtgactggtataggctcggcgctgatgcaaacatggatgccgtattattagttgttaactccgcctggaggtttctggccgtctggcgacccttcgtaaactcaatccaacatgcaactcaggaattgtatcaaaatatcgcccattaccttcttcatggcaacgtaaatatacagagggtcacagcactaatacagctcgtaatgggacaggacgatttactttttagtatggatgatgttctacaagaggtcttcagaatacagctctatttgaataagatgctgccgcacaactctcacaaatggcaaaagccatccccctttgactccgcaaacttactacttaacttcagagactggacaactgacaatgctctcctccaagagttgctactatcctatcccacaattaataaaaacaaacacaaaaatcactccgtccctcgtctaatacaaatctgggtagagtcttattggcaagatagtgagacaacattaaaagatatcctcaatttttggtacagtcacttggctgaatattatgaataccaagaactgtttgcagacatagttcagctgtttataaacaaaaaaagaacgaggcaattgaagattcattacattggtctaactgataaggaaatcgaagaaaataaaccgcccctggactacgaaaacttatttctccaatacgagatagacaaaacgaacgcaaatgatgaattgtgcggtgcaactgacctcagtgatttacttttccaatggaaacagggtgaacctctagaagtcgaagccttcgctctaaacgtatctccatggtcacttgcaaagacattgactctcttagaatcttctctttacttggatattgaaacaatagaattcacaagacatttcaaacacaacgatacaacaattgactccgtgtttacgctttccaaccagttatcgtcctacgttcttgagacaactttgcagcaaacgcacaccatttcctactggttacaagttgcacttgcttgtctatacttacgaaacttaaactcacttgcttcaatcattacatcattgcaaaatcattcaatagaaagactatctctcccgatagatgttaaatcagaccacctttttcagcgcctaaaagtcgtcgtacatccaaacaacaactacaacgtttatagaagaacaattaaacatattttccacagtcagcttccttgtgtaccttttacatcactgcttatcagggacattaccttcataagagacggaaacgatacattcactaaagatggtaataacgtgaatatgcaaaagttcaaccaaatcacaaagatagtcgcttttgcgcaatatttacaacaaaagcaatatgaagatatacactgttcaaatactactgcaagaagcttattaggggctatgataaaggtgcacactttatataacgacaacaaagacagggcgtatcaagtcagtatagctaaggttccaaggcttacctaa

SEQ ID NO: 25215 - DNA, 4224 bp, Saccharomyces cerevisiae
atgatgtccttttccaaaaacgccactcctagagccattgttagtgaatctagcactttgcatgagatgaagtttagaaattttagagttgcccatgaaaaaatctcgttggatatagatctagctactcactgcattaccggtagcgctactataataatcattccgttgatccaaaacctagaatatgtaacttttgattgcaaggaaatgactattaaagatgttctggtcgaaaatcgtcgatgtgatcaatttattcatgacgacccacttcaaacaaatttgaatggattgacttcacaaaatgtattatacagcgacaattccattgaacagtcacattttttgagatctaagtttgctagcttgaatgaatacccagaaacggactctaaatcccagttaactataaaaataccatcttccatcaaaatatctttggaggacgccaatgcattaagtaattacactccgattactccttcaattaagactacccctgggtttcaagaatctgttttcactccaattacattacaaattgaatatgaaatcagaaacccaaagtcgggtattaaattcgatactgtgtatgctgacaagccctggttatggaacgtttacacttcaaatggtgagatttgcagttctgcatcatattgggtcccatgtgtcgatttgcttgatgaaaaatctacatgggagttagaattcagcgtaccgagattggttaaaaatataggtacttcgaaattaatcggacaaaatggagaagagagtgaaaaagagaaggaggatacgcctgagcacgatgaagaggaagaggggaagccggcaagagttatcaaagacgaagataaggattctaacttgaaaaatgacgaagaaggcaaaaatagtaaaagcaaagatgcacaagataatgatgaagaagaagaggaaggcgaaagtgacgaagaggaagaggaaggggaagaggaaaggcggaatattgaggaaagcaacaatccgagtttgagggatgtgattgtgtgttgttcagaatattcaaatattaaagaacttccgcacccgattgatttgacgaaaaaaaaatgcatatttcagataattaatcctgtggctccacatcacattggttgggctataggcgcctttaattcatggtctttacctttgatatcacctccaagtgttgatgccgaggacgaagtagaggaagacaagttgagagagaatgttgtggacaatgttaacgatactatggatgacgacattggttcggatattatacccattcaaattttcacacttccgacgcaggaaacagatgagttaacagttataaattcgacagttgtctgccaaaaaattatagatttctactcgaaagaatttgggtcttatcctttcacttgttactctatggtgtttttacctaccgcaccttctaagcatatggattttgcagcattaggcatttgtaataccagattattgtaccctctagaagttattgataaagcattcagtactacgaatgagttagcatgggcacttgctaaccaatggtcttgtgtgaatataactcctttagatatgaacgactactggtgctgtcttggtattgctggttatatggtgtttcaggtaaccaaaaaattaatgggtaataacacgtataaatatcaattaaagcgtaatagtgaggcgattgtggaacaagacttcgagaaaccgcctattgggagcacttttaccggcagttctaggccaatatcttggtcttctaaagatttgtcctttatacaattgaaggcaccgatgatactacacatacttgacagaaggatgactaaaacagaacgatctttcggtatgtctcgagtattacctaaaattttccttcaagctatgtctggtgatttaccgaataattcgttgacttcatcgcattttcaacatgtttgcgaaagagttaataaaagtaaattagagaattttttcaacgaatgggtatatgggtctggggtacccatattacgtgtcacccaaagatttaataggaagaggatggttatagaactgggtataaggcaagttcaagatgaagaacttggccacgaaaaagtggtaggggaggaaggatttttcaaaagtgcactagaccacttagaacatccagatttgaaccgaaccgaatgcttcacgggctcgatgactataaggatccatgaacacgatggtactccgtatgagcatattgtggaaatcaaagatacattcacaaaaatagatattcagtacaatacaaagtacagaagattaaggaaaagaggtggtggtgcaaatgatgaaaatggtgttgaaaacaataatgaggagaagcctattgttgtggatgtgaattgtctaggaaatgtatacatgtcgcccgaagagtgttcccgattcagtttgacggaatttaatcgtacgtctgagagtaatgaattgcttaagcaaaacgaagcatttgagtggatacgcatagactctgatctggaatggatttgccaaatgcacattaatcagccggattacatgttttcttctcagttgagacaagatggggacatagaggcccaactagaagccatacgatattatgaggacgtcgttgttaatggtggtgtgaaatcacttgtttattcaagtattttgtttagaacggcgatcgacgagcgttacttttttggcataagactcgcggcgtgcgaagcgcttagtaaatacgtatatgatccggattttactggcggtgttaagcatttaattcagatttttcagattttgttttgcctagaagactctaatattccaaagagtaataactttgagaatcctaagttgtatttcttacagtgtaatattcccaaatatttggctaaagtgaaaaatgaaaatggtaaatgtccaaaattggtgaagcaatttttactggatattcttgtttataatgagaatggtgaaaataaatacagtgatgatgcgtacgtccgcagcttgattgaaaatgttgttaaagttgctttaaatgagtataaagataaagcatatatggaaaaagttaagactcagttattgaggtacgaaaatttggtgaattggctttcatcatacgagtctttgattaagactactatcatgtatgctaagtacaaattgcataaagtgggtgcttatgactttacggaattgacaggaatgataatgcatacattaacattaggtataaataacggagatatttccagggaaagctttcagaatgagtttttaatggttttgaaaatcatgcttttagaaggtggtttaaaaaacaaggatgcccttgttttgtttactgaaatactttgcttccatgaggattcttatattagggataaaagtgttgatgtgctttctgaatgtgtaaatctagttgttatggatggtagtttggataccataagtgacgatattaagtcctccgtccaatctgtgcacaatgaagttaaaaatataaaaagtgaggatgatattgagttgtttttaagtggtcattacgtcgatgatatgaaaataaaaatagaaaagattggccgtcaaaatattagtgggttaatacaaatatgccgagatatgtttaaagggtatagccctttgaagatattactctgggatgttttgaatttacctgttcttagcttgtaccagaggaagcaaatacatgatcttgttagggtgatgtacaccctaatcaacagttttgtagttagattggaaacaccaagggagagaagacttgtggcgaagatgaatagtaatgaagaaggtaaacttgatattgttataaagcgtgaaagtatcctaaaagtacatattaaaaaggaagtaacctctactgtggaggcacccaagaaggcgaataagataaagataagtttgaaaggtgataaacctgttagaaaagtggaaaaacaaattgtgaagccgaaggtaactagcaaacaaaggaaagtcaaaagtcatgtgaaccgcatgggcagtttacctttacggtttgttaagatccaacaacaacctagagtaatggtgcatttgtcatccgtcccgtatagccaattcgttcaaattacaaaagtcacatcaagatcgtttatggttaagataagaacaaagaatgatgctaagaattga

SEQ ID NO: 25216 - DNA, 1833 bp, Saccharomyces cerevisiae
atgacggagactaaggatttgttgcaagacgaagagtttcttaagatccgcagactcaattccgcagaagccaacaaacggcattcggtcacgtacgataacgtgatcctgccacaggagtccatggaggtttcgccacggtcgtctaccacgtcgctggtggagccagtggagtcgactgaaggagtggagtcgactgaggcggaacgtgtggcagggaagcaggagcaggaggaggagtaccctgtggacgcccacatgcaaaagtacctttcacacctgaagagcaagtctcggtcgaggttccaccgaaaggatgctagcaagtatgtgtcgttttttggggacgtgagttttgatcctcgccccacgctcctggacagcgccatcaacgtgcccttccagacgactttcaaaggtccggtgctggagaaacagctcaaaaatttacagttgacaaagaccaagaccaaggccacggtgaagactacggtgaagactacggagaaaacggacaaggcagatgcccccccaggagaaaaactggagtcgaacttttcagggatctacgtgttcgcatggatgttcttgggctggatagccatcaggtgctgcacagattactatgcgtcgtacggcagtgcatggaataagctggaaatcgtgcagtacatgacaacggacttgttcacgatcgcaatgttggacttggcaatgttcctgtgcactttcttcgtggttttcgtgcactggctggtgaaaaagcggatcatcaactggaagtggactgggttcgttgcagtgagcatcttcgagttggctttcatccccgtgacgttccccatttacgtctactactttgatttcaactgggtcacgagaatcttcctgttcctgcactccgtggtgtttgttatgaagagccactcgtttgccttttacaacgggtatctttgggacataaagcaggaactcgagtactcttccaaacagttgcaaaaatacaaggaatctttgtccccagagacccgcgagattctgcaaaaaagttgcgacttttgccttttcgaattgaactaccagaccaaggataacgacttccccaacaacatcagttgcagcaatttcttcatgttctgtttgttccccgtcctcgtgtaccagatcaactacccaagaacgtcgcgcatcagatggaggtatgtgttggagaaggtgtgcgccatcattggcaccatcttcctcatgatggtcacggcacagttcttcatgcacccggtggccatgcgctgtatccagttccacaacacgcccaccttcggcggctggatccccgccacgcaagagtggttccacctgctcttcgacatgattccgggcttcactgttctgtacatgctcacgttttacatgatatgggacgctttattgaattgcgtggcggagttgaccaggtttgcggacagatatttctacggcgactggtggaattgcgtttcgtttgaagagtttagcagaatctggaacgtccccgttcacaaatttttactaagacacgtgtaccacagctccatgggcgcattgcatttgagcaagagccaagctacattatttacttttttcttgagtgccgtgttccacgaaatggccatgttcgccattttcagaagggttagaggatatctgttcatgttccaactgtcgcagtttgtgtggactgctttgagcaacaccaagtttctacgggcaagaccgcagttgtccaacgttgtcttttcgtttggtgtctgttcagggcccagtatcattatgacgttgtacctgaccttatga

SEQ ID NO: 25217 - DNA, 1320 bp, Saccharomyces cerevisiae
atggtccgtagattcagaggaaaagaacttgcggcgacaacatttaatgggcacagagactacgttatgggtgcgttcttcagtcatgatcaggaaaaaatctacactgtaagcaaagacggtgctgtctttgtctgggaatttaccaagaggccatccgatgacgacgacaatgaaagtgaagacgacgacaagcaagaagaagtagatatttcgaaatacagctggagaatcacaaagaaacattttttttacgcaaaccaagccaaagtaaagtgtgtcaccttccatccagcaacaaggcttttagctgtcggatttactagtggggaattccgtctttacgatttgcctgatttcactttgattcaacagctttctatggggcaaaacccagtcaacaccgttagcgtcaaccaaaccggcgaatggctggcgtttggttccagcaaactgggccaattactagtttacgaatggcaatcggaatcgtatatcttgaagcagcagggccatttcgattccacaaatagtcttgcatactctccggatggttcacgtgtagtgacagcatccgaagatgggaaaatcaaagtttgggacattacatcagggttttgtttggccacttttgaagaacacacctcttcagttactgctgtacagtttgcgaaaaggggtcaggtcatgttctcatcatcgttagatggtacggtgagagcgtgggacttaatcaggtatcgtaattttagaacattcactggtactgaaagaatccaattcaattgtttagcggtggatccatcaggtgaagtggtttgtgccgggtccctggacaattttgacattcatgtttggtccgtgcaaactggtcaattattagatgctttgtccggacatgaaggccctgtttcgtgtctttcatttagtcaagagaacagtgtcttagcttctgcatcatgggataaaacaattagaatctggtccatatttggtagaagccaacaagtagaacctatagaagtttattccgatgttttagccttatcaatgagaccagatggtaaagaagttgcagtatctaccttaaagggtcaaatatccattttcaacatagaagatgccaagcaggtgggcaacattgactgtagaaaggatataatatctggtaggtttaatcaagataggttcactgccaaaattctgaacgatccaaattttttactacaatacattacagttttgatggtatggctattgtggctggtggtaataataactccatttgtctatatgatgttccaaatgaagtcttgttaa

SEQ ID NO: 25218 - DNA, 1548 bp, Saccharomyces cerevisiae
atgtccaccctgattcctccaccttctaagaaacaaaagaaagaggctcaacttcccagagaagtagctattattccgaaagatttacccaatgtttcaatcaagttccaagctttagatactggtgacaatgtaggtggcgccctgagagttcccggtgctatctccgagaaacagttagaagaacttttaaatcaattgaacggtacttcagacgatccagtgccatataccttcagctgtacaattcaaggtaagaaggccagtgaccctgtgaagacgattgatataacagataacctatattcttcattaataaaaccaggctataacagtacagaagatcagatcacgctactgtatacgccaagagcagttttcaaagtcaagccggtaactagaagttcatcagccattgcaggtcacggttccacaattttgtgttctgccttcgcaccacatacgagttctaggatggtaaccggtgcaggtgataatactgcaaggatttgggactgtgacacccaaacgccaatgcatactctaaagggtcactacaattgggttctctgcgtttcctggtcccccgatggagaagtaattgctacgggatccatggacaataccataagattatgggacccaaaaagcggtcagtgtctaggtgatgctctcagaggtcattccaagtggatcacttctttaagttgggaacctatacatcttgtgaagccgggctccaaaccaagattagcttcatcttctaaggatggtactattaagatttgggacactgtgagcagagtttgccagtatacgatgagtggtcacacaaattcagtgtcttgtgtcaaatggggcggccaaggtctattgtatagtggctctcacgatagaaccgtacgtgtatgggacatcaattcgcagggcagatgtatcaacattttgaagtcgcatgcgcactgggttaatcacttatctttatctacagattacgcattgcgcattggtgcattcgatcatacaggtaagaagccttctacaccagaagaagcccagaaaaaggcattggaaaattatgaaaaaatctgtaaaaagaatggaaattcagaagaaatgatggttactgcaagcgatgattataccatgtttttatggaacccactaaaatctaccaagcctatagcaagaatgaccggtcaccaaaaattagtcaatcatgtggcgttcagccctgatggtaggtatattgtctcagcgtcttttgataactctatcaaactttgggacggtagagatggtaagtttatctccacatttagagggcatatagccagcgtataccaggttgcgtggtcatcggactgccgactactggtgtcatgttccaaagataccacgttgaaagtgtgggatgtaagaactagaaaactttctgttgacctccctggtcataaagacgaagtttataccgtcgactggagtgtcgacggtaaaagagtgtgtagtggtgggaaagacaagatggtaagattgtggacgcattga

SEQ ID NO: 25219 - DNA, 3945 bp, Saccharomyces cerevisiae
atgatgatggatatactgaatacacagcaacaaaaagcggctgaaggcgggagagttctggctcctcataccatctcaagtaagctcgtgaagagattatcaagtcattccagccataaactatcaagatctgatttgaaagcattgggtggctcggaaacaataagcgacggccccagtcagctgacttttaaggaccgatacgttttcaatgaatcgctatacttgaaaaagctaaaaaagaccgctttagatgactactacacgaggggcataaaactcactaaccgctacgaggaagacgacggtgatgacgaaattattcggttgtctaatggcgacagaattgatgaagacctgcactcaggtgtcaagtttttctccactacaccttattgcaggaaaatgaggtcagacagtgatgaactagcttggaatgaaattgcgaccgaacggttcaaatggcagtcaatgctggccagagtgctgaagggagatattgttaaaggtgaaaagacgaggattgctaaccaagtcaagaaaccagggttaaataaggagctctcagatgagatatggctcgaattgaaggcatggctgaatgggaggaccatgcaagagatggaacagtcgcttacatatttaagagatagttcagattccgtttttgaagagataatgaagtttcaaattccacagggcaagatattgagcctggatgcactggaggccatcttacaagacctcatgaacagatatcacagcgttgtctcttattggcctaacttgaaaaaaatgtataaggataaaccaatcaccaatactgcagaatttaccgctagaatagacgtaatgaattcttggctgaactttaaaacgaacttaacgttgaggaggcaagagttggacgactggataaaccgtttctcaccgataagtagttcggataattgccaagaggattttgatggtgtgccccaatggaactgcaaaatgaagattcttgcagaacaattgatgaaggaaaagaacatcgagtctatattccaaaaaaaaattttctatccgctatcaccttggatgttcaaactgaaactacattttatagtctacagagaaactttgacaaagatgaacataaaatatccttatgaaaggttaagatcactactggcgttccccgtctatttaatcaaagaagttattttgactagattgtcatatgcacgaaagcttaaaaatccaacaatgatgatgatcgatcaaatgatcgatgattttaacgcttttattcgactttctgtgcaattgaagtacacactgacaaaatattgctccaatttgccgttcgatgtggattttgacccgacgttcgaaaatactgtaatagaagccattcgttatttattttttctgttgaatttaaagttgattgattccagtaaacaaaatttcaaagcacccgatctactcttgaaatactgggatcacctaaaaaacaccggtcactatattaacggtgcagaaaccgtgattccaaatgaatttctcaagttaactttgagactcgtacataaattgcaattctatcttttgaaacaacaaaacttcccaccaacatttgctaacgcttcagaagcagaaaaatggctaagttccattttcgaaaatttgggtgccatgaaaagaaagctgaacaggttcagcaatattctagtcaaggcgttccaaaattctgctgtttatcagattaatcataatgcacaacttgttaaaaagttaaaagatgctcactattttttggtatactccggtaacacttttgagtctagtggtgtatatatgtttgctgctcctgaattattaggttgtgacaatgataccatcttaagaattttgcgaaataaatccattggctgtgatttggtcccaaagcttgacattggaaataatttgaatgtgtatgatataacaacaaaagaaacagatttgaacattctagtatcgaaaggggaggattccaaaggaattccttactaccgagtagtagcaaattcgtcaagtgatttggacaggcatgctcatcagtccaaaaagaagaatttttcaacagacccttttgatcagcaccttgatgaaaagaacaatgaagtttttgaattggaagttgctttgagctcattgggtgcactagttgtactatatcctggagagccagtagtttgggatggaccagtatataagcttccaggtaacaacctttttgcatccaacgaaatggatttagggaaaattggtaacccaaatacgttgattttactcaatcaaggttctaattatgcactgacttatcaaatcgacaagtttaatcaaacggtaggtgattctgtttcattcatagagaaacgttgttcactcaattcaattgaatcctccctacaaaaaatcaataaggcatattacaaacttacttatacagtattgaacaactacaaaggaattctaggtagctttatgaagcaatgtccgggaaatgagttgttaaattcgatattcatgtttggaagggattttggaagaagtttccttaaatataacgcctttagctcaaagaggaagtacgttatcatctttctgatggttaaattaggaatgaactggttgaaattccttgttgaagagtgtgatcctaccgatcagcgaactttccgatggtgcgttcttgcaatggattttgcgatgcagatgactagtggttataatatcctggcgctgaatgtaaagcaatttcaagaactgaaggagagggtatcagtatgtatgtcattattaatttcacatttcgacgttatgggtgcacgagccactgaagctgaaaatggcatgcaacaggcaagattgaatattgatactgaagagaatattgatgaagaggccaccctagaaataaacagcaggttgagactggaagctataaagacgttggaaaagactatgaagaggaatcccaggcaaatgggtaaggtattggatgctacagatcagggaaacaaatacctactatcgctagcatcctcattatcgaatgtatcaatgaggtggcaaaaaagaagcttcattggcggtggaacatttggacaggtatactctgcaattaatctggaaaacggtgaaatcttagctgttaaggaaataaagatacacgataccacaacaatgaagaagatttttcccctgattaaagaagagatgaccgtattggaaatgttaaaccatcctaatattgtccagtactatggtgtcgaagtacatcgcgataaagttaacatcttcatggaatactgtgagggtggttctttagcctcgttattggatcatggaagaattgaagatgaaatggtaacacaagtgtacacattcgaactattagaaggtttggcatatttgcaccaatctggcgtggtgcatcgcgacattaaaccggagaatatcttgctggatttcaatggaatcataaaatatgtggattttggtacggcacgtaccgttgtaggatctaggactagaactgtgcggaacgcagccgttcaagattttggagtagaaacaaagtccctcaatgaaatgatggggacaccgatgtatatggctccagagactatttcaggctcggcagttaagggaaaacttggagcggacgatgtatgggcattaggatgtgttgtgctagaaatggccacaggtagacgaccttggtctaacttggataatgaatgggccatcatgtaccacgttgctgcaggtcgaataccgcaactacccaatagagacgaaatgactgcagcgggaagagcccttcttggaaaggtgtttggttcaagaccccactatgagggctactgctgtggaactactgatagacccttggatgatacaaatccgtga

SEQ ID NO: 25220 - DNA, 3681 bp, Saccharomyces cerevisiae
atgcacctgctaaaggactggacggatacctttgtatacatcctggaaaagctcatctttgatatgacaaatcactataacgattctcaacaactgcgtacgtggaagaggcagatttcttattttttaaaacttttggggaattgctactcactaagattgatcaataaggaaatctttcatcattggcttgtagagtttataaataagatggaaaacttcgaatttttgccattatctttacatattttgatgattttttggaacgacatctgccaaattgatacaaatgctcctgttgcggctacaataacatcaagtcaaaaagagcccttctttctggtaacaaaaatcactgatatgctattgcacaaatattatattgtttccagcagcaaatcaatgataaatgacgagaactacatcatcaatgatataaagaaaaacaacaagataaagttgaatattctcaaaatattatccagtttaattttgaaaatttttcaagaacaatctttagaggtgtttatatttcccacatctaactgggaaatttacaagcccttactttttgaaatagtctcaaacgccgacactaatcaaaattctgatatgaagaaaaaattagagttaattagttacagaaacgagtcattgaagaataattcttctatacgaaacgtaataatgtctgccagcaacgcaaatgactttcaattaactatcgtcacctgtaaacaatttccaaaactatcatgcattcaattaaattgtatagatactcagttcaccaagctactggacgataaccctacagaattcgattggcccacttacgttgaccaaaatccccttacaatgcataaaattattcaattaattctctggtccatacatccatcaaggcaatttgatcactatgaatctaatcaactggtagcgaaattattactattgcgaataaattcaacagatgaggatttgcacgaattccagatagaagatgccatttggtcattggttttccaattagccaaaaatttttcggcccaaaagagggtggtatcatatatgatgccttctttgtatcgcctgcttaatatactaattacttatggcatcattaaggtccctacgtatatcagaaagctaatcagttccggcctactttatctccaagattccaatgataagtttgtgcatgtccagctgttaattaacttgaaaatttcaccgttgatgaaaagtcaatacaatatggtattgaggaacgttatggaatatgacgttaaattttatgaaatttttaatttcgaccaactcgtggaaatcacagaacaaatcaaaatgcgaatactctccaatgatataactaatttgcaactgtcgaaaactcctctgagcattaaaatcatggttgcagaatggtacttatcacatttatgttccggtattttatctagtgttaaccgcacagtgttgctaaaaatattcaagattttttgtatcgatctggaggttttccaccacttttttaagtggatcgagtttattgtctaccatcaattgctaagtgatatagaatctctggaggcattgatggacatcttgctatgctaccaaaaattgttctcacaattcattaatgaccatattctttttacgaagacgttcatattcatttacaagaaagttttgaaagaaaaagacgtgcctgcttataatgtgacttcatttatgccattctggaaattttttatgaaaaacttcccttttgttttaaaggtggataacgatttaaggattgagttacaatctgtttacaatgatgagaaattgaaaactgagaagctgaagaatgataaatcagaagtcttgaaggtgtattccatgatcaataattcaaaccaagctgttggacagacttggaattttcccgaggtgtttcaagtaaacatcaggtttctactacacaactccgagatcattgatacaaatacaagcaaacagttccagaaagcacgaaacaatgtcatgcttttgattgccactaacttgaaggagtacaataaatttatgtccattttcttgaaaaggaaagactttactaacaaaaatttaattcaattgatctctctaaaacttctaacttttgaagtgacgcagaatgtgttggggctcgagtatattattcgattattaccaataaacttggaaaataatgacggctcatatggtctgtttttgaagtatcataaagaacaattcataaagtcaaattttgagaaaattttacttacatgttatgaattagaaaaaaaatatcatggcaacgaatgtgaaataaattattatgagatcctattgaaaattttaataacttatgggtcatctcccaaattacttgcaacatctacaaaaatcattatgttgttattgaatgatagcgtggaaaactcatctaatattttggaggatattttgtactactcaacttgtccgtcggaaaccgatcttaacgatattccattgggtagtggacaaccagacaatgacactgttgtaaccaacgatgataaaagtgacgatgatgatcacacagtcgacgaaattgatcatgtagaatattacgttatgatggactttgccaatctttgggttttccaagcgtttacctgtttctgcatcaaaaaaatcatggagaataatgagccagcaatggcaatggaagacttgaagaacttcatattccaaattatcgaaataactaattctaatgatttatgttcacaaatatttgaccaactgaaggatatgcagaccattgagatgataacccaaatagtggagaaagatttctgcacttcttgtttgcaaaacaacaaccaaaagatagatgataattacatcgttgtggtgatcgagattataacgtcattatcgatgaggtttcaaagagaaacttctggtatgatagttatttccatggagaactatcatttactaataaagatcataagacaattaagtgaactgaacgaaggaaatttatctaagagagaaatccaaatagatgccgtcttgaaaatttttagctttcatcaggattccattttccaacgcatcatcgctgatttatcagctgataaacccacaagtccattcattgatagcatatgcaagctgtttgataaaatatcatttaatttaagattgaagctgttcttgtacgaaattttgtcttcattgaaatcattcgccatctattcatccacaattgatgccccagcattccacacaagcggtaaggtcgaactaccgaagaaattgctgaacttaccaccattccaagtgtcctctttcgttaaggaaacaaaacttcatagtggcgactacggggaagaagaagatgcagaccaagaagaatcgtttagtttaaatttaggaatcggcatagttgaaatagcgcacgaaaacgaacagaaatggctcatttatgacaagaaagatcataaatatgtctgcacattttccatggagccgtaccacttcatctccaactataataccaagtacacagatgacatggctacaggcagtaatgatacgactgcgtttaacgattcctgtgtaaacctgagtctttttgatgctcggtttgagaggaaaaatccacattga

SEQ ID NO: 25221 - DNA, 1779 bp, Saccharomyces cerevisiae
atggctttggaacctattgattatactactcactcgagagagatcgacgcagagtacctgaagattgtcagaggctccgatcctgacaccacctggttgattatttcacccaatgcgaaaaaagaatacgaacctgagtctaccggttcctcctttcacgatttcttgcaattgtttgatgaaaccaaggtccagtacggactggcacgtgtgtccccaccagggtcagacgttgagaagattattatcattggttggtgtcctgattctgcgccattgaagacaagggcctctttcgccgccaattttgctgcagttgctaataatctgttcaagggttaccacgttcaagttaccgccagagacgaggacgatcttgacgaaaatgaactgttgatgaaaatcagtaacgcggccggtgcccgttattctattcagacttcctccaagcaacaggggaaggcttccactcctcccgtgaagaaatccttcacaccttccaagagccctgctccagtttctaagaaggaaccagtcaagactccttccccagcacctgctgctaagatttcttcccgtgttaacgacaacaatgacgacgacgattggaatgagcctgaattaaaggaacgcgacttcgatcaggctcccctgaaaccaaatcaatcatcttacaaaccaattggcaaaatcgacttgcaaaaagtgattgctgaagaaaaggctaaggaggacccacgtcttgttcaaaagccaaccgctgctggttccaagattgatcctagttctgatatcgctaatttaaagaacgaatcaaaattaaagagggactccgagtttaactcctttttgggcaccactaaacccccctccatgacggaatcttcattaaagaatgatgatgataaagtcattaagggttttagaaacgagaaatcacctgctcaattatgggccgaaagaaaggcaaagcaaaacagcggcaacgccgaaactaaggctgaggcaccaaaacctgaagttccagaagatgagcctgaaggtgaacctgacgtcaaagatttgaaatcaaaatttgaaggattggccgcttcagaaaaagaggaggaagaaatggaaaacaaatttgctcctcctccaaagaaatcagaaccaactattatctcaccaaaacccttctccaagccacaagaacctgtgaaagctgaagaagccgagcagcctaagactgattacaagaagatcggcaacccattacccggtatgcacattgaagcggataatgaggaagaaccagaagagaatgatgatgactgggatgatgatgaagacgaggctgctcaacctcctttgccttcgaggaatgttgcgtcaggagcaccagtgcaaaaagaagagcctgaacaagaagagatcgccccaagcttaccttctagaaactcgatcccagctccaaaacaagaagaagcacctgaacaagcacctgaagaagaaattgaagaagaagctgaggaagccgctccacagctgccatcaagaagctctgcagctcctcctccgcctccaagacgagcaactccagagaaaaagccaaaggaaaatccttgggccacagcagaatatgattacgatgctgcagaagataacgaactgacctttgtggaaaatgacaagattatcaatattgaatttgtcgacgatgactggtggctaggggaactagagaaagacggctcaaaaggtctcttccccagcaattatgtgtctttgggcaactag

SEQ ID NO: 25222 - DNA, 4830 bp, Saccharomyces cerevisiae
atgaactcatttgcgtcattaggtctgatatattcagtagtaaaccttttaactagagtagaggctcaaattgtgttctaccagaatagtagtacttcactgcctgtccctactttagtatccacctcaatagcagattttcacgagtcctcatcaactggcgaagtgcagtattcatcctcttattcgtatgtgcagccctcaatagactccttcacttcatctagcttcttaacaagttttgaagctcctaccgaaacttcttccagctatgcagtttcttcctcattgataacttctgatactttttcttcatactctgatatcttcgatgaagaaacaagttcattaatatcaacctcagctgcctcatcggagaaagcctcgtccaccctttcttcaactgcacaacctcataggacatctcactcttcctcttcattcgagctaccagtcactgctccatcatcctctagtttaccgtcctcaacttcattgacatttacgtcagttaatccatctcaaagttggacttcatttaactcagaaaaatctagcgctctttcctcaaccatagattttacttcttctgagatttcaggttcaacatctccaaagagcctggaaagtttcgataccaccggtactataacttcatcttattctccttctccttcttcaaaaaattctaaccagacctcactactcagcccattggagcctctgtccagttcttcaggagatttaatattgagttcaactattcaagctactaccaatgaccaaacttcaaaaactattccaactcttgttgacgccacatcgtcattaccaccaacattgaggtcatccagtatggcaccaacaagtggttctgattcaatctcacacaactttacgagccccccctctaaaacaagtggtaactacgatgttttgacttcaaactcaatagatccttctctatttacaactacgagtgaatattcatctacacaattgtcgagtttaaatcgggcctcaaaaagtgaaacagttaatttcactgcttctattgcttccacaccatttggtacagattcggctacttctctaatagaccccattagttcagtgggttctacagcatctagctttgtgggaatttcaaccgccaattttagtacacaagggaactcgaactatgttcctgaatcaactgcaagtggaagttcacaataccaggactggtcaagctcttctcttccgctgtcacaaaccacttgggttgtcatcaacacaactaatacacaagggtctgtaacgtcaaccacatccccggcttatgtttctacggccaccaaaacggttgacggggtgatcaccgaatatgttacatggtgtcctctaacacaaaccaaatcacaagcaattggggtcagttcgtccatttctagcgttccacaagcctcctcatttagcggtagttctattttgagctccaattccagcactcttgctgcctcgaacaacgttcctgaatcaactgcaagcggaagttcacaataccaggactggtcaagctcttctcttccgctgtcacaaaccacttgggttgtcatcaacacaactaatacacaagggtctgtaacgtcaaccacatccccggcttatgtttctacggccaccaaaacggttgacggggtgatcaccgaatatgttacatggtgtcctctaacacaaaccaaatcacaagcaattgggatcagttcatccacgattagcgccacacaaacctctaaaccatcttcaatattaacattggggatatcgaccttacaattgtctgatgccacatttaaggggactgaaactataaacacccatctcatgaccgaaagtacttcaatcacagagcccacctattttagtggcacatcggatagtttttatttgtgcaccagtgaagttaatcttgcgtcttccttatcttcttatccaaatttttcatcttcagaaggctctacggcgaccattactaactctaccgttacatttggatcgaccagcaagtatccatctactagtgtatctaacccaacagaagccagccaacatgtgagctctagtgtgaactcactcactgattttacttcaaattcaaccgaaaccatcgcagttatatctaatattcacaaaacttcgtcaaataaagactattcattgacgactacgcaattaaagaccagcggaaagcaaacgcttgtgctttctactgtcacaacaacggtgaacggtgctgctacggaatacacaacgtggtgcccggcatcaagtattgcttatacgacatccatatcatataaaacattagttttgaccactgaagtctgctctcattctgagtgtactccaacggttattaccagtgttactgcaacaagctctacaatcccccttttatcaacctctagctctacggtattatcttctacagtatccgaaggtgcaaaaaatcccgctgcttctgaagtaactattaatacccaagtttctgctacttccgaagctactagtactagcactcaagtgtctgctacttctgcgacggccactgctagcgagagttcaaccacatcccaggtttctactgcttccgaaactattagcactctcggtactcaaaactttaccactactggaagcttacttttcccggctttgtctactgaaatgataaatactactgtggtttcccgaaaaaccctaattattagtacagaggtatgttcccattccaaatgtgtcccaacagtcattaccgaggttgttacttcgaaaggcacgccttctaatggacattcttctcaaactctacaaacggaggcagtagaggtgacattgtcatcccatcaaaccgtaactatgagtaccgaagtatgttctaattcgatttgcacaccgactgttattacatctgtgcaaatgagaagtactccttttccatacttaacttcttcaacgtcaagttcctctttagcctccaccaaaaaaagttccttagaagcctcctcagaaatgtccaccttttctgtcagtacgcaaagtttgcctttggcattcacttgttcagaaaaacgctccaccacatctgtctctcaatggtcaaataccgttttaactaatacaataatgtcctcttcttctaatgtcatatcaacaaatgaaaagcccagtagtactacctctccatacaacttctcttcggggtactctttaccttcttcttctacaccttcccaatattcactatctacagctactacaacaatcaacggaatcaaaactgtgtacacaacttggtgtccattggcagaaaaatctactgtagctgcttcttctcaatcttcccgcagtgttgacaggtttgtttcgtcgtcaaaaccatcctcatctttatctcagacctctattcaatatacattatctactgctaccaccaccataagtggtttgaagactgtatacacgacttggtgtccattaacaagtaaatcgactttaggtgctactactcaaacttcctcgacagccaaagttagaattacttccgcttcatctgcaacatctacttctatttctttgagcacttcaacagaatcagaatcttcatctggatatttgtcgaaaggagtatgctcaggtactgaatgtacgcaagatgtgccaacacaatcatcctcacctgcttcaacgttagcatattccccctctgtttctacatcatcatcatcatcattctcaacaacaactgcatcaacactaacgtcaacacacacctctgtcccgttattaccatcatctagctctatatcagcatcttcgccatcatcaacttcgttgttatccacttctttaccatctcccgcttttacgtcatcaacacttccaacagcaacagcagtatcttcctccactttcatagcgtcttctctaccattgtcctctaaatcatcattgtcgttatcgccagtctcgtcgtctattttgatgtctcagttttcatcatcatcatcatcatcatcatcattggcatcgttgccatctctttctatatcaccaactgttgacactgtttctgttctacaaccaactacttccatcgcaacactaacttgcacagactcacaatgccaacaggaggtatccactatctgtaatggatccaactgtgacgatgtgacttcaactgccactactcctccatctacggttactgatactatgacatgtactggatctgagtgccagaaaaccacatctagcagctgtgatggttactcgtgtaaagtatccgaaacgtataaatcaagcgctacaatatctgcatgtagtggagaaggatgccaagcttccgctacaagtgagctaaattctcaatacgtcacgatgacgtctgtcattaccccaagtgccataacaacaacatcagtggaagtgcattcaactgaatccactatatcaattactacagtgaagccagttacatatacatccagtgatactaatggagaactgataaccataacaagttccagccaaactgtaattccatcagtaacgacgataataacgagaacaaaagtggccataacttcagcaccaaagccaacaactacgacctatgtcgagcaacgactttcctccagtgggattgctacttcttttgttgctgctgcatcctcaacttggattactacacccattgtcagtacgtatgctggttcggcgtcaaaatttctctgtagtaagttctttatgataatggtaatggtgatcaacttcatttaa

SEQ ID NO: 25223 - DNA, 3144 bp, Saccharomyces cerevisiae
atggtgataggtaatgaacctaaactggtacttttgagagccaaaagcagtgcaaatagatttattttgttgaatctattaacaataatggcgggacaacccacaataagcaggtttttcaagaaggcggtaaaatcagagctgacgcataagcaagaacaagaagttgcggttggaaatggcgctggtagcgaatccatctgccttgacactgatgaagaggacaatttatcttctgttgcaagcacaacagtaactaatgatagctttccactcaaaggcagtgtttcttccaagaattcgaaaaattcagaaaagactagtggtacttcgacaacatttaatgatattgactttgctaagaaattggataggattatgaaaagacgaagtgatgaaaatgttgaggctgaagatgatgaggaagagggtgaggaagatttcgtaaaaaaaaaagccagaaagtcccctacagcgaaacttactcccttggacaaacaggtgaaggacctgaaaatgcatcatagagataaagtgcttgttattagagtaggctacaagtacaaatgttttgcagaggatgcagtaacggttagcagaatacttcacatcaaacttgtgcctggaaaattgactatcgatgagtctaatcctcaagattgcaatcataggcagtttgcgtactgttctttcccggatgtcagattaaacgttcacctagagagacttgtgcatcataatttaaaggttgccgtggtagagcaagcagaaacaagcgctattaagaagcatgatccaggtgccagcaaatcaagcgtttttgaaagaaagatttcaaatgtctttaccaaagctacatttggtgttaattccacctttgtccttagggggaaacgtattctcggtgatacaaacagtatatgggctttgtcccgtgacgtacatcagggaaaggtggctaaatattccttaatttctgtcaatttaaataacggggaagtcgtgtatgatgaatttgaagagcctaatcttgctgatgagaaactacagatacgaatcaaatatttacagcccatagaagtactggtaaatacagatgatcttccattacatgtagcgaaatttttcaaagatatttcatgtcctttaatacacaagcaggagtatgatttggaagatcatgtagttcaggcaataaaagtaatgaatgagaaaattcaactctcgccgtctctcatacgcttagtttctaagttatattcgcatatggttgagtacaataatgagcaggtgatgttgattccttctatctattcgcccttcgcatcaaaaatacatatgttacttgatcctaactccctgcaaagtttggacatttttacccatgatggtggtaaaggttctttgttttggttattggaccatacaaggacatcgtttggattaagaatgttgagagaatggattctcaaacctttggttgatgtacaccaaattgaagagcggcttgatgccattgagtgcattacatccgaaatcaacaacagtatattttttgaatcgttgaatcaaatgttgaatcatacccctgacttattaagaactttaaatcgcataatgtatggtacaacttctagaaaagaagtctatttctatttaaagcaaataacttctttcgttgatcacttcaagatgcatcaatcttacctgtcagaacatttcaagtcatcagatggaaggataggcaaacaatctcctttactttttagactatttagtgaattgaatgaactactttctaccactcagttgcctcattttttgaccatgatcaacgtttctgcggtaatggaaaaaaattcagataagcaagtaatggatttttttaatttaaataactatgattgttcagagggtataataaaaattcaaagggaaagcgaatcagtacggtcacagttaaaggaagaattggcagaaatacgaaaatatctcaaacgtccatatctaaattttagagatgaagttgattacttaatcgaagtgaaaaactcgcaaattaaggacttgccagatgattggataaaagttaacaatacgaagatggtcagtagatttaccactcccagaacccagaaactgactcaaaagctagaatattacaaggacttattaattcgggaatctgaactacagtataaagaattcttgaacaaaattacggcagaatatacagagctccgtaaaattacactcaatttggcgcagtatgactgtattttgtcgttagcagccacatcatgcaacgtaaattatgttagaccaacttttgtgaatggtcaacaagccataatcgcaaaaaatgcaagaaatccaattatcgagtcgctggatgttcattatgtaccaaatgatatcatgatgtccccagaaaacggtaaaatcaatattataacggggccgaatatgggtgggaaatcatcttatattagacaagtggcactgcttactataatggcacagatcggctcatttgtccccgcagaagagatcagattaagcatatttgaaaacgtactcactcgaatcggtgcgcacgatgatattataaacggtgattctacttttaaagtggaaatgcttgatatcctacacatcttgaaaaattgcaataaacggtctttactattattagacgaagtgggaagaggtactggcacgcacgatggtatagcaatttcttatgctttaataaagtatttttctgagttaagtgactgccccttgatattatttactacccattttcccatgctgggagaaatcaaatctccgttaataaggaattatcatatggattacgtggaagaacaaaaaactggcgaggactggatgagtgtaatttttctatataagttaaaaaagggattgacttataatagttatgggatgaatgtggcgaaattggcacgcctggacaaagatattataaatcgggcattcagtatttcagaagaattgcggaaggaatccattaacgaagacgcgttgaaattattcagctctttgaaaagaatattaaaaagtgataatataacagcaacggataaactcgcgaaattactatcattggatatccactga

SEQ ID NO: 25224 - DNA, 6327 bp, Saccharomyces cerevisiae
atgctatcggccacataccgtgatttgaacacagcatctaatttagaaacatcaaaggaaaaacaggccgctcaaatcgtcattgcacaaattagtttattattcacgactcttaacaacgacaattttgaatccgtggaaagagaaattagacatattttagacaggtcgtccgtagatatttacataaaagtttgggaacgattattaaccttaagttctcgggatattttacaagcgggaaaatttttacttcaagaaaatctactacacagactactattagaatttgcgaaggatttaccgaagaaaagcacagaccttattgagcttttgaaagaacgaaccttcaataaccaggagtttcaaaaacaaacaggaattacattatcacttttcattgatctatttgataaatctgcaaacaaggacattatagagtcacttgaccgctcctctcagattaacgatttcaagacaattaagatgaatcatacaaattatttaaggaatttttttcttcaaaccacaccagaaacactagagtccaatctacgcgacttattgcattccttggaaggtgaaagtctaaatgacttattagctcttttactgtccgaaatactttcacctgggtctcagaatttacaaaatgatcccacacggagttggttgacacctccgatggttttagacgcaacgaaccgtgggaacgttatagcaagatctataagttctctgcaagccaaccagataaattggaatcgtgtgtttaatttaatgtcaacaaagtatttcttgagcgcaccattgatgcctactacagcatctttgagttgcttatttgcagcattgcacgatggtccagttattgatgaatttttcagttgcgactggaaagttattttcaaactagatttggccattcaacttcataagtggtcggtacagaatggttgctttgacttattaaatgcagaaggtaccaggaaagtttctgaaaccatcccaaacacaaagcaatctttactctacttattatccattgcatcattgaatttagaattgttcctacaaagggaggaattgtctgatggtcctatgctagcttattttcaagagtgcttctttgaagatttcaactacgcccctgaatatcttattttagcattagtcaaagaaatgaagcggttcgttttattgatagaaaacaggacagtcatagacgaaatacttattaccttattgattcaagtgcataataaatcaccgtcatcgttcaaggacgttatttctacaataaccgatgattctaaaatcgtagatgcagcaaaaatcataatcaactcggatgacgcacctattgccaactttttaaaatcgttgttagatacgggaagattagatacggtcattaataaacttcctttcaatgaagcttttaaaattttgccatgcgcaagacaaattggttgggaggggttcgatactttcttaaaaacaaaagtttctccatctaatgtcgatgtagtgctggaatcactagaggttcaaacgaaaatgactgatacaaacactccatttaggtcattaaagacatttgacttattcgcttttcattcattaattgaagtactgaacaaatgcccactagatgttctccaattacaaaggtttgaatccttggaattttccttattaattgcatttcctagattgatcaattttggttttggacacgatgaagctattttagccaatggtgacatcgcagggattaataatgatattgaaaaggagatgcagaactatttacagaaaatgtatagtggtgagttagccattaaagatgtaatcgaacttctgagaaggttaagagatagcgacttgccaagggaccaggaagtcttcacatgtattacccatgccgttatagcagaatcgacattcttccaagattatccattggatgcattggctactacatctgttctttttggatccatgattctctttcaactgttacgtggattcgtattagacgtcgcatttaggataatcatgaggtttgccaaggagcctccagagtccaagatgtttaagtttgctgtacaagctatttatgcatttaggatacgtttggccgaatatccacagtattgtaaggacctcttgagagatgttccggctttgaagtctcaggctcaagtttaccaatctatcgtcgaagctgctaccctagcaaatgctccaaaggaaaggtcaagacccgtccaggaaatgatcccattaaaattttttgctgtagatgaagtttcatgtcagatcaatcaagaaggtgctcctaaagatgtcgtagaaaaagttctttttgttctcaacaacgttactctggctaacttgaataataaggttgatgaattgaaaaaaagtttgacaccaaattatttttcttggttttccacatatttagttacgcaaagggctaaaacagaacctaactatcatgatctttatagcaaggttatagttgctatggggtcagggttgctacatcagttcatggtcaacgttactttgagacaattatttgtcctactatctacaaaagacgagcaagccatcgataaaaagcacctaaagaatttggcttcatggttaggatgtatcacattagctttgaataaaccaattaaacacaagaatatcgcattcagggaaatgttaatcgaagcttataaggaaaatagacttgaaatagttgtgccttttgtaacaaagattttacaaagggcttctgaatcaaaaattttcaagcctccaaatccctggactgttggcatattaaagctgttgattgagttgaacgaaaaagcaaactggaaattaagtttgactttcgaagttgaggttttattaaaatcttttaatttgaccaccaaatctctcaagccctcgaatttcatcaatactccggaagttatagaaactttatccggtgctttgggatcaatcactctggagcaacaacaaacagagcaacaaaggcaaattatactaatgcaacaacaccagcaacagatgctaatatatcaacagagacaacaacaacaacaacaaaggcaacaacaacaacaacatcatattagtgcaaatacaatcgcagaccaacaagcggcatttggcggcgagggttcaatttcacacgacaatccttttaacaacttacttggttctactatttttgtaacccaccctgacttgaagagggtatttcaaatggctttagccaagtcagttcgcgaaattttgttggaagtagtcgaaaagtcatcaggaattgctgttgttacgacgacaaaaataatacttaaagactttgccactgaagttgatgagtctaagttgaagacggctgcaatcattatggtaaggcatttggcacaaagtttagctcgagctacttcaattgaaccattgaaagaaggcatacgttctactatgcaatcactagcaccgaatttaatgtctctttcttcttcacctgcagaggagcttgacacggcaataaatgaaaatattggcattgctctagttttgattgagaaagcatctatggacaagtctactcaagatttagcagaccaattgatgcaagcgattgctattcgtcgttatcacaaggaaagaagggcagaccaaccatttattacgcaaaataccaatccatattcactgtctttaccagaacctcttggtttgaaaaacactggtgttactcctcaacaattcagggtatacgaagaatttggtaagaatattccaaacttggatgttattccgtttgcaggattgcccgctcacgctccaccgatgactcaaaatgtgggttcaactcagcctcagcaacaacaagcgcaaatgcctacccaaatcctaacctccgaacaaataagagctcaacaacaacagcagcaattacagaaaagccgtttgaatcagccatcccagtcggctcaacctccaggagtgaatgtcccaaatcctcaaggtgggattgctgcagttcaatcagatttggaacagaatcaacgtgttctcgttcacctcatggacattttagtttctcaaattaaagaaaatgctacgaagaataacttagctgaattaggcgatcaaaaccaaattaaaaccatcatttttcaaattttgacattcattgcaaaaagcgcacaaaaggatcaattagctttaaaggtatcccaagctgtcgttaatagcctttttgccactagtgagagtcctctctgcagagaagttttgtccctacttttggaaaagttatgttctttatccctcgttgctagaaaagacgttgtctggtggttagtttatgccttggacagtaggaaattcaatgttcccgttatcagatcccttctagaagttaatttaattgatgctacagaattagataacgttttagttactgcaatgaaaaataaaatggagaactcaactgaatttgctatgaaattaattcagaatactgtcttgtctgatgatccaattttgatgagaatggacttcattaaaaccttagaacacttggcctcttcggaagatgaaaatgtaaagaaattcatcaaagagttcgaagatactaagataatgccagtgaggaaaggtaccaaaaccacaagaacagaaaagctttacttagtatttacggaatgggtaaaattacttcaaagagttgagaataacgacgtaatcacaactgtttttatcaagcaattagtcgaaaagggtgttatcagcgatactgataatttacttacatttgtcaaaagttctcttgagctatcagtttcttcattcaaagaaagtgacccgactgatgaggttttcatcgctattgatgctctaggatcgctaattataaaattgttgattttacagggtttcaaagatgatacaagaagagattacataaatgcaatattttctgtgatcgttttagtgtttgctaaggatcatagccaagagggtaccacattcaatgaacgaccatatttcagactattttctaacatcttatacgaatgggctaccatcaggacgcacaattttgttagaatatctgattccagcactaggcaggagctgatcgaatttgattctgtattttacaacactttctcaggatatttgcacgctctgcaaccatttgccttccctggattctcatttgcatgggtgacactattatcacacagaatgttattaccaattatgctaagattacccaataaaataggttgggaaaagttaatgcttttgattatcgatttgtttaaatttttggaccaatacacaagtaaacatgcagtctctgacgctgtttcggttgtttataagggaacactgcgtgttattttaggcatttcgaatgatatgccatcctttttgattgaaaatcactatgaattaatgaacaatctacctccaacatatttccaactaaagaatgttattttatctgctattcctaagaatatgaccgttcccaacccatatgacgtggatcttaatatggaggatattccagcatgtaaagaactacctgaagtcttctttgatcctgtaattgatttacactcattgaaaaagccagttgacaactacctacgtattccctcaaattcattattaagaacaatactaagcgctatttacaaggatacctatgacataaaaaagggcgtaggctacgactttttatctgttgatagtaaattaattcgcgctattgtattacatgtgggcattgaagctggaatagagtataagagaacttcttcaaatgcggtatttaatacgaagtcttcttattatactttattgttcaatctgattcaaaatggtagcatcgaaatgaaatatcaaattattctgtctattgtggaacaattgcggtatccaaacatccacacctattggttcagctttgtgttaatgaatatgttcaaaagtgacgaatggaatgatcaaaaacttgaagtccaagaaattattttaagaaactttttaaaaagaattattgttaacaaaccacatacctggggtgtttcagttttctttactcagttgataaacaataacgatattaatcttttagacctgccctttgtacaaagtgttcccgaaattaaactaattttacaacaattagtaaaatattccaaaaaatacacaaccagtgaacaagatgaccaatccgccaccatcaatagaaggcaaacccctctacaatccaacgcataa

SEQ ID NO: 25225 - DNA, 1557 bp, Saccharomyces cerevisiae
atggaagacaaagatatcacatcggtaaatgagaaggaagtgaacgagaacactaatcctagaataataaaatatgatgccgagaggcgtgcaacccgtactgaaacctcaaagaaagataaatggaaaaacatagttacaatcattgcgtccggttttgctctgataagtgatggttacgtaaatggttcaatgagtatgctaaacaaggtttttgttatggagtacggtaagaaaaactatagctcaaaagtgtcgactagagtttccaacgcagccctagttggtattatttttggccaattctttatgggtatcgctgctgattattatagtagaaaatcttgtatccttgtggccactgctatcttggttattggtagtgctctgtgtgctgcctctcacggtactactgtacctggcatgttttggatgttaacagttatgagaggtttggtaggtattggtgttggtgcagaatatcctaccagtacattaagtgctaatgagtctgctaatgaatataccactaccaaaagaggtggtatcctggttatggtgacaaatttgccactagccttcggtggtccatttgctacgatcatctttttaatcgtctacaaaatctgttcaggaacaaaacatttagaggcgatctggaggactgtttttgcaatagggtgcttctggccattgagtgtgttctattttagatggaagactgctactacagaagtctatgaaaaaggtagaatcaagagaaatataccatatttcctagcattgaaattttattggaaaaggttacttggtacatgtggtacatggtttatgtatgattttgttaccttcccaaatggtattttcagttcaacaattatcagttccgttatcaaggaccaaaatgatttagtaaaagtggcagagtggaacttactgttgggagttttagctgtactgggtgtaccaattggtgcttatctgtccgatcgtattggtcgtaaatatacgttgatgtttggtttctctgggtacatcatctttggtctaatcattggatgtgcgtacgaccaattgaaaaaaatcacccccttgtttattatcttctacgcattcatgaatatgttaggtaatgctggaccaggtgatatgcttggtgttattagtagtgaagcgtcagcaaccgctgttagaggtgttttctatggtttatctgctgtgactggtaaaatcggttctgtagtaggcgtcgaatgtttccaacccattagggataatttgggtgcaagatggacttttattattgctgcaatttgtggtcttattggtatcattattacatatttctttgttccacattctcttgaaagcgatttaatgaagcaagacgttgaatttcacaactatttggtatccaatggctggactggtaagatgggatttgatgagacagatgaagaatcaatggttagaactattgaagttgaagagaatggtactaattgtagtaagaaaaacgcagaaataatttcagtcagacaggtcgatcaaagttga

SEQ ID NO: 25226 - DNA, 1086 bp, Saccharomyces cerevisiae
atgctttacccagaaaaatttcagggcatcggtatttccaacgcaaaggattggaagcatcctaaattagtgagttttgacccaaaaccctttggcgatcatgacgttgatgttgaaattgaagcctgtggtatctgcggatctgattttcatatagccgttggtaattggggtccagtcccagaaaatcaaatccttggacatgaaataattggccgcgtggtgaaggttggatccaagtgccacactggggtaaaaatcggtgaccgtgttggtgttggtgcccaagccttggcgtgttttgagtgtgaacgttgcaaaagtgacaacgagcaatactgtaccaatgaccacgttttgactatgtggactccttacaaggacggctacatttcacaaggaggctttgcctcccacgtgaggcttcatgaacactttgctattcaaataccagaaaatattccaagtccgctagccgctccattattgtgtggtggtattacagttttctctccactactaagaaatggctgtggtccaggtaagagggtaggtattgttggcatcggtggtattgggcatatggggattctgttggctaaagctatgggagccgaggtttatgcgttttcgcgaggccactccaagcgggaggattctatgaaactcggtgctgatcactatattgctatgttggaggataaaggctggacagaacaatactctaacgctttggaccttcttgtcgtttgctcatcatctttgtcgaaagttaattttgacagtatcgttaagattatgaagattggaggctccatcgtttcaattgctgctcctgaagttaatgaaaagcttgttttaaaaccgttgggcctaatgggagtatcaatctcaagcagtgctatcggatctaggaaggaaatcgaacaactattgaaattagtttccgaaaagaatgtcaaaatatgggtggaaaaacttccgatcagcgaagaaggcgtcagccatgcctttacaaggatggaaagcggagacgtcaaatacagatttactttggtcgattatgataagaaattccataaatag

SEQ ID NO: 25227 - DNA, 2499 bp, Saccharomyces cerevisiae
atggattcgattacagtaaaaaaacctcggttaagattggtttgcctgcaatgcaaaaagatcaaacggaaatgtgataaactgcggcctgcttgctcgcgatgccaacaaaattcattacagtgtgaatatgaagagagaacagatttatctgccaatgttgcagcaaacgactctgatggattcaattcctctcataagctcaatttcgaacagcaacctgtacttgaaaggactgggcttagatattccttacaagtgcctgaaggtgtcgttaatgctacgctgtcgatatggaacgccgaagatatgctagttatagtaggattagttacatttctggattatccttttgctgcgcatagtctggcgcaacatgaccagtatatcagggcactttgtgcttcgttgtacggcatggcgcttgttgactttagcaattatgctaatggtattccttgtgaagacacatcaagaagtatactaggaccattgtcattcatagaaaaggccatttttagacggatagaacatagtaagcaatttcgagttcagtctgccgccttagggttattatacaatgcattttcaatggaagaagaaaacttctcgactcttctaccgtcactcatcgctgaagtggaagacgtgttgatgcaaaaaaaagactgtgaaatacttttgaggtgtttctatcaaaatatttatcccttctatccttttatggacatttcactctttgagagcgatctcactagtttgcttttacaagacgacaataatcgttggaaaattagtactgaagttaaaaatgtgcgcaaaaaaatagaaactttgtcattacttacaatagtaatggccatggccttgatgcattcaaaattggatgcaaatcttctttcaatggtaaaagaaaatgcctccgaaagtgccaggaaactttctcttttatgtcataaactattatgcctcctggatgtatttcgctatccaaatgagaacacttttacttgccttttatatttctacgtttcagagcatttagatcccgagagtcccgattgtgtactgagccccactaacttgcttactctgcaccatcttttaaatttgtccatgaccttaggtcttcaatatgagccttcgaagtacaaacgtttcaaagatccagaagtgataaggcagagacggatattatggttaggagttcagtcattactttttcaaatttctcttgctgaaggtgatgctggtaaatcaaatagtgaatatatggaggcatatttaacagacttcgaagaatatattgaagcttcctcagagtatgaaaaaagttctgcgagtgaatcgaacgtgcaaatgaatgatattgtttggaataagtacaaatttcacgtcattttgagtaaactaatgtctgattgcacttcagttatacaacatccgcagcttttccacattttaggaaatattaaaagatctgaagattttatggctgagaactttcctacaagttcgatttaccaaccccttcatgaaaaggaaccaaatgcgatcaaagttggcaaaagtacggttctcgatgtcatggatattcaaaaaactgaaatatttcttacaaatattgtgggaagtatgtgttttttaaacatttttgatgtcctatcgttacattttgaaaaaaaatgtgttatgcactgggaagaatatgaaaagaactatcatttccttactttgaaaagtttcaatgcatacttaaagctagcagggttgatatctgattatctcgagaataagtttcaagggaacattttagagagtcgcggttatatcatagataaacaaatatgttttatgcttgtaaggatctggatgttccaatgtcgtattttgttaaggttttcatacaagcaagaaagtcagaaaaaattggcctcttccagtatatccactaacgataatgaaaaagaagatgaaatgattgtcattttagaaagacttattaaacacattcgtaaccaaatggcacatttagtggatctagcaaagggaaaacttcaagatagttactttggtgcttaccaaactgttcccatgtttagatacgttgtgtatttgatcgatgttggcggcttagtatctgtgacaaatgggttttgggataagatttccagtgatggtgaaataccgccaaaagtacaacaagccgtgagattgaaatggggattggactgcaataattcgagaagaatcaaacaaaagttaataagcagccagagtttgcagagtttcaatcaagttctgttgtgccagatggaggatgcagttctctccagttccttcgcaataaaagccaataccgctatgtcccaaaacacggctgaagaatttttcaatatcagcgaagaagaggctttaaatcaactattggaaaacaacaattttgatgccttctgggatttattaggtgaaaatctgagcgatatgccttctttgtga

SEQ ID NO: 25228 - DNA, 1830 bp, Saccharomyces cerevisiae
atgaaaaacttatcttttctcataaacagaagaaaggaaaatacaagtgactcgaatgtatacccaggaaaggctaagtcgcatgaacccagctggatagaaatggatgatcaaactaagaaggacggcttagatattgttcatgttgagttcagtccggatacaagagcgccaagcgatagcaataaagtaataacagagatatttgacgctactgaggatgccaaggaggcagacgaaagtgaaagaggaatgccacttgcgacagcattgaatacatatcccaaggcagcagcttggtcactattggtctctacaactttaatcatggaagggtacgacacagctattcttggagctttctacgccttgcctatttttcagagaaagtttggctcacaaaatgacaaaactggagaatgggaaatttcagcgtcatggcaaatcgggctgaccttatgttatatggcaggtgaaattgtggggctacagctaacggggccctccgtggatcttgttggaaatcgttacacattgattattgcattgttttttttagctgccttcacttttatactgtacttttgcaatagtttaggcatgattgctgtgggacaagcattgtgcgggatgccatggggttgttttcagtgtttgacggtgtcttacgcttctgaaatatgcccattggctctgagatattaccttacaacctattcaaacttgtgctggttatttggacaactttttgcagctggaatcatgaaaaattctcaaaaaaaatatgcggattcagaattaggatataaactaccatttgccctacagtggattttgccagttcctttagcactgggaattttttttgcacctgaatctccatggtggctagttaaaaaaggaaggtttgatgaggcaaggagatcacttagaagaactttaagcggcaagggacctgaaaaagaaatactagtaactctggaggtggacaaaataaaagtgactatagataaggaaaagagactcacaagtaaagaaggctcctatagtgattgttttgaagacaagattaatcgaagaagaacgagaattacttgtctctgctgggctggtcaagccacttgtggttcaatactaataggttattcaacttacttttacgaaaaggctggcgttagtactgaaatgtccttcacttttagtattattcaatactgtctcggtatttgtgctacatttctatcttggtgggcgtcaaagtattttggtagatatgacctttacgcttttggactagccttccaaaccattgtttttttcattattggcggtttggggtgctcaagtacgcacggttccaaaatgggaagtggttctcttttaatggctgtagcatttttttacaatttaggaattgccccggtcgttttttgcctagtctctgaaatgccatcttcaagactaagaacgaaaacaatcattctagcacgtaacacttataatgtggtcagtatcatatgtagcgttctcatcttataccaactgaactctaagaagtggaactggggcgctaagtcaggctttttctggggtgtcttatgcttttgtactttaatctgggctgtggttgacctaccagaaactgccggaaagactttcgtggaaataaatgagttatttaaacttggagtttctgcaagaaagttcaaatcgacgaaagtagatccgtttgttgtcaaaacccccctaaagacgtctctcataacgaccccaagggagatatcgaagcttccattgcagaggaatagcaatgtatcccatcacctatga

SEQ ID NO: 25229 - DNA, 1074 bp, Saccharomyces cerevisiae
atgtctcaaaatagtaaccctgcagtagttctagagaaagtcggcgatattgccatcgagcaaagaccaatccctaccattaaggacccccattatgtcaagttagctattaaagccactggtatctgcggctctgatattcattattatagaagcggtggtattggtaagtacatattgaaggcgccaatggttttaggtcatgaatcaagcggacaggttgtggaagttggtgatgccgtcacaagggtcaaagttggtgaccgtgttgctattgaacctggtgttcctagccgttactctgatgagaccaaagaagggagctataacctttgcccacatatggcatttgctgcaactcctccaattgatggtactcttgtgaagtactatttatctccagaagatttccttgtgaaattgccagaaggcgtcagttatgaagagggcgcttgtgtcgaacccttatcagtcggtgtacactctaataaattggctggggtccgctttggtaccaaagttgttgtatttggtgcaggtcctgtggggcttttaactggcgcagtcgcccgcgcttttggtgccaccgacgtcattttcgtcgatgtattcgacaacaagctacagagagcaaaagatttcggagccacaaacactttcaattcttcccagttttccaccgataaagcccaagacttggccgatggggtccaaaagcttttgggcggaaatcacgcagatgtggtgtttgagtgttcaggtgctgatgtttgcattgatgccgctgtcaaaacaactaaggttggaggtaccatggtgcaagtcggtatgggtaaaaactacactaattttccaattgctgaagttagtggaaaggaaatgaaattgattggatgtttccgttattcattcggtgattatcgtgacgctgtgaacttggttgccacaggaaaagtcaatgtcaagccattgataacccacaaatttaaatttgaagatgcagccaaggcttacgactacaacattgcccatggtggagaggtagtcaagactattatctttggtcctgaatga

SEQ ID NO: 25230 - DNA, 1704 bp, Saccharomyces cerevisiae
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcaacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaatccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 25231 - DNA, 1842 bp, Saccharomyces cerevisiae
atggctgaaggtgttttccaaggtgctatcggtatcgatttaggtacaacctactcttgtgttgctacttacgaatcctccgttgaaattattgccaacgaacaaggtaacagagtcaccccatctttcgttgctttcactccagaagaaagattgattggtgatgctgccaagaaccaagctgctttgaacccaagaaacactgtcttcgatgctaagcgtttgattggtagaagattcgacgacgaatctgttcaaaaggacatgaagacctggcctttcaaggttatcgacgtcgatggtaacccagtcatcgaagtccaatacttggaagaaaccaagactttctccccacaagaaatttccgctatggttttgaccaagatgaaggaaattgctgaagctaagattggtaagaaggttgaaaaggccgtcattactgtcccagcttactttaacgacgctcaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttccaccagaattccaaaggtccaaaagttgttgtctgacttctttgacggtaagcaattggaaaaatctattaacccagatgaagctgttgcttacggtgctgctgttcaaggtgctatcttgaccggccaatccacatctgacgaaaccaaggacttgttgttgttagatgttgctccattatctctaggtgttggtatgcaaggtgacatgttcggtatcgttgttccaagaaacactactgttccaaccatcaagagaagaacctttactacatgtgctgacaaccaaaccaccgttcaattcccagtctaccaaggtgaacgtgttaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctctaacgctgttggtagattgtcttctgaagaaattgaaaagatggttaaccaagctgaagagttcaaggctgccgatgaagcttttgccaagaagcacgaagctagacaaagattggaatcctacgttgcctccatcgaacaaactgtcactgacccagtcttgtcttctaaattgaagagaggttccaagtccaagattgaagctgctttgtccgatgctttggctgctttgcaaatcgaagacccatctgctgatgaattgagaaaggctgaagttggtttgaagagagttgtcaccaaggccatgtcttctcgttaa

SEQ ID NO: 25232 - DNA, 1059 bp, Saccharomyces cerevisiae
atgtcagattggaaagtggacccagatacccgcaggcgtcttttgcaattgcaaaagattggtgcaaataagaaatgtatggattgtggtgcgccaaatccacaatgggccacgcctaagtttggagctttcatttgccttgaatgtgccggtatccatagagggcttggtgtgcatatatcttttgtaagatctatcactatggatcagtttaaaccggaggaacttcttcgtatggaaaaaggtggtaacgaacctttgactgaatggttcaagtcgcataatattgacctgagtttaccacaaaaagtgaaatacgataaccccgtcgcagaggattataaagaaaagttaacatgtctttgcgaagatagagtatttgaagagcgtgagcatttggattttgatgcttccaagttatcagcaacctctcaaaccgctgcatccgctacgcctggtgttgctcaaagtcgagaagggacaccactggagaaccgtcgatctgcaacaccagcaaactctagtaatggtgccaattttcaaaaggagaagaacgaagcttattttgctgagctgggcaagaagaaccaatctagaccagatcatttgcccccttctcaaggtggtaaatatcagggctttggaagtacacccgcaaaacctccacaagaacggtctgcagggtccagcaatactttgagcctggaaaattttcaagctgatcctttgggaacattgagcagaggatggggcctcttctccagcgctgtaaccaaatcgttcgaggacgtaaacgaaacggttattaagcctcacgtccagcaatggcaatccggagagttgtcagaagaaacgaagagagcagctgcccagtttggccaaaagtttcaagaaacgagtagttatggattccaagcatttagtaacttcactaaaaatttcaatggtaatgcagaggatagctctacagcagggaatacaacccatacagaatatcaaaagattgataataacgataagaagaatgaacaggacgaggacaaatgggacgatttctaa

SEQ ID NO: 25233 - DNA, 1656 bp, Saccharomyces cerevisiae
atgagcactgcttcaacaccgccaattaacttatttcgtagaaagaaagaacataaacgtgggatcacatacacaatgttactatgtgggccagcaggtacaggaaagaccgcctttgctaacaatctattggaaactaagatctttccgcataagtatcaatacggtaaatcaaatgctagtattagctctaacccagaagtaaaagttattgctccgacaaaagttgtttcatttaattcgaaaaatgggattccatcttatgtttctgaattcgatccaatgagagccaatttggaaccaggtattaccatcacctccacttcattagaacttgggggcaacaaagatcaaggaaagccagaaatgaacgaggatgataccgtgtttttcaacttgattatgacgcatggtataggcgaaaacttggacgattcgttgtgttctgaggaagttatgtcgtatttagaacaacaatttgacattgttttagctgaggaaaccagaattaaaaggaatccgaggtttgaggacaccagggttcacgtagcattatattttattgaacccactggacacggtctgagagaagtcgatgtagagctcatgaaaagcatctccaaatacacaaatgtactgccaataataacaagagctgactcattcaccaaggaggagctaactcaattcaggaaaaatattatgtttgatgtggaaagatacaacgtcccaatttacaaatttgaggttgaccctgaagatgatgatttggaatccatggaagagaatcaagccttggcatccttgcaaccatttgctattataacttcagataccagagatagtgaaggtagatacgttagggagtatccgtgggggataatatcaatcgacgacgacaaaatttcggatttgaaagttttaaaaaacgtcctgtttggttctcacttacaagaattcaaagacaccacgcaaaatttgctttacgagaattaccgttccgaaaaactatcgtccgtggccaacgctgaagaaattggtcctaattctacaaagagacagtcaaatgctccaagtttaagcaactttgcctctttgataagcactggtcaattcaattcttctcaaactcttgcaaacaatttgagagcggacacaccaagaaaccaagtaagtggaaactttaaggaaaacgaatacgaagacaatggcgaacatgattcagcagaaaatgaacaggaaatgtctcccgtgagacagttgggtagagaaataaaacaagaaaatgaaaatttgataagatctatcaaaacagaatcttcaccaaaattcttgaactctccggacttaccagagcgtaccaagttaagaaatatttcagaaaccgttccatatgtcttgagacatgaaagaattttagcaagacaacaaaaactggaagagttagaggcccagtcagctaaagaattacaaaaaagaattcaagaattagaaagaaaagcacacgaattgaaattgagggaaaaactaataaatcagaataaactaaacggttcatcatcttcaatcaattctctacaacagagcacaaggagccaaattaaaaaaaatgacacgtatactgatttagcctctattgcatcgggtagagattga

SEQ ID NO: 25234 - DNA, 3141 bp, Saccharomyces cerevisiae
atgaatatgaacgagtccatttccaaagatggtcaaggcgaagaagaacaaaataatttttcgtttggtggtaagcccggttcctatgattccaattcagattctgctcaacgcaaaaagtctttcagtactacaaagccgaccgaatataacttaccaaaagaacagcccgaatcaacgtccaagaatttggaaaccaaggctaaaaacattctgttaccttggaggaagaagcataataaagactcggaaactccacacgaagacactgaggcggacgctaaccgccgtgccaacgtaacttctgatgtgaaccctgtttctgccgacaccaagtcaagttctggccctaatgctactattactacccatggatactcttatgtcaaaacaacgacacccgctgctacaagtgagcaatccaaagtgaaaacgtcacctcccactagccatgaacattcaaatataaaggcgtcccccactgcgcatagacattccaaaggtgatgcagggcatccaagtattgcaaccactcataaccacagcacttccaaagctgccacttctcctgttactcacacgcatggtcattccagtgctaccacttcccctgtcactcacacacatggtcatgccagtgtgaaaaccacatctcctaccaatactcatgagcattctaaagcgaatactggtccatcagccactgcaactacacatggacatatcaacgtcaaaactacccaccctgttagccatggtcactctggttcaagcactggtcctaaatccaccgctgctgcacaggatcattccagtactaaaactaacccttcagttactcatggacatacaagtgttaaagataactcctcagctacgaagggttattcgaacactgattccaactcagatcgagatgtcatacctggtagtttccggggcatgactggtactgatgtgaaccctgttgatcctagtgtttacacaagtacaggcccaaagagtaatgttagttccggtatgaacgctgtcgaccctagtgtctacacggacacaagttcgaagtctgcagatcgtagaaagtactctggcaacactgcgactggtcctcctcaagatacaattaaagaaattgcacagaacgtgaagatggatgagagcgaacaaactggattgaaaaatgaccaagtttctggttctgatgcaatccaacagcaaactatggaacctgaacccaaagcagcagtcgggacaagtggttttgtaagccagcaaccttcttatcatgatagcaataaaaacattcaacacccagaaaagaataaggttgataataaaaatatatcagaaagagcggctgaaaaatttaacattgaaagagatgacattctggaatccgccgatgattatcaacagaaaaacattaaatccaagacggattctaattggggtccaattgaatatagttccagcgctggtaaaaataagaatctgcaggatgttgttataccttctagtatgaaggagaaattcgacagcggtacatctggatctcagaatatgcctaaagcgggaaccgaattaggacatatgaagtataatgataatggtagggataacttgcaatatgttgccggttcacaagctggttctcaaaatacgaacaacaatattgacatgtcaccccgtcatgaagcagaatggtccgggctttctaatgatgccaccacccgaaacaatgttgtatcacctgctatgaaggacgaagatatgaatgaagattctactaaacctcatcaatatgggttggattatttggatgatgttgaagactaccacgagaatgatattgacgactactcaaatgcaaagaaaaacgacttgtattctaagaaagcgtaccagggaaaaccatcggattacaattatgagcagagagagaaaatcccaggtacttttgaacctgatacgttgtcaaaatcagtgcaaaaacaagatgaagacccgttgtctccaaggcaaaccactaaccgtgctggtatggagactgcaagagatgagagtcttggcaattacgaatactcgaatacttctggtaacaaaaaattatctgatttaagcaaaaataaatcaggcccaactccaacgcgttctaattttattgaccaaattgagccaagaagagcaaaaacaacacaggatattgcatccgatgccaaggatttcaccaataatccggaaacaggtactactggaaacgtagatacaaccggaaggatgggtgcaaaatccaagaccttcagctcgaacccttttgatgatagtaaaaatacagacactcatctcgaaaacgctaatgttgctgcctttgataattccagatctggagacactacatactccaaatcaggggatgctgaaacagctgcttacgataatattaaaaatgcggaccctacatatgccaaatcacaagatattactggaatgactcacgatcaggaaccatcatcagaacaaaaggccagttacggttctggcggcaattcccaaaatcaagaatattctagcgacgataatattgatgtcaataagaatgcgaaagttttagaggaagacgcaccgggctacaagcgtgaagtagatttgaagaacaaacgtagaaccgaccttggtggtgccgacgcctcaaacgcttatgctgccgaagttggtaatttccctagtttgattgacccacatgtcccaacatacggatttaaagacaccaacacctctagttctcaaaagccatctgagggcacctacccagaaaccacttcctattcaattcataatgaaacaacttctcagggaaggaaagtgtcggtgggttcaatgggttccggaaaatcaaaacatcatcacaatcatcaccgtcacagcagacagaattcttcaaaagggtctgactacgactataataattctactcattcagccgagcacactccaagacatcatcagtacggttccgatgagggtgagcaagattaccatgacgacgagcaaggtgaggaacaggctggtaaacaaagtttcatgggtagagtgagaaaaagtatttctggcggtacttttggatttaggagtgaaatttaa

SEQ ID NO: 25235 - DNA, 984 bp, Saccharomyces cerevisiae
atgggccctgaaactctacatattggtgggagaaaatcgaaattggcggtaatacaatccaaccatgttttaaaactgatcgaagaaaagtatccggactacgactgcaaggttttcactttgcaaactcttggtgaccagattcaattcaaacctttgtactcatttggcggtaaagctttatggacaaaggagttggaagaccatctttaccatgacgatccctcaaagaagcttgacttgatcgttcattctctgaaggacatgcccactttactaccagagggtttcgagctggggggtatcactaagcgggtcgatccaacagattgtcttgtcatgcccttttactctgcttataagtctctggatgaccttccagacggggggattgtgggaacctcatccgtgagaagatctgctcagctaaaaagaaaatacccacatttgaaatttgaaagtgtcagaggaaatatacaaactagattacaaaaactagacgacccaaaatctccgtaccaatgcatcatcttggcgtctgctgggttgatgcgtatggggttggaaaacagaattacgcagcgattccattcggatacaatgtaccatgcagttggacaaggcgccctgggtatagaaattagaaagggtgacaccaagatgatgaagattcttgacgaaatttgcgatctaaatgcaactatatgttgcctttcggagcgtgctttgatgagaactttagaggggggttgttccgttcctattggtgtggaatctaaatacaatgaagagactaaaaaattactattaaaggccattgtagttgacgttgaaggcacagaagcagtagaagacgaaattgaaatgctaatagaaaatgttaaagaagattccatggcgtgtggtaagatactagctgaaagaatgattgccgatggcgcaaagaaaattctggatgaaattaatttagacagaatcaaatga

SEQ ID NO: 25236 - DNA, 903 bp, Saccharomyces cerevisiae
atgcctcataccgataagaaacaatcaggattagctcgtcttttggggtccgcctctgcaggcataatggaaattgccgtcttccatcctgtggacaccatttccaaaagactgatgtccaaccacaccaaaataacctctggccaggaattgaatcgtgttatttttcgtgatcatttcagcgaacctttgggcaaacgtttgtttaccttgttcccgggtctcggttacgctgcatcatacaaagttcttcaaagagtgtataaatatggtggtcagccttttgctaacgagtttttgaataagcactacaaaaaggattttgataatcttttcggtgaaaagactggtaaggcaatgagatccgccgctgctggatctttgattggtattggtgaaattgttcttttgccgctggacgtgttgaagattaagagacagaccaatcccgaatcgtttaaaggtagaggtttcatcaagattttgagagacgaaggcctgttcaacttatataggggttgggggtggacggctgccagaaatgctcccggttcattcgccctttttggtggtaatgcattcgccaaggagtatatcttgggtttgaaagattattctcaagctacttggtcccaaaacttcatctcctccatcgtcggtgcttgctcctctctgatcgtttctgctccattagatgtcatcaagacaagaattcaaaataggaattttgataatcctgaaagcgggttgagaatcgtcaaaaacactctgaaaaatgaaggtgtaactgcgtttttcaagggcttaacacctaaattactaacaacgggtccaaaactggttttctcatttgcgttagctcaatctttgatacctagattcgataacctgttgagcaaatga

SEQ ID NO: 25237 - DNA, 546 bp, Saccharomyces cerevisiae
atgggtttgtttgcctctaagttgttcagtaacctttttggtaacaaagaaatgcgtattcttatggttggtcttgatggtgctggtaagaccaccgttttgtacaagttgaaattgggtgaagttatcactaccattccaacaattggtttcaacgttgaaactgtccaatataagaacatttcattcactgtctgggatgtcggtggacaagacagaattagatctctatggagacactactacagaaacactgaaggtgttatctttgttgtcgattctaacgatagatcgcgtattggtgaagctagagaagttatgcaaagaatgttgaacgaagatgaattgagaaacgccgcttggttggtgttcgctaacaagcaagatttgccagaagccatgtctgctgctgaaatcactgaaaaactaggtttacattctattagaaaccgtccatggtttatccaagccacgtgtgctacctccggtgaaggtttgtatgaaggtttggaatggttaagtaacagtttgaaaaactcaacttaa

SEQ ID NO: 25238 - DNA, 1134 bp, Saccharomyces cerevisiae
atggatatggaaattgatgaccctatgcatggttcagatgaagatcaattatcaccgactctcgacgaagacatgaatagtgatgacggcaaaaataatacgaaggcgcgttctaatgacgaagacacagatgaagagttggaagattttaattttaaaccggggtcctcgggtatagcagatcataaatcctccaaaccactaaaactgaccaatacaaatataaatcagcttgaccaatggattgagcatttgagtaaatgcgagccactatcagaagacgatgtagcacgactatgtaaaatggcggtggacgtgttgcagttcgaggagaatgttaaaccaattaacgtgcctgttaccatttgtggtgacgtacacggtcaattccatgacttgttagaacttttcaagattggtggtccttgtcctgacaccaattaccttttcatgggtgattacgtggatagaggatattattctgttgagaccgtatcttacctagttgccatgaaagtcagatatccacatagaattactatacttaggggcaatcacgagtctaggcagattacccaagtatatgggttttatgacgaatgtttgagaaagtacggcagtgcgaacgtgtggaaaatgtttaccgatctattcgattatttccccgttactgccttggtggataataaaatcttctgtttgcatggaggtctctcacccatgatagagacaatagatcaagttagagatttaaatagaatacaggaagtgcctcacgaaggtccaatgtgtgaccttctatggtccgatcctgatgatagaggcggatggggaatcagtccgagaggtgcaggcttcacttttggtcaagacatcagtgagcaattcaatcacactaatgacctatcactaatagcaagagctcaccaattggtaatggaaggatattcttggtctcaccagcaaaatgttgtcaccattttcagtgctccaaattattgttatagatgtggtaaccaggccgctattatggaggtggatgaaaaccataataggcaattcttacaatacgatccatctgtgagacccggtgaaccaaccgtcaccaggaagacaccggattatttcttataa

SEQ ID NO: 25239 - DNA, 3216 bp, Saccharomyces cerevisiae
atggctggtgcaattgaaaacgctcgtaaggaaataaaaagaatctcattagaagaccatgctgaatctgaatatggtgccatctattctgtctctggtccggtcgtcattgctgaaaatatgattggttgtgccatgtacgaattggtcaaggtcggtcacgataacctggtgggtgaagtcattagaattgacggtgacaaggccaccatccaagtttacgaagaaactgcaggccttacggtcggtgaccctgttttgagaacaggtaagcctctgtcggtagaattgggtcctggtctgatggaaaccatttacgatggtattcaaagacctttgaaagccattaaggaagaatcgcaatcgatttatatcccaagaggtattgacactccagctttggataggactatcaagtggcaatttactccgggaaagtttcaagtcggcgatcatatttccggtggtgatatttacggttccgtttttgagaattcgctaatttcaagccataagattcttttgccaccaagatcaagaggtacaatcacttggattgctccagctggtgagtacactttggatgagaagattttggaagttgaatttgatggcaagaagtctgatttcactctttaccatacttggcctgttcgtgttccaagaccagttactgaaaagttatctgctgactatcctttgttaacaggtcaaagagttttggatgctttgtttccttgtgttcaaggtggtacgacatgtattccaggtgcttttggttgtggtaagaccgttatctctcaatctttgtccaagtactccaattctgacgccattatctatgtcgggtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattgcggagaaagaggtaatgaaatggcagaagtcttgatggaattcccagagttatatactgaaatgagcggtactaaagaaccaattatgaagcgtactactttggtcgctaatacatctaacatgccggttgcagccagagaagcttctatttacactggtatcactcttgcagaatacttcagagatcaaggtaaaaatgtttctatgattgcagactcttcttcaagatgggctgaagctttgagagaaatttctggtcgtttgggtgagatgcctgctgatcaaggtttcccagcttatttgggtgctaagttggcctccttttacgaaagagccggtaaagctgttgctttaggttccccagatcgtactggttccgtttccatcgttgctgccgtttcgccagccggtggtgatttctcagatcctgttactactgctacattgggtatcactcaagtcttttggggtttagacaagaaattggctcaaagaaagcatttcccatctatcaacacatctgtttcttactccaaatacactaatgtcttgaacaagttttatgattccaattaccctgaatttcctgttttaagagatcgtatgaaggaaattctatcaaacgctgaagaattagaacaagttgttcaattagttggtaaatcggccttgtctgatagtgataagattactttggatgttgccactttaatcaaggaagatttcttgcaacaaaatggttactccacttatgatgctttctgtccaatttggaagacatttgatatgatgagagccttcatctcgtatcatgacgaagctcaaaaagctgttgctaatggtgccaactggtcaaaactagctgactctactggtgacgttaagcatgccgtttcttcatctaaattttttgaaccaagcaggggtgaaaaggaagtccatggcgaattcgaaaaattgttgagcactatgcaagaaagatttgctgaatctaccgattaa

SEQ ID NO: 25240 - DNA, 915 bp, Saccharomyces cerevisiae
atgatttctgactacgatgctcttttgcaattcaacaaaaaacctgtttcgcaagaaatgattcagttcttagccacttctactgcttccataattaaaatcagggaaaataataatccaatccaaggatgtcgcccaccagacttatctatcttcattaaaaacgtggtaattcagtcaaatgttcaaacaccaactttaatggccacatcagtttatttaaacaaactgaaaagcgtaataccaaaaaatgtgtacggtattaacaccacaagacatcggatatttctcggatgcttgatattagctgccaaaactctgaacgattcttctccctggaacaaacactggaccacgtacacagaaggtttactcagaatacgtgaggtgaataccatcgaacgagaactattagaatatttaaattgggatgtgaggataactacaccggatttgattgattctctttcttacttcctcgggcctatcaaggaacaactatttttacaaaggagacaagaaatgctgttgttcaatgcaccaagtcccggccaactgaaagaatatataaatcatagaagaccggtttcgcattctagaacttcttctgctatatcggttccttcactgacatccatggcaacagtttcgacaacagactcaaggtcttctctactggcaaaataccaaccgtccctaccgttggtggaatctgacaacttcaacaaaaaaaatcatgtgccgttaaggaataataacgatatctgtaataatttcagggcagaggaaaacatacactcagtaaaccatattgatgtaacaatgggaagttcaccagtaatgtcgcataagcccacaattcaccaacggttaaattttacaaggaggggctggtcatcgtttttcaagcaataa

SEQ ID NO: 25241 - DNA, 1593 bp, Saccharomyces cerevisiae
atgctaagaaacattttggtgagaagtactggcagcaatttcaaatttgctggcagatatatgaaatcatcagctcttttaggatactatagaagagttaactattattcgaccaagatacaaaccagactgactagcgaaaactatccagacgtgcatcgagaccctagattcaaaaaattaacgtccgatgatctaaattattttaaatctattttatcggaacaagaaatattaagagccagcgaatcagaggatctttcattttataatgaagattggatgagaaagtacaaaggacagtccaagttagtattgagacctaagtcagtggaaaaagtttctttaatcttaaattattgtaatgatgaaaaaattgccgttgtcccacaaggcggtaacacggggttggtaggtggttctgtgcccatttttgatgaattaattctatctttagcaaatttaaacaaaataagagattttgaccctgtatcaggtatcttgaagtgtgatgctggtgtaatcttggaaaatgctaacaattacgtaatggaacaaaattatatgtttccgttggatctgggagctaaaggttcctgccatgttggtggcgtggttgcaaccaacgctggaggactaaggttattgcgttatggctcactacatggaagcgttttaggcttagaggtggtaatgcccaatggtcaaattgttaatagcatgcattccatgagaaaagacaacaccggttatgatctgaaacagctgttcattggctcagaaggtactatcggtatcatcactggtgtttcaatcttgactgttcctaagccaaaagcgtttaatgtatcttacttgtctgttgaaagttttgaagacgttcaaaaagtcttcgtcagagccaggcaagaattatctgagattttatccgcttttgaatttatggatgctaaatctcaagtattggccaagagccaattgaaggatgctgccttccctttggaggatgagcatccattttatattcttatcgaaacgtcagggtcaaacaaagatcacgatgattccaaacttgaaacatttttagaaaacgtcatggaagagggcatagtaacggatggtgtagtggcacaagatgaaaccgaactccaaaacttgtggaagtggagagaaatgattccagaggcaagtcaagctaatggtggtgtttacaaatacgatgtttctttaccactaaaggacctatattctttggttgaagccactaatgcaagactttctgaagctgaattagtgggtgattcgcccaaaccagtggtgggcgccattggatacggtcacgtgggtgatggtaatctacacttaaatgttgcagttagagagtacaacaagaacattgaaaagactttggaaccatttgtctacgagtttgtttcctcaaaacatggttccgttagtgccgaacatgggctaggtttccaaaagaaaaattacattggctattctaagagcccggaagaggtcaagatgatgaaggatttgaaggttcattatgatcctaatggaattttaaacccttacaaatacatttga

SEQ ID NO: 25242 - DNA, 1764 bp, Saccharomyces cerevisiae
atgttgtggaagcgtacttgcacaaggctaataaagcctattgcacaacctagaggaaggctggtgagaagatcatgctacagatacgcctcaacaggcacaggcagcaccgacagcagcagccagtggttaaaatactctgtcatcgcctcttcagctactctattcggttatttgttcgctaagaacctctattctagggagactaaggaagatttgatagagaagctggaaatggtcaaaaagatcgacccagtaaattctacgttaaagctgtcctcattggactcaccagactatttgcacgacccggttaagatcgataaggttgttgaggacctgaagcaggtgctgggaaacaagcctgaaaactactctgatgcgaaatccgatttggacgcccattcagatacctacttcaacacgcatcacccctctcccgagcaaagacctaggattatattattccctcatactaccgaagaagtttccaaaattttgaaaatatgtcacgataacaacatgccagttgtacccttctcgggcggaacgtccttggaggggcacttcctgcctacaagaattggagataccataaccgtagacctgtccaagtttatgaataacgtcgtaaaatttgacaagctggacctggacatcaccgtgcaggccggtctaccctgggaggatttgaatgactatttgagcgaccacggtttgatgtttggctgtgaccctggtccaggtgcacagattggtggttgcattgctaattcttgttcaggaaccaacgcctaccgttacggtaccatgaaggagaatattataaacatgactatagtgttgccggacgggaccattgtcaagacgaagaaaagacccagaaagtcgagcgctggctataacttaaatggtttatttgtgggaagtgaaggtaccttaggtattgttactgaagctactgtcaagtgtcatgtcaagcccaaagctgaaactgttgcggtggtatcctttgatactatcaaggatgcggccgcatgtgcttctaatctgactcagagtggtattcatttgaacgccatggagttactggatgaaaatatgatgaagttgatcaacgcatctgaatccacggacagatgtgattgggtagagaaaccaactatgtttttcaagattggtgggagatctcccaacattgtcaatgctcttgtggatgaagttaaggctgtcgcccagttaaatcactgcaacagttttcagtttgctaaagatgatgacgaaaaattggaattatgggaagctagaaaggtcgcgctatggtctgtgctagacgctgataagagcaaagacaaatcagctaaaatttggacaactgatgtagctgttcctgtgtcgcagttcgacaaggttattcacgaaactaaaaaggacatgcaagctagtaagctgatcaacgccattgttggtcatgcaggtgatggtaacttccatgcattcatcgtctacagaacccctgaagaacacgaaacctgtagccaacttgttgacagaatggtcaagagagcactgaacgcagaaggcacttgcacgggtgaacacggtgttggtattggtaaaagagagtacttgctcgaagaattaggtgaagcacccgtcgatttgatgagaaagattaagctagctattgacccaaagagaatcatgaacccggacaaaatctttaaaactgatccaaacgagcccgctaatgattacaggtga

SEQ ID NO: 25243 - DNA, 1161 bp, Saccharomyces cerevisiae
atgtccgccgctactgttggtaaacctattaagtgcattgctgctgttgcgtatgatgcgaagaaaccattaagtgttgaagaaatcacggtagacgccccaaaagcgcacgaagtacgtatcaaaattgaatatactgctgtatgccacactgatgcgtacactttatcaggctctgatccagaaggacttttcccttgcgttctgggccacgaaggagccggtatcgtagaatctgtaggcgatgatgtcataacagttaagcctggtgatcatgttattgctttgtacactgctgagtgtggcaaatgtaagttctgtacttccggtaaaaccaacttatgtggtgctgttagagctactcaagggaaaggtgtaatgcctgatgggaccacaagatttcataatgcgaaaggtgaagatatataccatttcatgggttgctctactttttccgaatatactgtggtggcagatgtctctgtggttgccatcgatccaaaagctcccttggatgctgcctgtttactgggttgtggtgttactactggttttggggcggctcttaagacagctaatgtgcaaaaaggcgataccgttgcagtatttggctgcgggactgtaggactctccgttatccaaggtgcaaagttaaggggcgcttccaagatcattgccattgacattaacaataagaaaaaacaatattgttctcaatttggtgccacggattttgttaatcccaaggaagatttggccaaagatcaaactatcgttgaaaagttaattgaaatgactgatgggggtctggattttacttttgactgtactggtaataccaaaattatgagagatgctttggaagcctgtcataaaggttggggtcaatctattatcattggtgtggctgccgctggtgaagaaatttctacaaggccgttccagctggtcactggtagagtgtggaaaggctctgcttttggtggcatcaaaggtagatctgaaatgggcggtttaattaaagactatcaaaaaggtgccttaaaagtcgaagaatttatcactcacaggagaccattcaaagaaatcaatcaagcctttgaagatttgcataacggtgattgcttaagaaccgtcttgaagtctgatgaaataaaatag

SEQ ID NO: 25244 - DNA, 576 bp, Saccharomyces cerevisiae
atggaaaaatttggtttaaaagcgctagtaccgctccttaagctagaggacaaagaactttcaagtacatatgaccattccatgaccttaggagcggacttatcgtcgatgctatattcgttgggtattccaagagattcacaagatcacagagtcctcgatacttttcaatcaccgtgggcagaaacatccagaagcgaagtggagccccgatttttcacaccagaatcattcaccaatattccgggcgtattacaatccactgtaactccaccatgcttcaattccatccaaaatgaccaacagcgtgttgccctttttcaagatgaaactctatttttcctcttctataaacaccctggtacagtcatccaggaactaacgtatttggaactcaggaaaaggaactggagataccacaagacgttgaaggcctggctcaccaaagatcctatgatggaacctattgtatccgctgatggtttaagtgaaaggggatcatatgtgttttttgacccacaaaggtgggaaaagtgccaaagagatttcttattgttttataatgctattatgtaa

SEQ ID NO: 25245 - DNA, 2268 bp, Saccharomyces cerevisiae
atgcgcagattactgaccggttgccttctttcatctgcacgtcccttgaaatcaagattgccattattgatgtcatcctcattaccttcctctgccggtaagaagcctaaacaagccactttggctagattcttcacttccatgaaaaataagccaacagaaggtactccttctcccaaaaaatcatccaaacatatgctggaagatagaatggataatgttagtggggaagaggaatacgcgaccaagaaattgaaacagacggctgttacacatactgtagcagctccaagctccatgggtagcaatttttcttctataccatcatccgctccctcttccggtgttgctgattcaccgcaacaatctcagaggttggtaggtgaagttgaagacgccttgagctcaaataataatgatcactattcgtctaatatcccctattctgaagtttgtgaggtttttaacaagattgaggccatatcttcccgtttagagattataagaatctgttctgatttctttattaagataatgaagcaatcgtctaagaacttaatacctacaacataccttttcatcaatagattgggccctgactacgaagcaggcttggaattaggccttggagaaaatcttcttatgaaaaccataagcgaaacttgcgggaaatccatgagccaaattaaacttaaatacaaggatattggggatttgggtgaaatagcaatgggtgcgagaaatgtccaacccactatgtttaagcccaaacccttgaccgtgggtgaggtcttcaaaaatcttagagctattgctaagactcagggcaaagattcacaattaaaaaagatgaagctgatcaagagaatgcttactgcttgcaaaggtatagaggctaagtttttgattagatccctagagtcaaaattgagaatcggtcttgctgaaaagactgtcttaatatccctatcgaaggctcttttgctccatgatgaaaatagggaggactctccagacaaagatgtccccatggatgtgttagaaagtgctcaacaaaagataagagacgcattttgtcaagtacccaactatgaaattgttataaactcatgcctggaacacggtattatgaatttagataaatattgtactctaagaccaggaattccattgaaacccatgttagccaagcctaccaaggcaattaatgaagtattggatagatttcaaggcgaaacttttacgtcagaatacaaatacgatggtgaaagggctcaggtgcatttactaaatgatggtacaatgaggatttattccagaaatggcgagaatatgactgagagatatccagaaattaacataacggattttatccaggatttggatactaccaaaaatttaattctagactgtgaggctgttgcttgggacaaagatcaggggaaaattttgcctttccaggtcttaagtacaaggaaacgtaaagacgtggagctgaatgatgttaaagttaaagtctgtctctttgcatttgatatactttgctacaacgatgaaaggctgattaataagtcactaaaggaaagaagagaatacttgacgaaggttacaaaagttgtcccgggagaattccaatacgcgactcagataacaacaaataaccttgatgaacttcaaaaattccttgatgagtccgttaatcactcatgcgaaggtttgatggtcaaaatgttggagggccctgaatcccattatgaaccaagtaaaaggtcaagaaactggttgaaattaaaaaaagattacttggagggggttggagattcattggatctctgcgtgttgggggcatattatggtagaggaaaaagaactggtacgtacggtgggttccttctaggatgttacaaccaagacacaggagaatttgaaacttgttgcaagatagggacaggattttcggacgaaatgttgcagcttttgcacgacaggttgaccccgacgatcattgatggaccaaaagccacgtttgttttcgattcgagtgctgagccagatgtatggttcgaacctacgactttgtttgaagttttgactgcagacctttccctatcgcctatttataaagcaggtagtgcaacttttgataaaggcgtatccttaagatttccaagatttttgcgtataagagaagacaagggcgtagaagatgcaacctcttctgaccagatcgtcgaattgtatgaaaaccaatcccacatgcaaaattag

SEQ ID NO: 25246 - DNA, 1521 bp, Saccharomyces cerevisiae
atgggttccatcaataataacttcaacactaataataacagtaatacggatctcgatcgggactggaaaactgcattgaatattcccaagaaggataccagaccacagacagatgatgtcttaaatacaaagggtaatacttttgaagatttttatttgaaaagagagctgttaatgggtatttttgaagccggttttgaaaaaccatcccctattcaagaagaggctattccggtagcaataactggtagagacatattggccagagcaaagaatggtacaggtaagacagccgcatttgttattcctacgttagagaaagtcaaaccaaagttgaataaaattcaggctttgatcatggttcccacaagagagttagctctgcaaacttcccaagtcgtccgtacattgggaaaacactgtggtatttcatgtatggtgaccactggtggtaccaatttgagagacgatattctaagattaaatgaaacagtccatattttggttggtactcctggtagagtgttggatttagcttcgagaaaagtagcagatctgtctgattgttcattattcatcatggacgaagccgataaaatgttatctcgtgacttcaagacaataattgaacaaatcttatccttcttacctccaactcaccaatctttattatttagcgctactttcccactaacggttaaggaattcatggttaaacatctgcataagccttatgaaattaatttgatggaagaattgactctaaagggtattactcaatactacgcctttgttgaagaaagacaaaagctacattgtttaaatactttattctctaagcttcaaattaatcaagccattattttttgtaattctactaaccgtgtcgaattactagccaagaaaatcactgatttaggctattcctgttattactctcatgcaagaatgaagcaacaagaaagaaataaagttttccacgaatttcgtcaaggtaaggttcgtacattggtctgctccgatttattgacccgtggtatcgatattcaagccgttaatgtcgttatcaatttcgatttccccaaaacggcagaaacatatttacatcgtattggtagatccggtaggtttggccacttgggtttagcaatcaatttgattaactggaatgatcggtttaacctttataaaatcgaacaagaactgggcactgaaattgcggctattccggccactatcgataagtcattgtatgtggctgaaaatgacgaaacggtacctgtcccattcccgatagagcaacagagctatcatcaacaagcgatacctcagcaacaattaccatctcagcaacaatttgctattcctccgcagcaacatcatccacaattcatggttcctccttcgcatcagcaacaacaggcgtatcctccaccgcaaatgccatcgcagcaggggtatcctccacagcaggaacatttcatggcgatgccacctggtcagtcacaaccccagtattaa

SEQ ID NO: 25247 - DNA, 1548 bp, Saccharomyces cerevisiae
atgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgttttagttctgtcttctctatcacaatccccgtgtgtatcatcatcatcatctttgtccacgccatgcattatagatgcgtacagtaataatttcggattatcgccatcatccacgaattctactccctctacgattcagggattgtccaatattgcaacaccagttgaaaacgaacattcgatatcactaccacctttggaggaaagcctatcgccagccgcagcagatctgaaagatacgttgtcgggaacttcaaatggtaattatatacaactccaggacttggttcagttggggaaaattggtgctggaaattctggaactgtggtgaaggcactacatgttcctgattccaaaatagttgccaaaaaaaccattcctgtggaacagaataacagtacaatcatcaaccaattagttagggaattatctatcgtcaaaaacgttaagccccatgaaaacattatcaccttctatggagcttattataaccagcatataaataatgaaatcataattttaatggaatactctgattgtggttctttagataaaatactgtccgtttataaaaggtttgttcaaagagggactgtttcgagtaagaaaacctggttcaacgaattaacaatatcaaaaatagcgtatggcgtactaaatggcttggatcatttgtaccgacaatataagatcattcatcgtgatatcaagccttccaatgttctgattaatagtaaggggcagattaagttatgtgattttggagtttccaaaaaactaataaattctatcgctgatacatttgttggaacgtccacttatatgtcaccagagaggatacaaggaaacgtttattctatcaaaggggacgtttggtcattgggcttaatgatcatcgagctggtaactggagagtttcccctaggtgggcataacgatacacctgatggcatattggatttgctgcaacgtattgtcaacgagccttcaccaagattacccaaagaccgtatctattccaaggaaatgacagattttgtcaataggtgttgtattaagaatgaaagggaaaggtcatcgattcatgaattgctacatcatgatcttataatgaaatacgtatcaccgtctaaagatgataaatttagacattggtgtagaaaaataaaatctaaaataaaggaagacaagagaattaaaagagaagccttggaccgtgccaagttagaaaagaaacaatcggaaagatcaacccattga

SEQ ID NO: 25248 - DNA, 1284 bp, Saccharomyces cerevisiae
atgcatcataactcacagtctttgagctctggacacatcaggagccccgaggatgaaaatgtggcacctataggtaatcttaaacacaggactggatccctcagtcatatttcatctgcgcacccgagggtcgcacttagcgacgttaccaatatagttgcgacaaactctagcaacaacagcataagtaagccaaaagtcgccccaattaaagaaagattggattcagctgcgataattgaggaagaaaggctggatgcgaatagtgttgcacagagaaaagaagctgatcataacgatttgttaacggacagggaacaagaggaacccgttgaagacgacggagaaagcgaagaggatgaagaagaagaccaggagcctctactgttgcaacattatgctagtgatacattggtctgggagcatgcatttagaacttactatagaactacattagatcccaatgatgatgacgtgtacgatgtggtcatggttgccgaattatctaatgagatattcgagtatatgaggaaattggaagacctgtataaacccaacccgtactacatggataaacaaccagagttaagatggtcgtttcgaagcacactgattgattggatcgtccaagtacatgaaaaatttcaacttttacctgaaactctatatctctgcattaatataatagacagatatctgtgcaaagaagttgttcctgtaaataagttccaacttgtgggtgcagcctcactcttcattgctgctaaatatgaggaaatcaactgtcctacaatcaaggatttcgtatacatgtcagaaaactgctactcaaggaacgacctgctggacgcagaaagaactattttgaacggcttagaatttgaattgggttggcctggtccgatgtcatttttacgaagaatcagtaaggcagacgattacgagcatgatacgagaacactggccaaatatctattggaatccacaataatggaccatcgactggtttccgctcaacctagttggttagctgccggtgcatactttctaagtaagattattctgggccaaaatcagtggtctctggcgcacgtctactattccaattatacacaagaacaaattcttccgttggccaccattattttagaaaattgcagatatgcctctaaacgtcataacgccatatggagaaaatattcttcacgtcgttatttgcattcttcacagatcgtagcgaagtggatagcattagctgaacacagagtagaaagatctaactaa

SEQ ID NO: 25249 - DNA, 2706 bp, Saccharomyces cerevisiae
atgtcccatgaatggctcataagcgcatcggaaacaatgagaagcattggtaatggggaaggtttgcgggataaaggtgctgtcgttgccaacaatgacggagaatttaacgaaggtgatacaaatcgtgaagaggatagctctaccattttctccttcgattttgacgaggagattgtaatgtgtattgacttttctggaggaaaactcgggtgttctattttagattatcataccaagactttgaaagcgtttgaccaggactacgtggtcaataaaacaacaatttcgtctcatgatcttatcgatgatgcagatatgtcttcaaacgacataagtctgttacttggacttttaataatggaagcaaacccaactgtatgcctagtgccggcaagattggaggattggattttcgactacattaagacaaaatgcgatgagataaactgtaggctagaactacaaccaataaaacgtttcaaaaaatgggacttattgcagtcattgcagttaaggggtcatgataatcagactatattgaacgacatattatcaaatagcaaatttaccaccacagtcaccttaggtacagtgggatgcatccttgcaaatcatgaacaacttggtgaatacaatgacagtactgcttcaagtaatatggtaacaggacgattagttcagaatgcttttgaagatgtgatacatggcataaggtatatcgacataagggatcggatggtactggatgaaaatactatatcggctttgcatatttttccaacagctcataaactgggccatgataagatgatgagaaatggtttctttagtgtatttgaactattcaatcaagtgtcttcggactacgccaggagaattttgaagtcttggcttattaacccattaaccaataaaaaacggatagaaacaagatacagcatcataagaaccttattggataaacaaaacgccatcatttttagtgaccttagccaatcaataaaaagatgtccagacgcttttgggtttataaatcagttaagaagtggtaaatcgacattagggacatggtccaaggttgcaagttttttagaaaaaggaatagctatatttcaactggtgtcgtccttgaaattaggttcagacgaagccaacattttacatgatatcaaaaataaggttgatatatcagctttaaaggaatgtttgagaaaagtagaaacggtaatagattttgacacatcaagagataccaagacgctcacgataaatacgggggttgacaacagattagacgaatgcagaaatatttataatcatttggaagggatcttactggatgtcgcaagagaaactcaaatttttttactgaatactatgcctcaagaagattgtaagacaacaaagagtttagaaaagttagtgaatgctgtttatattccccaattaggatacttagtaaccattagcgtcttaatggaacctttattggatggcattccaaaccttcaatgggaagagatctttaggagttcagaaaatatatacttcaaaaatggcagggttcttgagctggatgaaacatacggcgatatttatggcgcgatttcagattttgaaattgaaatcctgttttccttacaagaacaaattctgagaagaaagactcaactcactgcttacaatatactgcttagtgaactggaaatattattatcgttcgctcaagtgtctgctgaaaggaattatgcagagcctcaattggtggaagatgagtgcatattggaaattattaacggaagacatgctttgtatgaaacattccttgataattatatccccaatagcacaatgattgatggcgggctattttctgaattaagttggtgtgaacaaaataaaggaagaatcattgtagtcactggcgctaatgcatctggaaagtctgtatatcttacacagaatggtttaattgtgtacttggcacaaattggttgttttgttccagcagagagagcgagaattggaatagcggataaaatattaactagaatcaggactcaagaaactgtttataagactcaaagttcctttttgctagattctcaacaaatggcaaaatcactgagtttggccactgaaaaaagtctcattttaattgatgaatacggcaaaggtactgatattttagatggaccttcactatttggttccataatgctcaatatgtccaagagtgaaaaatgtccacgcataatcgcatgtacacactttcatgaactatttaacgaaaatgtactcacagagaatataaaaggtatcaaacattactgcactgatatacttatcagccaaaaatataatcttttagaaacagcacatgtcggagaagatcatgaaagtgagggaatcacattcctattcaaagtaaaggaggggatctcaaagcagtcatttggcatatattgcgcaaaagtatgtggtttgagcagagatattgtggaaagggctgaagaactatctcgcatgattaatagaggcgatgacgtagttcagcaatgtggaaatctgaccgaaaaggagatgagagaattccaaaagaatcaggaaatagtgaaaaagtttttatcttgggatttggatctcgaaactacaacaacttccgagaatctcaggcttaaattgaaaaatttccttcgctaa

SEQ ID NO: 25250 - DNA, 1587 bp, Saccharomyces cerevisiae
atgtctgctaaagttccatctaacgccacgtttaagaacaaggaaaaacctcaagaggttcgcaaagccaacatcatcgctgcacgttctgttgcagatgccatccgtacttcattgggtcccaagggtatggacaagatgattaagacatctcgtggagaaatcatcatctctaatgatggccacaccattctaaaacagatggccattctgcatccggtggccagaatgctagtagaggtttctgccgcgcaggactcggaagccggtgatggtaccacttctgtggtgatcttgaccggagctctattgggtgctgctgagaggctgttaaacaagggcatccatccaaccatcattgcggactcctttcaaagtgctgcgaagagatctgtcgatattcttttagaaatgtgccataaggtttcgttgagcgatagagaacagctggttcgtgctgcatccacttctttgagttccaagattgtgtctcaatactcttcgtttttggcgcccttggcagtggactccgtattgaagatatctgatgaaaactctaagaatgttgacctgaacgatatcagactggtcaaaaaagttggtggtaccattgatgacacagaaatgatagatggtgtggtcttgacacaaacggcaatcaaatctgctggtggtccgacaagaaaggaaaaagcaaagattgggttaattcaattccaaatatctcctccaaagcccgacacagaaaataatatcatcgttaatgactatagacaaatggataagatccttaaagaagaaagagcgtatttgctaaatatctgtaaaaaaattaaaaaggccaagtgtaacgtgctgttgattcagaaatccatcttgagagatgcggtaaatgatttggctcttcatttcttgtcaaaattgaacataatggtggtaaaggatatcgagagagaagaaatcgagtttctgtcgaagggcttgggttgtaagccaattgctgatatagaattgttcaccgaagatagattgggttccgctgatttagttgaggagatcgatagcgatggttccaagatagttagagtaactggtataagaaacaataatgcaagaccaaccgtctctgttgttattcgtggtgcaaacaacatgatcattgatgaaacagagcgttccctccatgatgcactatgtgttattcgttgtctagtgaaagagagaggtttaatcgctggtggtggtgctccagaaattgaaatatcccgtaggttgagtaaggaagcaaggtctatggaaggtgtacaggcttttatttggcaagaatttgcctctgctttggaagttattccaacgactttggctgaaaacgcaggtttgaatagtatcaaagttgtcacagaattgcgctctaagcatgaaaatggtgaattgaatgacggtatctctgttagacgatctggtactacgaacacctatgaagaacacatcttacaacccgtacttgttagtacaagtgcaattaccttagcgtctgaatgtgttaaatccatcttacgtattgatgatattgcattcagccgttaa

SEQ ID NO: 25251 - DNA, 5202 bp, Saccharomyces cerevisiae
atggtaggacaacagtattctagtgctccactccgtacagtaaaagaggtccaattcggtcttttctcacctgaagaagttagagcaatcagtgtggccaaaattagatttccagagacaatggatgaaacccagacgagagcgaaaattggtggtctaaacgaccctaggttaggctctattgatcgtaatctgaagtgtcaaacttgtcaagagggtatgaacgaatgtcctggtcattttggtcacatagatttagcaaaacctgtatttcatgttggttttattgccaaaattaagaaagtatgtgagtgtgtctgtatgcactgtggtaagctattactggatgaacataatgaattaatgagacaagctctagcaatcaaagacagtaaaaaaaggtttgctgcaatttggactttatgtaaaacaaaaatggtctgcgaaacagatgtcccttctgaagatgatcctactcagctcgtatcaaggggaggttgtggtaatacacagcctacaattcgtaaggatgggttgaaattagttggtagttggaaaaaagatagagccacgggggatgcggatgaaccagaactaagagttttaagtacggaggaaatcttgaatatttttaagcatatctcagtaaaagacttcactagtttgggtttcaacgaagttttttctcgtccagaatggatgattttaacatgccttcctgtcccaccaccaccggtgcgtccatccatttccttcaatgaatctcaaagaggtgaggatgatttaacctttaaacttgctgatattttaaaagctaatattagtttggaaacactagagcataacggtgctccacatcatgctattgaagaagcagagagtttattacaatttcatgttgccacttatatggataatgatattgctggtcaaccacaagctcttcaaaagtccggccgtcccgttaaatctattcgtgctcgtttgaagggtaaagagggtcgtatcagaggtaatttaatgggtaagcgtgtggatttttcggcaagaactgttatttctggtgatcctaatttggaattagaccaagtcggtgttccaaaatctattgccaagactttaacatacccagaagtggtcacaccatataacatagatcgtctgacgcaacttgttaggaatggaccaaatgagcaccccggtgccaaatacgtcattcgtgatagcggagaccgtatagatttaagatacagtaaaagggcaggtgatattcaattacagtatgggtggaaagttgaacgtcatattatggacaatgatccagttttattcaaccgtcaaccttcgttgcacaaaatgtccatgatggcccacagagtaaaagttattccatattctacatttagattgaatttgtccgttacatctccatacaatgccgatttcgacggtgacgaaatgaatcttcacgttcctcagtctgaggaaacaagggcggaactttctcaattatgtgctgttcctctgcaaattgtttcaccacaatctaacaaaccttgtatgggtattgttcaagatactttgtgtggtattcgtaaactgacattaagagatacatttatagaacttgatcaagttttgaatatgctttattgggttccagattgggatggtgttattccgacacctgcaattatcaagcccaaacctttgtggtccggtaaacaaatcttgtctgtggctatcccaaacggtattcatttacaacgttttgatgagggcactactctgctttctccaaaggataatggtatgcttattattgacggtcaaatcatttttggtgtagtagagaaaaaaaccgttggttcctccaatggtggtttaattcatgttgttacgagagaaaagggacctcaagtttgtgctaagttgtttggtaacatacagaaagttgttaacttttggttactacataatgggttttcaacaggtattggtgataccattgcggacggcccaacaatgagggaaattacagagacaattgcagaggctaaaaagaaagttttggatgttacgaaagaagcccaggcaaacttattgactgctaaacatggtatgactctccgtgagtcttttgaggataacgttgttcggttcctaaatgaagcaagagataaggcaggtcgtttagctgaagtcaatttgaaagatttgaacaatgtgaaacaaatggttatggcaggttccaagggttcatttattaatatcgcgcaaatgtcagcttgtgtaggacagcaatctgttgaaggtaaacgtattgcttttgggttcgttgatcgtaccttacctcatttctctaaagatgattactccccagagtctaaaggttttgttgagaactcatatttgagaggtttgaccccacaagaattttttttccatgcaatgggtggtcgtgaaggtcttatcgataccgccgtcaaaacagccgaaacaggttatattcaacgtcgtttagtgaaagctctagaagatatcatggttcattacgataacaccacaagaaactcattgggtaacgttattcagtttatttatggtgaagatggtatggatgctgcgcatattgaaaagcaatcgctagatactattggtggctccgatgcagcttttgaaaagagatacagagttgatttattgaatacagaccatacccttgatccctcactattggaatccggatctgagatacttggcgatttgaaacttcaagttctcctggatgaagaatacaaacaattagtgaaagatcgtaaatttttgagggaagtttttgttgatggtgaagcaaactggccattaccagtcaacataagacgtattattcaaaatgctcaacaaactttccacatagatcatacgaaaccatctgatttaacaatcaaagacatcgttcttggtgtaaaggatttgcaagaaaacttattagtgttgcgtggtaagaatgaaattatacaaaatgcccagcgagatgcagttacattgttctgctgtttattacgttcccgtttggccacacgtagagttctacaagagtacagactaacaaaacaggcattcgattgggtattaagtaatatcgaggcacaattcctccgttctgttgttcaccctggtgaaatggttggtgttctagcagcccaatccattggtgaaccagccacacaaatgacccttaacaccttccattttgctggtgttgcttccaaaaaagttacttctggtgtcccccgtttaaaggaaattttgaatgtggccaaaaacatgaaaaccccttccttgactgtatacttagagcctggtcatgctgccgatcaagaacaagcgaagttgatcagatctgctatcgagcataccactttaaagagtgtcactattgcttcagaaatttactatgatcctgatccacgttccacagttattccagaagatgaagaaattatccaacttcatttctcattattggatgaagaggctgaacaatcttttgaccaacaatcaccttggttattacgtctggaactggatcgtgcagcaatgaatgataaagacttaacaatgggtcaggttggtgaaagaatcaagcaaacattcaaaaatgatttgtttgttatctggtctgaagacaacgatgagaagttgatcatccgttgtcgtgttgttcgtccaaagtcactagatgctgagactgaagcagaagaagatcatatgttgaagaaaattgagaacacaatgttagagaatattacattacgtggtgtagagaacatcgagcgtgttgtcatgatgaaatatgaccgtaaagtaccaagtccaactggtgaatacgttaaggaacctgaatgggtgttggaaacagatggtgttaacttatctgaagttatgactgttcctggtatcgacccaaccagaatctataccaactccttcattgatataatggaagttctaggtattgaagctggtcgtgcagccttgtataaagaagtttacaatgttattgcttctgatggttcgtatgttaactaccgtcatatggctttgttagtcgatgttatgacaacccaaggtggcttaacttctgttactcgtcatggtttcaacagatcaaatacaggtgccttaatgagatgttcatttgaagaaactgtcgaaattttgtttgaagctggtgcttcagccgaattagatgattgtcgtggtgtttcggaaaatgtcattcttggtcaaatggctccaatcggtaccggtgcatttgatgtgatgatcgatgaggagtcactggtaaaatacatgccagaacaaaaaataactgagattgaagacggacaagatggtggcgtcacaccatacagtaacgaaagtggtttggtcaatgcagatcttgacgttaaagatgagctaatgttttcacctctggttgattcgggttcaaatgacgctatggctggaggatttacagcgtacggtggtgctgattatggtgaagccacgtctccatttggtgcttatggtgaagcacctacatctcccggatttggagtctcctcaccaggcttttctccaacttccccaacatactctcctacctctccagcgtactcaccaacatcaccatcgtactcaccaacatcaccatcgtactcgccaacatcaccatcgtactcacctacatcaccatcgtattcaccaacgtcaccatcatattcgccaacgtcaccatcatattcgccaacgtcgccatcgtattctccaacgtcaccatcgtattcgccaacgtcgccttcctactctcccacgtcgccaagctacagccctacgtctccttcttattctcctacatctccatcatactctcctacgtcaccaagttacagcccaacgtcaccaagttacagcccaacgtctccagcctattccccaacatcaccaagttatagtcctacatcgccttcatactctccaacatcaccatcctattccccaacatcaccttcttactctcccacctctccaaactatagccctacttcaccttcttactccccaacatctccaggctacagcccaggatctcctgcatattctccaaagcaagacgaacaaaagcataatgaaaatgaaaattccagatga

SEQ ID NO: 25252 - DNA, 2292 bp, Saccharomyces cerevisiae
atgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcttcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataa

SEQ ID NO: 25253 - DNA, 546 bp, Saccharomyces cerevisiae
atgggtctatacgcttctaagttattcagcaatctttttggcaacaaagagatgcgtatacttatggttggtctagatggtgccggtaagaccaccgttttgtacaagttgaagttgggcgaagttatcactaccattccaaccattggtttcaacgttgagactgtccaatataagaacatttccttcactgtctgggacgtcggtggacaagacaggattagatctttatggagacactactacagaaacaccgaaggtgttatttttgtcatcgattccaacgatagatcgcgtattggtgaagccagagaagtcatgcagagaatgctgaatgaagatgaattgagaaatgctgtctggttagtcttcgctaacaaacaagatttgccagaagccatgtctgctgctgaaatcaccgaaaaattaggtttacattctattagaaaccgtccatggtttatccagtctacttgtgcaacctcgggtgaaggtctgtacgaaggtctggagtggttaagcaacaacttgaagaatcaatcctaa

SEQ ID NO: 25254 - DNA, 609 bp, Saccharomyces cerevisiae
atggccgaagaaagtaccgactttagtcaattcgaagaggagagaaacaacgatcagtataaagtttcagccaaaaaaactgttgacgaatacaaaaatctggatgctgaagacgaatccttggcgaaatggaaagagtctttgggtctaagttcagacgtcttgccattggaatttcccggtgacaaaaggaaggtggttgttcaaaaaattcaattactagtcaatacagaaccaaatcctatcacatttgatcttaccaacgaaaagacaatcaaagaactggcatctaaaagatacaaaattaaagaaaattctatttataagttgaagattgtgttcaaagttcaacatgaaattatcacagggttgcgatatgtccagtatatcaaaaaagcgggtattgccgttgacaagatagacgatcatttgggatcgtatgctcctaataccaagaccaaaccattttatgaggtggaactaccggaaagtgaagcacctagtgggtttttagcaagaggtaactacagtgccgtatcaaaattcattgatgatgataaaactaaccacttgactttaaattggggggtcgaaattgtcaaaaaataa

SEQ ID NO: 25255 - DNA, 1110 bp, Saccharomyces cerevisiae
atggatacagatttagatgtgcctatgcaagatgctgttaccgaacagctgactcccacagtatctgaagatatggatctcaacaacaattcatcggataataatgcagaagaattctcggttgatgatttaaaacctggttcctcgggcatagcagatcacaaatcttccaaaccactagaactgaataacacaaatataaatcagcttgaccaatggattgagcatttgagtaaatgcgagccactatcagaagacgatgtagcacgactatgtaaaatggcggtggacgtgttgcagttcgaggagaatgttaaaccaattaacgtgcctgttaccatttgtggtgacgtacacggtcaattccatgacttgttagaactttttaagattggtggcccttgtcctgacaccaattaccttttcatgggtgattacgtggatagaggatattattctgttgaaactgtatcttacctagttgccatgaaagtcagatacccacatagaattacgatactgagaggcaatcacgagtctaggcagattacccaagtatacgggttttatgatgaatgtttgagaaagtacggcagtgcaaacgtgtggaaaatgttcacagatcttttcgattattttcctataaccgcattagtagataataaaattttctgtctgcatggaggactttcccccatgatagaaaccatagatcaggtgagagagttgaacagaatacaggaagtgcctcatgaaggtcctatgtgtgaccttctatggtcagaccctgacgatagaggcggatggggaatcagtcccagaggtgcaggcttcacttttggacaagatgtcagtgagcaattcaatcacactaatgatctatcactaatagcaagagctcaccaattggtaatggaaggctatgcttggtctcaccagcaaaatgttgtcaccattttcagtgctcctaattactgctacagatgtggtaatcaagcagctatcatggaagtggacgagaatcataatagacaattcttacagtacgacccatccgtaagaccaggtgaacctagcgtcagcagaaagacgccagattactttttatga

SEQ ID NO: 25256 - DNA, 2448 bp, Saccharomyces cerevisiae
atgtctgagactctgcctagatctgatgatttagaggccacttggaactttatagagccaggaattaaccaaatactgggtaatgagaaaaaccaagcatccacgtctaagcgagtttacaaaattctttctccaaccatgtatatggaagtctataccgcaatttataactactgtgtgaacaaatcacgctcgtctggacattttagtactgacagtagaactggccaatcaacaattttggttggcagtgagatttacgaaaagttaaagaattatttgaagaattacattttaaattttaagcagtctaattcagagacctttttgcagttttacgtcaagcgctggaaaaggtttacaataggtgccatttttttaaaccatgcattcgattatatgaatagatattgggttcaaaaggaaagaagtgacggcaaaaggcatatttttgatgtaaacaccttgtgcttgatgacatggaaagaagtcatgtttgatccgagtaaagatgttttaataaacgaattattagaccaggtaaccttgggaagggaggggcaaataattcaaagaagtaatattagcactgccataaagtctttagttgcactaggtatcgatccacaggatttgaaaaagttgaacctaaatgtctacatccaagttttcgaaaagccatttttaaagaagactcaggagtactacacgcaatatacaaacgattatttagagaaacactcggtaactgagtatatttttgaagcacatgaaatcatcaaacgtgaggaaaaagcaatgacaatatattgggatgatcatacaaaaaaaccactatccatggcattaaacaaggtcttgatcacagaccatattgaaaagttggaaaatgagtttgttgtccttctggatgccagagatattgaaaaaattacttctttgtacgcactaatacgcagagactttacattaatcccaagaatggcttcagtgtttgaaaattatgttaaaaagacaggtgagaatgaaatttcgagtctactggcaatgcataaacacaatattatgaaaaacgaaaacgcaaaccctaaaaaactagcactaatgacagctcactccctttctcctaaagactatatcaagaaattactggaagtacacgatatattctctaagatttttaatgaaagtttccccgacgacatacctttagctaaagctctagataatgcgtgtggtgctttcatcaacatcaacgagttcgcattacctgctggatctccaaaaagtgccacctcgaagacttccgagatgctagctaagtacagtgatatactattaaagaaggccaccaaacctgaagtggcaagtgacatgtcagatgaagatattataacaatattcaaatatttgaccgacaaagatgcgttcgaaactcattatagaagacttttcgccaagcgtttaattcatggcacttcaacatcagcagaagacgaagaaaatattattcaaaggctgcaagcggcaaatagtatggaatatacaggcaagataactaaaatgtttcaagatattagactttccaagatcttggaagacgattttgctgtcgccctgaagaatgaaccagattactctaaagcaaaatatccagatctacaaccatttgtattggcagaaaatatgtggccattttcataccaagaagttgaatttaagctacccaaggaattggtaccatctcacgaaaaattgaaggagtcatacagccaaaagcataatggtagaatattgaagtggctatggccattatgtcgtggcgaattgaaggcagatattggaaaacccggcaggatgccgttcaactttacggtaacactgtttcaaatggcaattttgctactatataacgatgctgatgtattaaccttagaaaatattcaagagggcacgagcttaaccattcagcacatcgcagcggcaatggtaccattcatcaaattcaaactgattcaacaggtcccaccagggctagatgctctcgtgaaacctgaaacacaattcaagctatcacgtccttataaggcgcttaagaccaatattaatttcgctagcggagtcaaaaacgacattctgcaatcgctatccggtggaggccacgataatcacggtaataagttaggaaacaaacgcttgacggaagacgaaagaatagaaaaagaattgaatacagaaaggcagattttcttggaagcttgtattgtgagaataatgaaagcgaaaagaaatctgccacatacaacattggtcaacgaatgcattgcgcaatcacaccaaaggttcaatgcaaaggtttctatggtcaagagagccatcgatagcttaatacaaaagggatacctacagaggggagacgatggtgaatcgtatgcttaccttgcttaa

SEQ ID NO: 25257 - DNA, 840 bp, Saccharomyces cerevisiae
atgtcaaactacgaagccttgctgaaattcaataggaaggctgtatctaaggaaatggtgcaatatctagcatcgaccacagcttccattatcaaaattaagaagacgaatagtatgatagatattgcattgccagcaccaccgttgactaaattcatcaacagactgatcaagcattctaacgttcaaactccgactctgatggctacctctgtatatttggccaaattaagatcaataataccgagtaacgtttatggtatagagaccaccaggcatagaatattcttaggttgcctaatattagctgcaaaaacgttaaatgattcctcccctcttaacaaacactgggccgaatatacggacggccttctcatcctaagggaggttaatactattgaaagggaactattagaatattttgattgggacgtcaccatttccacagatgatttaattacatgtctctcgccattcttgaagcctatcaaagaggagcagttgtacaaatcgcaaagagactgtcgcacgttgaaaaatttttctgctcaagaaaaagacatagtaaacaaaacatccatttcccattcgcgctcatcgtccaatatgtctatcccatctttagcttccacttcgaccctctccacgttggaatctagaagatcgaatttatccaattatagtaacagaatacgaactttgcccgaactacacgaatccaataacattagcgacaagttttctccgcgaacatacaacatagactccaaacacgataacaaggaaataggccaataccgacaattaagccttttaattttagtaaagcgcgccctgtga

SEQ ID NO: 25258 - DNA, 2508 bp, Saccharomyces cerevisiae
atgggtgaagaacataaaccacttttggacgcctcgggtgtcgaccctcgtgaggaggataaaaccgccaccgccattttaagaagaaagaagaaggacaacatgcttttggtggacgatgctatcaatgatgacaattctgtcattgctattaattctaacaccatggacaaattggaattgttccgtggtgacaccgttctcgttaagggcaagaagagaaaagatactgtcttaattgtgttgatcgatgacgaattagaagacggagcatgcaggataaaccgtgtagttcgtaacaatttacgtattaggctgggtgatttagttacaattcatccttgccccgatatcaaatacgctactagaatttctgtgttaccaattgctgatacgatcgaaggtataactggtaatcttttcgatgtttttttgaagccttattttgtggaagcctacagaccagtgaggaaaggcgaccattttgttgtcagaggcggtatgagacaagtcgaattcaaggttgtggatgtcgaacctgaagaatatgccgtcgttgctcaggatactattattcactgggaaggtgagccaatcaacagggaagatgaagaaaataatatgaatgaggtgggttacgatgatattggtggttgtcgtaagcaaatggctcaaattagggaaatggttgaactaccattgagacatcctcagttgttcaaggctatcggtatcaagccaccaagaggtgttttgatgtatggtccccctggtactggtaaaaccttgatggcaagagctgttgctaatgagaccggtgccttttttttcttaattaatggtccagaagtcatgtcaaaaatggctggtgaatcagagtctaacttaagaaaggcctttgaagaagccgaaaagaacgctccagccatcatttttatcgatgaaatcgattctatagctccaaagagagacaagactaatggtgaagttgagagaagagttgtctctcaattgttaactttaatggatggtatgaaggcaagatctaatgttgttgtcattgctgctaccaatagaccaaattcgattgatcccgctttaagaagatttggtagattcgatcgtgaagtcgacattggtatcccagatgctacaggtagacttgaagttctacgtattcacaccaagaacatgaagttggctgatgatgttgatttggaagcattggctgctgaaacacacggttacgtgggtgctgatattgcctctttgtgttctgaagctgccatgcaacagatccgtgaaaaaatggacttgatagatttagatgaagatgaaattgatgcagaggtgctcgattctttaggagtcaccatggacaacttcagattcgcattgggcaattcaaacccatctgcattgcgtgaaaccgttgttgaaagtgtcaatgttacttgggatgacgttggtggcctagatgaaatcaaggaggaattgaaggaaactgtagaatacccagtcttacatccagaccaatacacaaagtttgggttatcaccatcaaagggtgtgttgttctacggtccaccaggtacaggtaaaactttgttagcaaaagctgtagctactgaggtttctgccaactttatctcagtcaaaggtccagaattattgagtatgtggtatggtgaatcggaatctaacatccgtgatatttttgataaggcaagagcagctgcaccaaccgtcgtttttctagatgaattagactccattgccaaggcaagaggtggttccttgggtgatgctggtggtgcttcggatagagtcgtcaaccaactattaacagaaatggatggtatgaatgctaagaaaaatgtgttcgtgattggtgccaccaataggccagatcaaattgatcctgctattttaagacctggcagattggatcaattaatttatgttccattgccagatgaaaacgctagattatctattctaaatgctcaattaaggaaaacaccactagaaccagggctagagttaactgcgattgccaaggccactcaaggtttctctggtgctgatttactctatattgtgcagagggctgctaaatacgctatcaaggattctatcgaagctcacagacaacacgaagctgaaaaggaagtgaaagtagaaggtgaagacgtggaaatgacagatgagggagcaaaggctgaacaagaaccagaagtagatcctgttccatatattacaaaggagcatttcgcagaagctatgaagaccgctaaacgttctgtttcagatgctgaattgcgtcgttatgaagcatactcacagcaaatgaaagcatctagaggtcaattcagtaatttcaactttaatgacgctccattaggtactacggctacggacaatgctaacagtaataatagtgctccaagtggagcaggtgctgcatttggttctaatgcggaggaagatgatgatttgtatagttag

SEQ ID NO: 25259 - DNA, 939 bp, Saccharomyces cerevisiae
atgtcatttcaccaacagttctttaccttgaataatggaaataaaatccccgcaatcgccatcattgggacaggtactagatggtataaaaacgaagaaacggatgctaccttttcgaacagtttggtcgaacagattgtttatgctctgaagttacctggcattattcacattgatgctgctgagatctacagaacatatccagaagttgggaaggcacttagcctcaccgaaaaaccaagaaatgcaatattcttgacagacaagtactcacctcaaatcaagatgtcagattccccagcggatggactagatttagctttgaagaagatgggcactgactatgtcgatctataccttttgcatagcccatttgtttccaaagaggtcaacgggttaagtttggaggaagcctggaaggacatggagcaattgtacaaatcaggtaaagctaaaaatatcggtgtttccaactttgctgtggaagacttgcaaagaattctgaaagttgcggaagtcaagccccaagttaatcaaattgagttcagtcccttcttgcagaatcaaacaccagggatctacaaattttgccaagaacatgatatattggtagaagcatactcgccactaggtcccttacaaaagaaaacagcacaagatgactctcaaccgtttttcgaatacgtgaaagagttatccgagaaatatatcaaatctgaagcccaaattatcctacgttgggtgaccaaacgtggcgtgttgcctgtaaccacctcttccaaacctcaaagaatttctgacgcgcaaaatttattctctttcgacttgacggctgaggaagtcgataagataacggagttgggcttggaacatgaaccgctaagattgtattggaataaattgtacggtaaatacaactacgctgctcaaaaagtataa

SEQ ID NO: 25260 - DNA, 2430 bp, Saccharomyces cerevisiae
atggatttgtttattgaaagcaagataaacagtttattacaatttttatttggttcccgacaggattttttgagaaattttaaaacttggagtaacaacaataacaatctatcgatttatttattaatttttggcatagtagtatttttttataaaaaaccagaccatctaaactacattgttgagagcgttagtgaaatgacaacaaacttcagaaataataatagccttagccgttggttgcccagaagtaagtttacccacttagacgaagagatcttgaaaagaggtggtttcattgctggtttagttaatgatggtaacacttgttttatgaactctgttttgcaatcattggcatcatccagagaattaatggagttcttggacaataatgtcataaggacctatgaggagatagaacaaaatgaacacaatgaagaaggaaacgggcaagaatctgctcaagatgaagccactcataagaaaaacactcgtaagggtggcaaagtttatggtaagcataagaagaaattgaataggaagtcaagttcgaaagaagacgaagaaaagagccaggagccagatatcactttcagtgtcgccttaagggatctactttctgccttaaatgcgaagtattatcgggataaaccctatttcaaaaccaatagtttattgaaagcaatgtccaaatctccaagaaaaaatattcttcttggctacgaccaagaggacgcgcaagaattcttccagaacatactagccgagttggaaagtaacgttaaatcattgaatactgaaaaactagataccactccagttgcgaaatcagaattacccgatgatgctttagtaggtcaacttaaccttggtgaagttggcactgtttacattccaactgaacagattgatcctaactctatactacatgacaagtccattcaaaatttcacacctttcaaactaatgactcctttagatggtatcacggcagaaagaattggttgtttacagtgtggtgagaacggtggcataagatattccgtattttcgggattaagcttaaatttaccgaacgagaatattggttccactttaaaattatctcagttattaagcgactggagtaaacctgaaatcatcgaaggcgtagaatgtaaccgttgtgccctcacagcagcgcactctcatttatttggtcagttgaaagaatttgaaaaaaaacctgagggttcgatcccagaaaagttaattaacgctgtaaaagatagggtccatcaaatcgaagaagttcttgccaaaccagttattgacgatgaagattataagaagttgcatacagcaaatatggtacgtaaatgctctaaatctaagcagattttaatatcaagacctccaccattattatccattcatatcaacagatccgtatttgatccaagaacgtacatgattagaaaaaataactcgaaagtattgtttaagtcaaggttgaatcttgccccatggtgttgtgatattaatgaaatcaatttggatgctcgtttgccaatgtcaaaaaaggaaaaagctgcgcaacaagattcaagtgaagatgaaaacattggcggtgaatactatacgaaattacatgaacgcttcgagcaggaatttgaagacagcgaggaagaaaaagaatacgatgacgcagaggggaactatgcgtctcattacaatcataccaaggatatcagtaactatgatcccctaaacggtgaagtcgatggcgtgacatccgatgatgaagatgagtacattgaagaaaccgatgctttagggaatacaatcaaaaaaaggatcatagaacattctgatgttgaaaacgagaatgtaaaagataatgaagaactgcaagaaatcgacaatgtgagccttgacgaaccaaagatcaatgttgaagatcaactagaaacatcatctgatgaggaagatgttataccagctccacctatcaattatgctaggtcattttccacagttccagccactccattgacatattcattgcgctctgtcattgttcactacggtacccataattatggtcattacattgcatttagaaaatacaggggttgttggtggagaatatctgatgagactgtgtacgttgtggacgaagctgaagtcctttcaacacccggtgtatttatgttattttacgaatatgactttgatgaagaaactgggaagatgaaggatgatttggaagctattcagagtaataatgaagaagatgatgaaaaagagcaggagcaaaaaggagtccaggagccaaaggaaagccaagagcaaggagaaggtgaagagcaagaggaaggtcaagagcagatgaagttcgagagaacagaagaccatagagatatttctggtaaagatgtaaactaa

SEQ ID NO: 25261 - DNA, 924 bp, Saccharomyces cerevisiae
atgactgagcaagcaactaagccaagaaattcatcgcatttgatcgggggctttttcggtgggctaacatctgctgttgcgttgcaacctttagaccttttgaagacgagaatccagcaagacaagaaagctacattatggaaaaatttgaaagagatagacagccctctacagctatggagaggtacattaccttcagcattacgaacatcaataggcagcgccttatatttatcatgtttgaaccttatgcgctcatctttggcaaagaggaggaatgctgtgccttcattaacaaacgattcaaacattgtatataacaagagcagtagcttaccacgattaacgatgtatgaaaatttactaacaggtgcatttgcaagaggtttggtaggttatataaccatgcctatcaccgtcattaaagtccgttatgagtctactctgtacaattactccagtttaaaggaggcaattacccatatatatactaaggaaggactttttggatttttcagagggtttggagctacttgtttaagagacgctccctatgcaggtttgtatgtgctgctatatgaaaaatcgaaacaattactgcccatggtattaccttctaggtttatacattacaatcctgagggaggatttactacttatacctctacaacagtaaatacaacaagcgccgtactatccgccagtttagccaccacagtaacggcaccgttcgacaccataaaaacgagaatgcaattggaaccatcaaaatttaccaactccttcaatacatttacatctatagttaaaaatgaaaatgtgctgaagttatttagcgggttaagcatgaggctggcaagaaaggccttcagtgcaggtattgcgtggggtatatatgaggagttggtcaaaagattcatgtaa

SEQ ID NO: 25262 - DNA, 927 bp, Saccharomyces cerevisiae
atggtacgcaagaataaaataaatagagcgagtggaactacaaaacacctcaaggattttccatcagtcatcctaagtctgcccagctacaacccttccatcctttctaaaaatgcaactgcactaataaccggtggttctagtggactcggatttgaacttgcaaaggaactttccagaagaattaataaagttattgtggcagatattcaatcatttcctacttttgctcaggtagaatataataacattttctactatcaatgcgacataacaagtctagatgaaattaaaaatttgaaaaaagctattgaaagagatcatggcaacattaatataattataaataatgctggtgttgctcacatcaaaaagttagaacatatgacaaacaaggaggtagaacaattgatcgacataaacttaataggtgcttaccgaatcatcagtacatttgcagaagatatgatagacaatagggaaggctttataattaacattgcttcagtcctcggagaactgactcctgcaaggctgacatcgtatggtgcatcaaaaggagcaatgattggttttcacaagtgtatgagcaggcatttcagaagtttgtccacggaatgtaataaaactggaataaaaacactactggtgtgcccgggaaaaatcaaaactaatatgtttattgatgtccctacaccatctaagttattggctcctgacatcataccttcccaactggcactagcgataatctctgcgatggagcataatcatctgcaaacactaaatgccccatattatgtgaacctagttccctttttcaaaactttgagttggccatataggcatctcttaaaacatttcagtggaatggaccatgtaacgtcaaccagcccgcgagcaataaatccgaagagaagtgcataa

SEQ ID NO: 25263 - DNA, 1002 bp, Saccharomyces cerevisiae
atgaaagtgaatatggagtacacaaagggtatgtgggggttatatattgtcgtctttcttttaacattcaataatgatactaacgttgattaatgatgattcatcgcagaaaagaaagttggtgagggtacttatgcggttgtttacttgggttgtcaacactctactggaagaaagattgctattaaggagatcaaaacatccgaatttaaagatggtttagatatgtcagctatccgtgaagttaagtacctccaagaaatgcagcatccgaacgtcatagaactaatagacatatttatggcttatgataatttaaatctcgttctggagttcctaccaactgatctagaggtggtaataaaagacaaatcaatactgtttacaccagcagatattaaggcatggatgcttatgactttgaggggcgtgtatcattgccacagaaatttcattttgcacagggatctgaaaccaaacaatttattattttcacctgatggccagataaaagtagcagatttcggtctagcaagggcgataccggccccacatgagatactgacaagtaacgtcgtaacaagatggtatagagcgccagaattgttgtttggagctaaacattacacatcggctattgatatctggtcagtaggcgttatattcgcggaattaatgctaaggataccttatttaccaggacagaatgatgtcgatcaaatggaagtaacgttcagggccttagggacacctacagatagagattggcccgaagtttcttcctttatgacgtataacaagttacaaatatatccgcccccttcaagagatgaattgaggaaaaggttcattgctgctagcgaatacgccttagattttatgtgtggaatgctaacgatgaacccacaaaagaggtggaccgctgttcagtgtttagaaagtgattatttcaaagaattaccaccaccaagtgacccgtcttcaataaaaatacgtaactga

SEQ ID NO: 25264 - DNA, 3294 bp, Saccharomyces cerevisiae
atgagtgaaaaaagatcccttcccatggttgatgtgaagatcgatgacgaggatactccccagttggaaaagaaaatcaaacggcaatcaatagatcatggtgttggaagtgaacctgtttcaacaatagagattattccgagtgattcttttcgaaaatataatagtcaaggcttcaaagcaaaggatacagatttaatgggtacgcaattagagtctacttttgaacaagacgtatcgcaaatggaacatgatatggccgaccaagaagagcatgacctgtcatcattcgagcgtaagaaacttccaaccgattttgacccaagtttgtatgatatttctttccaacaaattgatgcggaacagagcgtactgaatggtatcaaagatgaaaatacatctaccgtggtaaggttttttggtgtcactagtgaaggacactctgtactttgtaatgttacagggttcaagaactatctttacgtcccagcgcccaattcttccgacgctaacgatcaggagcaaatcaacaagtttgtgcactatttaaacgaaacatttgaccacgctattgattcgattgaagttgtatctaaacagtctatctggggttattccggagataccaaattaccattctggaaaatatacgtcacctatccgcatatggtcaacaaactgcgtactgcgtttgaaagaggtcatctttcattcaactcgtggttttctaacggcacgactacttatgataacattgcctacactttaaggttaatggtagattgtggaattgtcggtatgtcctggataacattaccaaaaggaaagtattcgatgattgagcctaataacagagtttcctcttgtcagttggaagtttcaattaattatcgtaacctaatagcacatcctgctgagggtgattggtctcatacagctccattgcgtatcatgtcctttgatatcgagtgtgctggtaggattggcgtctttccggaacctgaatacgatcccgtcatccaaattgccaacgttgtgagtattgctggcgctaagaaaccattcattcgtaatgtgtttactctgaatacatgctcacccataacaggttcaatgattttttcccacgccactgaagaggaaatgttgagcaattggcgtaactttatcatcaaagttgatcctgatgttatcattggttataatactacaaattttgatatcccttatcttttaaaccgtgcaaaggcgctaaaggtgaatgatttcccatattttggaaggttaaaaaccgttaagcaagaaattaaagagtctgtgttctcttcgaaggcttatggtacaagagaaaccaaaaatgtcaatattgacggccgattacagttggatcttttgcaatttattcagcgtgagtataaactaagatcctacacgttgaatgcagtctctgcgcactttttaggtgaacagaaggaggatgtacattatagcatcatttctgatctacaaaatggcgatagtgaaacaagaagaaggttggccgtttactgtttgaaagacgcctacctgcctttaaggcttatggaaaaactaatggcgttagttaactatacagaaatggctcgtgttacaggtgtgccattttcatatttactagctcgtggtcaacaaattaaagttgtttctcaactatttcgaaagtgcctggagattgatactgtgatacctaacatgcaatctcaggcctctgatgaccaatatgagggtgccactgttattgagcctattcgtggttattacgatgtaccgattgcaactttggatttcaattctttatatccaagtattatgatggcgcacaacctatgttatacaacactttgtaacaaagctactgtagagagattgaatcttaaaattgacgaagactacgtcataacacctaatggagattattttgttaccacaaaaagaaggcgtggtatattaccaattattctggatgaattaataagtgctagaaaacgcgctaaaaaagatctgagagatgagaaggatccattcaaaagagatgttttaaatggtagacaattggctttgaagatttcagctaactctgtctatggttttacaggagcgacggtgggtaaattgccatgtttagccatttcttcatctgttactgcttatggtcgtaccatgattttaaaaactaaaaccgcagtccaagaaaaatattgtataaagaatggttataagcacgatgccgttgtggtttacggtgacactgattccgttatggtaaagtttggtacaacagatttaaaggaagctatggatcttggtaccgaagctgccaaatatgtctccactctattcaaacatccgattaacttagaatttgaaaaagcatacttcccttaccttttgataaataaaaagcgttatgcaggtttattctggactaatcctgacaagtttgacaagttggaccaaaaaggccttgcttctgtccgtcgtgattcctgttccttggtttctattgttatgaataaagttttaaagaaaattttaattgaaagaaatgtagatggtgctttagcttttgtcagagaaactatcaatgatattctgcataatagagtagatatttcaaagttgattatatcaaagacgttagccccaaattacacaaatccacagccgcacgccgttttggctgaacgtatgaagaggagagagggcgttggtccaaatgttggtgatcgtgtggactatgtcattatcggtggtaatgataaactttacaatagagcagaagatccattatttgtactagaaaacaatattcaagtggattcgcgctattatttaactaatcaattacaaaatccaatcattagtattgttgcacctattattggcgacaaacaggcgaacggtatgttcgttgtgaaatccattaaaattaacacaggctctcaaaaaggaggcttgatgagctttattaaaaaagttgaggcttgtaaaagttgtaaaggtccgttgaggaaaggtgaaggccctctttgttcaaactgtctagcaaggtctggagaattatacataaaggcattatacgatgtcagagatttagaggaaaaatactcaagattatggacacaatgccaaaggtgcgctggtaacttacatagtgaagttttgtgttcaaataagaactgtgacattttttatatgcgggttaaggttaaaaaagagctgcaggagaaagtagaacaattaagcaaatggtaa

SEQ ID NO: 25265 - DNA, 1542 bp, Saccharomyces cerevisiae
atgagtttgtccacgaaaagagagcactctggtgatgtaactgactcttcattcaaaagacagcaacgaagtaataagcccagctcagaatacacttgtctgggccatctggtgaacttaatacccggaaaggagcaaaaagtggaaataacaaatagaaacgttactacaatcggtagaagtaggtcgtgcgacgttatattgagtgagcctgacatctcgactttccatgctgagtttcatctactgcaaatggatgtggataatttccaaagaaatttgattaatgttatcgataagagcagaaacggaacttttattaatggtaatcgtttggtgaagaaagactacatccttaagaatggtgacagaattgtctttggcaaaagttgctcctttttgttcaagtacgcatcttcatcttctactgacatcgaaaatgacgatgaaaaggtaagttcagaaagtcgttcatataagaacgacgacgaagttttcaagaaaccgcaaataagtgctacaagtagccaaaatgctacaacgagtgccgcaattagaaaactgaataagacaaggcctgtgtcgttctttgataaatatttattaggtaaagaattaggtgcagggcactacgccctggtgaaagaagccaaaaacaaaaaaactggtcagcaagtagctgtgaaaatattccacgctcagcaaaatgacgaccaaaaaaagaataaacaatttagggaggaaactaacatcctaatgagagtgcaacatccaaacattgtcaacttactagatagttttgtagagccaatcagcaaatctcagattcaaaaatatttggtactggaaaagatcgacgatggcgaactatttgaaagaatcgtcagaaaaacatgtttgagacaggatgaatccaaagctctattcaaacagttacttaccggattgaagtatctgcatgagcaaaacatcattcacagagacatcaagccagaaaatatcttattaaatataacaaggcgcgaaaatccaagtcaagtccaacttggcccatgggatgaagatgaaattgatattcaagttaaaatagcggattttggcctagcaaaatttacaggagaaatgcaattcacaaacacactttgtggtacgccttcttatgtagcgcccgaagtcctcacaaagaaaggatacacatcaaaagtagatctttggagtgctggtgtcatattatatgtctgtttatgtggttttcctccattcagtgatcaattggggccaccttcattgaaggaacagatcttacaagctaagtatgcgttttactctccgtactgggataaaatcgatgactcagtactacatttaatatccaatcttttggtcctaaatcctgatgaaaggtacaatatagatgaagctttgaaccacccttggttcaatgacatacagcaacaaagctcggtctcattagaattgcagcgtttacaaattactgacaataaaatacccaaaacatactcagaattatcttgcctctaa

SEQ ID NO: 25266 - DNA, 1341 bp, Saccharomyces cerevisiae
atgtcacacgaaggtgaagaagatttattggagtactccgataacgaacaagaaattcaaattgatgcctctaaggccgctgaagctggagaaactggcgccgccacttctgcaactgaaggtgataataataacaacactgcagctggcgacaagaaaggttcctatgttggtatccattccaccggtttcaaagatttcttgctaaagccagaactatcaagagccatcattgactgtggttttgaacatccttctgaggtccagcaacataccattcctcagtcaattcatggtaccgatgtcttgtgtcaagcaaagtctggtttaggtaagacagctgtctttgtcttatccactctgcaacaattggaccctgttccaggtgaagttgccgttgttgtcatttgtaatgctagagaactggcctatcaaattcgtaacgagtatttgagattttccaaatatatgccagacgttaagacagcagtcttttacggtggtactccaatttctaaggatgctgaacttttaaagaataaagatactgctcctcacattgttgttgcaactccaggtcgtttaaaagcgttagtgagagaaaaatacattgatttgtcacacgtcaagaactttgtcatagatgaatgtgataaggttttagaagaattagacatgagaagagatgtgcaagaaattttcagagctactccaagagacaaacaagtcatgatgttttcagccacactttctcaagaaattagaccaatttgtagacgcttcttacagaatccattggaaattttcgtcgatgatgaagctaagctaaccttgcacgggttgcaacaatattatatcaaattagaagaacgtgaaaagaaccgtaaattggctcaattattagatgatttggagttcaatcaagtcattattttcgttaaatctaccacaagagctaatgagttgaccaaactattaaacgcctctaactttccggctatcaccgttcatggtcatatgaaacaagaagaacgtattgctcgttacaaggctttcaaagattttgaaaaacgtatttgcgtgtccacagatgtttttggtagaggtatcgatattgaacgtattaatttagccatcaattacgatttgactaatgaagctgaccaatatttacatcgtgtcggtagagctggtagatttggtactaagggtttggctatttcattcgtttcttcaaaggaagatgaggaagtcttggctaagatccaagagcgtttcgatgtcaaaatcgctgaattcccagaagaaggcattgatccgtccacttatttgaataattaa

SEQ ID NO: 25267 - DNA, 1830 bp, Saccharomyces cerevisiae
atgaattctagctatacacagagatatgcactgccgaagtgtatagcaatatcagattatcttttccatcggctcaaccagctgaacatacataccatatttggactctccggagaatttagcatgccgttgctggataaactatacaacattccgaacttacgatgggccggtaattctaatgagttaaatgctgcctacgcagcagatggatactcacgactaaaaggcttgggatgtctcataacaacctttggtgtaggcgaattatcggcaatcaatggcgtggccggatcttacgctgaacatgtaggaatacttcacatagtgggtatgccgccaacaagtgcacaaacgaaacaactactactgcatcatactctgggcaatggtgatttcacggtatttcatagaatagccagtgatgtagcatgctatacaacattgattattgactctgaattatgtgccgacgaagtcgataagtgcatcaaaaaggcttggatagaacagaggccagtatacatgggcatgcctgtcaaccaggtaaatctcccgattgaatcagcaaggcttaatacacctctggatttacaattgcataaaaacgacccagacgtagagaaagaagttatttctcgaatattgagttttatatacaaaagccagaatccggcaatcatcgtagatgcatgtactagtcgacagaatttaatcgaggagactaaagagctttgtaataggcttaaatttccagtttttgttacacctatgggtaagggtacagtaaacgaaacagacccgcaatttgggggcgtattcacgggctcgatatcagccccagaagtaagagaagtagttgattttgccgattttatcatcgtcattggttgcatgctctccgaattcagcacgtcaactttccacttccaatataaaactaagaattgtgcgctactatattctacatctgtgaaattgaaaaatgccacatatcctgacttgagcattaaattactactacagaaaatattagcaaatcttgatgaatctaaactgtcttaccaaccaagcgaacaacccagtatgatggttccaagaccttacccagcaggaaatgtcctcttgagacaagaatgggtctggaatgaaatatcccattggttccaaccaggtgacataatcataacagaaactggtgcttctgcatttggagttaaccagaccagatttccggtaaatacactaggtatttcgcaagctctttggggatctgtcggatatacaatgggggcgtgtcttggggcagaatttgctgttcaagagataaacaaggataaattccccgcaactaaacatagagttattctgtttatgggtgacggtgctttccaattgacagttcaagaattatccacaattgttaagtggggattgacaccttatatttttgtgatgaataaccaaggttactctgtggacaggtttttgcatcacaggtcagatgctagttattacgatatccaaccttggaactacttgggattattgcgagtatttggttgcacgaactacgaaacgaaaaaaattattactgttggagaattcagatccatgatcagtgacccaaactttgcgaccaatgacaaaattcggatgatagagattatgctaccaccaagggatgttccacaggctctgcttgacaggtgggtggtagaaaaagaacagagcaaacaagtgcaagaggagaacgaaaattctagcgcagtaaatacgccaactccagaattccaaccacttctaaaaaaaaatcaagttggatactga

SEQ ID NO: 25268 - DNA, 1798 bp, Saccharomyces cerevisiae
atgaccgatgtgttgagaagcctagtgcgaaagatttccttcaataactcagataaccttcagctaaaacacaagacatctatacagagtaatactgccctagaaaagaagaagagaaagcctgatacaatcaaaaaggtaagcgacgttcaagttcaccatactgtacctaatttcaataacagttcagagtacatcaacgacatagagaatcttataatatctaaactgatagacgggggaaaggagggtattgcagttgatcacattgaacacgccaatatctcggacagtaaaacagatggaaaagttgccaataagcacgaaaatattagtagcaagcttagtaaagagaaggttgagaaaatgattaattttgattataggtatattaaaaccaaggaaaggactagtatgtataattattttttattttttttttttatgttcttgccagtggaggaatgtttctttcgtcacaaccggagtgaatagtggaactactgtcagttcatagtatcgcgacacaaaaaaaaataattaaaagaaaaaaaaagagagtgtaaaataaagatttatgaaattgcatccctaatcttagaaacttgcttacgaaatatcaggaagcatagcggaacatttttccatattacatcaactaccattttttatgggaatcacattatatactaacataggtttagttcataaacgggtttataaacatgaccgcaaaactgatgtcgaccgaaaaaatcatggaggaactatcgacatcagttatcctacgacagaagtggttggccatggttcatttggtgttgtagtcacgactgtaataattgagaccaatcaaaaagttgccataaagaaagtactacaagatagaagatataaaaatagggagctcgaaactatgaagatgttgtgccatccaaatactgtgggtctacagtactacttttacgaaaaggacgaagaagatgaagtatacctcaatctggttttggactacatgcctcagtcgttataccaaaggcttcgtcattttgttaatttgaaaatgcagatgccgcgtgttgaaattaaattctatgcataccaactattcaaagctttaaactatttgcataacgttcctcgaatctgtcacagagatataaaaccgcaaaacctactggtggatccgacaactttttctttcaagatttgcgattttggcagtgccaaatgcttgaaaccggatcagcctaatgtgtcttacatctgttcaaggtactatagggctcccgaactcatgtttggtgccactaattactcaaaccaggtcgacgtgtggtcaagcgcttgtgtcattgctgagttgcttttgggcaagcccttgttctctggtgaaagcggtatagatcagttggtggaaattattaagataatgggcatacccacaaaggatgaaatttcaggaatgaacccaaattatgaagaccatgttttccccaatatcaagcccattactttggctgaaatattcaaagccgaagatcccgatactcttgacttgttaacaaaaactctgaagtatcacccttgcgaaagattggtacctctacaatgtctattatcaagctattttgacgaaaccaaacgttgtgataccgacacttacgtaaaagcacaaaacctgcgtatatttgacttcgacgtggaaactgagttgggccatgttccacttgtggaacggcccgccattgaagaacggttgaaacattttgtttctgcaccttcatcgtctttgtga

SEQ ID NO: 25269 - DNA, 1032 bp, Saccharomyces cerevisiae
atggtcaaagtcgcaattcttggcgcttctggtggcgtgggacaaccgctatcattactgctaaaattaagcccttacgtttccgagctggcgttgtacgatatccgagctgcggaaggcattggtaaggatttatctcacatcaacaccaactcaagttgtgtcggttatgataaggatagtattgagaacaccttgtcaaatgctcaggtggtgctaataccggctggtgttcccagaaagcccggtttaactagagatgatttgttcaagatgaacgccggtattgtcaaaagcctggtaaccgctgttggaaagttcgcaccaaatgcgaggattttagtcatttcaaaccctgtaaacagtttggtccctattgctgtggaaactttgaagaaaatgggtaagttcaaacctggaaacgttatgggtgtgacgaaccttgacctggtacgtgcagaaacctttttggtagattatttgatgctaaaaaaccccaaaattggacaagaacaagacaaaactacaatgcacagaaaggtcactgttattgggggtcattcaggggaaaccattatcccaataatcaccgacaaatcgctggtatttcaacttgataagcagtacgagcacttcattcatagggtccagttcggaggtgatgaaattgtcaaagctaaacagggcgccggttccgccacgttgtccatggcgttcgcgggggccaagtttgctgaagaagttttgaggagcttccataatgagaaaccagaaacggagtcactttccgcattcgtttatttaccaggcttaaaaaacggtaagaaagcgcagcaattagttggcgacaactctattgagtatttttccttgccaattgttttgagaaatggtagcgtagtatccatcgataccagtgttctggaaaaactgtctccgagagaggaacaactcgttaatactgcggtcaaagagctacgcaagaatattgaaaaaggcaagagtttcatcctagactcttccaagctatga

SEQ ID NO: 25270 - DNA, 1917 bp, Saccharomyces cerevisiae
atgtctcgtactaacatggatacaagacacgcacattctgctttactggcagcaccacagagtgctactgcaaatagcaggagcagcaacagcagcagcgagagtagtagtaacaaaaacaatatcaatgtcggcgtcggtgacgatagcggtaatgtcagcgcggtaagtatcgacgatggaccccacttcagggatatcttccactatggacacgaggaaaattacaaacttgcgagcagcggtatcactaacctgaattcttcatcccacgcccaccaaactttgtctcccatttccattagtaatgcatccactccggaaagttttcccgagcaccctttgggcctagaacgggaaacagagccggcgttggaagctgaaatggaagcggaggaactaccaccacaccaaagtaaataccttttaagctccattaaggcgaccaaacgattaaaagatgctagaccgtttctgaagccggttgatcctattgctttgaacatcccgcattatttcaactacgttcaaaccccaatggatttgtctttaattgaaacaaaattgcagggcaacgtgtatcattcagtagagcaagtcacatcggacttcaaaacaatggtggataattgtttaaactttaatggtccagaatcttcaatctcttcgatggctaaaaggattcaaaagtattttgaaaaaaagttatctgcaatgccaccaagagttttacccgcttctgccttgaagaaaacaagcagaaaccggaaaaaaaatgaggatatggattccccacttgtcattagacgttcagttagtaccaccaatgacaatattggggaaagcggaaatagagaaggcgtcagtggtggtagacccaaaagaacaattcatccacccaaatcaaaagatttgtttgatatatatgaaaactccaaaccaaaatcaaagactttacaaaaaaaattcaggacttgtctgaaaatactaaaggttttgatgagtaaaaaaaattcggatataaattttccctttttacaacctgttgatccgattgctttgaatctaccaaattactttgatgtcgtgaagaatcctatggatttgggtacaatatcaaataatttaatgaactggaagtacaaaacaattgatcaatttgtcgacgacctcaaccttgtcttttataattgtttccaattcaatccagaaggcaatgaagtccattcaatgggcaaaaaactaaaagagcttttcaattttcattggttagagaaccaggatattttgaatgaaattgaaacggattcagatcttgaagaggataactattcttcttcatattcatctgatgatgaatatgatgatgaagacataaatgaaaacgatataactaatccggctattcaatatttggaacaaaaactgaagaaaatggaggttgaattgcaacaattgaaaagacaagagttaagtaaattatcgaaggaaaggaagaggaagcatctaggtaaaacgcttttgcgtaggaaggcaatgaagcattcagttgacgatttaaagaaatctattactgataaaatcaatgaattaagtgatttagaaatgaatgggatgattcgtatcattaaaaattcattacccgcagatgaaatactaacttccaatgaagatgaaattgaaattgatttggatattttagatgaagcgactattgcaagaatttatgagagatattttgagaaaaaaaataacaacaatagcaaaagaaaactaagtggcaactactcgactgcgccaactaacaagaaaaagaaaaccttgaaatttttggaaaaggatgaaatcataaataataataattattccgattctgaagaagacagtagtgatagtagcgacagtgacagtgattaa

SEQ ID NO: 25271 - DNA, 1287 bp, Saccharomyces cerevisiae
atgagtatgttatctagaagattattttccacctctcgccttgctgctttcagtaagattaaggtcaaacaacccgttgtcgagttggacggtgatgaaatgacccgtatcatttgggataagatcaagaagaaattgattctaccctacttggacgtagatttgaagtactacgacttatctgtcgaatctcgtgacgccacctccgacaagattactcaggatgctgctgaggcgatcaagaagtatggtgttggtatcaaatgtgccaccatcactcctgatgaagctcgtgtgaaggaattcaacctgcacaagatgtggaaatctcctaatggtaccatcagaaacattctcggcggtacagtgttcagagagcccattgtgattcctagaattcctagactggtcccacgttgggaaaaaccaatcattattggaagacacgcccacggtgatcaatataaagctacggacacactgatcccaggcccaggatctttggaactggtctacaagccatccgaccctacgactgctcaaccacaaactttgaaagtgtatgactacaagggcagtggtgtggccatggccatgtacaatactgacgaatccatcgaagggtttgctcattcgtctttcaagctggccattgacaaaaagctaaatcttttcttgtcaaccaagaacactattttgaagaaatatgacggtcggttcaaagacattttccaagaagtttatgaagctcaatataaatccaaattcgaacaactagggatccactatgaacaccgtttaattgatgatatggtcgctcaaatgataaaatctaaaggtggctttatcatggcgctaaagaactatgacggtgatgtccaatctgacatcgtcgctcaaggatttggctccttaggtttgatgacttctatcttagttacaccagacggtaaaactttcgaaagtgaagctgctcatggtaccgtgacaagacattatagaaagtaccaaaagggtgaagaaacttctacaaactccattgcatccattttcgcgtggtcgagaggtctattgaagagaggtgaattggacaatactcctgctttgtgtaaatttgccaatattttggaatccgccactttgaacacagttcagcaagacggtatcatgacgaaggacttggctttggcttgcggtaacaacgaaagatctgcttatgttaccacagaagaatttttggatgccgttgaaaaaagactacaaaaagaaatcaagtcgatcgagtaa

SEQ ID NO: 25272 - DNA, 584 bp, Saccharomyces cerevisiae
atgagtagtttgtgtctacagcgtcttcaggaagaaaggtaagtagtagttttcctccttttatgcttacattctgtaggcatacacaatttcatccagcggtatactaacaaatcgatgaacttaacttgttttacttgaataacagaaaaaaatggagaaaggatcatccatttggattttatgccaaaccagttaagaaagctgatgggtccatggatttacagaaatgggaagctggtatcccaggcaaagaaggtacaaactgggcgggtggtgtgtacccaattacagtcgaatatccaaatgaatatccttcaaaacctccaaaggttaaatttccagccggattttatcatccaaacgtgtatccaagtggcacaatatgtttaagtattttaaatgaagatcaagattggagacccgccatcacgttaaaacaaattgttcttggggttcaggatcttttagactctccaaatccaaattcccctgctcaagagcctgcatggagatcattttcaagaaataaggcggaatatgacaagaaagttttgcttcaagctaaacagtactctaaatag

SEQ ID NO: 25273 - DNA, 5373 bp, Saccharomyces cerevisiae
atggacatcattcaaggactgatacagcaaccaaaaattcaatctgtggatgaaaccattccgacgttgtgcgatcgagttgagaactccactttgattagcgataggagatccgctgtgctgggattaaaggcatttagccggcagtatagagaatcagtgattgcatccgggctaaaaccgttgctcaatactttgaaacgtgattatatggatgaagattcggtaaaggctatattagaaacaattttgattcttttcatcagaggcgatggccatgacgacttaactagaggttggatttctcaacaatcgcggttgcagaatggcaagtatccctcaccattggtgatgaagcaagaaaaggaacaagtagatcagttctcgttatggattgctgatgctttgacgcagtctgaagatttaattcacctacttgttgaattttgggaaatcgataatttccatattagattgtacacaattcaattactagaggcagtgatggccacgaggccgttgaaggcgagaagtgctttgatttcacttccaacgagcatatccacaatggtctcactcctagatgacatgcatgagcccatcagggatgaagctattttattattaatggcagtagtgaacgattcacctcacgttcaaaaattggttgcttttgaaaacatttttgaaaggctcttttccatcatcgaagaagaaggtgggttaagaggctctctcgtcgtcaatgattgtttatcgttgatcaataacatcctgaagtataacacttctaatcaaactttattccttgagacaggaaacttgccaaaactggcacaccttttgagtgaaccaatatctcaagatgaagtttttttttggaatgatcaaaggatagttaatatcaatacagctttagatatcgtcagcctaacagtagagccaggaaatactgtcaccactaagcatcaaaatgcgttgcttgactcaagcgtattaatggttgtgttgcgacttgcattctttcataatatcccaaaaaaagttagaccggttgctcttttgactgccgcaaacatggttagaagtaatgaacatgcacagctagagtttagtaagatcgatgttccatatttcgatccttcattacctgtaaactctactgcaaacggtggtccaattaaattaattcctgtagtcagcatcttgataaattggatgctctatgccaactccgttcacacgtttgatacaagagttgcgtgttctagactattaaaggcttatttcatggataattttgatcttcaaagagattttttactaaaacaagtccaattgtgtaataattcaacaaataatgtcggcgacaatgctaaagaaaatggtggttctaacaaatctgataaagaaagtgattcagataaagataccgacgggaaggatggcactgaatatgaaggttctttcaaggcaaatctattcgaagtcctgttaaattatgacgcagaattgaatctgaacccttttaaattattcttcacaactgatatttttatgttttttttccaacaggatcacaaatatagcgaagaactacgtgaaataacaagaaatgttaccaccggtaacgatctcgaagacgaagaacccttaaaggcaattcaaacaataagtgaattgctaactacttcccttactgctgctgacataagaattcctatttcctacttaacgttcctaatatattggctctttggcgactttaaggccacgaacgattttctttcggataaatccgtgattaaatccttgctttccttctcttaccaaattcaagatgaagacgttactatcaaatgccttgtaacaatgttactaggtgtggcatacgagttttcctcgaaagaatctccattcccaagaaaggaatacttcgaattcatcactaaaactttgggaaaagacaattatgcttctcgaatcaaacaatttaaaaaagattcatatttctcaaaagttgatatgaatgaagacagtatactaactccggagcttgatgaaactggtttaccaaaagtttatttcagcacttacttcatacagttatttaatgaaaacatatacaggatcagaactgcattgtctcacgaccctgacgaagagccaatcaataaaatatctttcgaagaagtcgaaaaattacagaggcaatgtacaaaattgaagggtgagataacttctttgcaaacagaaacggaaagcacccatgagaacctcaccgaaaaattgattgcgttgactaatgaacacaaagagttggatgagaaataccaaattttgaattcctcacattcttcgttgaaagaaaacttttccattttggaaactgaattgaagaacgtcagagattccttggatgaaatgacgcaactgagagatgtactggaaactaaggacaaagaaaatcaaactgctttactggagtacaaaagcacaatccacaaacaagaagactctatcaaaactttagaaaaaggacttgaaactattttgtctcaaaagaaaaaggcagaagatggtataaacaaaatgggtaaagatttattcgctctgagtagagagatgcaagcagttgaggagaattgtaaaaatttacagaaggaaaaagataaaagcaatgtcaaccatcagaaagagactaaatcactaaaagaagatattgcggcaaaaattactgaaataaaagctatcaatgaaaatctggaagaaatgaaaattcaatgtaataatttatcaaaagaaaaggaacatatttcgaaggaacttgttgagtacaaatcccgctttcagagtcatgacaatctagtagcgaaactaacagaaaaattgaaatccttagcaaataactataaggatatgcaagctgaaaatgagtctctaataaaagctgtagaagagtcaaaaaacgaaagcagcatacaattgtctaatttgcaaaataaaattgattctatgtcacaggaaaaagaaaattttcaaatagaaagaggcagtatagaaaaaaatatcgaacaactaaaaaaaaccatctctgacttagaacaaacgaaggaggaaattatctcaaaatccgattcttcaaaagatgaatatgagtcccagattagtctcttgaaagaaaaattagaaacggcgacaacagcaaacgatgaaaacgtgaataaaatctcagaattgactaaaactagggaagagctggaagccgagttagcagcttataaaaatctcaaaaatgaacttgaaacaaaactagaaacttcagagaaagctttgaaagaagttaaagaaaacgaggagcatttaaaagaagagaaaattcaactcgagaaggaggccactgaaaccaaacagcaactcaacagcctacgtgccaatttagaatcattagaaaaagagcatgaagatttagcagctcagttgaagaagtacgaggagcaaattgccaacaaggaaaggcaatataacgaggaaatatctcaattaaatgatgagattacttccactcaacaagaaaatgaatcaattaagaaaaaaaatgacgaactggagggcgaagttaaagcaatgaagagcacttcagaggaacaatcaaatttgaaaaagtcagagattgatgccttaaatttgcaaattaaagagctgaaaaagaagaacgaaacgaacgaagccagtttattggagtcaatcaaaagtgtagaatcagaaacggtaaaaattaaagaattacaagacgaatgtaactttaaagaaaaggaagttagtgaattggaagacaaactcaaggcctcagaagataagaactctaaatatttggagctacagaaggaatcggagaagataaaagaagaactagatgctaaaacgactgaactaaaaattcaattggaaaagatcactaatttatctaaggccaaggagaaatcagaatctgagttgtctagattgaagaagacatcttctgaggaaagaaaaaatgcagaggagcaattggaaaaattgaaaaatgaaatacaaatcaaaaatcaggccttcgaaaaggaaagaaagctacttaatgaaggatcttcaacaattacacaagaatattctgaaaagatcaatactttggaagatgaattaattaggctacaaaatgaaaacgaattaaaagccaaagagatcgataatacgaggagtgaactagagaaggttagtttaagcaatgatgagcttttagaagagaaacaaaacacaataaaaagcttacaagatgaaattctttcatataaagacaaaataactagaaatgacgaaaagcttctatcaatagagcgagataataaacgagacctggagagcttgaaagaacaactccgggctgcacaagaatccaaagctaaagttgaagaagggctgaaaaaacttgaggaagaatcttcaaaagagaaagcagagcttgaaaagtctaaagaaatgatgaaaaagctagagagtacgattgagagcaatgaaacggagttgaaatcctcaatggaaaccataaggaaatcagatgaaaaattagaacagtcgaaaaaaagtgctgaggaggatattaaaaacttgcaacatgagaagtcagatttgatatcccgaatcaacgaatctgaaaaggatattgaagaactgaaaagtaaactgaggatcgaagcaaaatctggctctgaactagaaaccgtaaaacaagagctaaataacgcacaagaaaaaataaggatcaacgcagaagaaaatacagttttgaaatctaaattagaagatatagaacgtgaactcaaagacaagcaagccgaaataaaaagtaatcaagaagaaaaagaattactaacttcgcgcctcaaggaattagaacaggaattagatagcacccaacagaaggcacaaaaatccgaggaagaacgtagggccgaagtcaggaagtttcaagtcgaaaagtctcaacttgatgaaaaagccatgttgcttgaaactaaatacaacgatttggtgaataaagagcaagcatggaaaagggatgaagatactgttaaaaagacaaccgattctcagagacaagaaattgaaaagttggctaaagaactggataacttgaaggcagagaactctaagttgaaggaagctaacgaagatcgttcggaaattgatgacttgatgctcttggttactgacctagatgagaaaaacgccaaatatcgctcaaagctgaaggatttgggcgttgaaattagttcggatgaagaggatgatgaagaagatgatgaagaagacgaggaagaagggcaagtggcatga

SEQ ID NO: 25274 - DNA, 2502 bp, Saccharomyces cerevisiae
atgtctaaccaaatatactcagcgagatattcgggggttgatgtttatgaattcattcattctacaggatctatcatgaaaaggaaaaaggatgattgggtcaatgctacacatattttaaaggccgccaattttgccaaggctaaaagaacaaggattctagagaaggaagtacttaaggaaactcatgaaaaagttcagggtggatttggtaaatatcagggtacatgggtcccactgaacatagcgaaacaactggcagaaaaatttagtgtctacgatcagctgaaaccgttgttcgactttacgcaaacagatgggtctgcttctccacctcctgctccaaaacatcaccatgcctcgaaggtggataggaaaaaggctattagaagtgcaagtacttccgcaattatggaaacaaaaagaaacaacaagaaagccgaggaaaatcaatttcaaagcagcaaaatattgggaaatcccacggctgcaccaaggaaaagaggtagaccggtaggatctacgaggggaagtaggcggaagttaggtgtcaatttacaacgttctcaaagtgatatgggatttcctagaccggcgataccgaattcttcaatatcgacaacgcaacttccctctattagatccaccatgggaccacaatcccctacattgggtattctggaagaagaaaggcacgattctcgacagcagcagccgcaacaaaataattctgcacagttcaaagaaattgatcttgaggacggcttatcaagcgatgtggaaccttcacaacaattacaacaagtttttaatcaaaatactggatttgtaccccaacaacaatcttccttgatacagacacagcaaacagaatcaatggccacgtccgtatcttcctctccttcattacctacgtcaccgggcgattttgccgatagtaatccatttgaagagcgatttcccggtggtggaacatctcctattatttccatgatcccgcgttatcctgtaacttcaaggcctcaaacatcggatattaatgataaagttaacaaatacctttcaaaattggttgattattttatttccaatgaaatgaagtcaaataagtccctaccacaagtgttattgcacccacctccacacagcgctccctatatagatgctccaatcgatccagaattacatactgccttccattgggcttgttctatgggtaatttaccaattgctgaggcgttgtacgaagccggaacaagtatcagatcgacaaattctcaaggccaaactccattgatgagaagttccttattccacaattcatacactagaagaactttccctagaattttccagctactgcacgagaccgtatttgatatcgattcgcaatcacaaacagtaattcaccatattgtgaaacgaaaatcaacaacaccttctgcagtttattatcttgatgttgtgctatctaagatcaaggatttttccccacagtatagaattgaattacttttaaacacacaagacaaaaatggcgataccgcacttcatattgcttctaaaaatggagatgttgttttttttaatacactggtcaaaatgggtgcattaactactatttccaataaggaaggattaaccgccaatgaaataatgaatcaacaatatgagcaaatgatgatacaaaatggtacaaatcaacatgtcaattcttcaaacacggacttgaatatccacgttaatacaaacaacattgaaacgaaaaatgatgttaattcaatggtaatcatgtcgcctgtttctccttcggattacataacctatccatctcaaattgccaccaatatatcaagaaatattccaaatgtagtgaattctatgaagcaaatggctagcatatacaacgatcttcatgaacagcatgacaacgaaataaaaagtttgcaaaaaactttaaaaagcatttctaagacgaaaatacaggtaagcctaaaaactttagaggtattgaaagagagcagtaaagatgaaaacggcgaagctcagactaatgatgacttcgaaattttatctcgtctacaagaacaaaatactaagaaattgagaaaaaggctcatacgatacaaacggttgataaaacaaaagctggaatacaggcaaacggttttattgaacaaattaatagaagatgaaactcaggctaccaccaataacacagttgagaaagataataatacgctggaaaggttggaattggctcaagaactaacgatgttgcaattacaaaggaaaaacaaattgagttccttggtgaagaaatttgaagacaatgccaagattcataaatatagacggattatcagggaaggtacggaaatgaatattgaagaagtagatagttcgctggatgtaatactacagacattgatagccaacaataataaaaataagggcgcagaacagatcatcacaatctcaaacgcgaatagtcatgcataa

SEQ ID NO: 25275 - DNA, 1086 bp, Saccharomyces cerevisiae
atgaaaggtttaattttagtcggtggttacggtaccagattgagacctttaactttgaccgttccaaagccactggttgaattcggtaatagaccaatgattttacaccaaatcgaggctttagccaacgctggtgttactgacatcgttcttgctgttaattacagaccagaagtcatggtggaaactttgaagaagtacgaaaaggaatatggtgttaacatcactttctctgtagaaactgaaccattaggtactgcaggtccattgaaattggctgaagatgttttgaagaaggacaactctccatttttcgtcctaaactccgacgtcatttgcgaatatccattcaaggaattggctgacttccacaaagctcacggtggtaaaggtaccattgttgctaccaaggtcgacgaaccttctaaatacggtgtcattgtccatgatatagctactccaaacttgattgacagatttgttgaaaagccaaaggaatttgttggtaacagaattaacgccggtttgtacattttaaacccagaagtcattgacttgattgaaatgaagccaacttcaattgaaaaggaaactttcccaatcttggtcgaagaaaaacaactatattccttcgatttggaaggtttctggatggatgttggtcaaccaaaggacttcttgtctggtaccgttctttacttgaactctttggccaagagacaaccaaaaaaattggctacaggtgccaacattgttggtaatgccttgatcgacccaaccgctaagatttcctccactgctaagattggcccagacgtggttatcggtcctaatgtcaccatcggtgatggtgttagaatcaccagatctgttgttttgtgcaactccaccatcaagaaccactccttggtcaaatctaccatcgtaggctggaactctaccgttggtcaatggtgtcgtttggaaggtgtcactgtcttgggtgacgacgttgaagttaaggacgaaatctacatcaacggtggtaaagtcttacctcataagtctatctccgataatgttccaaaggaagctattattatgtga

SEQ ID NO: 25276 - DNA, 912 bp, Saccharomyces cerevisiae
atgagtgtgataggtaggttcttgtattacttgaggtccgtgttggtcgtactggcgcttgcaggctgtggcttttacggtgtaatcgcctctatcctttgcacgttaatcggtaagcaacatttggctcagtggattactgcgcgttgtttttaccatgtcatgaaattgatgcttggccttgacgtcaaggtcgttggcgaggagaatttggccaagaagccatatattatgattgccaatcaccaatccaccttggatatcttcatgttaggtaggattttcccccctggttgcacagttactgccaagaagtctttgaaatacgtcccctttctgggttggttcatggctttgagtggtacatatttcttagacagatctaaaaggcaagaagccattgacaccttgaataaaggtttagaaaatgttaagaaaaacaagcgtgctctatgggtttttcctgagggtaccaggtcttacacgagtgagctgacaatgttgcctttcaagaagggtgctttccatttggcacaacagggtaagatccccattgttccagtggttgtttccaataccagtactttagtaagtcctaaatatggggtcttcaacagaggctgtatgattgttagaattttaaaacctatttcaaccgagaacttaacaaaggacaaaattggtgaatttgctgaaaaagttagagatcaaatggttgacactttgaaggagattggctactctcccgccatcaacgatacaaccctcccaccacaagctattgagtatgccgctcttcaacatgacaagaaagtgaacaagaaaatcaagaatgagcctgtgccttctgtcagcattagcaacgatgtcaatacccataacgaaggttcatctgtaaaaaagatgcattaa

SEQ ID NO: 25277 - DNA, 807 bp, Saccharomyces cerevisiae
atgctgatagtattattcttaacattattttgttcggtagtgttccgaacagcttattgtgatgtggccattgtggctccagaacccaactcagtttatgatttatctggtacaagtcaggctgttgtcaaagtaaagtggatgcatacagataacacaccacaggaaaaggattttgtcagatacacgtttactctgtgttcgggtaccaatgccatgatagaagcaatggctactcttcaaacactcagtgcgagtgatctgacagacaacgagttcaatgcgataatagaaaacaccgttgggacggacggtgtttacttcatacaagtctttgcgcaaacagctatcggttacaccattcattacactaacagatttaaactaaaagggatgattggtacaaaagccgctaatccgagtatgataaccattgcaccagaggcacaaacaagaattaccacaggagatgtgggtgccacgattgattctaagagtttcaccgttccctacaacttacaaacaggtgttgtgaaatatgctcccatgcaactccaaccggctactaaggtaacagcaaagacatggaaaaggaagtacgcgaccagtgaggtaacgtattactacactttaagaaactccgttgatcaacatactaccgtaacaccagggtggtcatacataattacagctgatagtaactatgctacgccggcccctatgccggctgataatggcggttggtataatccacgcaagagactctctctgactgcaagaaaagttaatgctttgaggcacagataa

SEQ ID NO: 25278 - DNA, 936 bp, Saccharomyces cerevisiae
atggtatctagaggccccgacgaatggcttgaaacaataaagaaatgccaggcgctaactgaaaacgagatgaaacaactgtgtgaaatggtgaaagaacttttgatggaggaaagtaacatccagccggtacagacccccgttactgtatgtggagacatacacggccaatttcatgacttgttagagctattccgtacggcgggtggctttcctgacgatataaactacatttttctcggtgattacgtggatcgtggctactatagtctggaaacttttacgcttttaatgtgtctgaaagtcaagtacccggcaaagataactttggtcagaggaaaccatgagtccagacaaattactcaagtttacgggttctacgaggaatgcctgaataagtacggatctaccaccgtatggaagtattgctgtcaagtttttgatttcctgacgctggccgctataattgacggtaagatcttatgtgtccatggagggttatctcccgagattagaatgctcgatcaaatcagagtcttgtcaagagctcaagaagtgccacacgagggtgggttctcggacctgctttggtcagaccctgacaatgtagaggcttggcaagtttcccctcgtggtgcaggatggctctttggcagtaaagttgctagagagtttaaccacgttaatggactgaaccttattgcccgggctcaccaactggttatggaggggttcaagtaccattttcctgaaaaggacgttgtaaccgtgtggtccgcgccaaattactgttatagatgtggtaatgtcgcgagtgtaatgaaggtcgatgaggatctggaacctactttcaaaattttctcggctgttcccgatgactacataagagaatccacggcaaaccataataatcaaagagccggctatttcttataa

SEQ ID NO: 25279 - DNA, 2565 bp, Saccharomyces cerevisiae
atgtctaggaaaagaagtactaagcccaagccagcagctaaaatagctttgaaaaaagaaaatgaccagttcctcgaggcattgaaactatacgaagggaagcaatacaaaaaatctctcaagctgctagacgcaattttgaaaaaagacggtagtcacgttgattccttggctttaaagggtcttgatttatattctgtaggtgagaaagatgacgctgcttcctacgtggctaatgccatcagaaaaattgaaggcgcttcagcatcaccaatctgctgtcatgtattaggtatctacatgagaaacaccaaagagtacaaagaatctattaaatggttcacggcagctttgaacaatgggtccactaacaagcaaatatatagagacttagcaactttgcaatcacaaattggcgatttcaaaaatgctttagtgtccaggaaaaaatattgggaagcattccttggttaccgtgccaactggacatcattggctgtggcacaagatgtgaacggtgagaggcaacaagctattaacactttatctcagtttgaaaaactcgctgagggaaaaatatctgattccgagaaatatgaacacagcgagtgtttaatgtacaaaaacgacattatgtataaagctgccagtgataaccaagacaagttacaaaatgtattgaaacatttgaatgatatcgagccatgcgtctttgataaatttggtttattagagagaaaagcaactatttacatgaaattgggtcaattgaaagacgcgtccattgtttatagaactctgatcaagagaaatccagataattttaagtactacaaattactggaagtatccttgggaatccaaggtgacaataaattgaagaaggctttgtatggaaaacttgaacaattttatccaagatgcgaaccacccaaatttattccattaactttccttcaagacaaagaagagctcagcaaaaaattgagagaatatgttttgcctcaattggagcgcggtgttccagcaactttttccaacgtgaaacccctttaccaaagaaggaagtccaaggtttcaccactattggagaaaattgtccttgattatttgtccggattagatcctacgcaggatccaattccttttatttggaccaattattacttgtctcaacatttccttttccttaaggattttccgaaagcccaagaatatattgatgctgcccttgaccacaccccaactttagttgagttttacatcctcaaggcacgtatcctgaagcacttaggcctaatggacacagcggctggaattttggaggaaggtaggcaacttgatttgcaggatagatttatcaactgtaaaacggttaagtactttttaagggctaacaatatcgacaaggcggtggaagtcgcgtcccttttcaccaaaaacgatgattctgttaatggtattaaggacttacaccttgtggaagcttcttggttcatcgtagaacaggcagaagcctattatagactatacctggatagaaaaaagaaattagacgatttagcatcgctaaaaaaagaggttgaaagtgataaaagcgaacaaattgcgaatgatatcaaagaaaaccaatggcttgttcgcaaatataaaggtttggcgctgaaaagattcaacgctattccaaagttttataaacaattcgaagatgaccagttggatttccattcatactgtatgagaaaaggtacgccaagagcctatctggagatgttagaatggggaaaggcactttataccaaacccatgtatgttcgcgcaatgaaggaagcatcaaagctttactttcaaatgcatgatgatcgcttaaaaagaaagtccgattctttagatgaaaattcagatgaaatccaaaataatggccaaaatagtagcagccaaaagaaaaaagctaagaaggaagcagccgctatgaacaaacggaaagaaactgaagccaagagtgttgctgcttatccgagtgatcaagataacgatgtattcggcgaaaagttgattgaaacctccactccaatggaggacttcgctaccgaattttataataactactccatgcaagtcagagaagacgaaagggattatattttggactttgaatttaactacagaattggaaagttagctttgtgctttgcttctctaaacaaattcgctaagagatttggcaccacgagcggtttatttggtagtatggccattgttttgttacatgccacaagaaacgacaccccctttgatccaattttgaagaaagtagtcacgaagagccttgaaaaagagtattctgaaaatttcccattaaacgaaatatctaacaatagcttcgattggctgaatttctaccaagaaaaattcggtaagaatgatataaatggcctgctatttctgtatcgctatcgcgatgatgttccgatcggaagctctaatttgaaagaaatgattattagcagtctttctcccttggagcctcactcccagaacgaaattctacagtattacttgtag

SEQ ID NO: 25280 - DNA, 2988 bp, Saccharomyces cerevisiae
atggcaggcgtgcagaaaagaaaaagggatctcgaagatcaagacgacaatggaagcgaggaggacgacatcgcctttgatattgcaaatgaaattgccttaaatgatagtgagagtgatgctaacgactccgatagtgaagttgaagctgattatggtcccaacgatgtccaggatgtgatcgagtacagctcagatgaagaagaaggagtgaacaataagaagaaggctgaaaacaaggacatcaagaaaaaaaagaatagtaagaaggaaatagcagcatttccaatgttagaaatgtcagatgatgaaaacaatgcatctggtaaaactcaaaccggtgatgatgaggatgatgtcaatgaatatttctccacaaataacttggagaaaacaaagcataaaaaaggtagttttcccagctttggcctatccaaaattgtattgaacaatattaaaaggaagggatttcgccaacccactcctattcaaaggaagactatcccattaattttgcaaagtagggatattgttggtatggcacgtaccggttctggtaagactgcagcattcatcttgccaatggtggaaaaattgaaaagtcactcaggtaaaattggcgcccgtgcagtcatcttatcgccttccagagaattagccatgcagactttcaacgttttcaaggattttgccagaggaacagaactaagaagcgtcctcttgactggtggtgattccttggaagaacaatttggcatgatgatgaccaacccagacgttattattgcaacacctggtagatttttacatctgaaagttgaaatgaacctcgatttgaagagtgttgagtacgttgttttcgatgaagctgataggttgttcgaaatgggttttcaagaacagttgaatgaattacttgcatctttgcctacaacaagacagactttgttgttttctgctactctacctaattcattggttgattttgttaaggctggtttggttaatccagttttggttcgtttggacgcggaaacgaaagtttcagagaacttagaaatgctttttctatccagtaaaaacgcagatagagaggcgaacctattatatattttgcaagaaatcataaagattccgttagccactagtgaacaacttcaaaagctgcaaaatagtaacaatgaggcagatagtgactcagatgatgaaaatgatcgccaaaagaagaggaggaatttcaagaaggaaaagttccgtaaacaaaaaatgcctgcagctaatgaacttccttctgaaaaagcaactattctgttcgttccaacaagacatcatgtggaatacatttctcaactcttaagagactgcggatacttgatttcgtacatctacggtactttggaccaacatgctcgtaaacgtcaattatataattttagggcgggcttaacttccattttggttgttacagatgttgctgcaagaggtgtcgatattccaatgttagccaatgttattaattacacattacctggttcatcaaaaatttttgtacatcgtgtaggtagaactgcaagagccggtaacaaaggttgggcatattccattgtcgctgaaaatgaattaccttacctattagatttggagctatttttggggaaaaaaattcttctaacaccaatgtacgatagtctagtcgacgtgatgaagaaaaggtggatagatgaaggaaaaccggaatatcaatttcaacccccaaagctttcttacacaaaaagactcgttctaggttcatgtccaagactggatgttgaaggcttaggtgatctttataagaatctgatgtcctctaattttgaccttcagttggcgaagaaaacagccatgaaggcagaaaaactttactacagaacacgcacttccgcctcccctgaatctttaaagagaagtaaagagatcatttcttctggctgggatgctcaaaatgcattttttggtaaaaatgaagagaaggaaaaattggattttttggctaaattgcaaaacagaagaaacaaggaaacggtatttgagttcaccagaaacccagacgatgaaatggcagtgtttatgaaaaggagaagaaagcaattagcgccaattcaacgaaaggcgactgaaagaagggaactattagaaaaggaaagaatggctggtcttcacattctatcgaagatgaaattttggaaaggtgacgatgttgagacaggttacaccgtgtcagaggatgccttaaaagaatttgaagatgcgcaccaattattagaagcacaggaaaacgaaaacaaaaagaaaaagaaaccgaagtcttttaaggatccaactttctttttaagtcactatgcgccagctggtgacatacaagataaacaattacagataaccaatgggttcgctaatgatgctgctcaagcggcttacgatttaaatagcgatgataaagtgcaagttcataagcaaacagcgaccgtaaaatgggataaaaaaagaaaaaaatatgttaatactcaaggtattgataacaagaaatatattattggtgaaagtggccaaaaaatcgcggcaagcttcaggtctggtagatttgatgattggtcgaaggcaagaaatttgaaaccattgaaggtaggttcgagagaaacaagcataccatctaacttgctcgaagacccttcacaaggtcctgctgcaaatggtagaaccgtccgtgggaaattcaagcataaacaaatgaaagcgcctaaaatgccagataaacacagagacaattattattcgcaaaagaagaaggtggaaaaggctctacaaagtggaatttccgtcaagggatataataacgctccgggtctgcgaagcgaattgaagtccactgagcaaattagaaaggacaggattatagcagagaaaaaacgtgcgaagaatgctcgtccttccaaaaagcgtaaattttag

SEQ ID NO: 25281 - DNA, 1299 bp, Saccharomyces cerevisiae
atggacccacataatccaattggtatgttgttgatatttttagtgtttgtggaggcaattgagctcggtgccccttttggctttgcctcttttgcattttagttcttttacccctatattattaatactaaccatctcgatatagtccttgatcagggtactggtttcgtcaaaattggtcgtgctggcgagaatttcccagattacacgtttccttctattgttggtagacccatcttgagggcggaagaacgtgccagcgttgctacaccattaaaggacattatgattggtgatgaggcaagtgaagttcgctcttatctgcaaatatcttatcctatggaaaacggtattattaagaattggacagatatggaacttctttgggattacgcctttttcgagcaaatgaaactaccatccacctccaacggtaagattttactaacggaacctccaatgaatccgctgaaaaatagggaaaaaatgtgtgaggtaatgttcgaaaaatacgattttggcggagtttatgttgccatccaagctgttctagcattgtacgcacaaggtttgtcttcaggagtcgtcgtcgattccggtgacggtgttactcatatagtcccagtttacgaatctgtcgttttgagccacttaacaagaagattagatgttgcgggtagagacgttactaggcatttgattgatctgctttctcgtcgtggttatgcatttaacagaactgcagatttcgaaactgtgcgtcagataaaggaaaaattatgttatgtttcatatgatttagacctagatacaaaattggctagagaaacaaccgcccttgtggaatcgtatgagttaccagatggcaggacaatcaaagtgggacaagagagatttgaagcaccagaatgtttgttccaacctggtttggttgacgttgaacaacctggcgtgggcgagctgttatttaatactgtgcaatcggctgatgttgatatcagaagttccctgtataaggccattgttctttcaggtggttcaagtatgtacccagggctgccttcgagattagagaaagaattgaaacaattatggtttagtagagttttacacaatgacccttcaagacttgataaattcaaagttagaattgaagatcctccaaggagaaagcatatggttttcattggtggtgccgttttagctagtatcatggctgataaagaccacatgtggttgtctaagcaagaatggcaagaaagcgggccatctgcaatgactaaatttggtccaagatag

SEQ ID NO: 25282 - DNA, 2295 bp, Saccharomyces cerevisiae
atgtcaacaaactcattccatgattatgtggatttaaaatcgagaactaatacacgacagttttcagatgacgaagagttcactacgcctccaaaactaagcaatttcggatcagctttactttcccacacagaaaaaacttcagcatcagagatattatcaagtcataataatgacaagatcgcaaatcgattagaagaaatggacaggagttcatcaaggagtcaccccccaccgtcaatgggcaatttgacatccggtcatactagtacctcatcgcattcaaccttgttcggacgatatctgagaaataatcaccagactagcatgacgacgatgaacactagtgacatagagataaatgttggaaatagtcttgataagagttttgaaaggataaggaatttgcgacaaaatatgaaagaagatattacggcaaagtatgctgaaaggagaagtaagagatttttaatatccaataggacaacgaagctgggtcctgcaaagagagcgatgactttgacaaatatctttgatgaggatgtgcctaactctccaaaccagccaataaatgcaagggagacagtggaattaccacttgaggattctcaccaaacaaactttaaagaacgaagagagaatacggattatgattcaattgattttggagatttgaatcctatccagtatattaaaaaacataatcttcccacaagtgaccttccactaatatctcaaatctactttgataaacaaagagaagaaaatagacaagcagcactccgaaaacatagttccagagaattgctttataaaagtaggtcttcttcctcttcactttctagtaacaacttattggcaaacaaggacaattctataacatccaataatggttctcaacccaggcgaaaagtttctactggatcatcttcatctaagtcatcgatcgaaataagaagagctctcaaggagaatattgatactagcaataacagcaatttcaacagcccaattcataaaatttataaaggaatttccagaaataaagattccgactccgaaaaaagagaagtactgcgaaacataagcataaatgcaaatcacgctgataatctccttcaacaagagaataagagactaaaacgatcattggatgatgcaataacgaatgagaatataaacagtaaaaatctagaagtattttaccatcgacctgctcccaaacctccagtcaccaagaaagttgaaattgttgaacctgcaaagtccgcttctttatcgaataatagaaatataattacagtaaatgactcccagtacgaaaaaatagaacttttgggtagaggtggatcctccagagtttacaaggtgaaaggatctggcaatagggtatacgcgctcaaaagggtgtcttttgacgcttttgacgattcaagtattgatggattcaaaggagaaatagaacttctggaaaaattgaaagaccaaaagcgtgtaatccaactactagattatgaaatgggggatggtttattgtatttgataatggaatgtggtgatcatgatttgtcacaaatccttaaccaaagaagcggcatgccactggattttaattttgttagattctatacaaaggaaatgttgctgtgcattaaagtagttcatgatgcgggcatagttcattcggatttaaaacctgcaaattttgttttagtgaaaggtatcttaaaaatcattgattttggtatagcaaacgcggtaccggaacatacggtgaatatatatcgtgaaactcaaattgggactccaaattatatggcaccagaagcactagttgctatgaattacacacaaaatagtgagaaccaacatgagggaaacaagtggaaagtggggagaccatctgatatgtggtcatgcggttgtattatatatcagatgatttacgggaaacccccatatggcagtttccaaggccaaaataggctgttggctattatgaatcctgatgtgaaaatcccatttcctgaacatactagcaataatgaaaagattccaaagtctgccattgaattaatgaaagcatgtctgtacaggaacccagacaaaagatggactgtggataaagtcctgagtagcactttccttcaaccttttatgatatccggatcgattatggaagaccttattaggaatgccgttagatatggctctgagaagcctcatatatcacaagatgatctcaatgatgtggtagacactgttttaaggaaatttgcagattacaaaatttag

SEQ ID NO: 25283 - DNA, 1407 bp, Saccharomyces cerevisiae
atggtgaagcccgttatttttgccatttgtttaggtgttctattatctaaggcactctccatcccactcagaagttttgcggatattgaactaattggctctcagaagagtctgtttccctttcttggagggtctgcgccatatttctcctttcccgctaactacggtatacccactgatattcctgaaggttgtagattaacgcaagttcaaatgattggcagacatggcgaaaggtatcctaccagaagtgaggccaaggatatttttgaagtatggtataaaatatccaattacacaggtaagtacgagggatcattatcgtttttgaataatggatatgaattttttattcccgatgaaagtcttctagaaatggagacaactttgcaaaattcgattgatgtgttgaacccgtatacaggagaaatgaatgcaaagagacatgcaagggagtttttagcaaaatatggaaaattgatggagaactgtaccaactttcctatcttcaccacaaattcgaaaagaatctacgatactgcgcaatattttgccgaggctttgggcgatggctttaatatatcacttcaaacacttagcgaaaattcctcgtcaggagcaaacacattagctgccaaaagttcgtgccccaattggaattcgaatgccaacaatgatatattaatgtcatattcgagggactacttagaaaatatttccgatcgtcttaatgacgaaaataaagggctgaacttgagcaggaaagatgcagcggccttgttttcttggtgtgccttcgagttgaacgcaaaaggttatagtaacatttgtgacattttctccgcggcagagttaatacattattcttatgagactgatttgacgagcttctaccaaaatggtcccggatacaaattgattaaatctataggtgctaatttgttcaatgcaacagtgaagctaatacgacaaagtgcgcacttggaccaaaaagtttggctgagctttacgcacgatactgatattctaaattatttgacaactgctggattgattgatgacactagaaatttaacaaccaatcatgttccctttcgtgatcattcctaccacaggtcgtggtacattcctcagggagctagagtctacacagaaaagtttcaatgctcaaacgattcgtacgtccgttatgtggtcaacgatgctgtggttcctatagagagttgctccagtggtccaggtttttcatgtgaagagggcacattttacgagtatgccaaagacagattacgaggtgtgagcttctatgaagattgcgacgtctccaaagttagcaaagaaaaggaattgacgttttactgggattggaacacaacaaggtataacgcatccttagtgaatcaataa

SEQ ID NO: 25284 - DNA, 1176 bp, Saccharomyces cerevisiae
atgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 25285 - DNA, 936 bp, Saccharomyces cerevisiae
atgactgcaagcacaccatccaatgtcatgacattgttcttgttaaggcatggacaaagtgaattgaatcacgagaatatattctgtggttggattgacgctaagctaaccgaaaaaggtaaagaacaagctcgtcattctgccgagctaatcgaacaatattgtaaagctaataatttgagattaccccagattggttacacctcacgtttaattaggacccaacagaccatagaaacgatgtgtgaagaatttaagttaaagccacaactgcaggttgtttacgactttaataaaatcaaacttggagacgaatttggcagtgatgacaaggataatatgaaaatcccgattcttcaaacttggaggctaaatgaacgtcattacggttcctggcagggccagaggaaaccgaatgttttaaaagaatatggtaaggataaatatatgttcattaggagagattacgagggtaagccaccacctgtagatcttgaccgtgagatgattcaacaagaaaatgagaagggctcttctactgggtacgaattcaaggagccaaacagacaaataaaatatgaattggaatgcagcaatcatgacattgtattaccggattccgaatctcttcgtgaagtggtttatagattgaatccttttctacaaaatgtcatattaaaattagccaatcaatatgatgaatcttcatgcctgattgtgggccatggaagttcagtgagatcgctactgaaaattctggagggtatatcagatgatgacatcaagaatgttgatattccaaatggtatccccttagtcgttgaattagataagaataatggtcttaagtttatcagaaaattctacctagatcctgaatctgctaagatcaatgctgagaaagtccgtaatgagggtttcataaaaaatccttaa

SEQ ID NO: 25286 - DNA, 1596 bp, Saccharomyces cerevisiae
atggcttctacggaacttagcctaaaaagaaccttaacggatattttagaagacgagttgtaccatactaatccaggtcacagtcagtttacgagtcattatcaaaactatcatccaaatgctagtattactccatataagttggtgaataagaacaaggaaaacaacacttttacgtggaatcattcattacaacaccagaatgaatcgagtgcagcttcgatacccccacaacaaacctaccatttcccgatattcaacaaatacgcggatcctactttaactaccaccacctcttttacgactagtgaagcaacggccaacgatagacagattaataatgtccatctcataccaaacgagattaagggtgctagcgaaaccccattgcagaagaccgtcaatctaaagaatataatgaaagtatcagacccgtatgtaccgacacggaatacgttcaattatgatgttaaaatttccaacgattttttcgataacggtgacaatctatatggtaatgatgaagaagtgcttttctatgaggataattataatccgaaaatgcagtggtcacttcaagataatagcgccgcaataaacaatgaggatgcgagagctatttttaacaatgaatttgactctgatgacgacgatatcagtgatgatgaagaggatgaaatagaagaaaattgtttgcaacaagagcaacaccaagaggagcctttactgtcattggatgttacaccaatctcaatgtttggctcagatcaaaaaacgggtcgtgccaagagttctagtcatttatttaatgagtacagttacgttgactctaacatggacagcatttccagtgttgtatctgaagatctgttagatgaacggggacatgagaagatagaggatgaggatgaggataatgatcttgatgaagacgatatctacgatatctctctcttgaagaacagaagaaagcaaagttttgtcctcaataaaaacactattgattttgaaagatttccatctccctcaacctcggcaaacgtaccgtctactgctactaccggtaaaaggaaaccagcaaaatcatccagtaaccgtagttgcgttagtaacagtaatgaaaacggcacattagaaagaataaagaagcctacatcagctgtagtaagctcaaatgctagtaggcggaagctaattaattatactaagaagcacttatcttcacattcatctacaaattcgaattcgaaaccttcgactgcatcaccatcggcccatacgtcatcttctgacggtaataacgaaatatttacgtgtcagataatgaatctcattacaaatgaaccgtgtggtgcccaattttcaaggtcctatgatttaacgagacaccaaaataccattcacgctaaaaggaagattgtcttccgttgctcggagtgtataaaaattcttggatctgagggctatcagaagacgttttcgagactggatgctttaacaaggcatataaaatcgaagcatgaagatttgtcgttagaacaacgtcaagaagttacaaaatttgcaaaggctaatattggttatgtcatgggttaa

SEQ ID NO: 25287 - DNA, 1524 bp, Saccharomyces cerevisiae
atgacaagcaaaacgaagaatatcgatgatatacctccagaaatcaaagaagagatgatacagctctatcatgatctaccgggtatagaaaatgaatataaactcatagacaagatcggtgagggaacattttcgtcagtgtataaagccaaagatatcactgggaaaataacaaaaaaatttgcatcacatttttggaattatggttcgaactatgttgctttgaagaaaatatacgttacctcgtcaccgcaaagaatttataatgagctcaacctgctgtacataatgacgggatcttcgagagtagcccctctatgtgatgcaaaaagggtgcgagatcaagtcattgctgttttaccgtactatccccacgaggagttccgaactttctacagggatctaccaatcaagggaatcaagaagtacatttgggagctactaagagcattgaagtttgttcattcgaagggaattattcatagagacatcaaaccgacaaattttttatttaatttggaattggggcgtggagtgcttgttgattttggtctagccgaggctcaaatggattataaaagcatgatatctagtcaaaacgattacgacaattatgcaaatacaaaccatgatggtggatattcaatgaggaatcacgaacaattttgtccatgcattatgcgtaatcaatattctcctaactcacataaccaaacacctcctatggtcaccatacaaaatggcaaggtcgtccacttaaacaatgtaaatggggtggatctgacaaagggttatcctaaaaatgaaacgcgtagaattaaaagggctaatagagcagggactcgtggatttcgggcaccagaagtgttaatgaagtgtggggctcaaagcacaaagattgatatatggtccgtaggtgttattcttttaagtcttttgggcagaagatttccaatgttccaaagtttagatgatgcggattctttgctagagttatgtactatttttggttggaaagaattaagaaaatgcgcagcgttgcatggattgggtttcgaagctagtgggctcatttgggataaaccaaacggatattctaatggattgaaggaatttgtttatgatttgcttaataaagaatgtaccataggtacgttccctgagtacagtgttgcttttgaaacattcggatttctacaacaagaattacatgacaggatgtccattgaacctcaattacctgaccccaagacaaatatggatgctgttgatgcctatgagttgaaaaagtatcaagaagaaatttggtccgatcattattggtgcttccaggttttggaacaatgcttcgaaatggatcctcaaaagcgtagttcagcagaagatttactgaaaaccccgtttttcaatgaattgaatgaaaacacatatttactggatggcgagagtactgacgaagatgacgttgtcagctcaagcgaggcagatttgctcgataaggatgttctcctaatatctgaatag

SEQ ID NO: 25288 - DNA, 1314 bp, Saccharomyces cerevisiae
atgggacaaggtgtatcatctggacaagacaaaaagaagaagaagggatctaatcagaaacccaaatatgaacctcccgttcaatctaaatttggtcgtaagaaaagaaagggaggtccagctactgctgaaaaattacccaacatatatccaagtactcgttgtaagttaaagcttctaaggatggaacgaattaaagaccatttgttattagaagaagaatttgtctctaactctgaaattttaaaaccctttgaaaagaagcaggaggaggaaaagaaacaattggaagaaatacgtggaaatccattgagcattgggacccttgaagaaattatagacgatgatcatgcgatagtgacaagtccaactatgcctgattattatgtatctatcttatcctttgtcgataaagagttactagagcctggatgttctgtgttattgcatcataaaaccatgtccatcgtaggtgttttacaggatgacgccgatccaatggtttcggtcatgaaaatggataagtcgccaacagaatcatacagtgatattggtggcttagaatctcaaattcaagaaataaaagagtctgtagagttaccgttaacacaccccgaactgtatgaagagatgggtatcaaacctcccaagggtgtgattctttatggtgcacccggtacaggtaagacattgctagcaaaggctgttgcaaatcaaacatctgccacattcttaaggattgttggctcagagttaattcaaaaatatttgggggatggtcctaggttgtgtaggcaaattttcaaagtagcgggtgagaatgcaccaagtattgtatttattgatgaaatagacgccattggtactaaaagatatgactccaatagtggtggtgagagagaaattcagagaaccatgctggaattgctgaaccagctggacgggttcgacgacagaggggatgtgaaggtgattatggccactaacaaaatcgagactcttgacccagcattaatcaggcctgggagaattgatcgtaaaatcttatttgaaaaccctgatctaagtactaagaaaaaaattttagggattcacacttccaagatgaatttaagtgaggacgttaatcttgaaactttagtaacaacaaaggatgatttgtcaggcgccgatatccaggcaatgtgtacagaagcaggtttgttagcccttagagagagaagaatgcaagttacagcggaggattttaaacaagccaaggagagagtcatgaaaaataaagttgaggaaaatttagaaggtttatacttgtga

SEQ ID NO: 25289 - DNA, 846 bp, Saccharomyces cerevisiae
atgagtaatcattctgaaatcttagaaaggccagaaacaccatatgacataacttatagagtaggtgtggcggaaaataaaaactcgaaatttcggaggacaatggaagatgttcatacgtatgttaaaaactttgcttcaagattagattggggatatttcgcggtgtttgatggacatgctgggattcaggcctccaaatggtgtggtaaacatcttcatacaattatagagcaaaacattttggcagatgaaacacgagatgttagagatgtattgaacgattcattcctagccattgacgaagaaattaatacaaaacttgtaggaaatagtggatgtactgctgctgtttgcgtattacgttgggagcttccggattcagtttctgatgattcaatggatttagcccaacaccaaagaaagttatatacagcaaatgttggtgattctcgaatagtattgtttagaaacgggaacagcataagactgacttatgatcataaggcatctgacactttggagatgcagagagttgaacaagcaggtggcctgataatgaaaagtcgtgtaaatggtatgctggcagtgacgagatcgttaggggataaattttttgatagtttagtagtgggcagcccatttaccacgagcgtagaaataacttctgaggacaaatttttaatcctagcgtgtgatggattatgggatgttattgatgatcaagatgcatgcgaattaatcaaggatattactgaacctaatgaagctgcaaaagtcttggttagatatgctttggaaaatggcacaacagataatgtaacggtcatggttgtcttcctctaa

SEQ ID NO: 25290 - DNA, 2256 bp, Saccharomyces cerevisiae
atgagtcaagttaatacaagccaaggaccggtagcccaaggccgtcaaagaagattatcatcactaagtgaattcaatgatccattttcgaacgcagaagtctactatggccccccaacagacccaagaaagcagaagcaggcaaagcccgctaagatcaaccgtacgaggactatgagtgttttcgataatgtatctcctttcaagaaaactggttttggtaaacttcaacagactagacgtggttctgaggatgacacctattcaagtagtcaaggtaatcgtcgtttctttatcgaagatgtcgataaaacacttaatgaactactggctgctgaggataccgataaaaattatcagatcaccatcgaggataccggtccaaaagttttgaaagtcggtaccgcaaactcctatggctataagcatattaatattaggggtacgtatatgttatccaatttgttgcaggaactaactattgcgaaaagttttggtagacaccaaattttcttagatgaagctcgtataaacgaaaatcccgtcaacagattatcaagattgataaacacacagttctggaactctttgaccaggagagttgatctgaacaacgtaggcgaaattgcaaaagataccaagattgatacgccgggggcaaaaaatccaagaatctatgttccttatgattgtccagaacaatacgaattttatgttcaagcttctcaaatgcatccatctttgaaattagaagttgaatatttaccaaaaaaaataacggcagaatacgtcaaatccgtcaatgatacccccggtttactagcattggctatggaagagcacttcaatccttctactggtgaaaaaactctcattggttacccttatgctgttcctggtggtagattcaatgaattatatggttgggactcctatatgatggcactaggtctcctagaagccaacaagactgatgttgcaagaggtatggtggagcattttatttttgagattaatcactatggaaaaatattgaatgctaacagaagctactatctatgtagatcacagcccccattcttgactgaaatggccttggtagtattcaaaaaacttggtggtaggagtaatcccgatgctgtggatttgttgaaaagagctttccaagcaagcataaaagagtacaaaactgtttggaccgcatctccaaggcttgatcccgaaacaggcttatccaggtaccatcctaacggtctcggtattcctccggaaactgaaagtgatcacttcgataccgttttactaccatatgcatcgaaacacggcgttaccttagacgaatttaagcaactttataacgatggtaagataaaggagcctaaattggatgagttttttcttcatgaccgtggcgttagagaatctggacacgacactacatataggtttgagggcgtatgtgcctacctggccactattgacctgaattctcttctttacaaatacgagattgatattgcagacttcataaaggaattctgcgacgacaaatatgaagatcctttagaccattctataacaacttcagctatgtggaaagaaatggccaaaatcagacaagaaaagattaccaaatatatgtgggatgacgagtcggggtttttctttgactacaacacaaaaatcaagcacagaacgtcatacgaatccgcaactacattctgggcattatgggctggacttgccacgaaggagcaagcacagaaaatggtggagaaagcactacccaagttagagatgcttggaggtttagctgcatgtacggagcgttctcgaggcccaatttctatttcgagaccaattagacaatgggactatccatttggttgggcaccccatcaaattcttgcttgggaaggcctccgttcttatggttatttaactgtaacgaataggctagcttatagatggcttttcatgatgacaaaggcttttgtcgattataatggtattgtggttgaaaaatatgatgtcacaagaggaacagatcctcatcgtgttgaagcagaatacggtaatcaaggtgctgactttaaaggggcagctactgaaggttttggatgggtcaatgccagttacattcttggtttgaagtatatgaacagtcacgcaagaagagcgcttggtgcttgcattccaccaatatcattctttagcagtttaaggcctcaagaaagaaacctctatggactatag

SEQ ID NO: 25291 - DNA, 474 bp, Saccharomyces cerevisiae
ggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagcaggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatag

SEQ ID NO: 25292 - DNA, 1563 bp, Saccharomyces cerevisiae
atgaatacaaacgttccaatattcagttctccggtcagagatttaccaaggtctttcgaacaaaaacatttagcggttgtagatgcatttttccaaacataccatgtcaaacctgattttatcgctaggtctcctggcagagtaaatctgattggtgagcatatagattattgcgatttttcagttttgccattagccattgatgtggatatgctttgcgcagttaaaattttagacgaaaaaaatccatccattaccttaacaaatgcggaccctaaatttgctcagcgaaagtttgatctgcctttagatggttcctacatggccatagatccgtctgtgtcggaatggtcgaattactttaaatgcggactacatgtggcacattcatacttgaaaaaaattgctccggaaagatttaataatacacccttagtaggtgcgcagatcttttgccagagcgatattcctactggtggtggactctcatctgcatttacttgcgcggcagcactagccacaattagagccaatatgggaaaaaattttgatatttccaaaaaagacttgacccgcatcacagcggttgctgagcactatgttggagtcaataatggtggtatggatcaagcaacgtctgtttatggggaagaagatcatgctctatacgtagagtttaggccaaaactaaaggccacacctttcaagtttcctcaattgaaaaatcatgaaatcagtttcgtcatcgccaatactcttgtaaagtctaataaattcgaaactgctcctacaaattacaatttaagagtaatagaggtaacagttgctgccaacgccttggcgaccagatacagcgtggccttaccatctcacaaggacaattctaactcagaaagagggaatctaagagattttatggatgcttactacgccagatacgaaaaccaagcccaaccatggaatggagatatcggaactggtattgaacgtttactcaagatgctacaattggtagaagaatctttctcgaggaaaaagagcggattcactgtacatgaagcctctacggcgctaaactgttcacgtgaggagttcactagagattacctgacaacttttcccgtccgcttccaagtcttgaaactatatcaaagagctaaacacgtttactccgaatccttaagggtgcttaaggctttaaaaatgatgacaagtgccacttttcacacggacgaagatttctttacagattttggccgactaatgaatgagtcccaggcctcttgtgataaactttatgaatgttcgtgcatagaaaccaatcaaatatgctcgattgccctagcaaatggttctttcggctcccgtctcactggcgctggttggggcggttgcactatccaccttgttcctagtggcgctaatgggaacgtggaacaggtacgaaaagcactaatcgaaaaattctacaatgtaagatatccggatctcacagatgaagaactaaaagacgcaattatagtttcgaagcctgccttgggtacttgtttgtacgaacaataa

SEQ ID NO: 25293 - DNA, 4506 bp, Saccharomyces cerevisiae
atgagcaatatcaaaagcacgcaagatagctctcataatgctgtcgctagaagctcaagcgcttcttttgcagcttcagaagaatcatttacgggcataacccatgacaaagatgagcagagcgataccccggcggataaactaacaaaaatgctgacaggacctgcaagagacactgcgagccagattagtgccactgtgtctgaaatggcgccagatgtcgtatctaaagtggagtcatttgcagatgcactatcccgtcatacaacgagaagcggtgcctttaatatggattcagatagtgacgatgggttcgatgcccatgccatctttgaaagttttgtaagagacgctgatgagcaaggcatccatatccgcaaggctggtgttaccatagaggacgtaagcgctaaaggtgtggatgcgagtgccctagaaggtgctacctttggtaacattctttgtttaccgttgaccatctttaaaggtattaaggctaagaggcatcaaaagatgagacagatcataagcaatgtcaatgccctggcagaagcgggtgaaatgattttggttcttggaaggcctggtgctggttgttcctcctttttaaaagtaacagctggtgaaatagatcagtttgccggtggtgtttccggtgaagtagcatatgatggtattccccaagaagaaatgatgaaacgatataaagcagatgttatttacaatggtgagttggatgttcatttcccttatttaacagttaagcaaactttggatttcgctattgcctgcaaaacgcctgctctcagagtcaataacgtttccaaaaaggaatacattgcatccagaagagatttatatgcaaccattttcggtctaaggcatacctataataccaaagttggtaacgatttcgttagaggtgtatctggtggtgaacgtaagcgtgtttccattgccgaggctttggcagccaaaggttccatttactgttgggataatgccactagaggtttggatgcgtctacggccttagaatacgcaaaagccatccgtattatgacaaacttattgaaatcaaccgcttttgttacaatttatcaggcaagtgaaaacatttacgaaacatttgataaagtcactgtcctttattctggtaagcaaatttattttggtttgatccacgaggcaaaaccttatttcgcaaaaatgggttatttgtgtcctccaaggcaagcaacagctgaatttttaaccgcgttgactgatccaaatggattccatctgatcaagccaggttatgaaaataaagtaccaagaaccgctgaggaattcgaaacatattggttaaattctccagagtttgctcaaatgaaaaaagatatcgctgcttataaagagaaggtcaataccgaaaagactaaagaagtttatgacgaatcgatggctcaagagaaatccaaatatacgagaaagaagtcttattatacagtgtcatattgggaacaagttaaactgtgtacccaacgtgggttccaaagaatttacggtaacaagagttatacagtcatcaatgtctgctctgcaataattcaatcttttattactggatcattattttacaataccccttcatccacttccggtgctttttcaagaggtggtgtgttgtattttgcgctactatattattctttgatgggactggcgaatatttcttttgaacataggccaatcttacaaaagcacaagggctattctttgtatcatccttcagctgaggcaattggctccactctggcatctttccccttcagaatgattggtttgacctgtttctttatcattttattcttcctatctgggttgcacagaacagcgggatcattttttaccatctatttgttcttaaccatgtgttcagaggcgatcaatggtttatttgagatggtttcttcagtatgtgacactctttctcaagctaactctatctcgggtattctgatgatgtctatctcaatgtactctacctatatgatccaattgccttcgatgcatccatggtttaaatggatatcgtacgtactacctatcaggtacgccttcgagtcgatgttaaatgccgaatttcacggtaggcatatggattgtgctaacactctagtacccagtggaggagactatgataatttatccgatgactacaaagtatgtgcttttgttggttcgaaaccaggtcagtcttatgtgcttggtgatgactaccttaaaaatcaatttcagtacgtttataagcacacgtggagaaactttggtatcttgtggtgctttttactgggttatgttgttttgaaagtgatattcacagaatataagaggcctgtgaaaggtggtggtgatgctcttatcttcaagaaaggatcaaaaagatttatcgcacatgcagatgaagaatctccagacaatgtcaatgatatagatgccaaagagcaattctccagtgaaagtagcggcgcaaatgatgaagtatttgatgatttagaagccaaaggtgttttcatttggaaggacgtatgctttactattccatatgaaggcggtaagagaatgcttttggataatgtttcaggttattgtattccaggtaccatgacggccttgatgggagagtcaggtgctggtaaaacaactttgttaaatactcttgctcaaagaaatgtcggtatcattactggtgatatgcttgtcaatggacgtcccattgatgcgagtttcgaaaggcgtacaggttatgtacaacaacaggatatacatatcgcagagttaactgttagggaatcgttgcagttttctgctcgtatgcgtcgccctcagcatttgcctgattctgaaaaaatggattatgtggaaaaaatcatcagagttttgggaatggaagagtatgcggaagcccttgttggtgaggttggttgtggtttaaacgttgaacagagaaagaagctgtctattggtgttgaactagtcgccaaaccagacttattattattcctcgatgaacctacatcaggtttggattctcaatcttcatgggccattattcaattattaagaaagttatcaaaagctggccaatccattctttgtacgatccatcaaccttcagctactctgttcgaagagtttgatagattactacttttgaggaagggtggacaaactgtttatttcggagatattggtaagaactctgccaccattttgaactactttgaaaggaatggggcaagaaaatgtgattctagtgaaaatcctgctgaatatattttagaggctattggtgccggtgccacagcatccgtcaaagaagactggcacgaaaaatggttgaactctgtcgagtttgaacaaacaaaagaaaaagtacaggatttaataaatgatttatcgaaacaagaaactaaatccgaagttggagacaaaccttccaaatatgctacttcttatgcttaccagttcagatatgttttaatcagaacctctacttcattttggagaagtctgaattacatcatgtcaaagatgatgctaatgctggttggtggtctgtatattggtttcacatttttcaatgttggtaaaagttatgtcggcttacaaaatgcgatgttcgcggcatttatctctattatcttgtctgctcctgcaatgaaccaaatccaaggacgtgctattgcctccagagaactttttgaagttagggaatcccaatctaacatgtttcactggtcgctggtgttgatcactcagtacttgagcgaacttccctatcatttatttttttcgacaattttctttgtctcatcgtattttccattaagaatcttcttcgaagcgtcaagatctgcggtgtactttttgaattactgcattatgttccagttatactatgttggtcttggcttaatgatcctatatatgtcaccgaaccttccatccgctaatgttatcttaggtttgtgtctgtcatttatgctttctttctgtggtgttacacaacctgtctcattgatgcctggcttctggacattcatgtggaaggcttccccatacacatattttgttcagaatctggtcggaattatgctgcacaaaaaaccagtcgtatgcaaaaagaaagaactaaactacttcaacccaccaaacggctcaacgtgtggagagtacatgaaaccctttttggaaaaagctactggttacatcgaaaatcctgatgctacgtcagattgtgcatactgtatttacgaagttggagataattatttgacacatatcagctctaagtatagctacttgtggagaaattttggaatattttggatttacattttcttcaatatcattgctatggtttgtgtgtattacctcttccatgtaagacaatcttccttcctaagccccgtatctatactcaataaaattaaaaacataaggaaaaagaagcagtaa

SEQ ID NO: 25294 - DNA, 1200 bp, Saccharomyces cerevisiae
atgtcgtttgacagagaagaagaccaaaaattgaagtttaaaacatcgaaaaaattaaaggtgtcttctacttttgaaagcatgaatctaaaagatgacttacttcgaggaatatactcatacggttttgaagcaccatcctctatccaatcaagggctattacacagattatttcgggcaaggacgttatagcacaagcacaatcaggtacaggtaagacagcaacttttacaatcggccttttacaagctattgatttaaggaagaaagatttacaagctctaatactatctccaacacgtgaattagcaagccaaattgggcaagtagtaaaaaatctaggggattatatgaatgtcaatgcatttgccattacaggtggtaaaactttgaaagacgacctgaagaaaatgcaaaagcatggttgccaggccgttagcggaacaccaggaagagtattagacatgattaagaaacaaatgttgcaaacaagaaatgttcaaatgttagttttagatgaggctgatgaattattgagtgagacactaggtttcaagcaacaaatatacgatatttttgcaaaattgcctaaaaattgccaagttgttgttgtcagcgcaacaatgaataaggacattttagaagtaaccagaaaatttatgaatgatccagttaaaatcctagtgaagagggatgaaatatcacttgaaggtatcaaacaatatgtcgttaatgttgacaaagaagagtggaaattcgatactctgtgtgatatatacgattctttgaccattacacaatgtgtgatattctgtaacaccaagaaaaaagtagattggttatctcagcggctaatccaatcaaactttgctgtagtctccatgcatggtgatatgaaacaagaagaaagagataaagtaatgaatgattttagaacaggtcattctcgtgtactgatatcgacggatgtttgggcgcgcggtattgatgtccaacaagtttctttagtcattaactatgacctaccagaaataatagaaaattacatccatcgtatcggtagaagtggtcgatttggtagaaagggtgtggctataaacttcattaccaaagctgatttagcaaaacttagagaaattgaaaaattctattctatcaaaataaatccgatgccagcaaattttgcagaattatcataa

SEQ ID NO: 25295 - DNA, 3045 bp, Saccharomyces cerevisiae
atgtcaacaaatctagcaaattacttcgccggtaagaaagatattgaaaacgagcatgtaaatagaaatgcgagccatgaaagtaatagcaaaagtgatgtcaaaattagtggtaacgataacgacaacgacgaagatatggggccttcagtatcgatggctgttcaagcgaaaaatgatgatgatttccataaatcaactttcaaccttaaaagaacaagatcaatgggccttcttgatgaatatattgaccctaccaagaaattgctaggaaggtcagacgacttatatgataacgacaatgaatattatgacaactcatctaataattcttcaagcaattcttcagatgatgattatgatgacggctatcaggaacactcaacctccgtttctccaccgccggcggataatgatagctacttaattccacaagatgataatgacgtagtggtagagccagaaagacatgttgactatctgtcacatgaatggaaagaatcagaaatttctaattcttggaaatatatcatcctaaagaaaaagaaaagagatgttgatctagtaaatgctgctaggttagaaaatgcctcatggagaacatgggcaaaagcaagaaacaacttgaaaacagtgtcacctgaagtggttaattggtcaaaagattctgatgtgacttggctatatggccctattgtaagagattctgaaggtaatgcccaaagtgaagaagaacatgatctagaaagaggatatggttcggatgatgaaaattccaagagaatttcaatgcccactaaaaattcaaagtcgatcgcagctgctccgaaaccaattttgaagaagagaaccgtcacagaaattatagaggacaacgctttatggaaactgaatgaggcaagaaaacacatgacagaaatgaaacatgcttcggtaataatggatcccaatggcaacaaaaacgtccatgacgatttcgatgctctggccgctcaagttaacgcccagtactaccattatcccaaagaatcgaacagtagcgttagtttgaagagtcaacactctgacaaaaaagataattctaccataccgaatcctgtaggagaaaattcaaatggtggcggtgacaagggagaagaagacctgcatttaaagtcagcgcttcatgttcaaaacaataggtcaacggcacaatcaaacaaaagcatactagaaaatagtaccaatgatcgtaaggctaacttggatcaaaacctaaattctcctgataataataggttcccctcctcaacatcttcctccaatagagataatgaaaacaattccatgggattatcatcaatattaacctcaaacccaagtgaaaaatctaacaaacctactaaaaatagacatatacattttaatgacagggtggaacaatgtatggcactacgatatccagcttcacaatcggaggatgatgaaagcgatgatgaaaataaacaatatgttgatgttaataacaatgcgaacgttacaacaataaacaacaataggactccattgctagccattcagcataaatctattcctatcaactccgcaactgaacatttgaacaaaaatactagcgacgatgatacatcctcacaatcatcatcttcatcacattctgatgatgaagaacacggcggcctttacataaatgcaagattttccaggaggtctgactctggagttcattcaccaataacagataattcctctgtggcttcatctactacttccagagctcatgtacgtcccataataaagttgcttcctgataccactttgaattatggatcagacgaagaatctgataatggcgaatttaatgggtatggtaatgctgtgtcacataacgtcaatacctccagaggctatgattacatatacgattataactcggtctacactggtgatacttccagttttttaccagtagattcatgtgacattgtagatgttcctgaaggaatggacttacaaacagccattgcagatgataatgcatcaaactatgaatttaacaatgcggtagaatccaaggaaaaacatgttccacaactacacaaagcttcagcaaataatacaacacgtcaacatggatcgcatatgttattatatgacgacgacaattacagctcttcatcagatagcgaacagcaatttattgaagactcacaatacaatagtagcgacgacgaagaggaagaagatgacgatgaccaagaagtagacgataaccacgatgaaggactttcactgaggagaacattgtcacttgggaaatcaggatctaccaattctttgtacgatctagcacaaccatcactctcttcggcaactcctcaacaaaaaaatcctactaattttacagggggtaaaactgatgtagacaaagatgcacaactggctgtcaggccgtatccgttgaagcgcaattcctcttcagggaacttcatattcaattcagatagtgaagaagagagtagcagcgaggaggaacaaagaccattacccgctaacagtcagctggttaatcgaagcgtattgaaaggcagtgtgacaccagcaaacatatcatctcagaagaaaaaagcccttccaaagcagccaaaagcgtccgatagttcacaaagctttagaattgtaaataatactccttcaccagccgaagtgggggcgagtgatgttgccatagagggttatttctctcctagaaatgaatctatcaagtctgttgtttccgggggaaatatgatggaccatcaagatcactcagaaatggacactttggcaaaaggatttgaaaactgccatataaataatgctagtaagctaaaggacaagaaagttgatagcgtgcaaaccactagaaaagaagcgtctttgacggattcgagtaatgaaagcttacacaaagtggtgcagaatgcaagaggtatggcaagcaagtacttgcactcttggaaaaagagtgacgtcaagccacaagaaaatggaaatgacagcagttag

SEQ ID NO: 25296 - DNA, 963 bp, Saccharomyces cerevisiae
atgtctacctttgaaactttaattaaaagaggtggtaacgaagccatcaaaattaaccctccaaccggtgcggatttccacatcactagtcgtggttccgattggttctggacatgtttctgttgttacctattatttggtttaattttaacattcttaatgttcagaaaaccagtcaatgacagattcttttaccttaccggtattgctccaaactttttcatgtgtatcgcttatttcaccatggcttctaacttaggttggattccagtcaaggctaagtacaaccatgtccaaacttctactcaaaaagaacatccaggttacagacaaatcttctactctagattcgttggttggttcttagctttgccatggccaattattcaaatctgtatgctagctggtaccccattctggcaaatggctttcaatgtttgtattactgaattcttcactgtttgttggttgatcgctgcctgtgttcactccacttacaaatggggttactacaccatcggtctaggtgctgctattgtcgttagtatcagtgttatgaccaccagttacaacttggtgaaacaaagagataacgatatcaggttgacattccttgttttcttcagcattattatgttcttgtggattattgcttacccaacttgtttcggtattaccgatggtggtaacgttttgcagccagactctgccggtattttctatggtatcattgatcttattttgatgtgtttcattccaactttattggttccaattgctaaccacttcggtgctgacaaattgggctaccatttcggacctagtgatgccgaagcagtgatggctccaaaagctccagttgctagtccaagacctgctgctacaccaaacttgagtaaggacaagaaaaagaagtctaagaagagcaagaaatctaagaagtctaagaagtctgaagaataa

SEQ ID NO: 25297 - DNA, 1113 bp, Saccharomyces cerevisiae
atgttcattaaaaacgatcacgccggtgacaggaaacgcttggaagactggagaatcaaaggttatgatccattaacccctccagatctgcttcaacatgaatttccaatttcagccaaaggtgaggaaaacattatcaaggcaagagactccgtctgtgatattttgaatggtaaagatgatcgtttagttatcgtgatcgggccatgttccctacatgaccccaaagccgcttacgattacgctgacagattggctaaaatttcagaaaagttgtcaaaagacttattgattattatgagagcgtatttagaaaaaccaaggactactgttggctggaaagggttgattaacgaccctgatatgaataactcttttcaaatcaataaaggtctacggatttcgagagaaatgttcataaaactggttgaaaaattacccattgctggtgagatgttggataccatttctccgcagtttttgagtgattgtttctccttgggtgccatcggcgccagaactactgaatcccaactgcacagagaattagcatccggtctatctttccctattggatttaagaacggtactgatggtggtttgcaagtcgccatcgacgctatgagagccgctgcacatgaacattacttcctttctgtcacaaagccaggtgtcactgctatcgtgggcactgaaggtaacaaggataccttcctgatcttgagaggtggtaagaacggtactaactttgacaaagaaagtgttcaaaatactaagaaacagttagaaaaggccggtttgactgatgattcccagaaaagaattatgatcgattgttcccacggcaacagtaataaagatttcaagaaccaaccaaaggttgccaaatgtatttatgaccagctgacggagggtgagaatagtctctgtggtgttatgattgagtccaacataaatgaaggtagacaagatattcccaaagaaggtggcagagagggattgaagtatggttgttctgttacggatgcttgtattggctgggagtccaccgaacaggtattggagctattggcagaaggtgttagaaacagaagaaaggccttgaaaaaatag

SEQ ID NO: 25298 - DNA, 2847 bp, Saccharomyces cerevisiae
atgagcgagggaactgtcaaagaaaacaataatgaagaattcaatgcttatcacacattgactacagaagaagccgctgaatttataggcacaagtctgactgaaggtcttactcaagatgagtccctccgcagactgaaagcagtgggagagaacacattgggtgatgataccaaaattgactataaagcaatggtcctccatcaggtatgtaatgcaatgattatggtcttggtaatatccatggcgatctctttcgctgtgcgcgactggattactggtggcgttatttcttttgttatcgcggtcaatgtgctcattggcctagttcaagaatataaggctaccaagacaatgaactctttgaaaaacttgagctctcccaatgctcatgttattaggaacgggaaaagtgagactataaactcaaaagatgtggttccaggtgatatttgtctggtgaaggtcggtgatactattcctgctgatttgcgtttaattgaaactaagaattttgatactgatgaatcactactgaccggtgaatctttgcctgtctccaaagacgccaacttagtgtttggaaaagaagaagaaacctccgtgggtgatcgtttgaatttagcattttcttcatccgccgttgtcaagggaagagccaagggtattgtcatcaagacagctttgaatagtgaaattggtaaaattgcaaaatctctacaaggtgattcaggtctcatttcccgcgatcctagtaagtcgtggttacagaatacatggatatctacaaagaaagttactggtgcatttttaggtacaaatgtcggtacgcccctgcacaggaaactgtctaagttggcggtattgcttttctggattgccgtactttttgctatcatcgtcatggcctctcaaaagtttgacgtagataaaagggtagctatctatgccatttgtgtggccctatccatgattccctcttcattagtcgttgtcttgaccatcaccatgtctgttggggctgctgttatggtttctagaaacgttattgtaagaaaattagattctctggaagctttaggtgccgttaacgatatctgttctgacaagaccggtactcttacacagggtaaaatgttagcgaggcaaatttggatccctcgctttggtaccataactatctcgaattctgatgacccctttaatcccaatgagggcaacgtgagtttgattccaaggttttcaccttacgaatattctcataatgaggatggtgacgttggtattctccagaatttcaaggatcgcctatacgaaaaagatttaccagaagatattgacatggatctatttcaaaaatggctcgaaaccgccactttggctaacattgctactgttttcaaagatgacgcaactgactgttggaaagctcatggtgacccaacagaaattgcgattcaagtgtttgctactaagatggacttgcctcacaatgcccttaccggtgagaaatcgactaatcaaagtaatgagaatgaccaatcctctctttcacaacacaatgagaagcctggcagtgcacaattcgaacatattgctgaattcccattcgactcaactgtgaagcgaatgtcatctgtctactacaacaatcacaacgaaacatataatatttatggcaagggtgctttcgaaagcatcatcagttgttgcagttcttggtatggtaaggatggtgtaaaaatcacaccattgaccgattgtgatgtcgaaacgataaggaaaaatgtttacagtctatcaaatgagggtttaagagtcttgggttttgcctccaaatctttcactaaagatcaagtgaatgacgatcaattgaaaaacattacttcaaacagggccaccgcagaaagtgatttagttttcctagggttgattggtatttacgatccacccagaaatgagactgccggtgcagtcaagaagtttcaccaagctggtattaacgttcatatgttaactggggactttgtgggtacagcaaaggctatcgctcaggaggttggcatcttacccaccaatttgtaccattactcccaagagattgttgacagtatggtcatgaccggatctcagtttgacggactaagtgaggaggaagtggacgatttgcccgtcttacctttagttattgcacgttgctctccgcagactaaggtgagaatgatcgaagctttacaccgtaggaagaagttctgcgcaatgacaggtgacggtgttaacgattctccatctctaaaaatggccaatgttggtattgcaatgggtattaatggttcagatgtttccaaagaagcgtctgatattgttctaagcgatgacaattttgcttctattttgaatgctgtcgaagaaggtcgtaggatgacggataacattcagaagtttgtcctacaattattggcagaaaatgttgctcaggctttgtatttgatcattggtttagtattcagagatgagaacggaaaatcagtatttcccttatcaccagtggaagtattgtggattattgtcgtcacctcttgttttcctgctatggggctaggtctagaaaaggctgctccagatttgatggatagacctcctaatgattcagaggttggtattttcacatgggaggttattatagatacatttgcatatgggattataatgacagggtcctgtatggcttcatttactggatcactgtatggaataaatagtggtagattggggcacgattgtgatggcacctataacagcagttgtcgtgatgtttatagatcacgttctgcggctttcgcaact

SEQ ID NO: 25299 - DNA, 3276 bp, Saccharomyces cerevisiae
atgagcgagggaactgtcaaagaaaacaataatgaagaattcaatgcttatcacacattgactacagaagaagccgctgaatttataggcacaagtctgactgaaggtcttactcaagatgagtccctccgcagactgaaagcagtgggagagaacacattgggtgatgataccaaaattgactataaagcaatggtcctccatcaggtatgtaatgcaatgattatggtcttggtaatatccatggcgatctctttcgctgtgcgcgactggattactggtggcgttatttcttttgttatcgcggtcaatgtgctcattggcctagttcaagaatataaggctaccaagacaatgaactctttgaaaaacttgagctctcccaatgctcatgttattaggaacgggaaaagtgagactataaactcaaaagatgtggttccaggtgatatttgtctggtgaaggtcggtgatactattcctgctgatttgcgtttaattgaaactaagaattttgatactgatgaatcactactgaccggtgaatctttgcctgtctccaaagacgccaacttagtgtttggaaaagaagaagaaacctccgtgggtgatcgtttgaatttagcattttcttcatccgccgttgtcaagggaagagccaagggtattgtcatcaagacagctttgaatagtgaaattggtaaaattgcaaaatctctacaaggtgattcaggtctcatttcccgcgatcctagtaagtcgtggttacagaatacatggatatctacaaagaaagttactggtgcatttttaggtacaaatgtcggtacgcccctgcacaggaaactgtctaagttggcggtattgcttttctggattgccgtactttttgctatcatcgtcatggcctctcaaaagtttgacgtagataaaagggtagctatctatgccatttgtgtggccctatccatgattccctcttcattagtcgttgtcttgaccatcaccatgtctgttggggctgctgttatggtttctagaaacgttattgtaagaaaattagattctctggaagctttaggtgccgttaacgatatctgttctgacaagaccggtactcttacacagggtaaaatgttagcgaggcaaatttggatccctcgctttggtaccataactatctcgaattctgatgacccctttaatcccaatgagggcaacgtgagtttgattccaaggttttcaccttacgaatattctcataatgaggatggtgacgttggtattctccagaatttcaaggatcgcctatacgaaaaagatttaccagaagatattgacatggatctatttcaaaaatggctcgaaaccgccactttggctaacattgctactgttttcaaagatgacgcaactgactgttggaaagctcatggtgacccaacagaaattgcgattcaagtgtttgctactaagatggacttgcctcacaatgcccttaccggtgagaaatcgactaatcaaagtaatgagaatgaccaatcctctctttcacaacacaatgagaagcctggcagtgcacaattcgaacatattgctgaattcccattcgactcaactgtgaagcgaatgtcatctgtctactacaacaatcacaacgaaacatataatatttatggcaagggtgctttcgaaagcatcatcagttgttgcagttcttggtatggtaaggatggtgtaaaaatcacaccattgaccgattgtgatgtcgaaacgataaggaaaaatgtttacagtctatcaaatgagggtttaagagtcttgggttttgcctccaaatctttcactaaagatcaagtgaatgacgatcaattgaaaaacattacttcaaacagggccaccgcagaaagtgatttagttttcctagggttgattggtatttacgatccacccagaaatgagactgccggtgcagtcaagaagtttcaccaagctggtattaacgttcatatgttaactggggactttgtgggtacagcaaaggctatcgctcaggaggttggcatcttacccaccaatttgtaccattactcccaagagattgttgacagtatggtcatgaccggatctcagtttgacggactaagtgaggaggaagtggacgatttgcccgtcttacctttagttattgcacgttgctctccgcagactaaggtgagaatgatcgaagctttacaccgtaggaagaagttctgcgcaatgacaggtgacggtgttaacgattctccatctctaaaaatggccaatgttggtattgcaatgggtattaatggttcagatgtttccaaagaagcgtctgatattgttctaagcgatgacaattttgcttctattttgaatgctgtcgaagaaggtcgtaggatgacggataacattcagaagtttgtcctacaattattggcagaaaatgttgctcaggctttgtatttgatcattggtttagtattcagagatgagaacggaaaatcagtatttcccttatcaccagtggaagtattgtggattattgtcgtcacctcttgttttcctgctatggggctaggtctagaaaaggctgctccagatttgatggatagacctcctcatgattcagaggttggtattttcacgtgggaggttattatagatacatttgcatatgggattataatgacagggtcctgtatggcttcatttactggatcactgtatggaataaatagtggtagattggggcacgattgtgatggcacctataacagcagttgtcgtgatgtttatagatcacgttctgcggctttcgcaaccatgacgtggtgcgctttgattctggcttgggaagtggttgacatgagaagatcctttttcagaatgcatccagacactgacagcccagtcaaggaatttttcagaagtatttggggaaaccagtttttgttctggtcaatcatttttggatttgtgtcagccttccccgtcgtctatattccggttattaatgataaagtgtttttgcataaaccaattggtgctgaatggggtctcgccattgcattcacaattgcattctggataggtgctgaactttacaagtgtggaaagaggcgctatttcaaaactcagagagcgcacaacccggagaatgatttggagagtaacaataagcgcgatccattcgaagcgtatagtacttctactacaatccatacagaagttaatattggtattaaacaatga

SEQ ID NO: 25300 - DNA, 3276 bp, Saccharomyces cerevisiae
atgggcgaaggaactactaaggaaaacaataatgcagaattcaatgcttatcacacgctgactgcagaagaagccgctgaattcataggcacaagtctaactgaaggtttgacccaagatgagttcgtccacagattgaaaacagtgggtgagaacacattgggtgatgacactaaaattgattacaaggcaatggtcctccatcaggtatgtaatgccatgatcatggtccttctaatatccatgataatctcgtttgccatgcatgattggattactggtggcgttatttcttttgttatcgcggtcaatgtgctcattggcctagttcaagaatataaggctaccaagacaatgaactctttgaaaaacttgagctctcccaatgctcatgttattaggaacgggaaaagtgagactataaactcaaaagatgtggttccaggtgatatttgtctggtgaaggtcggtgatactattcctgctgatttgcgtttaattgaaactaagaattttgatactgatgaatcactactgaccggtgaatctttgcctgtctccaaagacgccaacttagtgtttggaaaagaagaagaaacctccgtgggtgatcgtttgaatttagcattttcttcatccgccgttgtcaagggaagagccaagggtattgtcatcaagacagctttgaatagtgaaattggtaaaattgcaaaatctctacaaggtgattcaggtctcatttcccgcgatcctagtaagtcgtggttacagaatacatggatatctacaaagaaagttactggtgcatttttaggtacaaatgtcggtacgcccctgcacaggaaactgtctaagttggcggtattgcttttctggattgccgtactttttgctatcatcgtcatggcctctcaaaagtttgacgtagataaaagggtagctatctatgccatttgtgtggccctatccatgattccctcttcattagtcgttgtcttgaccatcaccatgtctgttggggctgctgttatggtttctagaaacgttattgtaagaaaattagattctctggaagctttaggtgccgttaacgatatctgttctgacaagaccggtactcttacacagggtaaaatgttagcgaggcaaatttggatccctcgctttggtaccataactatctcgaattctgatgacccctttaatcccaatgagggcaacgtgagtttgattccaaggttttcaccttacgaatattctcataatgaggatggtgacgttggtattctccagaatttcaaggatcgcctatacgaaaaagatttaccagaagatattgacatggatctatttcaaaaatggctcgaaaccgccactttggctaacattgctactgttttcaaagatgacgcaactgactgttggaaagctcatggtgacccaacagaaattgcgattcaagtgtttgctactaagatggacttgcctcacaatgcccttaccggtgagaaatcgactaatcaaagtaatgagaatgaccaatcctctctttcacaacacaatgagaagcctggcagtgcacaattcgaacatattgctgaattcccattcgactcaactgtgaagcgaatgtcatctgtctactacaacaatcacaacgaaacatataatatttatggcaagggtgctttcgaaagcatcatcagttgttgcagttcttggtatggtaaggatggtgtaaaaatcacaccattgaccgattgtgatgtcgaaacgataaggaaaaatgtttacagtctatcaaatgagggtttaagagtcttgggttttgcctccaaatctttcactaaagatcaagtgaatgacgatcaattgaaaaacattacttcaaacagggccaccgcagaaagtgatttagttttcctagggttgattggtatttacgatccacccagaaatgagactgccggtgcagtcaagaagtttcaccaagctggtattaacgttcatatgttaactggggactttgtgggtacagcaaaggctatcgctcaggaggttggcatcttacccaccaatttgtaccattactcccaagagattgttgacagtatggtcatgaccggatctcagtttgacggactaagtgaggaggaagtggacgatttgcccgtcttacctttagttattgcacgttgctctccgcagactaaggtgagaatgatcgaagctttacaccgtaggaagaagttctgcacaatgacaggtgacggtgttaacgattctccatctctaaaaatggccaatgttggtattgcaatgggtattaatggttcagatgtttccaaagaagcgtctgatattgttctaagcgatgacaattttgcttctattttgaatgctgtcgaagaaggtcgtaggatgacggataacattcagaagtttgtcctacaattattggcagaaaatgttgctcaggctttgtatttgatcattggtttagtattcagagatgagaacggaaaatcagtatttcccttatcaccagtggaagtattgtggattattgtcgtcacctcttgttttcctgctatggggctaggtctagaaaaggctgctccagatttgatggatagacctcctcatgattcagaggttggtattttcacgtgggaggttattatagatacatttgcatatgggattataatgacagggtcctgtatggcttcatttactggatcactgtatggaataaatagtggtagattggggcacgattgtgatggcacctataacagcagttgtcgtgatgtttatagatcacgttctgcggctttcgcaaccatgacgtggtgcgctttgattctggcttgggaagtggttgacatgagaagatcctttttcagaatgcatccagacactgacagcccagtcaaggaatttttcagaagcatttggggaaaccagtttttgttctggtcaatcatttttggatttgtgtcagccttccccgtcgtctatattccggttattaatgataaagtgtttttgcataaaccaattggtgctgaatggggtctcgccattgcattcacaattgcattctggataggtgctgaactttacaagtgtggaaagaggcgctatttcaaaactcagagagcgcacaacccggagaatgatttggagagtaacaataagcgcgatccattcgaagcgtatagtacttctactacaatccatacagaagttaatattggtattaaacaatga

SEQ ID NO: 25301 - DNA, 987 bp, Saccharomyces cerevisiae
atgcctgcccctcaagatccaaggaatcttccaattagacaacaaatggaagctcttatccgtcgcaaacaagctgaaatcacgcaaggtttggaatccatcgatactgttaagttccacgctgatacttggacccgtggtaacgatggtggtggtggtacctctatggttatccaagacggtacaactttcgaaaaaggtggtgttaatgtctccgttgtttatggtcaattgagcccagcggccgtttcagccatgaaagctgatcataagaatctgcgtctaccagaagatccaaagactggtttgccagttaccgacggtgtcaagttcttcgcttgtggtttaagtatggtcattcatcccgttaacccacacgctccaaccacgcacttaaactaccgttacttcgaaacttggaaccaagatgggaccccacaaacttggtggtttggtggtggtgctgatttgacaccttcttacttatacgaagaagacggtcaattattccaccaactgcacaaggatgccttggacaagcacgacactgctttgtacccacgtttcaagaaatggtgtgatgagtacttctacattacccaccgtaaggaaacacgtggtattggtggtatattctttgacgattatgatgaacgtgacccacaagaaatattgaagatggttgaagactgtttcgatgctttcttgccatcctacttgactatcgtcaagagaagaaaagatatgccatatacaaaggaagaacaacaatggcaggccattagacgtggtagatacgttgaattcaacttaatctacgatagaggtacccaattcggtttgagaaccccaggctctagagttgagtcaattttgatgagtttgcctgaacatgcttcatggttatacaaccaccaccctgctcctggttccagagaagctaaattactagaagttaccaccaaaccaagagagtgggttaaataa

SEQ ID NO: 25302 - DNA, 333 bp, Saccharomyces cerevisiae
atgctttcgttttgtccttcgtgtaacaatatgctactgataacgagtggcgatagtggtgtatatacattagcatgccgttcatgtccatatgagtttcctatagagggtatagaaatctatgataggaagaaacttccaagaaaggaagttgatgatgttcttggtggtggttgggacaatgtggatcaaaccaaaacccaatgtcccaattatgatacttgtggtggtgagagtgcttactttttccaactacaaattaggtcagctgatgagccgatgactaccttttataagtgtgtaaactgtggtcatagatggaaggaaaattaa

SEQ ID NO: 25303 - DNA, 1815 bp, Saccharomyces cerevisiae
atgtcagatcctatagtaacgtcttccaaaatggaaaaaagtgcagagtttgaagtaacagactctgctttatataataacttcaatacatcaacaacagcttcactaactccggagattaaggaacattctgaggaatctcgcaatgggttagttcacagattcgtcgactcattcagaagagccgaaagccaacgtttagaagaagacaatgacttggaggatggtaccaaatcgatgaaatctaataaccacttaaaaaagtcaatgaaatctagacatgttgtaatgatgtctttaggtacagggataggaacaggtcttctagttgccaacgccaaaggtttgagtcttgcaggcccggggtctttagtcatcggttacgttatggtgtccttcgtcacgtattttatggtccaagcggctggtgagatgggtgtcacttatccgacgcttccaggtaacttcaatgcatacaattcaatctttatttcaaagtcgtttgggttcgcgaccacttggttattttgcattcagtggttaactgtgctaccgttggaattgattacttcttccatgaccgtcaagtactggaatgacacaattaatgctgatgtattcattgtcattttctatgtgtttttattgtttatccacttttttggtgttaaggcatacggtgaaacggaatttatcttcaattcctgtaagatattgatggttgcaggattcattattttatcagtcgtcatcaattgtgggggagccggtgtggacggctatattggcggcaaatattggcgcgaccctggttcatttgcagaaggcagcggtgccactcgtttcaaagggatatgttatattctagtatctgcatatttctccttcggtggtattgaattatttgttctttccatcaatgagcagtctaaccctagaaaatccactcctgtagccgcgaagagaagtgtatatcgtattttgatcatttatttgctgacaatgattctaattgggttcaatgttcctcacaataacgatcaattgatgggttccggtggctccgcaacgcacgcttcaccatatgtcttggcagcctctattcacaaggttagggtcatcccccatatcattaatgctgttattttgatatcagtcatctctgttgcgaactctgccctttatgccgcaccgagattaatgtgttccttggctcaacagggctatgctccaaaatttttgaactatattgatagggagggaagacctttaagggccttggtagtgtgctctcttgttggtgtcgttggcttcgtcgcctgttctccacaggaagagcaagcatttacatggttggcagccattgcaggtttgagtgaacttttcacatggtcaggcattatgctttcacacattcgattcagaaaagcgatgaaagtccaaggaagatcacttgatgaagtcggctataaggccaataccggtatatggggttcatactatggggtttttttcaatatgcttgtctttatggcccaattttgggtcgcactgtctccaataggaaatggcggaaagtgtgatgctcaggcattcttcgagagttatctggctgccccgctatggatattcatgtatgttggatacatggtttacaaaagagattttacctttttaaacccactggacaagatcgacttggactttcatagaagagtttacgaccctgaaataatgaggcaggaggacgaagaaaataaagaaaggttaaagaactcttcaatattcgtcagagtctacaaattttggtgttag

SEQ ID NO: 25304 - DNA, 1089 bp, Saccharomyces cerevisiae
atgggtaactttccagctccaaaaaacgatttgatattgagagccgcaaagggtgaaaaagtcgagagaccgccatgctggataatgcgccaggcaggtcgttacctgccggaatatcacgaggtgaaaaacaatcgtgatttctttcaaacttgcagggatgcggaaattgcttctgagattactatccagccggtaagacgctatagaggcctcattgatgctgctattatttttagtgatatcttagttattccgcaagccatgggtatgagggtcgagatgctcgaaggtaaaggtccacatttcccagaacctttaagaaatccggaagacctccaaacggtattagactacaaggttgatgttttgaaagagttagattgggctttcaaggcaatcaccatgacaaggatcaagttggatggtgaggttcccttatttggcttttgcgggggaccttggactctaatggtttatatgacggaaggcggtggatcccgtcttttcagatttgccaaacaatggattaacatgtatccagagctttctcacaaattattacaaaaaatcactgatgtggccgtggagtttctgagtcagcaagtcgtggcgggtgctcaaatactacaagtttttgaaagttggggtggtgagctttcgtctgtagattttgatgagttttccctaccatatttaagacaaattgccgaaagagtgcctaaaagattgcaagaattaggtatcatggaacagattcctatgatcgtttttgcgaaagggtcgtggtatgctttggacaagctatgctgttcaggatttgacgttgtttcgttggactggtcctgggacccaagagaagcggtaaaaataaacaagaaccgtgtcaccttgcagggcaacctggatcctggcgtcatgtatggttctaaagaggtaataacaaagaaagttaaacagatgattgaggcttttggaggtgggaagtcccgctacattgttaatttcggtcacggtacccaccctttcatggatccagacgtcatcaagtttttcttggaggagtgccacagaattggttcgaagtaa

SEQ ID NO: 25305 - DNA, 747 bp, Saccharomyces cerevisiae
atggctagaactttctttgtcggtggtaactttaaattaaacggttccaaacaatccattaaggaaattgttgaaagattgaacactgcttctatcccagaaaatgtcgaagttgttatctgtcctccagctacctacttagactactctgtctctttggttaagaagccacaagtcactgtcggtgctcaaaacgcctacttgaaggcttctggtgctttcaccggtgaaaactccgttgaccaaatcaaggatgttggtgctaagtgggttattttgggtcactccgaaagaagatcttacttccacgaagatgacaagttcattgctgacaagaccaagttcgctttaggtcaaggtgtcggtgtcatcttgtgtatcggtgaaactttggaagaaaagaaggccggtaagactttggatgttgttgaaagacaattgaacgctgtcttggaagaagttaaggactggactaacgtcgttgtcgcttacgaaccagtctgggccattggtaccggtttggctgctactccagaagatgctcaagatattcacgcttccatcagaaagttcttggcttccaagttgggtgacaaggctgccagcgaattgagaatcttatacggtggttccgctaacggtagcaacgccgttaccttcaaggacaaggctgatgtcgatggtttcttggtcggtggtgcttctttgaagccagaatttgttgatatcatcaactctagaaactaa

SEQ ID NO: 25306 - DNA, 2115 bp, Saccharomyces cerevisiae
atggtttctccaacgaaaatgataataaggtctccgttaaaggaaacagataccaacttgaaacataataatggaattgccgcatcaacaacagcagcgggccacttgaatgtgttttctaacgacaataattgcaacaataacaataccactgaatcctttccgaagaaaagatctcttgagcgcctcgagctccaacagcagcagcatttgcatgaaaagaaaagggccagaatagaaagggccaggtctattgaaggcgctgtccaagtcagcaaaggtacgggtctgaaaaatgtcgagccaagggttacgcctaaggaattgctggaatggcaaacaaattggaaaaagataatgaaaagagattctcgcatttactttgacattactgatgatgtagagatgaatacatataataagtccaagatggacaaacgcagagatttattgaaaagagggtttcttacattgggtgcgcaaataactcaattttttgacactactgtcacaatagttatcacaagaaggtctgttgagaacatatatttactaaaagataccgacattttatcgagagctaaaaaaaactacatgaaagtttggagttacgaaaaggctgccagatttctgaaaaatcttgatgttgatttggatcatttgagcaagactaaatctgcttctttagctgcgcccacattgtccaatcttctacacaatgaaaaattatatggaccaacggatagagaccccagaactaaaagagacgatattcactactttaaatatcctcatgtatacctttatgacctatggcaaacttgggcccccataataactttggaatggaaacctcaagaactaacaaacttagacgaactaccttacccaatattgaaaataggttcattcggaagatgcccttttataggggataggaattatgacgaaagttcttataagcgcgtagtaaagagatactcgagagacaaagcaaacaaaaaatatgcactgcaacttcgtgctctatttcaatatcatgccgacaccttactgaatacgtcatcagttaatgatcaaacgaaaaacctaatattcatacctcacacatgcaacgattctaccaagagcttcaaaaaatggatgcaagaaaaggcaaaaaattttgagaagaccgagttaaagaagacggatgatagcgcagttcaagatgttcgtaatgaacatgctgaccaaaccgatgaaaaaaatagtatattattaaatgaaactgaaaccaaagagcctccgttgaaagaagaaaaagaaaataaacaatctatagcagaagaatcgaataagtacccacagcgaaaagagctggctgccacaccaaaactaaaccatccagtattagctacttttgcaaggcaagaaactgaagaagtgccggatgatttgtgcactttgaaaacaaagtcacgtcaggcatttgaaatcaaagcaagtggtgcacatcaatctaatgatgtggcaacctcttttggcaatggtttgggcccaacaagagcaagcgtcatgagtaagaacatgaagtcattaagtagactaatggttgatagaaagctgggagtaaagcagacaaatggaaataacaaaaattatacagccactatagcaactactgctgaaacatcaaaggaaaatagacacagattagattttaatgctttgaaaaaagacgaagccccttcgaaagagacgggcaaagatagtgctgtacacttagaaactaatagaaagccccagaatttccctaaggtagctaccaaatcagtctccgcagactccaaagttcataatgacatcaagataacaaccacagaatctccaacagcatcgaagaaatcaacttccacaaacgtcaccttacattttaacgcacagacagcacagacagcacagccggtgaagaaagaaacggtaaaaaattccggatactgtgaaaattgtcgtgtaaaatacgaatctttagaacaacacatagtttctgagaagcatttgtctttcgctgaaaacgatttaaattttgaggctattgactcgttaattgaaaatctcagatttcaaatatag

SEQ ID NO: 25307 - DNA, 888 bp, Saccharomyces cerevisiae
atgagtagtcgcaaaagcaccgcttctagcttactgttacggcaatatagagaacttactgatcctaagaaagctattccctcatttcatatagaactagaggatgattcaaatattttcacttggaacataggtgttatggtgctaaatgaggattccatttatcatggagggtttttcaaagctcaaatgagatttccggaagactttcccttttctccaccacagtttcgatttacgccggctatctaccatccaaacgtttacagggatggcaggctttgtatttctattttacatcaaagtggggatcctatgaccgacgaacctgatgctgaaacgtggtcccccgtgcagaccgtggaaagtgtgttgatctctatagtatctctattagaggaccccaatatcaactcgccagcaaatgtcgatgccgctgttgattacagaaagaaccctgaacaatacaagcaaagagtcaaaatggaagtggaaagatcgaaacaagatatccctaaaggtttcataatgcccacttctgaatcggcgtacatatctcaaagtaaactagatgaaccagaatcgaataaggatatggcggataatttttggtatgatagtgatttggacgacgatgagaacgggtccgtcattttacaagacgacgactacgacgatggaaacaaccatatcccctttgaagatgatgacgtttacaactataacgacaacgacgacgatgacgaaagaatcgaattcgaagatgatgacgatgatgacgacgatagtatagataacgacagcgtcatggataggaaacaaccccacaaggctgaagatgaaagtgaagatgtggaggatgtagaaagagtttcaaagaaaatataa

SEQ ID NO: 25308 - DNA, 537 bp, Saccharomyces cerevisiae
atgtcttcctccaagcgtattgccaaggaattaagtgatttagggaggtatgttaaaaataaaatgaatgatttttcttgatctgtaaagaaaaaggattactaacatgagtttcttttttgaacttttttccgaagagatcctcctgcttcatgttcagcaggacctgtaggggatgacctgtatcattggcaagcctctattatgggtccttcagactcaccctacgctggtggcgttttctttttgtctattcactttccaactgattatccattcaagccaccgaaggtaaactttacgaccaaaatttatcatccgaatattaattcgagtggtaatatctgccttgatattttaaaggaccagtggtcaccggcgctaaccctttcaaaagttttgttgtctatttgctctcttttaacagatgctaatcccgacgatcctttggtccctgaaattgctcaaatctacaagacagataaggctaagtatgaagccaccgctaaggagtggactaaaaaatatgctgtttga

SEQ ID NO: 25309 - DNA, 1686 bp, Saccharomyces cerevisiae
atgagtactcctgcaaactatacccgtgtgcccctgtgcgaaccagaggagctgccagacgacatacaaaaagaaaatgaatatggtacactagattctccggggcatttgtatcaagtcaagtcacgtcatgggaagccactacctgagcccgttgtcgacacccctccttattacatttctttgttaacatatctaaattatttgattctgattatattaggtcatgttcacgacttcttaggtatgaccttccaaaaaaacaaacatctggatcttttagagcatgatgggttagcaccttggttttcaaatttcgagagtttttatgtcaggagaattaaaatgagaattgatgattgcttttctagaccaactactggtgttcctggtagatttattcgttgtattgatagaatttctcataatataaatgagtattttacctactcaggcgcagtgtatccatgcatgaacttatcatcatataactatttaggcttcgcacaaagtaagggtcaatgtaccgatgccgccttggaatctgtcgataaatattctattcaatctggtggtccaagagctcaaatcggtaccacagatttgcacattaaagcagagaaattagttgctagatttatcggtaaggaggatgccctcgttttttcgatgggttatggtacaaatgcaaacttgttcaacgctttcctcgataaaaagtgtttagttatctctgacgaattgaaccacacctctattagaacaggtgttaggctttctggtgctgctgtgcgaactttcaagcatggtgatatggtgggtttagaaaagcttatcagagaacagatagtacttggtcaaccaaaaacaaatcgtccatggaagaaaattttaatttgcgcagaagggttgttttccatggaaggtactttgtgtaacttgccaaaattggttgaattgaagaagaaatataaatgttacttgtttatcgatgaagcccattctataggcgctatgggcccaactggtcgcggtgtttgtgaaatatttggcgttgatcccaaggacgtcgacattctaatgggtactttcactaagtcgtttggtgctgctggtggttacattgctgctgatcaatggattatcgatagactgaggttggatttaaccactgtgagttatagtgagtcaatgccggctcctgttttagctcaaactatttcctcattacaaaccattagtggtgaaatatgtcccggacaaggtactgaaagattgcaacgtatagcctttaattcccgttatctacgtttagctttgcaaaggttaggatttattgtctacggtgtggctgactcaccagttattcccttactactgtattgtccctcaaagatgcccgcattttcgagaatgatgttacaaagacggattgctgttgttgttgttgcttatcctgctactccgctgatcgaatcaagagtaagattctgtatgtctgcatctttaacaaaggaagatatcgattatttactgcgtcatgttagtgaagttggtgacaaattgaatttgaaatcaaattccggcaaatccagttacgacggtaaacgtcaaagatgggacatcgaggaagttatcaggagaacacctgaagattgtaaggacgacaagtattttgttaattga

SEQ ID NO: 25310 - DNA, 2781 bp, Saccharomyces cerevisiae
atggagcagaatattattagtaccataagggatgagtgtattcgtcaccggtcgaagtaccttacgatagcacaactaaccgctattgcagaggctaaaattaacgaattcatcataactggtaaggcaaaagatcaagatttgagcagtcttctagataaatgcatcgatattttatctatttacaagaagaactcgaaagatatcaaaaatattatatcgtgcaaaaataagggtgcaatgattagttcaaattccgtaatgattattcaattaaattatgtttactacaaggtaattcacattattgtaacaaccaatattcctcatttaagtgaattcgccaagattaaattacataagagcacgagtgatgagggcaacggtaataacaacaataatgaatttcaactcatgaacatttacaacactttgctggaaaccttattaaaagatgaaaacattgcaaaaataaaaagtttcattaagtcttccataaaacaaacaaaattgaaccatgagcaagaagaatgtaacctgatgagaacgggttcctatatcacttccaatcaattaaactccctaataagttcatcagcaaattctgcttcctcccaaatggagatactactgatagatatacgatcaaggttggaattcaacaagtcacatattgatacaaaaaatattatatgcctggagcctatttcttttaaaatgtcatattcagatcatgatttggagaaaaaatcattaattacttctcctaatagtgagattaaaatgtttcaaagtagaaatcttttcaagtttatcattctctatacagacgcaaacgaatacaatgttaaacagcagtctgtcctgttggacattctggtgaatcattcctttgaaaaaccaatatccgatgactttaccaaaattttcattctggaatctggttttccaggttggcttaagtcaaattatgggaggcaagtatcatcatcttttccatcaaataacaatattaaagatgatagtgtttatattaatggtaacacttctggcctaagtttacaacatttacctaagatgtctcccagtataagacattcaatggacgactctatgaaagaaatgctagttgcgcctactccattaaatcatcttcaacaacagcaacaacagcaatcagacaatgatcatgtgctaaaaagatcttcaagtttcaaaaaattattctcaaattatacgtctcctaatccgaagaattcaaattcaaacttatattctatatcttcgttgtccatatctagttcaccatcgcctttacctctacattcgcctgacccagttaagggcaattcattgccaatcaattatccggaaacgccacatctttggaaaaacagtgagacagattttatgacaaatcaaagagaacagttgaatcacaactcttttgctcacatagctcctatcaacacgaaggccatcacttctccatcaagaactgccacaccgaagttacaacgcttcccgcaaacaattagtatgaaccttaatatgaactccaatggacacagttctgccacctctaccattcaaccttcgtgtctatccttgtctaataatgactctttagatcatacagatgttacaccaacttcttctcataattatgaccttgatttcgcggttggtttggaaaatctaggaaattcgtgttacatgaactgtatcattcagtgtatcttaggtacacacgaattaacccaaatctttttggacgattcatatgctaaacacatcaatattaatagtaagttgggatcgaaaggtattctggcaaaatattttgcaaggttggttcatatgatgtataaggaacaggttgatggttcaaagaaaatttccatatcaccgataaaatttaaattggcatgtggatctgttaactcattatttaagactgcatcccaacaggactgccaagagttttgccaattccttctagatggtcttcatgaagacttgaaccaatgcggttcaaacccacctttgaaggagctttctcaagaagctgaggcgagaagagaaaaactgtctttgcgaattgcctcgtcaattgagtgggaacgattcttgactactgatttcagtgttattgtcgacttatttcagggacaatacgcctcacgactaaaatgtaaagtctgtagtcatacctcgacaacataccaaccttttacggtgctgtcaatccctattcctaaaaaaaattcccgaaataatattaccattgaagattgtttcagagagttcaccaaatgtgagaacttggaagtggatgagcaatggttgtgcccacattgtgaaaaaaggcagccctccacgaaacaattgacaataacgagattaccgaggaatctgatagtccatttaaagagatttgataatttattaaacaaaaataatgacttcgtcatatacccttttttgttggacttgactccattttgggccaatgattttgacggggtttttcctccaggtgttaatgacgatgaactaccaataaggggacaaataccaccttttaagtatgaattatatggtgtagcatgccactttggtactttgtatggtggtcattatacagcctatgtgaaaaagggattaaagaagggatggctatattttgatgataccaaatataaacctgtcaaaaacaaagccgatgcaattaactctaatgcatacgttttgttttatcaccgcgtctacggtgtttga

SEQ ID NO: 25311 - DNA, 2691 bp, Saccharomyces cerevisiae
atgaccaccactgcccaagacaattctccaaagaagagacagcgtatcatcaattgtgtcacgcagctgccctacaaaatccaattgggagaaagcaacgatgactggaaaatatctgctactacaggtaacagcgcattattttcctctctagaataccttcaatttgattctaccgagtacgagcaacacgttgttggttggaccggcgaaataacaagaaccgaacgcaacctgtttactagagaagcgaaagaaaaaccacaggatctggacgatgacccactatatttaacaaaagagcagatcaatgggttgactactactctacaagatcatatgaaatctgataaagaggcaaagaccgatactactcaaacagctcccgttaccaataacgttcatcccgtttggctacttagaaaaaaccagagtagatggagaaattacgcggaaaaagtaatttggccaaccttccactacatcttgaatccttcaaatgaaggtgaacaagaaaaaaactggtggtacgactacgtcaagtttaacgaagcttatgcacaaaaaatcggggaagtttacaggaagggtgacatcatctggatccatgactactacctactgttattgcctcaactactgagaatgaaatttaacgacgaatctatcattattggttatttccatcatgccccatggcctagtaatgaatattttcgttgtttgccacgtagaaaacaaatcttagatggtcttgttggggccaatagaatttgtttccaaaatgaatctttctcccgtcattttgtatcgagttgtaaaagattactcgacgcaaccgccaaaaaatctaaaaactcttccaatagtgatcaatatcaagtctctgtgtacggtggtgacgtactcgtagattctttgcctataggtgttaacacaactcaaatactaaaagatgctttcacgaaggatatagattccaaggttctttccatcaagcaagcttatcaaaacaaaaaaattattattggtagagatcgtctggattccgtcagaggcgtcgttcaaaaattaagagctttcgaaactttcttggccatgtatccagaatggcgagatcaagtggtattgatccaagtcagcagtcctactgccaacagaaattccccccaaactatcagattggaacaacaagtcaacgagttggttaactccataaattctgaatacggtaatttgaatttttctcccgtccagcattactatatgagaatccctaaagatgtatacttgtccttactaagagttgcagacttatgtttaatcacaagtgttagagacggtatgaataccactgctttggaatacgtcactgtcaaatcgcacatgtcgaactttttatgctacggaaatccattgatcttaagtgagttttctggctctagtaacgtattgaaagatgccattgtggttaacccatgggattcggtggccgtggctaaatctattaacatggctttgaaattggacaaggaagaaaagtccaatttagaatcaaaattatggaaagaagttcctacaattcaagattggactaataagtttttgagttcattaaaggaacaggcgtcatctaatgatgatatggaaaggaaaatgactccagcacttaatagacctgttcttttagaaaattacaagcaggctaagcgtagattgttcctttttgattacgatggtactttgaccccaattgtcaaagacccagctgcagctattccatcggcaagactttatacaattctacaaaaattatgtgctgatcctcataatcaaatctggattatttctggtcgtgaccagaagtttttgaacaagtggttaggcggtaaacttcctcaactgggtctaagtgcggagcatggatgtttcatgaaagatgtttcttgccaagattgggtcaatttgaccgaaaaagttgatatgtcttggcaagtacgcgtcaatgaagtgatggaagaatttaccacaaggaccccaggttcattcatcgaaagaaagaaagtcgctctaacttggcattatagacgtaccgttccagaattgggtgaattccacgccaaagaactgaaagaaaaattgttatcatttactgatgactttgatttagaggtcatggatggtaaagcaaacattgaagttcgtccaagattcgtcaacaaaggtgaaatagtcaagagactagtctggcatcaacatggcaaaccacaggacatgttgaagggaatcagtgaaaaactacctaaggatgaaatgcctgattttgtattatgtttgggtgatgacttcactgacgaagacatgtttagacagttgaataccattgaaacttgttggaaagaaaaatatcctgaccaaaaaaatcaatggggcaactacggattctatcctgtcactgtgggatctgcatccaagaaaactgtcgcaaaggctcatttaaccgatcctcagcaagtcctggagactttaggtttacttgttggtgatgtctctctcttccaaagtgctggtacggtcgacctggattccagaggtcatgtcaagaatagtgagagcagtttgaaatcaaagctagcatctaaagcttatgttatgaaaagatcggcttcttacaccggcgcaaaggtttga

SEQ ID NO: 25312 - DNA, 927 bp, Saccharomyces cerevisiae
atgatggacttagataagattatagcatcactgagagacggaaaacatattcctgaagaaaccgtttttaggctatgtttaaattcacaggaactattaatgaatgaaggcaatgtaacacaagtcgatacaccggttacaatatgcggtgatatacatggccaattacacgatctactaacgctcttcgaaaagagtggtggtgtagagaaaacaaggtatattttcttgggcgattttgtggataggggattttactcattggagagttttttacttttactatgttacaaattaagatatcctgataggattactttaattagaggcaatcacgaaacccggcaaattactaaagtatacggattttacgatgaagtagtaagaaaatatggtaatagtaacgtatggaggtactgctgtgaagtttttgattatttatcattgggggcaataataaacaatagcatattctgtgttcatggtggattatctccggatatgaccacggttgatgaaatacgaacaatagacaggaaacaagaagttccacatgaaggtgctatgtgtgacttattatggagcgaccccgaagacgttgacacatggtcattatcaccaagaggtgctggatttcttttcggtaaaagagaagttgatcaattcttagagaaaaacaacgttgagttaattgctagagctcatcagttagtgatggaaggttacaaagaaatgttcgacggtggattagtgacagtctggtcggcaccgaattactgttatcgttgtggtaatgtagcagctgtattgaagatagacgacgatttgaatcgtgaatatacaatttttgaagctgttcaggcacaaaatgaagtcggaaatgctataattccaaccaaaaaatctcaaatggactatttcttataa

SEQ ID NO: 25313 - DNA, 1863 bp, Saccharomyces cerevisiae
atggagggctcatatctatctgcacaagaaaaccaacccataccggagcgattgatacctaggtcgaactcaacttcgaatttgtttgctttgtctagtacattctctaaactcaatgttaggaatgatgctgattacaattattcgaacccgaataagaagagacacatttatagtggcgagatagactgtaggtctgtgacagcagctagaaaatttccagtaaggtcctgttcaatgacagccgcccagcaaagaaagagaactgcgctattcacagttagggaaagaaactcttaccatgaggggttcaataatgatcaagattatgtgagccaataccagaagccacagtacactttcggagtatataaagaattaacaccttatcaactgcagcgctctaaaatgaaaagaagctttcaatttcccaatggcgaaatatacaagccaaaacttgatggaaaatgcacccacagcttgaaaaagcctgaattaaattcaagagactcttctttattcaaattcagcgagaagaaaggtcgcaatttatcaaaagattttgtggggcctcataatgggacatcagtcatacatattcctcccaatgatacaggctacggtgtaaatagcttggagctgaacacttcagttccttcaacaataaaaagttcggtttcatcaacctctccgatatctgctgttaataccctgaccagcttgccagaaagtcaaactgatgatgatgacggttatgaaaataaaactgtaactatatcttattgcttcgaaaatacggtaaatgaaaaacatggtagccatatagaaaaattggatttatcaactaaggaaaaaactaagccaacaactaattcaggcctatttgatagaaagaaaaagactattctgggcactgagaaatatagatgtataaagtcacaatcgaagttgaaactgggttctgttttgaagaaattatggcgtacttcaggaaactcgaatacaaagcatggaaaaaaggatacaaaaagaaggagaattcctatcgatgatatggttacgcattctgatggaaattctgaagctgagaatgatattgaattaatggatgcaaatctggacggcattgaatttgacgacgacgaaactctaatggatacagattcaatttttgatgatctgttgtccaaggaaaatgataaatacgatttgaggcgaaggcaattagaaatacgacaaaagctccacgagacctcgcacaacgacgatggcaaggtttcttttcgagataccgaaaagcataatgtcaatgaaggtttgatcgacaagaccataatcgaagaattttcaaagctcggtgaatatataatcgacacgagaaatcaaccaccaccaagatcgtccaagaggccttcattagatgacaatgaatctgcacgatacttctacaacatatcgacagatttgcgacagtctctgtcaggtccaataagcttaccaatgcatgttgggaacgacatggtaaataggttgagaaatgactgggagtatatcagattcgaagatagaaggaattcgctgccagattcctcatttgataaagtcgaaacacctccaaaaccaataaaaaaagatgtccggtttgcaaaagaagtatgtttagcaagcacttggtcatcgaatgcatatgagagagctaatccggaattcattatgaatcgccacagattgttgtggatgatgaaagtacatccaagcatgaatagtgccatgaatgagatcaaacttgaacttaactcttacaaaaaaaatgagatggttgtccatgagaacagcaagtgctttacacattatttaatttga

SEQ ID NO: 25314 - DNA, 730 bp, Saccharomyces cerevisiae
atggcatcattacccaagagaataatcaaggtatgttcaaacaagagcagtggattatatacgaaatctgaagtgacgttttcgtctgagccgtcacactctacactgtttcctcttgataatggctagaacttacatactaacgcaaaacttccaaaacaagaaggctttttttgtccagtttgtagcagcgttccgccttccctttgtccatatccgcaaacgctcatatggagggaattcaacagaacaaactactagggcagaaaacgcaaagtctttgtgaactttcatataggaaactgagaaattagtaagtgacccagtacctggcattacagcagaaccacatgacgacaacttacgttacttccaagtaacaatcgaaggcccagaacagtcaccatatgaagacggtattttcgaattagaattatatctgcctgacgactatccaatggaagcaccgaaagtacgttttttaaccaagatatatcatcccaatattgataggttgggccgtatatgtcttgatgtgcttaaaactaattggtcacccgctttacagatcagaaccgtcctgctgtccattcaagcactgttggctagccctaatcctaatgatccgctagctaatgacgtcgctgaagattggataaagaatgagcaaggtgccaaagctaaggctcgcgaatggacgaaattgtatgcaaagaagaaacccgagtga

SEQ ID NO: 25315 - DNA, 4807 bp, Saccharomyces cerevisiae
cgtggatgatattgagcatgaatcgggatcagcatctaatggtctgtcgtccatgtcaccatttgacgatagttttcaatttgaaaaacccagtagtgcgcatggaaatattgaagtagcgaaaaccggcggttctgttttgaagcgacaatctaagccaatgaaagatattagcacacccgatctctcaaaagttacttttgatggaatcgatgattatagtaacgataatgatattaatgatgatgatgaactcaatggtaaaaaaaccgagatacatgaacacgaaaatgaggtggatgatgacctccattcgttccaggcaacacctatgcctaatactggaggctttgaggatgttgagttggataacaatgaaggtagcaacaatgattcccaggcagatcataagttgaaaagagtacgttttggtacaagaagaaataagtcaggtaggatagatataaataggtcaaaaacattgaaatgggccaagaagaacttccacaatgctattgatgaattcagtacaaaagaagacagtctcgaaaattcagccttgcaaaataggtctgatgagttgagaacagtttactataatttacccttgccggaggacatgcttgacgaggacggcttaccgttggcagtttacccgcgtaataaaatcaggactacgaagtatactccattaacattttttcccaagaacattcttttccaatttcataattttgccaatatttactttttaatactgttgattctaggtgcttttcaaatatttggtgtgacaaatccaggttttgcatccgttcccctaattgtcatcgtaattatcactgctattaaggatggtatcgaagattccagaaggactgtattggatttagaagttaataatacaagaacacatatcttaagcggggtgaagaatgaaaatgttgctgttgataacgtttccttatggaggcgtttcaagaaagcgaatacaagggcattgattaaaatttttgagtatttttcagaaaacctcactgctgctggtagagaaaagaagttacagaaaaaaagggaagaattacgaaggaagaggaactcgagaagctttgggccacgtgggtctctggattcaattggtagttacagaatgtctgccgactttggtcgtccctctttggattatgagaacctgaatcaaacaatgtcacaggctaacaggtataacgatggtgaaaatttagttgatcgaacgctacagccaaaccctgaatgtaggtttgccaaggattactggaaaaatgttaaagttggtgatattgttcgtgttcacaataacgatgaaattcctgctgatatgatcttattatcgacatcagatgttgatggcgcttgttatgtggaaaccaaaaatttggatggtgaaacaaatctaaaggtccgtcaatcattaaaatgtagcaagattattaagagttcaagggatattaccaggacgaagttttgggttgaaagtgaaggcccacatgccaacttgtattcttatcaaggtaatttcaaatggcaagatacacaaaatggaaacatcagaaatgagcctgtaaatatcaataacttattattgagaggttgtaccttgagaaacactaagtgggccatgggtatggttatttttactggtgacgataccaagattatgataaacgctggtgtcactccaaccaaaaaatccagaatttcaagagagttgaatttttctgtgattttgaattttgtactattgtttatcctatgtttcactgctggtattgttaacggtgtttattataaacagaaacctcgatcgagagattattttgaatttggtaccattggaggttctgcctcaactaacggttttgtttctttttgggtggcggttattctttatcagtcattggttccgatctctttatatatttctgtggaaattattaagacagcacaggctattttcatttacactgatgttttgttgtataatgccaagctagactatccatgtacaccaaagtcgtggaacatctccgatgatttgggtcaaattgagtatattttttcagataaaacaggcaccttgacacaaaatgtgatggaattcaaaaaatgtactattaacggtgtgtcttatggacgtgcctatacggaggcactagcaggcctgaggaagagacaaggtgttgatgtcgaatcggaaggtcgtcgcgaaaaggaagagatagcaaaagatagggaaacaatgatcgacgaattaagatcaatgagtgataatacacagttttgtccggaggatttaacttttgtatctaaggaaattgtggaagacttgaaaggatccagtggcgaccatcaacaaaagtgctgtgaacactttttgctggcgctcgcattatgtcattctgtccttgtggagccaaataaagatgatcctaaaaaactggacatcaaggctcaatcacctgatgagtctgccttagtttccaccgccagacaattagggtacagtttcgttggtagttcaaaaagtggattgatagtagagatccagggtgttcaaaaggagttccaagttctgaacgtacttgaattcaattcgtcgagaaaaaggatgagttgcattatcaagatccctggctctacaccaaaggatgaacctaaagcactgttaatatgtaaaggtgcggattccgttatctattcaagattagatcgcactcaaaacgacgctactttgttggaaaagacggccctccatttggaagaatatgccacagaaggtttaagaacattatgtttggctcaaagagagctcacgtggtccgagtatgaacgttgggttaagacttatgatgtggccgctgcatccgttactaatagggaggaagagttggacaaagttactgacgttattgaacgtgagcttattttgcttggtggtacggccattgaggatcgtttacaagatggtgttcctgattcgattgccctcttggccgaggccggtattaagttatgggtcctaacgggtgataaagtggaaactgccattaacattggtttttcctgcaatgttttgaacaatgatatggaattattggttgtgaaggcttccggcgaagatgtagaagaatttggtagtgaccctattcaagtggttaacaatttggtgacaaaatacttaagggaaaaatttggcatgagtggatccgaggaggagttaaaagaagctaaaagagagcatggtttgccacagggaaattttgctgtcattatcgatggcgatgcgctaaaagttgctttgaatggtgaagaaatgagacgcaagttcttgctactgtgtaagaattgtaaagctgttttgtgttgcagagtttctccagcacaaaaggctgcagtggtcaagttggtaaaaaagaccttagacgttatgaccttggccattggtgatggttcgaatgatgtagccatgattcaatcggcggacgttggtgttggtatcgcgggtgaagaaggcagacaagctgtcatgtgttctgattatgccatcgggcagttcagatatgtgacaagactggtattggtgcatggtaaatggtgttataagagactggcagagatgatcccacagtttttctacaagaacgttatttttacgctatccctgttctggtatggtatttacaataatttcgatgggtcgtatttgtttgagtatacgtacttgacattctacaatcttgcattcacatccgtacctgttattttactagcagtactcgaccaagatgtttccgacaccgtttcgatgctggtgccacagttgtaccgtgtgggtatcctaagaaaagaatggaaccaaaccaaatttctttggtacatgttggatggtgtataccaatctgtgatatgcttctttttcccctatttggcgtaccataaaaacatggttgtaactgaaaatggccttggactagaccaccgttactttgtcggtgtcttcgttacagcaattgcagtcacttcatgtaacttttacgtcttcatggaacagtatagatgggactggttctgtggcctattcatatgtctatcactggccgtgttttacggctggacgggtatatggacaagctcgtcgtcaagtaacgaattttacaagggtgcggcgcgtgtattcgcacaacctgcctattgggcagtacttttcgttggcgtgctgttctgcctactgccaagattcaccattgactgtatcagaaagatattctatccgaaagatatagagatcgttagagaaatgtggttacgcggtgattttgacctctacccacaaggctacgaccctacggaccctagcaggcccagaataaacgaaatacgtccccttacagatttcaaagagcccatttcactggacactcattttgatggtgtcagccactcacaagagaccatagtcacagaggaaataccaatgagtatactcaatggtgagcaaggctcgcgcaaggggtaccgtgtctctaccactctggaacgccgtgaccagctcagccccgttacaacaacgaacaacttgcctagaagatcaatggccagtgcccgcggaaataagctcagaacttcgctggatcgcacaagagaagagatgcttgccaaccaccaactggacacaagatactccgtggaaagagcacgtgcctcgctggatctgccgggtatcaatcatgcagagacgctgctcagccagcgcagcagggaccgttaa

SEQ ID NO: 25316 - DNA, 3729 bp, Saccharomyces cerevisiae
atggccccagctacccctaaaacttctaagactgcacacttcgaaaatggctccacatcttctcaaaagaaaatgaagcaatcgagtttgttatcttttttctcaaaacaggtaccttctggcacaccgtcaaagaaggtccagaagcctactccagcgactttagaaaatacagctactgataagataacaaagaatccacaaggaggaaagacaggcaaacttttcgtagatgtagacgaagacaatgatttgacaatagctgaagaaacggtatcaactgtaaggagtgacataatgcattctcaagagccccaatctgatactatgttaaatagtaacacgacagaacctaaaagtaccactacggacgaggatttatcatcttcccaatctcgaaggaatcacaaaaggagagtgaattatgccgaaagtgatgatgatgactcagatactacattcactgctaaacggaagaagggtaaggtagttgatagtgaaagcgatgaggatgaatatttaccagataaaaatgacggcgatgaagatgacgatattgcagacgacaaagaggacatcaaaggagaattggcagaagatagtggtgatgacgatgatttaatctctctggcagaaacgacttctaagaaaaaattttcatacaacacttcgcattcttcatcgccctttacaagaaatatatcccgtgacaactcaaaaaagaaaagcaggccaaatcaggcaccaagtagatcgtacaatccttctcatagtcaaccatcagcgacttctaagtctagcaaattcaataaacaaaatgaagaacgatatcaatggttagtggatgaacgagatgctcagcgccgtcccaagagtgatccagagtacgatccaagaacactgtacatcccatcttctgcatggaacaagtttactccgtttgaaaaacaatattgggaaattaaatccaaaatgtgggattgtattgtctttttcaaaaagggtaagttctttgaattatatgaaaaggatgcattattggctaatgcattatttgacttaaagattgcaggtggaggacgcgctaatatgcaactagctgggattccagagatgtcatttgaatattgggccgctcagtttatccaaatgggatataaagttgcgaaagtggatcaaagagagtcaatgttggctaaagaaatgagggaaggttctaaaggtatcgttaaaagagaactccagtgcatattgacatcgggtacgttaactgatggagatatgttgcattcggatctggctactttttgtcttgccatcagggaagaacctggtaacttctacaatgaaactcagctagattcatcaacgatagtgcaaaagctgaatacaaaaatattcggtgcagcattcattgatactgcaactggtgagcttcaaatgctggagtttgaagatgatagtgaatgcaccaaattggacacattaatgtcgcaagtaagacctatggaagtcgtcatggagaggaataacttaagcacactagctaacaaaattgtaaaattcaattcagcacccaatgcaatttttaatgaggttaaagccggtgaagaattttatgactgcgataaaacctatgctgaaatcatatcatcagaatacttttctacggaagaagattggccagaggttttgaaatcctattatgatacgggtaaaaaagttggctttagtgcatttggtggattattgtattatttgaagtggttaaaactggataagaatttaatttcgatgaaaaatatcaaagagtacgattttgtaaaatcgcaacactccatggttttagatggtatcactttacagaacttggaaatattttccaattcgtttgatggttctgataagggtactttgttcaaattattcaacagggctattactccaatgggtaagagaatgatgaaaaagtggttaatgcatccattattacgtaagaatgatattgaaagcaggctcgatagtgttgactctttgttacaagatattacattaagagaacagctagagataacattttcaaaattgccagatttggaaagaatgttggcccgtatccatagtaggacaattaaagtgaaagattttgaaaaggtaattaccgcttttgaaacgattattgaattacaagactctttaaagaacaacgatttgaagggagatgtttcaaaatacatatcctctttccctgagggacttgtggaagctgtcaaaagctggactaatgcttttgaaagacaaaaagcaatcaatgaaaatatcattgtaccacaaaggggatttgacatagagtttgataagtcaatggatagaatacaggagctagaagacgaattgatggaaattctgatgacttataggaagcaattcaaatgttccaatatacaatataaagattccggaaaggagatatacactattgaaattcctatctctgcaactaaaaatgtcccatcaaattgggttcaaatggctgcgaacaaaacgtacaagagatactactctgatgaagtaagagctttagcaagatcgatggcggaggctaaagaaatacacaagacgttagaggaggacctaaaaaatagattatgtcaaaaatttgatgcgcattataatacaatttggatgccaaccatacaggccatctctaacatagattgtttgttggcaattacaaggacatctgaatatctaggtgctccctcttgtaggccaaccattgtagatgaggtggactcgaaaacgaatactcaattaaatggttttctgaaatttaaatcattaagacatccatgctttaacctcggcgctactacagcaaaggacttcattcctaacgacattgaattaggtaaagaacagcccagattaggattgttaacgggtgccaacgcagctggtaaatccacgatattgaggatggcatgtattgccgtaattatggcacaaatgggatgttatgttccttgtgaatctgccgttctgacgccgattgatagaatcatgactcgtttaggcgctaatgataatatcatgcaaggtaaatctactttttttgtggaattggcggaaacaaaaaaaatattagacatggctaccaataggtcattattagttgttgacgagttgggaagaggaggttcatcgagtgatggttttgcaattgcagaaagtgtgctacatcatgtcgcgacacatattcaaagtctgggtttttttgccacacattatgggacattggcatcaagtttcaagcaccatcctcaagtaagaccactgaaaatgagcattctagtcgatgaagcgactaggaacgttacatttttgtataagatgcttgaaggacaaagtgaaggctcttttggtatgcatgttgcgtcaatgtgtggcatttcaaaggaaattattgataacgcgcagattgccgctgataatttagaacatacttctaggctagtcaaagaacgtgatttagctgcaaataatttgaatggtgaagttgtctctgtgccaggtggcttacaaagtgatttcgttcgaattgcgtacggagatggactgaagaatacaaaattaggttctggtgaaggggtcttgaactatgattggaacataaaaaggaacgttttgaaaagtctatttagtataattgatgatttacaatcctaa

SEQ ID NO: 25317 - DNA, 822 bp, Saccharomyces cerevisiae
atgtcccaaactcgtgaagattctgtttacctagctaaattagctgaacaagccgaacgttatgaagaaatggtcgaaaacatgaaggccgttgcttcatcaggtcaagagttatctgtcgaagaacggaatctattgtcggttgcttacaagaacgtcatcggtgctcgccgtgcttcatggagaatagtttcttcgatcgaacaaaaagaagaatcaaaggagaaatctgaacatcaagttgaattaatccgttcttaccgttctaaaattgaaactgaattgaccaaaatctctgacgacattttatctgtgttagattctcatttaatcccttctgctactactggtgagtctaaagtattttactataagatgaagggtgactaccaccgttatttagctgaattttccagcggagatgcaagagaaaaggcaaccaactcctctttggaggcttataaaaccgcttccgaaatcgccacaactgaattgcctccaactcacccaattcgtttaggtctagctttgaatttctccgtcttctattacgaaattcaaaactctcctgataaggcttgccacttggccaaacaagcctttgatgatgctattgctgagttagatactttatctgaagaatcatacaaggatagcactttgatcatgcaattattaagggacaacttgaccttatggacctctgatatttctgaatctggtcaagaagatcaacaacaacaacaacaacagcaacagcaacagcaacaacagcaacaacaagctccagctgaacaaactcaaggtgaaccaaccaaataa

SEQ ID NO: 25318 - DNA, 2754 bp, Saccharomyces cerevisiae
atgatggaaactcctacagacaatatagtttccccttttcacaattttggtagctcgacacaatatagtggtaccttgtcgagaactcccaaccaaataatagagctagagaagcccagtactctatccccattgtcaagaggaaaaaaatggacggaaaagttagccaggttccaaagaagtagtgctaaaaagaaaagattctcaccttctcctatttcctcctctacattttcgttctcacccaaatctagggtcacttcttcaaactcttctggcaatgaagacggtaacctaatgaatacaccttctacggtttccactgattatttgccacaacaccctcacagaacatcgtctttgccaagacctaattccaatctctttcacgcaagtaatagtaacctatcccgagcaaatgagcccccaagggccgaaaatttatcagataatataccacccaaggtcgctccatttggctatccaatacaaagaacctctattaaaaaatcctttttgaatgcttcttgtacgttatgtgacgagcctatttctaacagaagaaagggagagaaaattatagagcttgcatgtggccacttaagtcaccaagaatgtcttattatctcttttggcaccacttcaaaggcagacgttcgtgcgctatttcctttttgtaccaaatgtaaaaaagatactaacaaagccgttcaatgcattccagaaaatgatgaactaaaggatattctaatttctgattttttgattcataagattcctgattctgagttatcaatcacacctcagtcccgctttcctccttattcaccactcttgcctccttttgggttatcctatacacctgttgaaagacaaacgatatattctcaagctccaagtctaaacccaaatctcatattggctgcaccccccaaggaaagaaaccaaattccacaaaaaaaatcaaactatacatttttacattcacccctggggcacagaagaattccgtccggagcaaactctatcttagcagacacctctgtagcgttgtcagctaatgattctatttctgctgtttccaattcggtaagagcaaaggatgacgaaaccaaaacaacgttgccgctgttaaggtcatattttattcaaattcttttgaacaatttccaggaagaattgcaggattggagaatagacggggactatggattactaaggttggtagacaaattgatgatttccaaagatggtcagagatatatacaatgctggtgtttcttatttgaagacgcatttgtaatagcagaagtggataacgatgttgatgttttggaaattagactaaagaatttagaagtatttacacctattgccaacttgagaatgactacactcgaagcttcagtactcaaatgcaccttaaataaacaacattgcgccgatttatcagatctttacattgttcagaatataaattctgacgaaagcacaactgtacagaaatggatatcaggtatattgaatcaggattttgtattcaatgaggacaatatcacttcgaccctgcctattcttcccattataaagaacttttcaaaagatgttggtaatggtaggcacgagacgagtacctttctaggtttaatcaatcctaacaaagttgttgaagttggaaatgtgcacgataatgatactgtaatcataaggaggggattcaccttaaattcaggagaatgttctaggcagagtactgtcgacagtatacaatctgttctaaccacgataagctcaattctttcccttaaacgagaaaaacctgataatttggcaataatcttacagatcgattttacgaaattgaaggaagaagacagtttaattgttgtttataacagtctaaaagctttaaccattaaatttgcgcgtttgcagttttgtttcgttgatcgaaataattatgttctggactatggatcggtattacacaagatagattcactagattccatctcaaatctcaaatcaaagagttcctcgacacaattttcacctatttggttgaaaaatactctatatcccgaaaatattcatgaacatttgggtattgttgctgtatcaaatagtaatatggaagcaaaaaaatccatactatttcaagattacagatgctttacaagttttggaagaagaaggcccaatgaattgaagattaaggtgggctatttgaacgttgactacagtgataaaattgatgaactagtcgaggccagctcctggacttttgttttagaaactctttgctacagtttcggtctaagttttgatgaacatgatgacgatgacgaagaggataatgatgattcgaccgataatgaacttgataatagttcaggatcactgtcggatgctgaatctacaactactattcatattgattctccatttgataatgaaaatgctaccgcaaatatggtgaatgacagaaaccttctcactgagggtgaacatagcaatatagaaaacttagaaactgtcgcttcttcagtacagccagctctgattcctaatattagattttcacttcattctgaggaggaaggtactaatgaaaatgaaaatgaaaatgatatgccagtattattacttagtgatatggataaaggaatcgatggcataaccagacgcagttcattctcgagtcttatagagagcggtaataacaactgtcccctccatatggattatatatag

SEQ ID NO: 25319 - DNA, 2148 bp, Saccharomyces cerevisiae
atgaaaagcaggaaacgccaaaacaatatgcaaaatgaaacacgggagccagcggtattgtcgtcacaggaaacctcgatttctcgcatttctccacaagatccagaagcaaaattctacgttggtgtagatgtcggaacaggctctgcaagggcatgtgttatcgatcaatctggtaacatgttgtcgctagcagaaaaacccataaaaagggaacaattgatatccaattttattactcagtcttcaagagaaatctggaatgcagtttgctattgtgttagaactgttgttgaagaatcaggagttgaccctgaaagagttcgtggaattggttttgatgcgacttgttccttagtagtcgtatccgctaccaattttgaagaaattgcagttggaccggattttaccaataatgaccagaatatcatattatggatggaccatagggcgatgaaggagactgaagaaatcaactcatctggtgataaatgtttaaaatatgtgggagggcaaatgtctgttgaaatggaaattccgaagattaagtggttgaagaacaacttagaagctggaatttttcaggattgtaagttttttgaccttccggattacttgactttcaaagccacgggaaaagagaataggtcattttgttctgctgtttgtaagcagggatttctaccagtgggtgtcgaaggttccgatataggctggtccaaagaattcttaaattcaattgggctttcagagcttacgaagaatgattttgaaagactgggtggatcgttaagggaaaaaaaaaactttctgaccgcaggtgaatgtatcagcccgttagataaaaaggctgcctgtcaattaggcttgacagagcattgtgtagtaagttcaggaattattgatgcatatgcaggctgggtagggacggtagccgccaagccggaatcagcagtaaaaggtcttgccgagaccgaaaattataaaaaggatttcaatggtgcaattggcagattggcagctgttgccggtacgtctacgtgtcatattttgttatcaaaaaaccctatatttgtccatggcgtttgggggccttatagagatgtccttgcaagaggcttttgggcggcagaaggcggccaaagctgtacaggcgttcttttagatcatttaataacgacgcatccagctttcactgagctatcccatatggctaatttggcaggtgtgtcgaaattcgaatatttaaacaaaatacttgaaaccttggtcgagaagcgcaaagtaagatctgttatttctttagctaagcacttgtttttttatggtgactatcacggtaatcgatcaccgatagcagatccgaatatgcgcgcttgtattataggacaatctatggataactcaattgaagacttagcggttatgtatttgagtgcctgtgaattcatatcacaacaaacaagacaaatcattgaagtaatgctaaaaagtgggcatgaaataaatgctattttcatgtcaggtggacagtgtcgaaatagcttgttgatgaggttgttggctgattgtactggcctgccgatagtgattcctcgatacgttgacgctgcagttgtatttggttctgccttgcttggggctgcagcaagtgaagattttgattataccagggaaaaaagaactctcaaaggccaaaaatcttctcagacaaagacggaacgttttaacgattcatattcgtcgatacaaaagttatcaatggaagatcgaaactcgacaaatggctttgtatccccacataatctacaactttcaactccaagtgcgcctgccaaaataaataactattctcttccgatttgcacacaacaaccacttgacaaaacctctgaggaaagtagtaaggatgcttcattgaccgtgggacaggagagcctaggagagggaagatataacgggacaagttttctatggaaagttatgcaagagctaacgggtaatgcaagaattgtcaatccaaatgagaaaactcatccagatagaattcttttagacacgaagtaccaaatttttctcgatatgattgaaacacagagaaaatataggcgtatggtagataaagtagaagggtcctttagtagataa

SEQ ID NO: 25320 - DNA, 1701 bp, Saccharomyces cerevisiae
atgacgaaaccgcgttacaatgacgtgttgtttgatgatgatgactcggtaccatcagaatcagttacgaggaaatcgcagagaagaaaggcaacgtcacctggggaatcaagagagtcctcaaaagatcgtctactgatacttccctctatgggggaatcatatactgagtacgtagactcttatttgaacttagaattattggaaaggggagaaagagaaacaccaatctttcttgaatctctgacaagacaactaacgcagaaaatatatgaactaataaaaacaaaatctttaactgcagataccttgcaacaaataagtgataaatacgatggtgtagtggcagaaaacaagctgttatttttgcaaagacagtattatgttgatgatgaaggaaatgttagagatggccgaaataatgataaaatatactgtgagccaaagcatgtatacgacatggtgatggcaacacacttgatgaataagcatcttaggggtaaaacattacattcctttttattttctcattttgccaatattagtcatgccatcatcgattgggtccagcaattttgttcaaaatgtaataaaaagggcaaaattaaaccattgaaggaatataaacgtcctgacatgtacgataaactactaccaatggaaaggatacatattgaggtattcgaacccttcaatggagaagctattgagggaaaatattcttatgtccttttatgccgagactatcgctctagttttatgtggttattaccacttaagagtaccaaattcaaacatcttatcccagttgtttcctcactttttttaacatttgctagggttccaattttcgtaacatcaagcactttagataaagatgatctttatgatatttgtgaagaaattgcatcaaaatacggtctccgtattggcttgggtttgaagagttctgcgagatttcatactgggggtatactgtgcattcagtatgctctaaatagttataagaaggaatgtctagccgattggggtaagtgcctaagatatggcccttacagattcaaccgaaggagaaataagagaacgaaacgtaaacctgtgcaagtactacttagtgaagttccaggtcacaatgccaagtttgagactaagagagaaagggttatagaaaacacatattcccgtaatatgttcaagatggcaggtggaaaaggtcttatatatttggaagatgtcaatacttttgcccttgctaatgaagcggataatagctgtaacaataatggaattcttcataataacaatataggaaatgataactttgaagaagaagtgcaaaaacaatttgatctaactgaaaaaaactatatcgatgagtatgatgatttggcacatgattcttcagagggcgaatttgaacctaataccttaactcccgaagaaaagcctcctcataatgtcgatgaggaccgaatagagtccaccggcgtggcagccccaatgcagggaacagaagagcctgaaaaaggggatcaaaaagaaagtgacggtgcatcacaagtagatcaaagtgtcgaaataactagaccagaaacttcctactatcaaactctggaatcgccgtcaacaaaacgacagaaattagaccaacagggtaatggagatcaaacaagagactttggcacatcaatggaattgtaa

SEQ ID NO: 25321 - DNA, 3195 bp, Saccharomyces cerevisiae
atggatgattatcacgtaaatactgccttctcaatgggcagaggtaaccagcaggatgatggcaatagtgaaagcaacagcatgcatacacaaccaagcactatggcgcccgctacgctgagaatgatgggaaaaagtccacagcagcagcagcagcagaacacaccgctaatgcccccggcggatatcaaatacgccaataatggtaactcacatcaagcagagcaaaaggagagacaagtagaacttgaaggtaaatcgagagagaatgcaccaaagccaaatactaccagccagagtcgagtttcgtcttctcagggcatgcctaagcagtttcatcgaaaatcgttaggagattgggagtttgttgaaacagttggtgcaggttctatgggtaaagtgaagctggcaaaacatcgttacactaatgaggtttgtgcagtaaaaattgtaaaccgtgctacaaaggctttcctacataaagaacaaatgctgccaccacccaaaaatgaacaagatgttttggagagacagaagaaattagagaaggaaatatctagggacaaaagaactattcgagaagcgtccttgggacaaatcttatatcatccacacatatgtagactttttgagatgtgcacgttgtcaaatcatttctatatgttgtttgaatatgtttcaggtggtcagctgttagactatatcatccaacatgggtcaatacgagaacaccaagcgagaaagtttgctaggggtatcgcgagcgccttaatatatttgcatgctaacaacatcgtccatagagatttgaagatagaaaatataatgatttcagattccagtgaaatcaagataattgattttggactttcaaatatttatgattctaggaagcagcttcatacattctgtggctctctgtattttgccgctcccgagctgttaaaagcgaatccttatacaggacctgaagtagatgtctggtcatttggtgtagttttatttgttttggtatgcggtaaagtgccatttgacgacgaaaattcgagcgttttacatgaaaagatcaagcaaggtaaggttgaatatccccaacatttatctatcgaagtaatatcactgttatccaaaatgttggtagtagatccgaaaagaagagccacacttaaacaggttgtggagcaccactggatggtaagagggttcaatggtccccctccttcttacttaccgaaaagagttcccctaactatcgaaatgcttgatataaatgtcttaaaagaaatgtaccgtttagaatttattgacgatgtagaggaaacaagaagtgttttggtcagtataatcacagatcctacttacgttcttctctctagacaatactggactttagcggccaaaatgaacgcagaatccagtgataacggaaacgcgccaaacataacagagagttttgaagacccaactcgggcatatcatccaatgatttccatatattacttgacttctgagatgcttgataggaaacatgcgaaaattcggaatcaacaacagcgacagagccacgaaaatatagaaaagctttctgaaataccggaaagtgtgaagcaaagggacgtagaggtcaatacaaccgctatgaaatcagagccagaagccacgttggcgacaaaagatacctctgtgccattcactccaaagaatagcgatggcacagagccccccttacatgtcttaattccaccgaggttagcaatgccagaacaagcgcatacgtcaccaacgagtagaaaaagttctgataatcaacgccgtgaaatggaatatgctctctctccaactcctcagggaaatgactatcaacaatttagggtaccttcaactactggcgatccctcagaaaaggcgaagtttgggaatatatttagaaaattatcacagcgccgtaaaaagaccattgaacagacatctgttaatagtaataatagtatcaataaacctgtgcaaaagacgcattctcgcgctgtttcagactttgtccctggttttgctaaaccgagttatgattcaaattataccatgaatgagcctgtcaagacaaacgatagcagaggtggcaataaaggtgactttccagcattgcctgcggatgcagaaaatatggtagagaagcaaagggagaagcaaattgaagaagatataatgaaattgcatgatattaataaacagaataatgaagttgcaaaaggaagcgggcgggaagcttacgctgcacagaagtttgaaggaagcgacgacgacgagaatcatcccttaccacctctcaatgttgcaaaaggtcgaaaactacatccaagcgcaagagctaaatcagttggtcatgctcgtcgtgaatcactcaaatatatgagacccccaatgccttcatctgcctatcctcagcaagagcttatagatactgggttcttagaatcaagtgacgataacaaatccgatagtttgggaaatgttacttcacagacgaatgatagcgtcagcgtgcattctgtgaacgcacacataaactcgccatctgtggagaaggaattaacagatgaagagatattgcaggaagcttctagagctccagccggttctatgccatccatcgatttcccccgttctttatttttgaagggtttcttttctgttcagacaacttcatcgaagcctttgccaattgttagatacaagattatgtttgttctgaggaaaatgaatatagagttcaaggaggttaagggtggttttgtttgtatgcaaaggttctcttccaataatgtggcagcgaagagagaagggactccaagatcgatcatgccactttcgcaccacgaatccattagacgtcaaggctctaataaatactcaccttcttctcctttgacaactaattccattcaccagagaaaaacatctattaccgaaacctatggagatgataagcattcgggaacatctttggagaacatccaccaacaaggtgacggtagcgaaggcatgactacaacagaaaaagagcccatcaaattcgaaattcatatcgtcaaggttcgtattgttggtttagccggtgtgcattttaagaaaatttctgggaacacttggttgtataaagagctggcttctagtatattaaaagaactaaagttgtaa

SEQ ID NO: 25322 - DNA, 4767 bp, Saccharomyces cerevisiae
atggtgcagttagccaaagtcccaattctaggaaatgatattatccacgttgggtataacattcatgaccatttggttgaaaccataattaaacattgtccttcttcgacatacgttatttgcaatgatacgaacttgagtaaagttccatactaccagcaattagtcctggaattcaaggcttctttgccagaaggctctcgtttacttacttatgttgttaaaccaggtgagacaagtaaaagtagagaaaccaaagcgcagctagaagattatcttttagtggaaggatgtactcgtgatacggttatggtagcgatcggtggtggtgttattggtgacatgattgggttcgttgcatctacatttatgagaggtgttcgtgttgtccaagtaccaacatccttattggcaatggtcgattcctccattggtggtaaaactgctattgacactcctctaggtaaaaactttattggtgcattttggcaaccaaaatttgtccttgtagatattaaatggctagaaacgttagccaagagagagtttatcaatgggatggcagaagttatcaagactgcttgtatttggaacgctgacgaatttactagattagaatcaaacgcttcgttgttcttaaatgttgttaatggggcaaaaaatgtcaaggttaccaatcaattgacaaacgagattgacgagatatcgaatacagatattgaagctatgttggatcatacatataagttagttcttgagagtattaaggtcaaagcggaagttgtctcttcggatgaacgtgaatccagtctaagaaaccttttgaacttcggacattctattggtcatgcttatgaagctatactaaccccacaagcattacatggtgaatgtgtgtccattggtatggttaaagaggcggaattatcccgttatttcggtattctctcccctacccaagttgcacgtctatccaagattttggttgcctacgggttgcctgtttcgcctgatgagaaatggtttaaagagctaaccttacataagaaaacaccattggatatcttattgaagaaaatgagtattgacaagaaaaacgagggttccaaaaagaaggtggtcattttagaaagtattggtaagtgctatggtgactccgctcaatttgttagcgatgaagacctgagatttattctaacagatgaaaccctcgtttaccccttcaaggacatccctgctgatcaacagaaagttgttatcccccctggttctaagtccatctccaatcgtgctttaattcttgctgccctcggtgaaggtcaatgtaaaatcaagaacttattacattctgatgatactaaacatatgttaaccgctgttcatgaattgaaaggtgctacgatatcatgggaagataatggtgagacggtagtggtggaaggacatggtggttccacattgtcagcttgtgctgaccccttatatctaggtaatgcaggtactgcatctagatttttgacttccttggctgccttggtcaattctacttcaagccaaaagtatatcgttttaactggtaacgcaagaatgcaacaaagaccaattgctcctttggtcgattctttgcgtgctaatggtactaaaattgagtacttgaataatgaaggttccctgccaatcaaagtttatactgattcggtattcaaaggtggtagaattgaattagctgctacagtttcttctcagtacgtatcctctatcttgatgtgtgccccatacgctgaagaacctgtaactttggctcttgttggtggtaagccaatctctaaattgtacgtcgatatgacaataaaaatgatggaaaaattcggtatcaatgttgaaacttctactacagaaccttacacttattatattccaaagggacattatattaacccatcagaatacgtcattgaaagtgatgcctcaagtgctacatacccattggccttcgccgcaatgactggtactaccgtaacggttccaaacattggttttgagtcgttacaaggtgatgccagatttgcaagagatgtcttgaaacctatgggttgtaaaataactcaaacggcaacttcaactactgtttcgggtcctcctgtaggtactttaaagccattaaaacatgttgatatggagccaatgactgatgcgttcttaactgcatgtgttgttgccgctatttcgcacgacagtgatccaaattctgcaaatacaaccaccattgaaggtattgcaaaccagcgtgtcaaagagtgtaacagaattttggccatggctacagagctcgccaaatttggcgtcaaaactacagaattaccagatggtattcaagtccatggtttaaactcgataaaagatttgaaggttccttccgactcttctggacctgtcggtgtatgcacatatgatgatcatcgtgtggccatgagtttctcgcttcttgcaggaatggtaaattctcaaaatgaacgtgacgaagttgctaatcctgtaagaatacttgaaagacattgtactggtaaaacctggcctggctggtgggatgtgttacattccgaactaggtgccaaattagatggtgcagaacctttagagtgcacatccaaaaagaactcaaagaaaagcgttgtcattattggcatgagagcagctggcaaaactactataagtaaatggtgcgcatccgctctgggttacaaattagttgacctagacgagctgtttgagcaacagcataacaatcaaagtgttaaacaatttgttgtggagaacggttgggagaagttccgtgaggaagaaacaagaattttcaaggaagttattcaaaattacggcgatgatggatatgttttctcaacaggtggcggtattgttgaaagcgctgagtctagaaaagccttaaaagattttgcctcatcaggtggatacgttttacacttacatagggatattgaggagacaattgtctttttacaaagtgatccttcaagacctgcctatgtggaagaaattcgtgaagtttggaacagaagggaggggtggtataaagaatgctcaaatttctctttctttgctcctcattgctccgcagaagctgagttccaagctctaagaagatcgtttagtaagtacattgcaaccattacaggtgtcagagaaatagaaattccaagcggaagatctgcctttgtgtgtttaacctttgatgacttaactgaacaaactgagaatttgactccaatctgttatggttgtgaggctgtagaggtcagagtagaccatttggctaattactctgctgatttcgtgagtaaacagttatctatattgcgtaaagccactgacagtattcctatcatttttactgtgcgaaccatgaagcaaggtggcaactttcctgatgaagagttcaaaaccttgagagagctatacgatattgccttgaagaatggtgttgaattccttgacttagaactaactttacctactgatatccaatatgaggttattaacaaaaggggcaacaccaagatcattggttcccatcatgacttccaaggattatactcctgggacgacgctgaatgggaaaacagattcaatcaagcgttaactcttgatgtggatgttgtaaaatttgtgggtacggctgttaatttcgaagataatttgagactggaacactttagggatacacacaagaataagcctttaattgcagttaatatgacttctaaaggtagcatttctcgtgttttgaataatgttttaacacctgtgacatcagatttattgcctaactccgctgcccctggccaattgacagtagcacaaattaacaagatgtatacatctatgggaggtatcgagcctaaggaactgtttgttgttggaaagccaattggccactctagatcgccaattttacataacactggctatgaaattttaggtttacctcacaagttcgataaatttgaaactgaatccgcacaattggtgaaagaaaaacttttggacggaaacaagaactttggcggtgctgcagtcacaattcctctgaaattagatataatgcagtacatggatgaattgactgatgctgctaaagttattggtgctgtaaacacagttataccattgggtaacaagaagtttaagggtgataataccgactggttaggtatccgtaatgccttaattaacaatggcgttcccgaatatgttggtcataccgctggtttggttatcggtgcaggtggcacttctagagccgccctttacgccttgcacagtttaggttgcaaaaagatcttcataatcaacaggacaacttcgaaattgaagccattaatagagtcacttccatctgaattcaacattattggaatagagtccactaaatctatagaagagattaaggaacacgttggcgttgctgtcagctgtgtaccagccgacaaaccattagatgacgaacttttaagtaagctggagagattccttgtgaaaggtgcccatgctgcttttgtaccaaccttattggaagccgcatacaaaccaagcgttactcccgttatgacaatttcacaagacaaatatcaatggcacgttgtccctggatcacaaatgttagtacaccaaggtgtagctcagtttgaaaagtggacaggattcaagggccctttcaaggccatttttgatgccgttacgaaagagtag

SEQ ID NO: 25323 - DNA, 2040 bp, Saccharomyces cerevisiae
atgaatattgtcaaattacaagtatgtatgcctttctcgaattcccacactgctgagcacagtgaaaaagttttttctaccttttaggttgtaataaacgtttcatatactaacaaactcttctgcgattagagaaaatttccaattttgactcaagaggatcttttttccacaattgaaaagttcagagccattgacttagatgataaaggatgggttgaaaaacagcaagctctagaagcggtgtccaaagatggtgatgctacttatgacgaagcaagagaaaccctgaagcatgtgggtgtggatgcgtcaggccgtgttgaactggacgattacgtcgggttggttgcaaaattaagagaatctaaaacaggagctgctccacagaccactttcaacgtagcacctaactcaacccctattgtttccactgctgccacaggactacagcacaagggtaagggtactcaagccaagattattgttgctggctcccaaacaggtactacacataccatcaatgaagaagaaagacgtgaatttactaaacatatcaatagcgtcttggcgggagaccaagatataggtgatttgcttccatttcctactgatactttccaattatttgatgaatgtagggatgggttggtgctatctaagttgatcaacgactctgttcctgatactatcgatacaagagttttgaattggcctaagaagggtaaggaattgaataattttcaggctagtgaaaatgctaatattgttattaattctgcaaaagccattggttgtgtcgttgttaatgttcattccgaggacattattgaaggtagagagcatttgatcctgggtttgatttggcaaattattaggagaggtttgttaagtaaaattgatattaagctgcatcctgagttataccgtctattggaggatgatgaaacgttggagcaatttttgaggttgcctccggagcaaattctactacgttggtttaactaccatttgaagcaagcaaactggaacagaagggttaccaatttttcaaaagacgtgtctgatggtgaaaactatactatcttgttgaaccagttggaccccgccttgtgttctaaggcaccattacaaaccacagatttaatggagagagctgagcaagttttacaaaatgctgaaaagctagattgtagaaagtatttaaccccaagttcattagttgcggggaaccctaaattaaacctggctttcgtggcacatctattcaatacacatcctggattagagcctattcaggaagaggaaaagcctgaaattgaagaatttgacgccgaaggtgagagagaggcaagagtctttaccttatggttgaactctcttgacgttgatccacctgtcatttcgctgtttgatgatttgaaggatggtttgatattattgcaagcttacgaaaaggtgatgcccggtgctgttgattttaaacatgtcaacaaaagaccggcctcgggtgcagagatatccagattcaaagccttagaaaacaccaactatgcagtcgacttgggcagagccaaaggattttctttggttggtatcgaaggatctgatattgtagatggtaacaaattactgaccttagggttagtgtggcaattgatgcgtagaaatatttcgataaccatgaagacattatcctcaagtggtagagacatgagtgattctcaaatattaaagtgggcccaagaccaggtaactaaaggtggtaaaaactctaccattagatcatttaaggaccaagctttatcaaacgcccacttcttattggatgttctgaatggtatcgcgccgggctatgttgattatgatctagtcacccctggtaacaccgaggaagaaaggtacgcaaacgcaagattggctatttctattgctagaaagttgggtgctttgatttggttggtgccagaagatatcaacgaagttcgtgcaagattaattattacttttatcgcttcgttaatgactttgaacaaatga

SEQ ID NO: 25324 - DNA, 4548 bp, Saccharomyces cerevisiae
atggctggtaatcttgtttcatgggcctgcaagctctgtagatctcctgaagggtttggacctatatccttttacggtgactttactcaatgcttcatcgacggtgtgatcctaaatctatcagcaattttcatgataaccttcggtatcagagatttagttaacctttgcaagaaaaaacactctggcatcaaatataggcggaattggattattgtctctaggatggcactagttctgttggagatagcgtttgtttcacttgcgtctttaaatatttctaaagaagaagcggaaaactttaccattgtaagtcaatatgcttctacaatgttatctttatttgttgctttagccttacactggatagaatacgatagatcagttgtagccaatacggtacttttattctattggctttttgaaacattcggtaattttgctaaactaataaatattctaattagacacacctacgaaggcatttggtattccggacaaacgggtttcatactaacgttattccaagtaataacatgtgccagtatcctgttacttgaagctcttccaaagaagccgctaatgccacatcaacacatacatcaaactttaacaagaagaaaaccaaatccatacgatagcgcaaacatattttccaggattaccttctcttggatgtcaggtttgatgaaaactggctatgaaaaatacttagtggaagcagatttatataaattaccgaggaactttagtagtgaagaactctctcaaaaattggagaaaaactgggaaaatgagttgaagcaaaaatcaaatccttcattatcatgggctatatgcagaacttttggatctaaaatgcttttagccgcattctttaaagcaattcatgatgttctagcatttactcaaccacaactactaaggattttaatcaagttcgtcacagactataacagtgagagacaggatgaccattcttctcttcaagggtttgaaaataaccacccacaaaaattacccattgtaagagggtttttgattgcgtttgctatgtttctggtgggctttactcagacatctgtcctgcatcaatatttcctgaatgtcttcaacacaggcatgtatattaagagcgccctaacggctttaatatatcaaaaatccttagtgctatctaatgaggcttctggactttcctctaccggtgacattgtcaatctcatgagtgtggatgttcaaaaattacaagatttaacacaatggctaaatttaatatggtcagggccttttcaaatcattatttgcttatattctctgtataagttgttgggaaattccatgtgggttggcgtgattatactagttattatgatgccattgaactcatttttgatgaggatacaaaagaagttgcaaaaatcccagatgaagtacaaagatgaaaggacccgtgttataagtgaaatactaaacaatattaaatctttgaagttatatgcatgggagaagccttatagggaaaagctagaagaagtaagaaataacaaagagttaaaaaatcttacaaaactaggatgttatatggctgtgacaagttttcagttcaatatagtaccattccttgtttcatgttgtacctttgctgtatttgtttatactgaggatagagcattgactactgacttagttttccctgctttgactctgttcaacctgctctcattcccactaatgattattcctatggttttaaattcttttatcgaagcttctgtttctattggtagattatttacattctttaccaatgaagagctacaaccagattcggttcagcgtttaccaaaagtaaaaaatattggcgatgtagccattaacattggagatgatgctacctttttatggcaacggaaaccggaatacaaagtagccttaaagaatattaatttccaagctaaaaaaggaaatttgacctgtattgttggtaaagttggcagtggtaaaacagctctattgtcatgcatgttaggtgatctattcagggttaaaggtttcgccaccgttcatggttctgttgcttatgtttcacaagttccatggataatgaatggtactgtaaaggaaaacattttatttgggcatagatacgacgcggaattttacgaaaaaacgatcaaggcctgtgcgttaactattgatcttgcaattttgatggatggagataagacattagttggcgagaaagggatctccttatctggaggacaaaaagctcgtttgtctttagcaagagcagtttatgcgagagctgacacttatttacttgatgatcctttggcagctgttgatgaacacgttgccaggcacttgatcgaacatgtgttgggtccaaatggtttattacatacaaaaacgaaggtattagccactaataaggtgagcgcgttatccatcgcagattctattgcattattagataatggagaaatcacacagcagggtacatatgatgagattacgaaggacgctgattcgccattatggaaattgctcaacaactatggtaaaaaaaataacggtaagtcgaatgaattcggtgactcctctgaaagctcagttcgagaaagtagtatacctgtagaaggagagctggaacaactgcagaaattaaatgatttggattttggcaactctgacgccataagtttaaggagggccagtgatgcaactttgggaagcatcgattttggtgacgatgaaaatattgctaaaagagagcatcgtgaacagggaaaagtaaagtggaacatttacctagagtacgctaaagcttgcaacccgaaaagcgtttgtgtattcatattgtttattgttatatcgatgttcctctctgttatgggtaacgtttggttgaaacattggtctgaagttaatagccgctatggatctaatccaaatgccgcgcgttacttggccatttattttgcacttggtattggttcagcactggcaacattaatccagacaatcgttctctgggttttttgtaccattcatgcctccaaatatttacacaacttgatgacaaactctgtgttgagagccccaatgacgttttttgaaacaacaccaatcggtagaattctaaacagattctcaaatgacatatacaaagtggatgctttattaggaagaacattttctcagtttttcgtcaatgcagtgaaagtcacattcactattacggttatctgtgcgacgacatggcaatttatcttcattatcattccactaagtgtgttttacatctactaccagcagtattacctgagaacatcaagggagttgcgtcgtttagactctattactaggtctccaatctactctcatttccaagagactttgggtggccttgcaacggttagaggttattctcaacagaaaaggttttcccacattaatcaatgccgcattgataataacatgagtgcgttctatccctctatcaatgctaaccgttggctagcatataggttggaacttattggttcaattatcattctaggtgctgcaactttatccgtttttagactaaaacaaggcacattaacggcaggtatggtgggtttatcattaagctatgctttacaaatcactcaaacgttaaattggattgttagaatgactgtggaagttgaaacgaatattgtttcagtggaaagaataaaggaatatgctgatttgaagagcgaggcacctttaatagttgaaggccacagaccacccaaagaatggccgagccagggtgatataaagtttaataattattccactcgttataggccggagcttgatcttgttctgaagcacattaatatacacattaaaccaaatgaaaaagttggtatcgtgggtagaacgggtgcgggaaaatcctcattaacgctagcattattcaggatgattgaggctagcgagggaaacatcgtaatcgacaacattgccatcaacgagattgggttatatgatttgagacataaattgtcaatcatacctcaggattctcaagtttttgagggcactgttcgtgagaacattgatcccattaaccaatacactgatgaagctatttggagggcattggaactttctcatttgaaagaacacgtgctatcaatgagcaatgacggattagatgcccaactaaccgaaggtggtggcaacttaagtgttggacaaagacaattattatgtcttgcaagagcaatgttggttccatcaaagattttggtgcttgatgaagccacggccgcagtcgacgtggagacagataaagtcgtccaagagacgattcgtactgctttcaaggacagaactatcttgaccatcgcgcatagactgaacacgataatggacagtgatagaatcatagtgttggacaatggtaaagtagccgagtttgactctccgggccagttattaagtgataacaaatcattgttctattcactgtgcatggaggctggtttggtcaatgaaaattaa

SEQ ID NO: 25325 - DNA, 2259 bp, Saccharomyces cerevisiae
atgtctaataccgaggaattgatccaaaactcaataggttttctccagaaaacttttaaagcactcccagtttcgtttgactccattcgacatgaaccacttccatcttcaatgttgcatgcaagtgttctcaattttgaatgggaaccgctcgaaaaaaatatttcggcaattcatgatagagattctttgattgacattatacttaaaagattcattatagattcaatgacaaatgctattgaagacgaagaagaaaataatcttgaaaaagggttactaaattcgtgtataggtctcgattttgtgtataactcaagatttaatagatctaatccagctagctggggaaatacctttttcgagttattttccaccatcattgatttgctaaactcaccatctacgtttttgaagttttggccctatgctgaatcacgtatcgaatggttcaaaatgaatacatctgttgagccagtatcattgggggagagcaatttgattagttacaaacagcctttatacgaaaagctgcgccactggaacgatattttagctaaattagagaataatgacatccttaataccgtcaaacattataatatgaaatacaaactagagaactttttatccgagctactacctataaatgaagaatcgaacttcaatagatccgcttctatttcagctttacaagaatctgataacgaatggaacagatcagcacgtgaacgagaaagcaaccgcagttccgacgttatatttgctgcagattataacttcgtgttttatcatctaattatttgcccgatcgaatttgcttttagcgatttagaatataaaaatgatgtggacagatcattaagtccccttcttgatgcaatcttggaaatcgaagagaacttttacagcaaaatcaagatgaacaataggactagatattccttagaggaagctctgaacactgagtattacgcgaattacgatgttatgacccctaaattacccgtgtatatgaagcattcaaacgcaatgaaaatggacaggaatgaattttgggcgaatctacagaatattaaagaatcagatgactacactcttcgacctaccattatggatatctctttgagcaatacgacctgcctttataaacaattgactcaagaggacgatgattactaccgcaaacagttcattttacaactatgtttcacaacaaatcttatacgcaatttaatttcttctgatgaaacgaggaatttctataaaagctgctatttgagggaaaacccgttgagcgatattgattttgagaaccttgatgaagttaacaaaaagcgtgggctcaatttatgttcatacatttgcgacaatcgtgttttgaaattttataaaattaaagaccctgacttttatcgtgttatccgcaaattaatgtcttctgacgaaaagtttacaaccgccaagatcgatggctttaaagaattccaaaacttcagaatatctaaggagaagataccgccacccgcttttgacgaaacttttaaaaagtttacgttcatcaagatggggaataaattgattaataatgtttggaaaatacctactggtctagataaaattgagcaagaagtaaagaagcctgaaggtgtctatgaagcagcccaagcgaaatgggaatcaaaaatttcttctgaaacttccggtggagaagcgaaagatgaaataatcagacaatggcaaactttacggtttctaagatcgcgatacttgttcgattttgataaagttaacgaaaagactggtgttgatggtttgttcgaggaacccagaaaagtggaagcgttggatgatagtttcaaagagaaacttttgtacaaaatcaatcaagagcacaggaaaaaacttcaggatgctagggagtacaagattggaaaggaaagaaagaagagggcactggaagaagaggcttcgtttcctgaaagagagcaaaaaattaagtcgcaacgtataaacagcgcttctcaaacagaaggagatgagttgaagagcgaacagacgcaaccaaagggagaaatatcagaagagaataccaaaataaaaagctcggaagtttcttcgcaagatcctgacagtggtgttgccggggagtttgctccacagaatacaacagctcaactagaaaatccaaaaacagaagataacaatgcagctacttcgaacatttctaatggttcatctacccaagatatgaaataa

SEQ ID NO: 25326 - DNA, 1230 bp, Saccharomyces cerevisiae
aactccaataatacagaattttcgatcgcctatggtgatacgacttttgcatctggtacctggggccatgatcaattgagcttgaacgatttgaacattacgggtttatcatttgctgtagcaaacgaaacaaactcaacagttggtgtcttgggtattggtttgcctggcttggagtcaacttattctggtgtttctctcagctctgtacaaaaaagctacacttacaataactttccgatggtgctaaagaattcgggtgtaataaaatcaacagcttattctttattcgcaaatgattctgattcgaaacatggtaccattttgtttggcgctgtggatcatggaaaatatgcgggcgacctatacacaattcccatcattaatactttgcagcatcgcggctacaaggatccaattcaattccaagtcactttacaaggattaggtacgtcgaaaggggataaagaagacaatctgacaaccctaaccactacaaagatcccagtcctgctagattcaggtacgaccatatcgtatatgccaactgagctggtaaaaatgcttgccgaccaggtcggagctacttactcttctgcatatggttactacataatggattgtatcaaagagatggaagaagagagtagcatcatctttgattttggtggattctatctttctaattggttaagcgattttcagctagtcacagatagtcgttcaaacatttgtatactaggtattgcaccgcagtcagatccgaccattattttgggtgataacttcttagctaatacttacgtggtatatgatctggacaatatggagatatcaatggctcaggctaacttcagcgacgacggtgaatacattgagattatagagagcgcggttccaagtgctcttaaagcacctggttactcaagcacttggtctacatatgaaagtattgtctccggcggcaacatgttttccacggcagctaactccagtatatcgtactttgcttccacgtctcattcggcaacaagttcttccagctccaaaggccaaaaaacccaaacaagtacgacagctctctctatttcaaaatctacctcaagtacttcctcaacaggaatgttatctcccacctcaagttcatctacgagaaaagaaaacggaggacacaatctgaatcctccatttttcgccaggttcattacagctatttttcatcacatttga

SEQ ID NO: 25327 - DNA, 2130 bp, Saccharomyces cerevisiae
atggatacatcaaactcttggtttgatgcctcaaaagtacaaagcctaaattttgacctacaaaccaactcttattactcaaatgctagaggcagtgacccttcgagttatgcaatagaaggcgaatataaaacactagcaacagatgatttaggcaatatattgaacctaaactatggtgaaaccaacgaagttataatgaatgaaataaatgacttaaaccttccgctgggaccactttctgatgaaaaatctgtcaaggtttctactttctccgagttaataggaaatgattggcaaagtatgaactttgacttagaaaataattcaagagaagtgactctaaatgcaactagcttgttgaatgaaaatagattaaatcaagacagtggtatgactgtttatcaaaaaacaatgagtgataagccccacgatgaaaagaagatttccatggcggataatttattgtcgactataaacaaaagtgaaattaataaaggcttcgatagaaacctcggggaattactgttacagcaacaacaagagttgcgcgagcaattgagagcacaacaagaggctaataagaagttagagttagaactcaaacaaacacaatacaagcaacaacaactacaggctaccttagagaactctgatggtccacagtttttatctcccaaaaggaagatctctcctgcttcagaaaatgtggaggatgtatacgcaaatagcctttcaccaatgatttccccaccaatgtctaatacttcgttcactgggtcaccttctaggagaaacaatagacaaaagtactgcctgcagagaaaaaactctagtggtactgtaggaccactatgtttccaggaattgaacgaaggtttcaatgactccctcatttcaccaaagaaaattcgctcgaatccaaatgaaaacctcagttcaaaaaccaaatttattacgcccttcactccaaagagtagagttagttcagctacgtccaactctgctaacattacccctaataacttaaggttagatttcaagattaatgttgaagatcaggaaagcgaatattcagagaaacctttgggcctgggtattgaacttcttggaaaaccaggtccttctcctacaaaatcagtgtctttaaagagtgcttctgtggatattatgcctacaattcctgggtctgtaaataatactccatcagtcaataaagtatccctttcctccagttatatagaccaatatacaccaagaggtaagcagttacactttagctctatcagtgagaatgcattgggtatcaatgctgcgacaccacatctaaagccgccgagccagcaagcacgacatcgggaaggcgttttcaatgatttagaccctaatgtacttacgaaaaatacagacaatgaaggagatgataatgaggaaaatgagcctgaaagtagatttgttatttccgaaacgccttctcccgttcttaagtcacaaagtaagtacgaaggaagatctcctcaattcggcacacacattaaggaaatcaacacatataccacaaatagtccctcaaaaatcacaagaaaactcacaacactgcccagaggttcaatcgataaatatgtgaaggaaatgcctgataaaacatttgaatgtttatttcctggatgtacaaaaacattcaagagaaggtataacatcagatctcatattcaaacacatttggaagatcggccatattcctgtgatcaccctggatgtgataaggcatttgtacgaaatcatgacttgataagacacaaaaaatcgcaccaagaaaaggcgtatgcatgtccctgtggtaagaaattcaatagagaagacgctttggttgtgcacagaagtagaatgatttgcagcggtggtaaaaagtatgaaaacgtggtaattaaaaggtctccaagaaaaagaggaagaccaagaaaagatggaacttcaagtgtttctagtagtccaatcaaagaaaatattaacaaggatcataatggacagttgatgttcaagcttgaagatcaactcagaagagagcgtagttatgatgggaatggaacggggattatggtttcgccaatgaaaactaatcaaaggtaa

SEQ ID NO: 25328 - DNA, 1605 bp, Saccharomyces cerevisiae
atgtacaccaattattcacttacaagcagtgacgcaatgccccgaacttacttggtcggcacagcctcaccagaaatgtctaagaaaaagcgccagtctgcaaattgtgacaagccaacgaggagggtgatccacatcatcgatactaatgagcactcagaagtcgacttgaaaaatgaactgccaataacatgcacgaatgaagacggtgagatgacatcaagctcatggacttcacaaaccgctaatgattttctcaaactggcatacgtaaacgcgaaattagacccgtctttgccatctcaatatttcaaacaagatatcataaatgttttacaaagcttggagattcctggatggtctgtgcccggctctaaagaatcctcgttgaataagaatttattaactttgacacaaatcaagggggcccttacaaatgttatttataagattcactatccaaacttaccccctttactgatgagaatttttggtgatagcatagattctgtaattgatagagagtatgaattaaaggttattgcgagattatcattttatgatttaggacccaaactagaagggttttttgaaaatggcagatttgaaaaatacattgagggttcgaggacatctactcaagccgactttatagatcgggatacttcaataaaaattgctaaaaaattgaaagagttgcattgtactgttccattaacgcataaagaaataacggatcaaccgtcatgctggacaacctttgatcagtggatcaaattaatagactcgcataaagagtgggtttccaataatgtaaatataagtgaaaatttacgctgttcaagttggaatttttttttaaagagtttcaaaaattataagcgttggttgtataatgattctgcttttacctcaaaattattaagagaggatgataaagatagtatgataaattctgggctaaaaatggtattttgccataacgacttacagcatggtaatttactttttaaaagtaagggtaaggatgacatctcagtgggcgatttaacaattattgactttgagtacgcaggccctaaccccgttgtatttgatttatcaaatcatttgaatgaatggatgcaagactataatgatgtgcagtctttcaagtctcatattgataagtatccaaaagaagaagatattttagtttttgcacaaagttatataaatcacatgaatgagaaccatgtcaaaattgcttctcaagaggttaggattctttacaatctaatcatcgaatggaggccttgtacacaattattctggtgcctttgggctcttttgcaaagcggaaggctaccacaacgaccactgatagaaggtgaaaaactaatgagcgaaaaggctggactaggtgatgaaacgcaccttatggagcacaaaaataaagagaatggaaaatacgattgttctgaagatgattcgttcaactatttaggattttgtaaagaaaaaatgtctgtcttttggggcgatttaattacattgggagttatcgacaaagactgcccagatattggaaaaacagattacttagacactaaacttattttttaa

SEQ ID NO: 25329 - DNA, 1392 bp, Saccharomyces cerevisiae
atgctttccagagcgacgcgtactgcagctgccaaatccttagtaaaatctaaagtggctagaaatgttatggctgcttctttcgtcaagagacatgcttctacaagtttgttcaaacaagctaacaaggtcgaatccttaggttcaatatatttatccggcaagaaaatttcagttgcggcgaatccgttctccataactagcaatcgttttaaatctacctctattgaagttcctccgatggcagagtccctgactgaaggctctttaaaggaatatactaaaaacgttggtgattttattaaggaggacgagctgttggccactattgagaccgataaaattgatattgaggtcaattcgccagtatcaggtactgttacgaagctaaatttcaaaccagaggacactgtcactgttggtgaggagttagctcaggtcgagcctggtgaagcacctgctgagggttctggagaatctaagccagagcctaccgaacaagcggagccatcgcaaggtgtcgccgcaagggaaaactcaagtgaggaaacggcttcaaagaaagaagctgctccaaagaaagaagccgctccaaagaaagaagttacagaaccaaaaaaggctgatcaaccaaagaagaccgtctctaaggcgcaggaacccccagtagcctctaactctttcacaccatttccacgtacagaaaccagggtcaaaatgaaccgtatgagattgaggattgccgaaagattaaaagagtctcaaaacactgctgcttccttaaccacattcaacgaagttgacatgtcagctttgatggaaatgaggaaactgtataaagatgagattattaagaagaccggtactaaattcggattcatgggtcttttctccaaagcatgtaccttggccgccaaggatattccagccgtcaatggtgccattgaaggtgaccagattgtttatcgtgattacacagatatttctgttgctgtggccactccaaagggtttggttacccccgtcgttcgtaatgcagagtcattgagtgttttagatattgagaacgaaattgttcgcttgagtcataaagcgcgtgatggcaaattaaccctagaagatatgacgggtggtactttcaccatatctaatggtggtgtttttggttcattatacggtactcctatcatcaattcaccacaaacagccgtcctaggcttgcatggtgtcaaagagagacctgtcactgttaatggacaaattgtctcaagaccaatgatgtacttggctttgacttatgatcatagattgctagatggtagagaagctgttaccttcttgaagactgttaaagagttgattgaagaccctagaaaaatgttgttatggtga

SEQ ID NO: 25330 - DNA, 1098 bp, Saccharomyces cerevisiae
atggctggaaagaaaattgctggtgttttgggtgctactggttccgttggtcaacgtttcattctgttgttggcaaatcaccctcatttcgaactgaaagttcttggtgcctcttctagatcagctggcaagaaatacgttgacgctgtgaactggaagcaaaccgatttgctaccggaatctgctaccgatattattgtttccgaatgtaaatctgaattctttaaagagtgtgacatcgtcttttccggattggatgctgactatgctggcgctatcgaaaaggaattcatggaagctggtatcgccattgtttccaatgccaagaattatagaagagaacaagatgtgccattgattgttcctgttgtcaatcctgagcatttggatattgtagctcaaaagcttgacaccgccaaggctcaaggtaagccaagaccagggttcattatctgtatttccaattgttccactgcaggtttggttgcaccattgaagcctttgattgaaaaattcggtcctattgatgctttgaccactactactttgcaagcaatctcaggtgctggtttctccccaggtgtaccaggtattgatattctagacaatattattccatacattggtggtgaagaagacaagatggaatgggagaccaagaaaatcttggctccattagcagaagacaagacacacgtcaaactattgactccagaagaaatcaaagtctctgctcaatgtaacagagtcgctgtttccgatgggcacaccgaatgtatctctttgaggttcaagaacagacctgctccatccgtcgagcaagtcaagacatgcctaaaagaatacgtctgcgatgcctacaaattaggctgtcattctgctccaaagcaaactattcatgttttggaacaaccagacagacctcaaccaaggttggacaggaacagagacagcggttacggtgtttccgttggtagaatcagagaagacccattgttagatttcaaaatggttgtcctttcccacaacaccattattggtgccgctggttctggtgtcttgattgccgaaatcttactagcaagaaacttgatttaa

SEQ ID NO: 25331 - DNA, 3906 bp, Saccharomyces cerevisiae
atgaacacatcatttggctcagtagtgccttccactaatttcaattttttcaaagggcatggaaataatgataacactagtgccaatagtactgttaacaacagcaatttctttttaaatagcaatgaaacgaaaccttcgaaaaatgtcttcatggtgcactctacctctcaaaagaagtcgcagcaaccgttacaaaatctctcacactcaccttcctacacggaaaataaaccagataaaaagaaaaaatatatgataaacgatgccaagaccattcaacttgtaggtccactgatttcctctcctgataatttgggatttcagaagagatcgcacaaagcaagagaattaccaaggtttttgattaatcaagaacctcaattggagaaaagagcttttgtacaagatccctgggacaaggctaatcaagaaaaaatgatctcattggaagaatccatagatgatctcaatgaattgtatgaaacactaaaaaaaatgagaaatactgagcgatcgataatggaagaaaaagggctagtggataaagctgactcagcaaaggatctttacgatgctatagtatttcaaggtacctgtttagatatgtgtcccacattcgagagatcaagaagaaacgttgaatatactgtgtattcatatgaaaaaaatcaaccaaatgataaaaaagcttctcgaactaaagcattgaaggtcttcgcgaggccagcagcagcagcagctcctcctttaccttctgatgttaggccaccccatattttagtcaagacattggactatattgtagataacttattaacaacattgcctgaaagcgaaggattcttatgggataggatgagatccataaggcaggactttacatatcagaactattcaggacctgaggcggtagattgtaatgagcgtattgttaggatacatcttctgatcttgcatatcatggtgaaatcaaatgtggaattttcgcttcaacaagaactagaacaattgcataaatcccttatcacgttatcagaaatatacgatgacgttcgttccagcggcggaacatgcccaaatgaggctgaatttcgagcttatgctctcctgagtaaaataagagaccctcaatacgatgagaatatccaaagattaccaaaacatattttccaagataaattagttcaaatggctttatgtttcagaagggttatatctaactcagcttatactgaacgcgggtttgttaaaactgagaattgtttaaacttctacgcaaggtttttccagttaatgcaatcacccagcttgccattattaatgggattttttttgcaaatgcatctgacggatattagattttatgcgctaagagctttatcacatactttaaacaaaaagcataaaccaataccatttatttatttggaaaatatgttactctttaataatcggcaagaaataattgaattttgtaattattactcaattgaaatcataaatggggatgcagccgatttgaaaacattgcaacattattctcacaaattgtcagaaacacaacctttaaaaaaaacataccttacctgcttagaaaggagattacagaaaactacttacaagggtttaattaatggcggtgaagataatttggcttcttcggtttatgtgaaggacccaaaaaaggatagaataccttctatcgcagaccaatcttttttaatggaaaattttcaaaacaactataacgaaaagttgaaccaaaactcatccgttaaaccacagatcaatacctctccaaaaagagttgcaacgcggcccaaccactttcctttttcacaggaatctaagcaattacctcaaatatctcaatctcatactttatcaacaaatcctttattaacgccacaggttcatggagacctatcggaacagaaacaacaacaaattaaaaccgtcacagacggaggctccccatttgtttttgatcaatcagcacagaattctacggtggaagcttccaaggctcatatgatatccacgaccagcaatggtgcatatgatgagaagttgagttcagagcaagaagaaatgaggaaaaaagaagaacaacgaatagaagaagagaaaactcaattgaaaaagaagcaagaaaatgcggacaaacaagtaatcactgaacaaattgcaaatgacttagtaaaagaagtggtaaacagtagcgtgattagtattgttaagcgtgaattttcagaggctaattataggaaggacttcattgacacaatgacccgtgaactttatgacgcatttcttcatgaaaggttgtatctgatatatatggattctcgtgctgaattgaaaaggaattccactctaaaaaaaaagttctttgagaaatggcaagcatcttattctcaagcaaagaagaaccgtatattagaagaaaaaaaaagggaagaaattaaactcgtaagccaccaattaggagtaccaggttttaaaaaatctacatgtttgtttagaaccccgtataagggtaacgtaaattcatcatttatgctatcatcttcagataagaatctaatattttcacctgtaaatgacgagtttaataagtttgcgactcatttaaccaagatttcaaaactttggcggccgttagagatgcaatcaatctattatgataaccttacgaaaaagttcccctccaattctcttactccggcaaatttattcatttatgcgaaagattggacatcactctcaaaccgttggatcttaagtaagttcaatctgcaaacagcacaggattcaaaaaagttcagcaataatattatctctagcagaataatttgtattgatgatgaatatgaaccatctgattttagtgatttgcaattattgatatttaatacaggtgttacgaatccagatatattcgatttggagatgaaactgaaagatgatggtgaagaactgataaagctaatcactggtatttctctaaatacaaatatatgcttttcccttttgattatttattgggaatccgcagaaaatactttatcggaaagtaccattaaacacttactaaaattaaaccgaatatctaaaaactatagtagtgttattgaacgcattgacttaatgaatctcaccgaagaatcccctcataagtgtttagaggacaaattatctgaaatatcacattcttatgtgtacaagttgacagaaaggggaaaatatgataaaacacttcgtcagaaaaggtcattggccggcattcactcacgtagcactcaactacaaactacaaaggacattgatcaaaagatgaagaaaatgctggaaaaagagaaaaacaagtaccaacaacaaataggcgaaaggaacacctatgcgcatctagaatcgcatatagatgcatcaccaagaagcaagaaaaggaaattgccaatactcctgtcaacttctcattcgagccaatttaaaactcctctagcttctagattaaacacctctggttcgtctacttcaccacctttaccatctcatttggcgatgaaattcaggaaaaactcgagagttactagtttacataccgtattacccgttagcacaccaagccatagtaataacataccagctgcaagttttagcgggaataacaccaccgatatacagtcccaacaattaatcgaaaaccagaagagtacatctgtatatttgaataacgtttctgaaaggattctgggaaatcaagaaatatgtcaaacaccaattaatcctgttactcctgtgctagatggggccgatcaaggtaaggaggacattcctgatagtatattagagctgaagatcttgatcgattctgtcaagaagaaagtaaataatgattaa

SEQ ID NO: 25332 - DNA, 2559 bp, Saccharomyces cerevisiae
atgagttctgtcaaccaaatatatgacctatttcccaataagcataatatccaatttacagattctcattcacaggagcatgatacttcgtccagccttgctaagaatgatacagacggaactataagtataccaggtagtatagacactggcattttaaagagcattattgaggagcaaggttggaatgacgctgagttatatagaagttcaatacaaaatcaaagattttttttaacggataaatacactaaaaagaagcatttgactatggaggacatgcttagcccagaagaagaacaaatatatcaggaacctattcaagatttccaaacatataacaaacgtgttcaaagggaatatgagctcagggaaaggatggaagaattcttccgtcaaaacaccaaaaatgatttacatattttaaacgaggattcattaaatcagcaatattccccgttaggacctgcagattatgttctgcccctcgatagatactccagaatgaaacacattgcctcaaactttttcagaaaaaaacttggtattcctagaaaactgaaaagaagaagccattataatcccaacgcagagggccacaccaaagggaattcttctatattgagttccactactgatgtaattgataacgccagctacaggaatattgcaatagatgaaaatgttgacataacacataaagaacacgccattgacgaaataaacgagcagggtgcatcaggtagtgaatctgttgtggaaggtggatcgttattgcatgacattgaaaaggttttcaataggtccagggcaactaggaaataccatatccaacggaaattaaaagtgcgccatattcaaatgctttctatcggggcttgctttagtgtcggattatttttaacctcagggaaagccttttctattgccgggccatttggtacactacttgggtttggactcacaggtagcatcattttagccacaatgctgtcatttacagagttatccacccttattcctgtgtcttctgggttctcaggactggcttctagatttgtagaggatgctttcggatttgcattgggctggacgtattggatttcctgtatgcttgctcttcctgcccaagtttcctcaagtacattctatctcagctattataataatgtcaatatatcaaagggagtaacagcagggtttatcacgctgttttctgcatttagcattgtagtaaatttactggatgtcagcataatgggtgaaattgtatatgttgctggaataagcaaagtgataattgcaattttgatggttttcacgatgatcatcctaaatgccggacatggaaatgacattcacgaaggagtcggttttagatattgggatagctctaaatctgtccgaaatttgacctacgggctatatcgtccaacatttgacctggctgatgctggcgaaggaagcaaaaaaggaatttcaggcccaaaaggccgatttttagctacggcatcagtaatgctaatttcaacatttgcgtttagcggtgttgagatgacttttttagctagtggggaagctataaatccaaggaaaacaattccttctgctacaaaaaggacattttccattgtactgatatcttacgtttttttgattttttcggtaggcatcaacatatacagtggcgatccaagactactatcatattttcctggtatttccgaaaagaggtatgaagccattataaaaggcacaggaatggactggagacttaggactaattgtcgcggcggtattgattataggcagatttcagtaggaacaggttattctagtccttgggttgttgcattgcagaactttgggctatgtactttcgcatctgcttttaacgcaatactgatatttttcactgctacagcagggatatcctcgttatttagttgttcaagaacactatacgccatgtctgtacaacggaaggcaccgccagttttcgaaatttgcagcaagagaggtgttccttatgtttcagtgatattctcctctttattttcagtcattgcttatattgcagttgaccaaaccgcgattgaaaacttcgacgtcttggccaatgtttctagtgctagtacgtctattatatggatgggattgaatctttcctttttgcgattctattacgccctaaaacaaaggaaggatattatatcaagaaatgattcatcatacccatataaatcgccattccaaccatatctagcgatttatggtctagttggatgttcattatttgttatatttatgggatatcctaactttatacatcatttctggagtactaaagcttttttttcagcatatggtggcctgatgtttttctttatcagttacacagcttataaggttctcggaacgtcaaagattcaaagactagatcagttagatatggacagtgggaggagggaaatggacagaactgactggaccgaacatagccaatatttgggaacatatagggaaagagcgaagaagttggttacctggctgatttag

SEQ ID NO: 25333 - DNA, 2676 bp, Saccharomyces cerevisiae
gatcccttgaatggacaagaaatgtctaaagaattgcaacatctaccaaatgattcaatgcggttgaactatcttgtcaacagtaaacaattcaacgtcaaagcctttctgagagatatgcacaaacaagactctttcaatgatctaaataactcactggacaggttggacagtgatatacaagaccaatctatacatttgaaacaattggttggtaaaaatttcaccaagtatgttaagattaaaaacaagttagaccaaatttacaaagaatttgacgagaaaacgaatgaaaaaaaccaatgtgattcaccaaaagaaaatcaaataaatgtggaaagcttaaataaaaaggtcgacgaggttattagaacaacaactttcaaactgaaaccgctaatggataactatcagaaaattttgaattaccaggccaccaaaaaatttattgaattgaataagttttacttcaacctacccaaatctttaaagagatgtttgactaacaacgatttcaatgagttcattatcgaatattcaaaaggtcttacgctccgtcgccgtttcaaccagagttcagatgcttcacaatctcttgttataaaaagaatttggactcaaatagaaaatttattagtcacgtataaagatctgatttggaacagtttaataaattcaaattttaacattgaccaaccccaagaaacaattttgtccctcttttcaaaattgttgaacttagaaaactttatcaataataatcaaagagaaagtgaaagtggtaacaagaacacaacttcatcatccaatgaaaatccaatcctaagatggatgtccatcaaaatgaatggctttcagaatgaactgaacgagttgtctggccatatgattagtaaaatcattcattctcaaaggcttatattacaaaacaatactaatcaagataaaagtcaagggtgcgtggagctgtcgtattatttgaaaatcaatcaattattccaaataataagtgatacgggcaaggatagtgaaggtttgaaaagtaccgttgaacccaataaagttaacaccatttctggaaccagctatctaaatttgaattgccaacccagctctcaaggactaactgattccccaactatcattgaaatgtggctattaatcttaaaatatattaacgacctgtggaaaatttgtgatcaatttatagaattctgggaacacattgaaaagttcctcgatgggacttaccaaaattccattataaatgaaaaaagaaaagaaaacattttgatcggtgattctaatattattgaatcataccaaaaaagcttgatcttgaaggaagaacagattaacgaggttaggttaaagggcgaggaattcatcacttcagtctcacaaaatttaatatcatttttcacatcttctcaatcatctctaccatcatcattgaaggattctactggagatattacccgcagtaataaagattcggggtcacctttggattatggatttatacctcctaattgtaatggattgagttgtttaagatatctaccgaaaattgtggagcccattttgaaattctctaccgagttagcgcaattaaatatcacaactaacggaatcaccatttgcaggaacactctatcaactataatcaatcgttgcgtaggtgccatatcttccacgaaattaagagatatatctaacttttatcaactggagaactggcaggtctatgaaacggttacattttcaagcaaatcacaggacagtagtaaaaatctaactttcgaatatggtgtgacacaatttccggaaattgtcacctcgtttcaagaagtgagtatcaaaactactagagatctattattcgcatatgaaaaattaccaatcattaacggaatttcagtagtaagttatccgtcaaaacaactgctcacaggtatagaaattcaacagattatatcgatggaagctgtattggaagcgatcttaaaaaatgcggcaaaggataaggacaacccaagaaattctcataccatcttaacattaacaaatctacaatattttagagaatgtgcattcccaaatattttgcagtattttgatgacgcattcgagtggaatttggcttccaaaaacttagaattatttagcctactatctaagatggaatcttcaattttcggtaactatctttctgacttaaagatcaacttaagggatactcttgaagaaaaattccacgaaataaattggcccatgtatacatcaaattcattcagggttggtgactatattatagaagcgttaatgattctgatcgtggttcacagtgagtgctttagaattgggcctcagctcatccataagattttaattgaaacgcagatttttatagccagatacctctttgaggcatttaagccttatgttggtaatctttctaatgatggctcattacaaattatagtggatttggaattctttcagaaggttatgggtcctttacttgaaaaggacaccgaggccacattaagggcgtgcttacaaaactgtttccagaacgacacaaatagactacaaaaatgtatcaatgagattaatcctattgtatctgccaatttaaaaagaactgctattcaattcgccgccttcagctag

SEQ ID NO: 25334 - DNA, 621 bp, Saccharomyces cerevisiae
atggattttgaggaagattacgatgcggagtttgatgataatcaagaaggacaattagaaacaccttttccatcggttgcgggagccgatgatggggacaatgataatgatgactctgtcgcagaaaacatgaagaagaagcaaaagagagaggctgtagtggatgatgggagtgaaaatgcatttggtatacccgaatttacaagaaaagataagactctggaggagattctagagatgatggacagtactcctcctatcattcccgatgcagtaatagactactatttaaccaaaaacgggtttaacgtagcagatgtacgagtgaaacgacttttagcacttgctactcagaaatttgttagtgatatagctaaggatgcctacgaatattccaggatcaggtcttccgtagcggtatctaatgctaacaacagtcaggcgagagctaggcagctattgcaaggacagcaacagcctggcgtgcagcagatttcacaacaacaacatcaacagaatgagaagactacagcaagcaaagttgttctgacggtgaacgatctcagtagcgctgttgctgaatacgggctcaatataggtcgcccagacttttatcgttag

SEQ ID NO: 25335 - DNA, 1521 bp, Saccharomyces cerevisiae
atggccattgattactctaagtgggataaaattgaactatcagatgattctgatgtcgaggtgcatcctaatgtggacaagaaatcgttcattaaatggaaacaacagagtatccatgaacagcgattcaaaaggaaccaagatatcaaaaatttggagacacaagtggatatgtattctcatttgaacaaacgagtggacagaattttgagtaatttacctgaaagttctcttactgatttgccagccgttaccaaattcttgaatgcaaattttgataagatggagaaaagtaaaggggaaaatgttgatcctgagattgcaacatacaatgaaatggttgaagatctttttgaacaattagcaaaagatttagacaaagagggcaaagactcgaagagcccatctctcataagggatgctattttgaaacatagggctaagatcgattcagtaactgtagaggctaagaagaaattagatgaattatacaaggagaaaaatgcacacatttcatctgaagacattcatacaggctttgatagtagctttatgaacaagcaaaaggggggggctaagccactggaagcaactccttcagaagctctttcgagcgctgcagagtctaatattcttaataaactagcaaaatcatcagttccgcaaactttcatcgattttaaagatgatcctatgaaactggccaaggaaactgaagaattcggtaaaatatccattaatgagtactcaaaatctcagaaattcttactggagcacttacctattatttcagaacaacaaaaggacgccttaatgatgaaggcctttgagtatcagttacatggtgacgataagatgactttgcaagtcattcatcaatccgaattgatggcctacattaaggaaatctacgacatgaagaaaattccatatttaaatccaatggaactatcaaatgtcattaatatgtttttcgagaaggttatcttcaacaaggacaagccaatgggtaaagagtcttttttgagatcagttcaagaaaaatttttgcacattcaaaaacgttccaaaattttacaacaagaggaaatggatgaatcgaatgctgaaggagtagagacgattcaattgaaatctctagatgattctacagaattagaagtaaacttgccagacttcaattctaaagatccagaagagatgaaaaaggttaaagttttcaaaactttaataccggaaaaaatgcaagaagccataatgaccaaaaatttggataatattaataaagtctttgaagatataccaattgaagaggctgagaaacttttggaagtgtttaatgacattgacattattggaataaaagcgatcttagaaaacgagaaagactttcaaagtttgaaagatcaatacgaacaggaccatgaagacgccactatggagaatctgtccttaaacgaccgtgatggtggcggagataaccatgaagaggtcaaacatactgccgacactgttgactag

SEQ ID NO: 25336 - DNA, 1128 bp, Saccharomyces cerevisiae
atgagtttttatcaaccatccctatctctttatgacgttttgaacgcattatccaaccaaactggccagagagggcagcaaggatatcctcgccaaccacaaaggccacagagataccatccccattatggacaagtgcacgttggcgggcatcatcctcgtcatcatccattgtatagcagatacaatggtgttcctaatacctattactaccagttccctggacaagcctattactatagtcctgaatacggttatgatgacgaggatggtgaagaagaggaccaagacgaagatatggtgggtgacagcggcactacaagacaggaagatggtggcgaggacagcaactcgagaagatatccatcatattaccattgtaatactgccaggaataataggaccaaccaacaggcaaacagtttaaacgacttattaaccgcgttaataggtgttccaccatatgaaggcactgaaccagaaattgaagcaaataccgaacaggagggcgaaaagggagaagaaaaggataagaaggataagtctgaagcacccaaagaggaagctggcgaaaccaacaaagaaaaacctttgaatcagctggaggaatcgtcgagaccaccattagccaaaaaatcttcatcgttcgctcacctacaagcgccttccccaatacctgacccgttacaagtatccaagcctgaaacgagaatggacttaccattttcaccagaagtgaatgtctatgataccgaggacacttacgtagttgttcttgcgttaccaggtgctaactctagggctttccacattgattaccatccatcttctcatgagatgctcatcaagggtaagatcgaagacagagtgggcattgatgaaaaattcttgaagatcacggaactaaaatatggtgcgtttgagagaaccgttaaattccccgtgctgccacgcattaaggacgaagaaattaaagctacttacaacaacggtctactacaaattaaggtgcctaaaattgtcaatgacactgaaaagccgaagccaaaaaagaggatcgccattgaggaaatacccgacgaagaattggagtttgaagaaaatcccaaccctacggtagaaaattga

SEQ ID NO: 25337 - DNA, 648 bp, Saccharomyces cerevisiae
atgtctagggctaagagaattatgaaagaaatccaagctgtgaaggatgatcctgcagctcacattactcttgaatttgtgagtgaatctgatatccaccatttaaaaggcacatttttgggcccacctggaacaccttacgagggtggcaaatttgtcgtggatatcgaagtacctatggagtatccattcaaaccaccaaagatgcagttcgacacaaaagtataccatccaaatatatcatcagtgacaggtgccatttgtttagatattcttaagaatgcatggtcgccagtgataacactaaagtctgcattgatttcgctacaggcgctactacaatctccagagcctaacgatcctcaagatgcagaagtagcacaacactatttacgggatagagaatcttttaataagactgctgcactatggacgaggttatacgccagtgaaacttccaatggtcaaaaaggcaatgtagaggagtctgatttatatgggattgaccacgatctgattgacgagtttgaatctcaaggttttgaaaaggacaagattgtggaagtgttgagacgattaggcgtcaagtccttagaccccaatgacaacaacacagccaaccgtatcatcgaggaattgttgaagtga

SEQ ID NO: 25338 - DNA, 546 bp, Saccharomyces cerevisiae
atgatgttgccaagatccatgaaatttatgactggaaggagaattttccatactgccacagtaagggccttccagtctaccgctaagaagagcttaactatcccatttttgcccgtattaccccagaaaccaggtggtgttaggggcactcccaatgatgcctacgtccccccccctgagaataaattagagggctcataccactggtatatggaaaaaatctttgccttgtccgtcgttccattggctacgacggctatgctgacaaccggtccgttatccactgcagctgattctttcttttctgtcatgcttttgggatattgttacatggaatttaactcttgtatcaccgattatatttctgaaagagtttatggtgtttggcacaagtacgccatgtatatgttgggccttggttctgcggtctccctttttggaatctataaactagaaaccgagaatgatggtgttgttggtttagtaaaaagtctatgggattcttccgagaaagacaacagtcaaaagattgaagccaagaagtag

SEQ ID NO: 25339 - DNA, 1476 bp, Saccharomyces cerevisiae
atggtatatcgtaacaggtcaaagagcgttttatctacacacagcaagaagagcgacgataaggcccactataaatcacgttcgaaaaagaaatcaaaaagcaggagcaagaagaggttaagaatctactggagatacatatctattgtatggatcttatggttaggattaatatcttattatgaatcagtggttgtgaagagagcaatgaagaagtgccaatggtcgacttgggaggattggcctgaaggcgctgaaagtcatagggtgggtttatttgcagacccacaaataatggacgaatattcatatcctgggaggcctcaaatagttaattattttacaagagtgattgttgaccattatcacaggagaaattggaaatatgtccagtattacttggatcctgatagcaattttttcctaggtgatctatttgatggagggagaaactgggatgataagcaatggattaaagagtacacacgattcaaccaaatattccccaagaagccactgagaagaacggtcatgtctttaccaggtaatcacgatattggttttggagacacagttgttgaatcgagtttacagagattttctagttactttggagaaacttcctcctcattagacgctggaaatcatacctttgtacttttagatacaatttcgctttctgataaaacaaatccgaatgtctcgagggttcctagacagtttttggataattttgcaatgggttcacatccgcttcctagaattcttttaactcacgttccattatggagggatccagaacagcaaacgtgcggtcagctacgtgaatccaaagaaccttttcctattcagaaagggcaccagtaccagacagttatagaaaacgatatatcacaagaaattttaacgaaaattcaaccagaaatattattttccggggatgatcatgaccattgtcagatatcacactcatatccgtttcaggggaaaactaaaaatgctcaagaaattacagtaaagtcatgtgcaatgaacatggggatcagtaggcctgctattcaattgctctccttatataatccttcagatttgacaatggtaaatgccggcggagagtatgcatcaaaaacttaccaaacagagctatgctatatgccagatccctataaggcaatcagaatgtacctatggggattattattctctgctgcctttatcgcatacatgcattttttcccaaaatcttttaataatcgcgtagcaaccataatgaacagagtatttacacgacctgatggtaacacctcagatttgccattacctacaagtatttccaaatcgaaatccaaaaaatcattgacacatagtaaatacgctgtgaatgatacgcgttcgatcaaacaatttctagttaatgcaattgtcctttttgtttctgtgatgcccatttttatttatttttatactgtagtctag

SEQ ID NO: 25340 - DNA, 1641 bp, Saccharomyces cerevisiae
atgtcattgcaattgttgaatccgaaggctgaatcgttgagaagggatgcggctttgaaggttaacgtcacatctgctgagggcttacaatccgtcctagagaccaacttgggccctaagggcacgctaaagatgcttgtggatggtgctggtaacatcaagctgaccaaggacggtaaagtgttgctgaccgagatgcagatccagtcgcctacagcggtactgattgctagggcagctgccgcgcaggatgaaatcacgggcgatgggaccacgacggttgtgtgtcttgtgggtgaattgcttagacaagcgcaccgtttcattcaagagggcgtgcatccgcggatcatcactgatgggtttgagattgcgcggaaggagtccatgaaatttttggacgaattcaagatcagtaagacgaacctttccaatgatagagagttccttctgcaagtggcccggtcgtcgctgctaaccaaggtggacgctgacttgacggaggtcttgacgcccattgtaacggatgcggtgctaagcgtgtacgacgcgcaggctgacaatttggatttacacatggttgagatcatgcagatgcagcacttgtctcctaaagataccacttttattaagggtttggtattggaccacggtggtaggcatcctgacatgcccacccgtgtgaagaacgcgtatgttttgattttgaacgtatctttggaatacgagaagactgaagttaactctgggttcttttacagttctgcggaccaaagggacaagttggccgctagtgagaggaagtttgtggatgccaagttgaagaagatcatcgacttgaaaaacgaagtttgtggcatggatccagacaagggttttgttatcattaaccaaaaaggcattgaccccatgtctttagacgtgtttgccaaacacaacatcttggctttgagaagggccaagagacgtaacatggaaagattgcaattggtcactggcggtgaagctcagaactctgtggaagacttgtcgcctcagattcttgggttttctggcttggtctaccaagaaaccataggcgaggaaaaattcacatacgttacagagaacactgaccccaagtcttgcaccatcttaatcaagggctccactcattatgccctcgctcaaacaaaggatgcggtgagagatggtctcagagctgtggcaaacgttctcaaggacaaaaacatcattccaggcgctggtgcgttctacatcgccctttcgagatacctaagatctgccaacatgaacaagttgggtgccaagggtaaaacaaagacaggtattgaggcgttcgcagaagcattgctggtaattccaaagactttggtgaagaactcaggattcgacccattggacgtgctcgcaatggtggaggacgagttggatgacgctcaggattctgacgaaacgagatatgttggtgtggacttgaacataggtgattcttgcgaccctaccatcgagggtatttgggattcctaccgcgtactaagaaatgctattaccggtgctacaggtattgccagcaacttgttattatgcgatgaattgttaagggcaggtagatccactttgaaagaaacaccacagtaa

SEQ ID NO: 25341 - DNA, 1995 bp, Saccharomyces cerevisiae
atgttgacctctatattgataaaaggtcgcacacctgttcttgcaagcagaaatttattagcagctctctcgaattgcaaccatattacttgggctgtttcaagaagattatacaatgatggaaacagagatcaaagaaattttggtaggaatcagagaaacaacaacagtaacaggtatagaaactcccgtttcaattctcgcccaaggacaaggtctagagaagacgatgatgaagtgcactttgataagaccactttttccaaactaattcacgtcccaaaagaagataatagtaaagaagtaacgctggactctttactggaggaaggagtccttgataaagaaatacataaagccattaccaggatggaatttcccggtttaactcctgtacagcaaaagactatcaaaccaatattatccagtgaagaccatgatgttatcgcaagagctaaaaccggtacaggtaagacatttgccttcttgattccaattttccagcatttgataaatacgaagttcgattctcaatatatggtaaaagctgttattgtcgcaccaacaagagatttggccttgcaaatcgaagcagaggtgaaaaaaatccacgatatgaattatggcttgaaaaagtacgcttgtgtctctttagttggtggtactgacttcagggcagctatgaataaaatgaataagttgagaccaaacattgtaattgccactccagggagattgattgatgttttggaaaaatactccaacaaattttttaggttcgtagattacaaagtgctagatgaagctgacagattgctagaaattggattcagggatgatttagaaactatttctggtattttaaatgaaaagaactccaaatcagccgataatatcaagactttgttgttctctgctactctggacgacaaagtacaaaagttggcaaacaatatcatgaataaaaaagaatgtctctttttagacacagtagataagaatgaacctgaagcacatgaaagaattgatcagtctgtcgtcatttcagaaaagtttgccaatagtatatttgctgctgtggagcatataaagaaacaaataaaggaaagagattctaattacaaagccattatttttgcaccaactgttaaattcacatcctttttgtgcagtattttaaagaatgaatttaagaaagatttaccaattttggaatttcatggtaaaattactcaaaataaaagaacaagtttagttaaaagattcaaaaaagatgaatccggtattttggtttgtacggatgtgggagcccgtggtatggatttcccaaacgtccacgaagttttgcaaattggtgttccatctgagttggctaattatattcatagaattggtagaacagccagaagtgggaaagaaggatcttctgtgctattcatttgtaaagatgaattgccatttgttagagagttggaagatgcaaaaaatatagtcattgccaaacaagaaaaatatgagcccagtgaagaaataaaatctgaggtcctagaggcagtgaccgaagaaccggaagacatatcagatattgtaataagtttaatctcatcctacagatcctgtatcaaggaatacaggttttctgaaaggcgcatacttcctgaaattgcttccacttatggtgtactgttaaatgatcctcaattaaagattccagtatccagaaggtttttagataaattaggtttgagccgtagtccaattggtaaggcaatgtttgaaattagagactatagtagtagagatggaaataacaagtcctacgattatgatgatgattcagaaatttctttcagaggcaacaaaaactataataataggagccaaaatagagattacgatgacgaaccgtttagacgcagcaacaacaatagacgctcattctcccgtagtaatgataaaaataattactccagtagaaacagcaacatatattag

SEQ ID NO: 25342 - DNA, 1680 bp, Saccharomyces cerevisiae
atgtcccaattattcaataactcgcgctcagatacccttttcctaggaggtgaaaaaataagtggtgatgatattcgtaatcagaatgttttggctactatggctgtggctaacgtcgtcaagtcatctttaggccccgttggactggacaaaatgcttgttgatgacattggtgattttaccgtcaccaacgatggtgccactattttgtctttgttagatgttcaacatccagctggaaaaattttagtagaattggctcaacaacaggacagagaaattggtgacggtactactagtgttgttattattgcttctgagttgttgaaaagagctaatgaattagtcaaaaataagattcatccaactaccatcataactggtttcagggttgcattaagagaggctattcgttttataaatgaagttctttccacaagtgttgacactttagggaaagagacgttaattaatatagccaagactagtatgtcctctaagatcattggtgctgactctgattttttcagcaatatggttgtagatgctcttttggctgttaagacgcaaaattccaaaggagaaatcaagtatcccgtaaaggctgtcaatgtgttgaaagctcatggtaaatctgccactgaatcactgttggtgccaggttatgctttgaattgtacagttgcttctcaagcaatgcctaaacgtatcgccggtggcaatgtgaaaatcgcatgtttggatttgaacttgcagaaagctcgtatggcaatgggtgttcaaatcaacattgatgatccggaacaattggagcaaatccgtaaacgtgaagctggtattgttttggaaagagtgaagaagatcattgatgctggtgctcaagttgtgttaaccaccaaaggtattgatgatttatgcttaaaggagttcgttgaagctaagataatgggtgtaagacgctgtaagaaggaagatttgagaagaattgcacgcgctacaggcgccactttggttagttctatgtctaacttagaaggtgaggaaactttcgaaagcagttatttaggtctttgtgatgaagtagttcaagccaaattttctgatgatgagtgtatcttaattaagggtacttctaaacattcatcttcttcgatcattttaagaggtgccaacgattattctttagatgagatggaacgttctttgcacgattctctttctgttgtcaaaagaacgcttgaaagtggaaatgttgtccccggtggaggttgcgttgaagccgcattgaatatctatttggacaattttgccaccacagttggttctcgtgaacagttagctattgctgagtttgcagctgcattattaatcattccaaaaactttagctgttaacgctgccaaggattctagtgaattagttgcaaaattaaggtcctaccatgccgctagtcaaatggccaagccagaggacgttaagaggagaagctacagaaattacggcctagatttgattagaggtaaaattgtggacgagattcacgctggtgttcttgagccaaccataagcaaagtcaaatccttgaaatcagcattggaggcttgtgtagcaattctaagaattgatacaatgattacagtggatccagaaccacccaaagaagatccgcacgatcattga

SEQ ID NO: 25343 - DNA, 3930 bp, Saccharomyces cerevisiae
atgtcaggccagttagttcaatggaaaagctctccagatcgagtcacccaaagcgctataaaggaagcactgcattctcccttggctgatggcgacatgaacgaaatgaatgttcccgttgatccgttggaaaacaaggtaaatagcacaaacataatcgaaggaagtcccaaagcaaatccaaatcctgtcaagtttatgaatacaagtgagatatttcaaaaatctctgggattacttgacgagagtccaagacatgatgatgagttaaatattgaagtaggagataatgatcgaccaaatgctaacatattgcataatgaaaggactcctgaccttgaccgaattgctaactttttcaaaagcaatcgaacccctggtaaagaaaatcttttgaccaaatatcaaagctccgatctggaagacactcctctgatgttaagaaaaaaaatgacttttcaaactccaactgatccattggaacagaaaaccttcaaaaagttgaagtcagatactgggttttgctattatggagagcagaatgatggagaagaaaatgcgtcattagaagttacagaggcggatgccacttttgtacagatggctgaacgttctgctgataattatgactgtgcattggaaggaattgttacacctaaaagatataaagacgaattaagtaaaagtggaggaatgcaagatgaacgagttcaaaaaactcaaatcatgatatcagcagaatcacctaattcgataagctcttatgacaagaacaaaattaccgggaatggccggaccacaagaaatgtaaacaaggtttttaacaataacgaagataacataggagctatcgaggaaaaaaatccagtaaaaaagaaaagtgagaactattcatcagatgatctcagagaacggaacaatcaaataatacaaagtaatgaatcagaggagattaacgaattggaaaagaatctgaatgtttcgggtagagagaatgacgtgaacaatttagatatcgatattaatagtgctgtgtctggcaccccttcacgcaacaatgcggaagaagaaatgtattccagtgagagtgtaaacaatcgggaaccatccaagaagtggatattccgatactcaaaagacaaaacggaaaataatagcaatagatctacgcaaatagtcaataatccaagaacacaggaaatgcctttagatagtatttcaatcgatacgcaacccttatctaaaagtttcaataccgaaacaaataatgaattagagacacagataattgtttcatcgctttcccaaggcatatctgctcagaagggacctgtttttcattctactggccagacagaagaaataaaaacccaaataataaattctcctgaacaaaatgctttgaatgcaacctttgaaactcccgttactctttctcggattaattttgaacccatattggaagttcctgagactagttcaccatctaagaatacgatgtcaaaaccctcgaattcttcacctattccgaaggaaaaagatacatttaatatacacgagagagaagtagagacaaacaatgttttttcaaacgatatacaaaattcttcaaatgcagctaccagagatgacattatcatagccggttcatctgatttcaacgaacaaaaggaaataaccgatagaatatacttacaactttcaggaaagcaaatatctgattcaggaagtgatgaaacagaacgtatgtccccaaatgagcttgatacgaaaaaggaaagtacaatcatgagcgaggttgaactaacccaagaactgcctgaagttgaagagcagcaagatcttcaaacgtctccaaaaaagctggtagtcgaggaagaaactttaatggagataaaaaaaagcaaggggaactcacttcagcttcatgatgataataaagaatgcaattcagataaacaagatggcacagagtctttggatgtagctttgattgaacacgaaagcaaaggacagagctcagaacttcagaaaaacctcatgcaattatttccaagtgagtcacaggagattattcagaaccgaagaacaataaagcgacgtcaaaaagatacaatagagatcggtgaagaggaggagaacagaagcactaagacatcaccgacaaaacacctcaaaagaaattcagatttggatgctgcttctatcaaaagggaaccgtcttgcagcattaccatacaaacaggggagacaggttcgggcaaagactctaaagaacagtcttacgtgtttcctgaaggtattagaacggcagataatagtttcttatcgaaagacgacataatttttggaaatgcggtatggtgtcagtatacgtggaattacaaattttatccgggtattttattggaagttgacactaatcaagatggctgttggatttatttcgaaacaggaagatcgctaaccaaagatgaggacatctactacttagatattagaataggggatgctgttacctttgatggaaatgagtacgtagtcgttggtctagaatgtcgtagccatgatctcaacataataagatgtattcgaggatatgatacggttcatttgaaaaaaaaaaatgcaagcggattgttggggaaaaggacgttaattaaagcactaagctcgatcagtcttgacctaagcgagtgggctaaaagagcgaagatcatattagaagataatgagaaaaataaaggcgacgcgtataggtacttgagacatcccattaggggaaggaaatcaatgaccaatgttctgtctccgaagaaacatactgatgacgaaaaggacataaatacgcatactgaagtgtacaataacgaaatagaatcgagctccgaaaagaaggaaattgttaaaaaggattctagagacgcattagctgaacatgcaggagcgccaagcctgcttttttcttctggtgaaatcagaacagggaatgtatttgataaatgtatttttgttttgacaagcctattcgaaaatagagaggaacttcgacagaccattgaatcgcaaggcggcactgtaattgagtcaggattttccactttatttaacttcactcatccgctagctaaatctttagtcaataaaggtaatacagataatattcgagaattggccttgaagctagcctggaaacctcattccctatttgcagactgcagatttgcttgcctaatcacaaaacggcatttaagaagcttaaagtacttagaaactttggcgttggggtggcctacactacactggaaattcataagtgcatgcattgaaaagaaaagaatagtaccacatttaatataccaatacctattaccttcgggtgaaagttttcggttatcgttagattctccatcaaagggaggaatcattaaatccaacaatattttttcattttatacacaattcttacgcggatctaatttaagagatcagatatgtggagtgaagaaaatgttaaatgactacattgttattgtttggggtagatctgagttggacagttttgtcaaatttgcttttgcatgtttgagcgcaggtagaatgcttacaattgatttacccaatattgatgtagatgatacagagccattgttaaatgccttagattctttagtacccagaataggatcagaattatctaatcgaaagttaaagtttctcatatatgctaacgaaaataatggtaaatctcagatgaagcttctcgaaagattgagaagtcaaatatcactgaaatttaagaaatttaattacatatttcacactgaatctaaagaatggctaattcagacaataattaacgaggacactggttttcacgatgatattacggacaatgatatatacaacactatttctgaggttagatga

SEQ ID NO: 25344 - DNA, 1272 bp, Saccharomyces cerevisiae
atgttcccaatgaaagatcactcagctcttgaacaacatactctcagcagagatgagttaagacgtcgcaagggttacaagaaaggactgcagttgtcaattttgttacttggagaaaaaggcagcggcaaatcaacgtttttaaacaatctgtgcggtcaggatatatcgctttctgatggggattatgatgatgatgatgataaagtgacaaataatgtaacaccagaaaatggaaacgccatcgaagatatagatcctggatataaaacagcccatttgagtcctgggctgaagcttgtcaccagaagagtgtatttgaacgatgaactaggcgtacccataacattagatatcatattgtttccaggctgcggtgacaatgtcgacaattcacaaagctctgttgttataaaaaactacttagaccaacagtttgcaaatgttttaaaagaagaggtcagaataaagagaaacacaaaagaaactgatgggaggcctcatgtttgtttatactttctgaagagtactccaagaggagtcaaaaaatttgatattgagttaatgaaaacgatttgtgataaagttaatttaattcccattattccaaaagccgatggtctcacagaaactgaattaaatttacacaaagacattgtgcgccaagaaatctctcagaacaatatacgtgtttttgattttaaaagtgacaccctaggcgaaacattagctctgtacgatatggacatcgattccagttcagcaaaatccaaatacgataatgacacgaagatcaaggaaatatcgccatttgccattgtttgcagcaaaacttttaataaaaattcggaaaatagggttgagcatatcagaacgtacgaatggggtagcttggtggtcgaagaccaaaacacctccgattttatatacttaaaagcaatactgttaggttctcaccttcaggaattaaaagatgtaacaaacaacgtattgtatgaaaattatagggctaaagtgttaactgagaagaaaaacaactatgatattccaaactatagctatatcgacgaaacctcaaggggaagtgtcagcaatgtttccaccagaagaaatagtgcaagtagaacacttgggaatccagatacaaacgatgaaaatgcttatcaaatacacaaagaaatagacgaaaaaaacagaattattgaagactatcaaaggaagattgatttattggagaaaatgttggcagctccccatcaaaataaggtctaa

SEQ ID NO: 25345 - DNA, 4077 bp, Saccharomyces cerevisiae
atgccaaatgacaataagacacccaataggtccagcactcccaagtttactaaaaaaccagtaaccccgaatgataaaattcctgaaagagaagaaaaatccaatgaagtgaagacacctaaaattccattattcacgtttgccaaaagcaaaaactattcaaggccgtcaaccgcaattcatacctcacctcatcaaccaagtgatgtaaaaccgacttcccataaacagttgcaacagccaaaatcctcaccactgaaaaaaaataactataattcttttcctcactcaaatctggaaaaaataagcaacagcaaactactctcccttcttcggtccaaaacgtcagcaggaagaattgaatcaaacaatccttcacatgatgctagcaggtctctagcaagttttgaacaaacagcattttcccggcatgcgcagcaacaaacttctaccttcaattcaaagcctgtacgtaccatagtaccgatatcaacatcacaaaccaataactcatttttatcaggagtaaaaagcttactaagtgaagagaaaataagggattactctaaagagattctaggcataaacttggcaaacgaacagcctgttttagagaagccacttaaaaaaggatcagcagacatcggcgcctctgtgatttctttgaccaaggacaaatctatcaggaaagataccgtagaagaaaaaaaagaagaaaagttgaatataggtaaaaactttgcccattctgattcactatcagttccgaaggttagtgccggtgacagtggtatatcaccggaggagagcaaggcaagaagtcctggaattgcaaaaccgaatgccatacaaacagaagtgtatggaataaatgaggaatctactaacgagcgtttagaaataaatcaagaaaaaccagtaaaattagatgagaatagtgcaaatagtacggtcgcatcggccttagataccaatgggacgtcagccacgacagaaactctaacatcaaagaagatcgttccatctccaaaaaaagtcgccattgatcaagataaaataacactgcacgatgagaaaacacttgcaccttcgaagcatcagcctataacatctgaacaaaaaatgaaggaagacgccgacctcaagaggatggaaatcttaaagtcacctcatttgtcgaaaagtccagctgacagacctcaagggcgtagaaacagccgaaatttttccactagagatgaagaaactacaaaacttgcttttcttgttgaatatgaaggccaagaaaacaactataactctacttctcgaagcacagaaaagaaaaatgatatgaacacttctgcaaagaataaaaatggtgaaaacaagaaaattggtaagaggccgcctgaaatcatgagcactgaagctcacgtaaacaaagtaaccgaagaaaccacaaagcagatacagagtgtacgaatagatggtcgaaaagtgcttcaaaaagtacaaggagaatcccacattgattcgagaaacaataccctgaatgttacaccatcaaagaggccccagctaggagaaataccgaatcctatgaaaaagcataagcctaatgaagggcgaactccaaatatctcaaacggtacaataaacatccaaaagaaattagagcctaaggaaattgtgcgagatattttgcatacgaaagaatcatcaaatgaggctaagaaaactattcaaaaccctttaaataaatcacaaaacactgctcttccttccacacataaagttacacaaaaaaaagatataaaaattggaactaatgacctttttcaggttgaatctgctccaaaaatatcctcagagattgaccgggagaatgttaaatcaaaggatgaaccggtttccaaggctgttgaaagcaaatctttattaaatttgttttcaaacgtactcaaggctcctttcattaaaagtgaaagcaaacctttttctagtgatgctctgtcaaaagaaaaagccaattttttggaaactatcgcttccactgaaaagccagaaaataagactgataaggtgtctctatctcagccagttagtgcaagtaagcatgagtatagcgataattttccagtttctctatctcaaccttcaaagaaatctttcgcaaatcatacagaggatgagcaaattgaaaaaaagaagatctgccgtgggagaatgaatacgataataactcacccgggaaaaatggagctggtatacgtgtccgactcagacgattcttcttcagataatgatagcctaactgacttggaaagtttaagctctggtgaatcaaatgaaatcaaagtaactaatgatttagatacaagtgctgaaaaggaccaaattcaggcaggcaaatggtttgatcctgtattggattggcgaaaatctgatcgtgaattgacgaaaaacattctttggaggatagctgataaaacgacatacgataaagaaacaataactgaccttattgaacaagggatcccaaaacatagttatttaagtggcaatccattaactagtgtgactaacgacatttgctctgttgaaaactatgaaacatcaagtgctttcttttaccaacaagtgcacaagaaggacagattacaatatttgccattatatgcagtttctacatttgaaaacacaaataacactgaaaaaaatgatgtgaccaataaaaatatcaatatagggaaacatagccaagaacaaaattcttcttccgctaaaccatcccaaattccaaccgtgtcttctccattaggattcgaagaaacaaagctaagtaccacgcctactaaaagcaatagaagagtgtcgcatagtgatactaattctagcaaacccaaaaacacgaaggagaacctttcaaaaagctcttggaggcaagaatggcttgcaaatttgaaacttatttccgtttcgttggttgatgagttcccttcggagctttccgacagtgatagacaaataattaacgaaaaaatgcagttacttaaagatatatttgctaacaaccttaaatcagcaatttccaataattttagagagagtgacatcattatactgaaaggtgaaatagaagattacccaatgagttctgaaattaagatttactacaacgaattacagaacaagcctgatgcaaaaaaagccagattttggtcatttatgaagactcagagatttgtttccaacatgggatttgatattcagaagtcctgtgaacctgtttctatatccacgtcggtcaaaccacatgtggtcgagcccgagcatatggcagatgccaaaattatgcctaaggatatactgcaaattacaaaaaaaccgttaatggttaaaaatgtgaagccttcttctccgccagatgtgaagtctttggtgcagctgagcacaatggaaacgaaaaccctaccagaaaagaagcaattcgacagtatttttaattctaacaaagcaaaaataatccctggaaatgggaagcacgcatcagaaaacatctcactctctttctcaagacctgcgtcctacggctatttttctgttggaaaaagggttccaatcgttgaagatcgtcgagtgaaacaactcgacgatataacagacagtaatacaacagaaattttaactagtgttgacgttttaggaacacattcacaaactggtactcaacaatcaaatatgtacacatcaacccaaaaaacagaacttgaaattgataataaggatagtgtcaccgaatgttcgaaggacatgaaagaagatggtctttcctttgtggatatcgttttgtcgaaagcagcatcggcgctggatgaaaaggaaaaacaattggctgttgcaaatgaaattattcggtctttgtcagatgaagttatgaggaatgaaattagaataacttcacttcaaggtgatttaacttttacaaagaaatgtcttgaaaatgcgagaagtcaaatatctgaaaaagatgctaaaattaacaaattgatggaaaaagattttcaagtgaataaggagataaaaccgtattga

SEQ ID NO: 25346 - DNA, 1647 bp, Saccharomyces cerevisiae
atgcaacgctccatttttgcgaggttcggtaactcctctgccgctgtttccacactgaataggctgtccacgacagccgcaccacatgcgaaaaatggctatgccaccgctactggtgctggtgccgctgctgccactgccacagcgtcatcaacacatgcagcagcagcagcagccgctgctgccaaccattccacccaggagtcgggtttcgattacgaaggcctgatagattccgaactgcagaagaaaagacttgacaaatcgtacagatatttcaacaatatcaaccgattggccaaggagttccccctagctcatcgccagagagaggcggacaaggtcaccgtttggtgttccaacgactatttagcactttccaagcaccctgaggtattggacgccatgcataaaactatcgacaagtatggttgtggtgccggtggtacaagaaacattgctggccataacatccccactttgaatctggaagccgaattggccactttacacaagaaggaaggtgccttagttttttcgtcatgttacgtagccaacgatgccgtcttatccctactgggtcaaaagatgaaggacttggtgattttctccgacgaactcaaccatgcgtccatgattgtcggtattaagcatgctaacgtaaaaaaacacattttcaaacataatgacttgaacgaattggaacaactgctccagtcataccccaaatccgttcctaaactaattgctttcgaatcagtatattctatggccggttcagtggccgacatagaaaaaatttgcgacttggccgacaaatacggtgctttgaccttcttggatgaagtacatgcggtcggcctgtacggccctcacggtgcaggtgttgcagaacattgtgattttgaaagtcaccgtgcaagtggtattgctaccccaaagaccaatgacaagggcggcgcgaagactgtgatggaccgtgtcgacatgatcaccggcactttaggtaagtctttcggtagcgtaggtggctacgtcgcagcctctaggaaattgatcgattggttcagatcgtttgcacctggtttcattttcaccacgactttaccaccttcagttatggcaggcgctaccgcagcaattagataccaacgttgccacatcgacctaagaacctcgcaacagaaacataccatgtacgtaaagaaagctttccatgagttgggcattccagttattccaaatccttctcatatcgtcccagtgttgattggtaatgctgatttggctaagcaagcttctgacatcttaatcaataagcatcaaatctacgtacaagctatcaacttccctacggttgctcgcggtaccgaaagattgagaattaccccaacgccaggtcacaccaacgatttatctgacatcttaatcaatgcagttgatgatgtgttcaatgagctacagttaccacgtgtcagagactgggaaagccaaggtggcttattgggtgttggagagagcggatttgtggaagagtctaacttatggacatcaagccaactatctttaactaatgacgacttgaaccctaatgttagagaccccatcgttaaacaactagaggtttctagtggtatcaagcagtaa

SEQ ID NO: 25347 - DNA, 1767 bp, Saccharomyces cerevisiae
atggcaagaccaatcgatgttagtcagctgattgctggtataaacaagaaaaaaggactagatgaaaatacatcaggtaaaatcagcaagcctaggtttttgaataaacaagaaagatctaagcaagaacgtttgaaggagaacgaagagagtttgacgcctacgcaaagtgatagcgctaaggtggagattaaaaaggtaaactctagagatgacagttttttcaatgaaacaaatgataagaagagaaatccatcaaagcaaaatggctctaaatttcacttttcttggaatgaaagcgaagatactctgagcggatatgatcctatcgtttcaactagagctatagatttgctatggaagggaaagactcctaaaaatgctgcagaatcttcatatatggggaagcattggactgagaagtccttgcacgaaatgaatgagagagattggaggatactaaaagaagactacgctattgttacaaaaggtgggacagtagaaaatccattgagaaattgggaagagctcaatataataccaagggacttgttacgtgttattatacaggagctgcgatttccttcaccaactcctattcaaaggattactattccaaacgtttgcaatatgaaacaatatagagattttcttggtgttgcctctacaggttcgggtaagactttggcctttgtaataccgatactaatcaagatgagtaggtcacctccaaggccaccatctttgaagattattgatggccccaaagcgttaattttagctccaacaagggaattagtgcagcaaattcaaaaagaaacacaaaaagttacaaaaatatggtccaaagagagcaactatgactgcaaagtaatttctattgttggtggacactccttggaggaaatttcattttctctatcggagggttgtgacatcctggtggccactccaggacgtttaattgactctttagaaaatcacttacttgtgatgaaacaggtggagacattagtactagatgaagctgacaaaatgattgatttaggttttgaggaccaagtaacaaacattttaactaaagtcgatataaatgctgactctgctgtgaatagacaaaccctgatgtttaccgctacaatgacacccgttatagaaaaaattgcagcaggatacatgcaaaagcctgtttatgcaaccattggggttgagacgggttctgaacctttgattcaacaggttgtggaatatgcagataatgacgaagacaaattcaaaaagttgaagccaattgtcgctaaatatgatccaccaataataatttttatcaattacaaacaaactgctgattggttagcagaaaagtttcaaaaggaaaccaacatgaaggtgacgattttacatggttctaaatcgcaagagcaaagggaacattctttgcaattatttcgcaccaacaaagtccaaatcatgatcgcaacaaacgttgccgcaagaggattggatatccctaatgtttccttggtagtcaatttccagatttccaaaaaaatggatgactacatccatagaattggtagaacaggtcgtgcagcaaatgagggcactgctgtctcctttgttagtgccgctgaagatgaatcattgatacgtgaactttacaaatacgtcaggaaacatgatcccttgaatagcaatatcttttccgaagccgtaaagaacaaatataacgtcggcaaacagctcagtaatgagattatatattaa

SEQ ID NO: 25348 - DNA, 1182 bp, Saccharomyces cerevisiae
atgtctagtgtaccttataattcccaacttcctatatccaaccatctagagtacgatgaagatgaaaagaagagcagaggctcaaaactaggcctgaaatataaaatgatatactggaggaaaactttatgcagttcgctagcgagatggagaaagctaatactattaatatctttagctttgtttttattcatatggataagcgattccaccataagcagaaatccatctaccacaagttttcaaggccaaaatagtaacgataataagttgagtaatactggttctagcatcaactccaaaagatatgtaccaccatattctaagagatcaagatggtcgttttggaatcaagatcctaggattgtcattatattagcggcaaacgaaggtggtggtgtattgaggtggaaaaatgagcaagaatgggctatcgaaggcatatcaatagaaaataagaaggcctatgcgaagagacatggatatgcgttgactatcaaggatttgacaacgtccaaaagatactctcacgaatacagagagggttggcaaaaagtagatatattgagacagacgttcagggagtttcctaatgcagaatggttctggtggttggacctggatactatgataatggagccttctaaatcattagaagaacatattttcgacagattggaaactctggctgacagagaattgaaaagttttaatcccctaaacctaagagacgacataccctatgtcgattattcagaggaaatggagtttctaataacacaagattgtggaggcttcaatttgggctcatttctgataaaaaatagcgaatggtctaagctgcttctagatatgtggtgggaccccgttctgtatgaacaaaaacatatggtttgggaacatagagaacaagatgcgttagaggcattatatgaaaacgaaccgtggattcgttcgagaataggatttttgcccttaagaacgatcaatgcattcccaccgggagcatgctctgaatacagtggtgactcaagatacttttacagtgagaaagaccatgattttgttgtgaatatggccggatgcaattttggcagagattgctggggcgagatgcagtactacaccactttaatggaaaaactgaataggaaatggtacacgagatttttcttcccataa

SEQ ID NO: 25349 - DNA, 582 bp, Saccharomyces cerevisiae
atgacagagaaacacaaaactatggggaaatttaaggttattgtattggcaggtactgcaggtacaggaaaatcaaccattgcaggtgaactaatccatgaatttaaagatatatacccggatttgaaattcatcgaaggtgatgatttacacccgcctgccaacgtagaaaagatgacaagagggattccattaaatgacgacgaccgttgggactggttgaaaaaagttgccgtagaatctacaaaagctgcagcaagcactaaggagcatttgtcaattgttgcttgctcgagcttgaagaagaaatacagagatttgattaggcacacatgccctgaatcggagttccattttatctttttgtatgcaagtaaaatagaagttctgaaaaggctcaaaacaaggaagggtcatttcatgaaagctgatatgatggagtctcaattcagggatctggagttaccagacatcaacgacgaaactgactgtgacattgttcccttagatttcaaaacgttttatcaaattgaaaaagatgttatacaggtggtaaaaagtaaagttttgaatattgagtaa

SEQ ID NO: 25350 - DNA, 1976 bp, Saccharomyces cerevisiae
atgacatctgcattaagggttttggtatgcggagatcacccaaatctcattctgtacacatccaggtttcaacatgccaaaaatatagaattttatcttgtgaacaactcaaaaaatgccaactacgaggttagttcactattttatgggacggaacggtttcagattcaaaaccatttccaatcgctcctagatttagtagaccttaataatgaaaatggtggcttggtattcgacttgataataatgagtgcgtcttcactgcaagaaatcccgcaggtattgagagatataaaacctatgatgaataagacaacaaagatactatttgaaagtagcgggtttatatatttggagccattcatcaaggcttcagttgatctttcgctgtcaaatattttcagcattttcaccgattatgacataagacggttggacaatggctcatacaaacagttcacgactgcaaatgccaaatccttttctgtttcgatcggtcaaacgacatccgttcacgaaaacagctattcaagtgatattattcctattttgaatacatttcagaaattgttccaaaaactgtttcctagggacgttgtgactctttacgatcattctccctccgctttcttggcaaaagaatgggaactagctttgcctcaaatatgtttcgatccattattaataatattagaagagaagaatccatcaaccttggatgaccacgttttggccaaacctcttatttcaggtttactaggcgagagcttattaataataaaaaaaatgggtatagccatgaacaatccaaattttcaaaatgaacagactatattgaaacattggaagaataagtgcgaagacttacctgatgggccggcacttttatataatttcatccataaggcttcatctttgaatattgacttattgttattacagccgatattattagcagatgactttggcgtgaagacaccatatttagaatgtttgtttacaatgatgactcaatatcaattgttaaataaaggtgattctgaatggtttattagaaaggatgagaacacagcgttaactcgcgttgatgatttacaaaacagtatcgcacttaaagatggaaaaatcatgcagctgcaaaattcggaatcaaccctgaaaaatgagataaaagaacttcaaagtcaagttttgagcttaaaacaagaagtgtcctcaagtaaagcaaataatggacaagagttggaaattttaaagaagaaagtgcaaatgggagacaattcattatttgatcgcccaaatagtaatactaatggtatatctccctctgataacattgttgatgttgatttaaattacgaaaggagtgaccaaggtaataatagtagtggtaatgatagcagaagacaatcttttttcaactccacatctgatacaacattatccagagatgaaacctcgttgaaagagcgtgagttagaagtacgaatgaaggaattagaacttcaagagcgtgagttagagttacagagaaaagccctccagcaacaacaacaatatcaacagagaccgcctaagcaagtatactccggtccttctggtacaccaaccagcggcaataacaataataaaagttacaatccaaatagaaaatcttcctatagtcagcctcaacatgtggctatgatgaccagcagaggtctacatggtcctagcgctgcaagctctagccctgtcatttctgccaacaattttgttgatccagtttcttctgggacgccatatagcagcaatagttctcgatttagtcagcaaattccatcgcagcaatacatgcatactgttaagccaacgagtagaaaaaacagaagtagtgtcatgcctaatataggttacgtcccagggctaaccaataacgagtatggtagaaagtttaacggtaatggtatgaatggtacccaaagccgtctgaattc

SEQ ID NO: 25351 - DNA, 1548 bp, Saccharomyces cerevisiae
atgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaattctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 25352 - DNA, 2436 bp, Saccharomyces cerevisiae
atgttaagacaagctacaaaagcaccaatacaaaaatatttacagagaacgcaactattaaggcgaagtactccacgaatatacactattgtacagtgtaaaagatctatttgcagttttaatgcaagacctcgagtagccaataaacttctatcagatataaaaacaaatgcattaaatgaagtcgctatttcaacctgcgccctcaagagctcatatggattgcccaatttcaaaagaacgtacgtccaaatgaggatggatcccaatcagcaaccggaaaagccagctttagaacaatttggtacaaacttgacaaaattagcgcgcgacggtaaattagaccctgtcattggcagagacgaagaaatcgcaagagctattcaaattttatcaagaagaacaaaaaataatccatgtttgatcggtcgagctggtgtcggtaaaaccgcccttattgatgggttagctcaaagaattgttgctggggaggtccctgactcgttgaaagataaagatctagtagctttggatttgggatctttgattgctggcgccaaatatagaggtgaattcgaagaacgtttaaaaaaggttttagaagaaattgacaaggccaatggtaaggttattgttttcattgatgaagttcatatgctgcttggcttaggtaaaactgatggtagtatggatgcttctaacatcttaaagccaaaactggcccgtgggctacgttgtatctctgcaaccactcttgatgaattcaaaatcattgaaaaagatccggctttatcgagaaggtttcagcctatcttattgaatgagccgagcgtctccgatacgatttctatactaagaggtttaaaagaaaggtacgaggttcatcatggtgtaaggatcactgatacagctttagtgtctgctgcagttctttcaaatcgttatataacagacaggtttctacctgataaagccattgatctagttgacgaagcttgtgctgtactacgtttacaacatgaatccaaaccggatgaaatacagaaactggatcgtgctattatgaaaatacaaatagaactggaatctttaaagaaagagaccgaccctgtttccgtggaaagaagagaagcgttggaaaaggacctagaaatgaaaaatgatgaattaaacagattaacaaaaatatgggacgctgaaagagctgaaattgaatctatcaaaaatgctaaggcaaatttggaacaagcaagaattgagttggaaaagtgtcagagagagggtgattacactaaagcatccgagttgcgatattccagaattcctgacttggagaagaaggtagctttaagcgagaagagtaaggacggagataaagtaaatttacttcatgattcagttacttctgacgatatttctaaggttgttgccaaaatgactggtattcctacagaaacggtgatgaaaggcgacaaggaccgcctactgtatatggaaaattctttaaaagaaagagtcgttggccaagacgaggccattgctgctatttctgatgctgtacgtcttcaaagggctggtttgaccagtgaaaagagacctattgccagctttatgttcttaggtcctactggtactggtaaaacagaattgaccaaggctttagctgaattcctatttgatgacgaatcaaatgtgattcgttttgacatgtcagaatttcaagagaagcatactgtctctcgtttaatcggtgcacctccaggttacgtcttaagcgaatctggtggccaattaactgaggctgtcagaagaaagccttatgctgtcgttttatttgatgaatttgaaaaagcgcaccccgatgtttccaaactactgttgcaagtgttggatgaaggtaagctgaccgattccctaggccatcatgttgatttccgtaacacgatcattgtgatgacctcaaacattggacaagatattttattaaacgacacaaagttgggtgatgatggtaagattgacaccgcaaccaagaataaagttatcgaagcaatgaaaagatcctatccacctgagttcatcaatcgtattgatgatattctagttttcaataggctatccaagaaagttttgaggtcaattgttgatattagaattgcagaaattcaagatcgtttggccgaaaaaagaatgaaaattgatttaactgatgaagcgaaggattggctaactgacaaaggctacgatcaattatatggtgcaaggccattgaatagattaattcatagacagattttgaactccatggcaactttcttattaaaaggtcaaattagaaacggcgaaactgttagagtggtggttaaagatactaagcttgtcgtgctaccaaatcatgaagaaggcgaagttgttgaagaggaagctgaaaagtaa

SEQ ID NO: 25353 - DNA, 1293 bp, Saccharomyces cerevisiae
atgggaatacctggcttactgcctcaattaaagagaattcaaaaacaggtgtccctgaaaaaatacatgtatcaaacattagccattgatggttatgcgtggctacacagggcttcttgtgcgtgtgcttttgaacttgtgatgaataagccaacaaacaaatacttgcaatttttcattaaaaggctgcaactcctaaaacgccttaagatcaagccatatatagtttttgatggtgattccctttttgtgaaaaatcatacagaaactagaagaagaaagaaaaggttagaaaacgaaatgattgcaaagaaattgtggtcagccggcaacagatataatgcaatggaatattttcaaaaaagtgttgacatcacaccagaaatggcgaaatgtattattgattattgcaaactacattcaattccctacattgttgcaccatttgaagcagatccgcaaatggtttacttggaaaaaatgggccttatacagggtatcatatcagaagattctgatttgttggtctttggttgtaaaacactcataacaaagttaaatgatcagggaaaagctttagaaatctcaaaagacgatttttcagctttacctgaaaatttccctctaggagaattaagtgaacaacaatttcgtaatctagtttgtttagcagggtgtgattacactagcggaatttggaaagtgggtgtagtcactgctatgaagattgtgaaacggtattctgaaatgaaagacatccttatacaaatagaacggacagaaaaactttgtttcagtaaggcgttcaagcagcaggttgagttcgccaattatgcgtttcaataccaaagagtgttttgtcctctatcaaatcagattacaactttaaataatattcctaaagcagtcacaaattcccacgctgaaattattaaaattatgaaatgtattggttccgttgttgaaaggggatcaggggtacgaaaagatgtcattaatactaaaaatattgatcacaaagttcatgaaatgatagcaaaaggggagttgcaccctgtagatatggcttctaaacttattaatagagaaagaaaattaaaagcaagaaagctgtttaaagtaggtctacttgggggtgaatccaactcattcaataagaaagtggagcaaccgctagtggatacgcaggacgtgttatcggagagggagaattctcttgataacaaaaacgcatcctctatttatatgacctcaccagcagcgatctcaggcaccgtaccatcaattttctaa

SEQ ID NO: 25354 - DNA, 2019 bp, Saccharomyces cerevisiae
atggtgaacgaattagagaatgtgccacgggcgtcgaccttgacgaatgaagagcaaacggttgatcctagcaataacgactcacaggaagatattagtctgggtgattctaacgaaattacttcgttggcatcattaaaggctatccgatcaggaaatgaagaggaaagcgggaacgagcaggtgaatcataatgatgaggccgaagaagatcctctgttaactcgctaccataccgcttgccaaagaggtgatctagcgactgtcaaagaaatgatacatggaaagttgctcgaagttaataacgacggtgactctacggaacatatcactggtttgcattgggcaagtattaataacagactttctgtagtggattttctagtttcacaaggcgctgatgtcaatgcaagggctggtgctttgcatgccacaccattacattgggctgcaaggtatgggtacgtgtacattgtcgattttttgcttaagcatggagctgatcccaccatgaccgatgaccaaggtttcaatctactacacttatctgtgaacagctcaaatataatgctagttctatacgttttattcaacgttgtcagcaaaggtcttttagatatagattgccgagacccaaagggcagaacttcactactatgggctgcttaccagggagattccctaactgtagcagaattgttgaaatttggtgccagcataaagatcgcagatacagaaggattcaccccactgcactggggcactgtaaaagggcaaccacatgtactaaaatacttgattcaagatggtgcagattttttccaaaaaacggataccggaaaagattgctttgctattgctcaagaaatgaacactgtgtactcacttagagaggctctaacacattctggattcgactaccatggttatcccattaaaaaatggttcaaaaaaagtcaacatgctaagctcgttacattcataacgccatttctatttctaggaatcgcatttgctcttttctctcatattaaccctttgtttgtaatcattgtcctttttttattggccattgccactaacaaaggcttgaacaaattcgttctgccgtcatatggacgaatgggtgtccacaacgttaccttgttaaggtcacctttgttatccggtgttttttttggcactttactttgggtgactatcgtttggtttttcaaagttatgcctcgaacattttctgatgaacaatatactaacatcctaatgctggtaatacttgtttctgtattttacctttttgggcagcttgttattatggacccaggatgtttgccagaagaaactgatcatgagaacgtgcgacaaacaatctcgaacttgctcgaaatcggtaaatttgatacgaagaacttttgtatcgaaacttggattagaaaacctctaagaagcaaattttcgcccttaaacaatgctgtggttgcaagatttgatcattactgcccttggatctttaatgatgtcggactcaaaaatcacaaagcatttatattttttattacattaatggaaagtggtattttcacatttcttgcactttgcctggaatattttgatgaacttgaagatgcacacgaagatacatcccagaaaaatggcaaatgtttcatcctaggcgcttcagatctctgttcgggattaatatatgatagatttgtctttctgatattattatgggctttactccaatctatttgggttgcaagtttgatcttcgtccaagcctttcaaatatgtaaaggaatgaccaatacagaattcaatgttttgatgaaagagagtaagtccattggccccgatgggttatctttcaatgaaaacttcaatactactccagaaggatttgcgccgtcgattgatccgggtgaggagagtaatgatactgtactagcaccagtcccaggctcaacgataaggaaaccacgcacttgttttggcgtttgttacgcggtgactggtatg

SEQ ID NO: 25355 - DNA, 3015 bp, Saccharomyces cerevisiae
atgagagaagtgatacttgctgtacatggaatgacatgcagcgcctgtactaatacaatcaatacgcagttacgagctttaaagggtgtaacaaaatgtgatattagtttagtgactaatgagtgccaggtgacatacgataacgaggttaccgccgattctattaaggaaattatagaggattgtggatttgactgtgagatactaagagattctgaaattacagccataagtacgaaggaaggactactgagtgtacaaggtatgacctgtgggtcttgtgtttctacagtcaccaaacaagtggaaggcattgagggtgttgaatcggtagtcgtttccttggtaacggaagagtgccatgttatttatgaaccgtccaagacaacgctagaaaccgccagagaaatgattgaagactgtggatttgactcaaatattattatggatggcaacgggaatgcagacatgaccgaaaaaacggtgatcttgaaagtaactaaggctttcgaggacgaatccccactcatactttcttcagtaagcgaaaggtttcaatttttgttagacctaggtgtaaaatcgatagaaatttctgatgatatgcacacactcaccataaaatactgttgtaacgaactcggcattagagatttattgaggcaccttgagaggaccggatataaattcactgtattttccaatttagataatactacccagttaaggcttctctctaaagaggacgagataagattctggaaaaaaaacagcataaaatccacccttttggctataatatgtatgctattgtatatgattgtccctatgatgtggccaacaattgttcaggaccgcatattcccttacaaagaaacctcctttgttagaggtctgttctacagagatattttgggtgtaatattggcaagctatattcagttcagcgttggtttttacttttacaaggcagcatgggcatctttaaagcacggttcaggaaccatggatacactagtttgtgtttccactacttgtgcatacacattttctgtgttttctttagttcacaatatgttccatccctcaagtactggcaaactcccaaggatcgttttcgacacatcaatcatgatcatttcatatatttccatcgggaaatatttggaaactttagctaaatcacaaacatcaaccgcactttctaaattaattcagctcactccatcggtgtgttcaattatatctgacgtggagcggaatgaaaccaaggaaattcccatagaattattgcaagtgaacgatatagtggagattaaaccagggatgaaaattcctgctgatggcatcataacaagaggtgaatctgaaattgacgagtcgttaatgacaggcgaatccattttggtgcccaagaaaactggttttccggttattgctggttctgttaatggacctggacatttctacttcagaactactaccgttggggaggaaactaaattagcaaatattatcaaggtaatgaaagaagcacaattgagtaaagctcccattcaggggtatgcagattatttagcctctatttttgttccggggatcctaattttggcagtattgactttctttatttggtgttttattttaaacatctcggctaatcctcccgtcgctttcaccgcaaatactaaggctgataatttttttatttgcttacaaactgctacttctgttgtcatcgtcgcatgcccatgtgcattgggacttgccacgccgactgctataatggtgggtacaggggttggagctcagaatggtgtcttaataaagggcggagaagtattggaaaaattcaatagtattactacttttgtttttgataaaacaggtaccttaactacaggttttatggttgtgaaaaagttccttaaagattcaaattgggttggaaacgtggatgaagacgaagttctcgcctgtataaaagcaacggaatccattagtgaccatccagtttcgaaagcaattatacgttattgtgatggtttgaactgtaataaggctttaaatgccgttgttttagaaagcgaatacgtgcttggaaagggaatagtctcaaagtgtcaagttaatggaaatacttatgatatttgtattgggaacgaggcgctgattttggaggatgcattaaaaaaatccggatttattaacagtaatgtcgaccaaggaaacactgtatcatacgtatcagtaaacgggcatgtgtttggcttgttcgagattaatgatgaagttaaacatgattcttacgcaacagttcagtatctacaaagaaatggatatgaaacgtatatgattactggcgataataactcagcagcaaaaagagtcgctagagaagtaggtataagcttcgaaaatgtttacagcgatgtgtcacccacaggcaaatgtgatctcgtgaaaaaaattcaagataaagaaggtaataacaaggttgctgttgttggcgatggcattaacgacgctcccgctttagcactgagtgatctaggtattgccatttcaacaggtacggagattgctattgaagcagctgatattgttatactgtgcggtaatgatctgaatactaatagtttgagaggactggccaacgccatcgatatttcactaaaaacgttcaaaagaataaagctgaatttgttctgggcactttgctataatatattcatgattccgattgctatgggtgtgctcattccttggggcataactcttcctccaatgctcgccggtttagcgatggcattcagctcggtcagtgtcgttctaagttcattgatgttgaagaagtggactccaccggatattgaatcacatgggatttcagatttcaagtccaaattttcgattgggaatttttggtcaaggcttttttctacgcgggctattgcaggtgagcaagacatagaatcacaggccggactaatgtcaaacgaagaagtcttgtaa

SEQ ID NO: 25356 - DNA, 825 bp, Saccharomyces cerevisiae
atgcaggttaaatcgattaaaatgagatgggagtctggtggtgttaattactgctatctattgtccgacagtaaaaataaaaaatcgtggctaatcgatccagcagagcctcctgaggttctgccagagttgactgaggatgagaaaataagtgttgaagcaattgttaatacacatcaccattatgaccatgcagatggtaacgctgatatcttgaagtatttaaaagagaaaaatccaacttcaaaagttgaggttataggagggtcaaaggactgcccaaaggttacgataattccggagaatttgaaaaagttacacctaggtgacttagagattacttgtattaggacgccctgccataccagagactctatctgttattatgtgaaagatccaacaacagatgagcgctgcatttttactggcgatacactatttaccgctggttgcggtaggttttttgagggtacaggcgaagaaatggatatagctctgaacaattctatcttagaaactgtgggcaggcagaactggagtaaaacgagggtttatccaggacacgaatacacaagtgataatgtaaagtttgttcgtaagatttacccgcaagttggtgaaaataaagcattggatgagttagaacaattctgctccaagcatgaagtcacagcagggcggttcactttgaaagatgaggtagaatttaatccattcatgagattagaagatccaaaggtccaaaaagctgccggagatacgaataattcatgggacagagctcaaattatggataaattgagagctatgaaaaaccgtatgtag

SEQ ID NO: 25357 - DNA, 870 bp, Saccharomyces cerevisiae
atgaacagagtttcgtttattaaaacgcctttcaacataggggcgaaatggagattagaagatgtctttttgctcattatcatgatacttcttaactacccagtgtattaccaacaaccgttcgaacgtcagttttacattaacgatctcactatatcgcatccttatgcgacaactgaacgtgtaaataacaacatgttgtttgtttatagttttgtcgtgccatctttaaccatattgataattggttccattttggccgatagaagacatttgatttttattttgtacacatctctccttggtttatcactcgcttggttcagtacgagtttctttacaaacttcatcaagaattggattggaagactaagaccagattttctagatcgttgccaacctgttgaaggcttgccattggacactttatttactgcaaaagatgtgtgtacgactaagaatcacgaacgtctgttggatgggtttaggacaactccgtcaggtcattcaagtgaaagctttgcaggactgggttatttgtacttctggctatgtgggcaacttttgactgaatcaccgttgatgcctttatggagaaaaatggtggcctttctaccactgttaggagctgcactaattgctctatccagaactcaagattacagacatcatttcgtcgatgtaattttagggtctatgttgggttatataatggcacactttttctacagaagaatcttcccacccattgatgatcctcttccgttcaaaccattgatggacgattcagatgtcaccctggaggaagcagtcacccatcagaggatcccggatgaggaattacatcctttgtccgatgaaggtatgtaa

SEQ ID NO: 25358 - DNA, 2628 bp, Saccharomyces cerevisiae
atgtcaaacttttttagagatagttcaatgggattcaagcctcgaccaaacatcttcgctaagctgagagtcagagatgtagattcagattcttccgctaatactgttgtcgagaattcatccaactgtttagacgtgggttcttctatagagggagatgataccttcaaaaaaccccacaaaacttctaccgaacaagaactgattacaagtatgagccttagtcagagaaaccatggttattctgatgatatggaaataggttcaccaaaaaaaacaacatcaacagaccaatacaacagaattttaaaaaatgatgttgccgcaattgaaaatgatactgatgaagattttgaaattacagaagtaagagaagtgagtgaaggagtagcaaaagaaacgaaagaaagtcatggggatcctaacgattctgagacaactctcaaggatagtaaaatgcatgaatatactatgacaaatggaaaggctcctttgcacacgtccatcaataattctagtacatcttcaaatgatgtcctgttagaagccttcacaaacactcaaagaatatgttcaaatttaaagcaagagctacaaaagcagcaacaggataatgcaaagttgaaagttcgactacagtcgtatgcttccaattctgataagatcaatgaaaaagtcggaaaatataaatcttgtttagaaactcttcaagaaaggattgcaacgttgacgagccataagaataatcaagaaactaaattgaaagatttaagacaaaaccaccaactatatcagagaaggataagcggatttaagacaagtattgaaaacttgaacaaaacaataaatgatttagggaagaacaaaaaggaggcggatgcagaattaatgaaaaaaggtaaagagattgaatacctgaaaagagaactagatgattgttcaggtcagttgagcgaagaaaaaatcaaaaacagttccttaatacaggaaatgggaaaaaatagagaagaaatgattaaatcaattgagaatttcttttcagaagataaagcacaccatttactgcaatttaacaaattcgaagaaagagttcatgatttgtttgaaaaaaaattacaaaagcacttcgatgtggcaaaagatacccttaacgtaggcttgaggaacaccactgtagagttgagtagtaatacagagaccatgctaaagcagcaatatgaagatatcaaagaaaatcttgaacaaaaaatgtcatccagtaaggatgaaatggcaaaaacaataaatgagctgagtgtaacgcaaaaaggacttataatgggagtacaagaagaactattaacgtcatcagggaatattcaaactgctttggtaagtgaaatgaataacacaaggcaagagcttcttgatgatgcgtctcaaacagccaaaaattacgcgagtttggaaaacttggtgaaggcatataaggcagaaatagttcagtcgaatgagtatgaagaaaggataaaacatttggagagtgaaaggtcaactttgtcttcacaaaaaaatcagattattagctctcttggtactaaagaagcacaatatgaagatttggtcaaaaagttggaggcgaagaatatcgaaatttcacaaatttctggcaaagaacaaagtttaactgaaaaaaatgaaaacctttctaatgaactgaaaaaagtccaggatcaactagaaaaactcaacaatttgaacatcacaacaaaatcaaattacgaaaataaaatatcttctcagaatgaaattgtgaaggctttagtttccgaaaacgacactctgaagcaaagaattcaacagctagtagaaatcaaagaaaatgaacagaaggatcatacaaccaaactggaggctttccaaaagaacaatgagcagctacaaaagctaaacgtcgaagtagtacaactgaaggctcatgaattggagcttgaagagcagaataggcacttaaaaaattgtttagaaaaaaaggaaactggtgttgaagaatcactaagcgatgtaaaaaccctaaaacagcaagtgatagttctgaaatcggagaagcaagatataacagctgaaaagttagaacttcaagataacctcgaaagtttggaagaagtcaccaaaaatttacagcaaaaggtgcaatcgcaaaagagggaattagaacagaagattaaagagctagaagagataaaaaaccataaacggaacgagcctagtaaaaaaggtacacaaaattttactaaaccatcagattcacccaaaaaaaatgctacgacgtccaacttatttcctaataactctgctgccattcactctcctatgaaaaagtgtcctaaggtggatcatataagtaagtcaagaattaattcatccaaagaaacatccaaatttaacgatgagttcgatctttcttcatcatcaaatgacgacctagagttaaccaacccttccccaatccaaattaaaccagtgagaggaaaaatcaagaagggttcaaattgcatgaaacctccaatttcttcaagaaaaaaattactactagtagaagacgaagaccagtcattaaaaataagcaagaaaaggagaaggaaatag

SEQ ID NO: 25359 - DNA, 3753 bp, Saccharomyces cerevisiae
atgtctaaaaatagcaacgttaacaacaatagatcccaagagccaaataacatgtttgtgcaaaccacaggaggtggtaaaaacgccccaaagcagattcatgttgcacacagacgttcccaaagtgagttgacaaatttgatgattgaacaattcactttgcagaagcagttggagcaagttcaagcacagcagcaacagttgatggctcagcaacagcaattggcacaacagacaggacaatacctgtcaggaaattctggctctaacaatcatttcacgcctcaaccgcctcaccctcattacaactcaaacggtaattcacctggtatgagtgcaggtggcagcagaagtagaactcactccaggaacaactccggatattatcataattcatatgataacaataacaatagcaataatcctgggtctaactcacacagaaagacgagttcacaatccagcatatatggccattccagaagacattctttaggtctaaatgaagcgaaaaaggctgctgcggaagaacaagctaaaagaatatctgggggtgaagcaggcgtaactgtgaagatagattctgttcaagctgatagtggctcaaattctactacagaacaatctgattttaaatttccaccaccaccaaatgctcatcagggccatcgtcgcgcaacttcaaacctatcacctccctctttcaaatttcctccaaactctcacggggataatgacgatgaattcatagcaacctcttcaacgcaccgccgttcaaagacaagaaacaatgaatattctccaggcattaattccaactggagaaaccaatcacagcaacctcaacagcagctttctccattccgccacagaggatctaattcaagggattacaattccttcaataccttagaacctcctgcgatatttcagcagggacacaaacatcgtgcctctaattcatcagttcatagtttcagttcacaaggtaataataacggaggtggacgtaagtccctatttgcaccctaccttccccaagccaacattccagagctaatccaagaagggagactagtagctggtatattaagagttaataaaaagaatagatcggatgcctgggtctctacagatggcgctcttgatgcggatatttacatttgcggctccaaagatcgtaatagagcacttgaaggtgatttagtcgcggtagaactattagttgtggacgatgtttgggagtccaagaaagaaaaggaagaaaagaagaggagaaaggatgcctctatgcaacacgatctaattcctttgaacagtagtgacgattaccacaacgatgcatctgttactgctgcaacaagcaacaattttctatcttctccctcctcgtctgattcgctaagcaaggatgatttatccgtcagaagaaagaggtcatctactatcaataatgatagtgattccttatcatctcctaccaaatcaggagtaaggagaagaagttcattgaaacaacgtccaactcaaaagaaaaatgacgatgttgaagttgaaggtcagtcattgttattagttgaagaagaagaaatcaacgataaatataagccactttacgcaggccatgtcgttgctgttttggaccgtatccctggtcagttatttagcggtacattaggtttgttgagaccatcccaacaagctaatagcgacaataacaaaccaccacaaagcccaaaaattgcttggttcaagcctactgataagaaggtgccattaattgcaattcctacagaattagctccaaaggactttgttgaaaacgctgataaatactccgaaaagttattcgttgcctctattaaacgttggccaatcacatctttgcatccatttggtattttagtttccgaacttggagatattcacgatcctgatactgaaattgattccattttaagggataacaattttctttcgaatgaatatttggatcaaaaaaatccgcaaaaagaaaaaccaagttttcagccgctaccattaacggctgaaagtctagaatataggaggaattttacggacactaatgagtacaatatctttgcaatttccgagcttggatgggtgtctgaatttgccttacatgtcaggaataacggaaatggtaccctagagctgggttgtcatgttgttgatgtgaccagccatattgaagaaggctcctctgttgataggcgtgcgagaaagaggtcctctgcggtgttcatgccacaaaaacttgtcaatttattaccacaatcgttcaacgacgaactgtcgttggcccctggcaaggaatcagccacgctgtcggttgtttacactctagactcatctactttaaggattaaatctacttgggtaggcgaatctacaatttccccctcaaacatcttgtctttagaacaattagacgaaaaattatctactggaagtcccactagctacctctctactgtacaggaaattgctagatcattttatgctagaagaataaatgatccagaagctacattacttcccaccctgtccttattggaaagcttggatgacgaaaaagttaaggttgacttgaacatcctggatagaactttaggctttgttgtaattaatgagattaaaagaaaggtcaactccactgttgcagagaaaatttacaccaaacttggtgatctagctcttttgagaaggcagatgcaacccattgcaaccaagatggcgtcatttagaaagaaaattcaaaattttggttacaattttgataccaatacggcggatgaattaatcaaaggggtgctaaaaattaaagatgacgatgttagagtcggaattgaaattttactgtttaaaaccatgccaagagctagatactttattgctggcaaagtagacccggaccaatatgggcattatgccttgaacctacctatctacacacatttcacagcgccaatgagaagatacgctgatcatgtcgttcataggcaattaaaggccgttatccacgatactccatacaccgaagatatggaagctttgaagattacctccgaatattgtaattttaaaaaggactgtgcttatcaagcacaggaacaagcaattcatctattgttgtgtaaaacaatcaacgacatgggaaatactacaggacaattattaacaatggctactgtcttacaagtttacgagtcctcctttgatgtatttattccagaatttggtattgaaaagagagttcatggagatcaactacctttgatcaaagctgagtttgatggtaccaatcgtgtcttggaattgcattggcagcccggcgtagatagtgcaacttttataccagcagatgaaaaaaatccaaaatcctatagaaattccattaagaacaaattcagatccacagccgctgagattgcgaatattgaactagataaagaagcggaatctgaaccattgatcagcgatccattgagtaaggaactcagcgatttgcatctaacagtaccaaatttaaggctaccatctgcaagcgacaacaagcaaaatgctttagaaaaattcatttctactactgaaaccagaattgaaaatgataactatatacaagaaatacatgaattgcaaaagattcctattctattgagagctgaggtggggatggctttgccatgtttaaccgtccgtgcattaaatccattcatgaagagggtataa

SEQ ID NO: 25360 - DNA, 1050 bp, Saccharomyces cerevisiae
atgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgttttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctcttttcaacaatcctgttgagggcttcttgttagatactttgggaaccggtattgccatgacgttaactcatttgactcacagagagcaaatcattctttttacctttgccaccatgaagactgtcgatgaccactgtgggtatgctttgccacttgacccattccaatggcttttccctaataacgctgtctatcacgatatccaccaccagcaatttggtatcaagacgaactttgctcaaccatttttcactttctgggacaatttgttccaaactaactttaaagggtttgaagaatatcaaaagaagcaaagacgtgtcaccatcgacaagtacaaagagtttttgcaagagagagaattggaaaagaaggagaaactcaaaaacttcaaagctatgaatgctgctgaaaatgaagtaaagaaagagaaataa

SEQ ID NO: 25361 - DNA, 639 bp, Saccharomyces cerevisiae
atgtttaatagagtctttaccaggtcatttgcatcaagcttaagagctgctgcttccaaagctgctgctcccccaccggtgagattgttcggtgttgagggcacttacgcaacagctttatatcaggccgctgcaaagaactcctctattgatgctgcctttcaatctttgcaaaaagttgaaagcacagtcaaaaagaatccaaaattaggtcacttattactgaatcctgcattgtcattgaaggacagaaattctgtcattgatgccatcgtggagactcacaagaatttggatggttatgtcgttaacctattgaaggttctttccgaaaataacagactgggatgttttgaaaaaattgcgtctgactttggcgttttaaacgatgctcacaacgggttacttaaaggtacagtgactagtgctgaaccattggatcctaaatctttcaagaggattgaaaaagctttgagcgcctccaaattggtggggcaaggtaaatctttgaagctggaaaacgtggttaagccagagattaagggtggtttgattgtagaacttggtgacaagactgttgacttaagcatttctacaaagattcaaaaactgaataaggtcttagaggacagcatttaa

SEQ ID NO: 25362 - DNA, 1152 bp, Saccharomyces cerevisiae
atgactagtgcaagtattaccaatactggaaacgaaaccatgaaccttccacagatgcggtcgatttggctggatgaagatgaagaagctgaaaaactctacggtctgcaggcccagcaattcatgggatctgatgatgaagaaaacctaggcattactttcatcaacagcgataaacctgtgctgagtaacaagaaaaacattgagttgcctccactttcaccaaattcacatccgtcttgccaccacaggagaagtaattctaactctgcaaagtctaaagaatcatcgtcatcatcgtccagcgccaacaagacaaatcacaaaaaggttttccttaagcttaatttgttgaagaaaaagttgcttggtgcccaaccggacataagaggtaaaggtatctccacaccatttgattttcaacatatttcacatgctgacactagaaatggattccaagatgagcaattgcaggaaccttcatcgctgtccacagagattaaggacgactatacctcctcctcaagcaagcgggattcgaaatcactaaataaagcttttgtcactgaaaggatccctgctaatcgtgaaagcaaactcatttcaagatcgcacgaaaataagacatcaagactatcagtcgcgcgttcgatctcagtaacgtcctccaattactctaaaaacacacaaggaaacaatcattccattaatgggagagtcgtatctacgtcaactatggctacatctatttttgagtattccccaaacgcatctccaaaacaatttaaaaataagtcacacgctctgggtcatagatacactaattccacggattctagtgagtcttcgctggattttttgaagaactacaacttccccacactacttgaagataagcctattttagacttcttgcctcgttctcagaggtcaagcgcttatcgtagccttttagagaccccaaactcaaataaggactcagcaaaagccttctttccttcacgccaaagccctcttcccaagagaagaaactctatagctacgccttctccacaatctaaattttcctactctgactcccctgtaaaccatagaaaatctttcgatgatgttctttattctttcaaccagctcgagcccctgcaaacttaa

SEQ ID NO: 25363 - DNA, 3189 bp, Saccharomyces cerevisiae
atgtctgagaacaccacagccccttctgataacataaccaatgaacagagacttccgtctggacccaaagatgacgtagatacgttagcacttaccagtgctcaaaatcaagctaatagtttgaggaagctagatacagatgcgaacgctaaagctttgccatccatcacagacataccagtcagtgatgattctgatataaaacgacaagttggctctggttttggttcaaatccgcttcatataaaagattccgaggcctttccacattcatctattgaagccctaaaagagggtatggacaaagtcacaaaacaatgcaacgatttgaagacggctttgctttccaaagacacttccctcactgattctgtgcaggatttgtttaactcattaaaagttttatcacacaaccaatcagttttggaaaataagctggatgatgtcatgaagaatcaagtaaatactgacatattggtcaataatttgaatgaacgattgaacaaattatcgacaatgttgcaaaatacttcgaaagtaaatcactctaaccttctcatagaaaattcatccaacaataccagttcacagcataatacctcttcttctcgaaggggacctggcaggccaagaaaagatgcctcgacctccacaatgaataagttagtgtcaaacgcagcctcggtcaatctcaaaagtgcatccaatcagggtgctcctttctcaccagtaaatattactttaccgactgccgtagtacaaacgtctaaatccaaaaggtattttgtggaaccatcaacgaaacaagagtcgcttttattatctgccccttcatcatcaagagatgatgctgatatgtccttgacttccgtaccgcaaagaacgaacaatgaaaatggtaaagagcgaccatccactgctaattctagctccatcacaccaacacctgttacgccgaacaacttaattcaaatcaaaagaaaaagaggcaggcccccaaaaaagagaacagtggaaacaatgatatccaattccacggatacgatagataagtcagatgcatctaatcggattaaaaacgagattccaataaattccttgcttccatcttccaaatttcatcaaataccatcatctccatccaatcctgtgtcacaaccggctccggttcggacttcaaggtcagccacacaagaaatagacattaaaagtttagaactggcctctctaatttcaactaatggtgatccaaacgcagaggattcgaatactactgatactgttcataataacgtggaaggaaaggtaaatgttgaagaaaataaaaccgagaaggagaaaataataaccatcaaatcatccagcgaaaatagtggtaataatacgaccaataataataatactgacaacgtcattaaattttcagctaattcagatatcaatagtgatattcgccgattaatggttaacgatcagttttcattaagttatgacgccagcggtaatattacggtcaaattaccacccgtttcctctccagcagcagcaacagctgccgctgctgcggcggttacgtcagagatgaatagacaacaaagagaattagataaaagacgtgattcaagggagaaaatgcttgttaatatgaaatataacgatcgcgataaagcaaagtcatttatggagtctaataagaaactcttaaaagcaatgaaagaagaagagaggaggaaaagaatgacttcgataatacatgataatcacttgaacttaaatttgaatgagatctccacccgttcaaagataaaaagtgcagaaaaaccaacaactaaaggttcttcaatgtcgccaaaaccaagatcggcctccatcagcggcatttcagaccaccaacaggaaggatatcaaccattagagcaagaaaaactcgtcgatattgacaatgagggctcaaacgcaaacagcgactctctcaagatgggtctaaccatatccgctgccgatacggttcacaaagttggaatacagtccatgctaaattctggggaagaggcaattaccaaggagaatgcagaatatgaaagaaagaccccgggagatgaagaaactaccacgttcgttccattagaaaactcacaaccttcggacacgataaggaaaagaacagcaggcgatgacggtgcattggatcaaacagagaatacgagcatatcaccaaagaagagacgcacagaagatcatacaaaaggtgaagaagatgagggagaaaggggtgttggtaatagcggaacgctggccaccgtggagaatgtctcaggagacatctccgcagatttatccaaaggtacttcatctatccataacgatactgagtctgctaacgatagtagcaatggcaacggaaacctcggtttgggtacagagtcacgcaatacattgttaacggcaactcccattgaattaatctgccgggaaggcttcttctaccggagagatattccggacgttcccattaccacaggagcgtacctggaatttaaattcaaggcgaaagaagaggaattgatcaactctagcatcaatgaggaggattatgctgctaaatcaaagcatgaaaaaatgaatgcgcatttcttcaagcctgatattcaagaagagacggaacttgcctttgaaattttgagcaagacaacgctgacagagaaatacgttaacagtttggagtacttcttgatggaattcaggtgggagaataaactagttggtctaggcttaaaacttcgggaatccaaaagaacctggcaaaggagaaaggcgttatttgcccttttcgaattttggagagaccaatcaagagacaaaagaagattccacaactacaccatcctgcatgcggtgaaagagatggaaaactacagaatatttattaatcgatccgtttcatggttctacaaccatattaccctgctaaaaatgatcctctacgacctctgcgacaatgtgaccactcaatggagagagtggatgtttccccataacgaaacactgccggcattgggtcaggacggcattaacgaagacaatctgaatgaaaccatcgacaacatgttaatttttgacttccttgatgacggttcagaaaacaaccaggtcaaatattccagaatcataccgccagatatccgttaa

SEQ ID NO: 25364 - DNA, 1929 bp, Saccharomyces cerevisiae
atgtcacattccggagctgccatttttgagaaagtttctgggataattgccataaatgaggatgtttcacccgcagaattgacatggaggtctacggacggtgacaaggttcacacagttgtcttatccactattgacaagttacaagctacccctgcttccagtgaaaaaatgatgttgaggctaatcgggaaagtggatgagtcaaaaaagagaaaagacaacgaaggaaatgaggttgtgcccaaaccgcaacgtcatatgttttcgtttaacaatagaacagttatggataatatcaagatgacccttcaacaaatcatctcacggtataaagatgcagatatctacgaagaaaagagaagaagagaggagtctgcgcaacacacagaaacaccaatgagctcttcttctgttactgcagggactcccacaccacatctcgatacaccacaattgaataatggggctccgttgattaatacagccaaactagatgattctctctctaaagaaaaattgttgaccaatttaaagctacagcaatctttactgaaaggaaacaaagttctaatgaaggtttttcaggaaacagtcattaacgccggtttgcctccatctgaattttggtcaactagaattccgttattgagggcttttgccttatctacttctcaaaaagttgggccttacaacgttttgtcaactatcaagccggtggcttcatcggaaaacaaagtcaatgttaatttgtcaagagaaaaaattttgaatatttttgagaactatccaattgtaaagaaagcttacactgataatgtgcccaaaaatttcaaagaaccagagttctgggcaaggttcttctcttcgaagttattcagaaaattaaggggtgaaaagatcatgcaaaatgatagaggtgacgtaatcattgacaggtacttgacattggatcaagagttcgacagaaaagatgatgacatgctattgcatcctgtgaaaaaaattatagatttagatggtaacatacaggacgacccagttgtacgaggcaacaggcccgacttcactatgcagccaggtgtggatattaatggtaatagcgatggtaccgtggacatcttaaagggtatgaatagattgagtgaaaaaatgattatggctttgaagaatgagtattcaaggacaaatctacagaacaaatctaatattacaaacgatgaggaagatgaagataatgatgaaagaaatgaactgaaaatcgatgacttaaacgaaagctacaagacaaactatgcaatcatacatctgaaaaggaacgcacatgaaaagacaaccgacaacgatgcgaaaagctcggcagactcgataaagaatgcagatttgaaggtttctaatcaacaaatgttacaacagttgtcattggtcatggataatttaattaataagctagacttgaaccaagtagttcctaacaacgaagtcagcaacaagatcaataaaagagtcataactgcaatcaagattaacgccaaacaggctaagcataacaatgttaattcagcactcggctcttttgtcgacaacacttctcaagcaaatgaattagaggtgaaaagtaccctaccaatagacctattagaaagttgtagaatgctacacacaacgtgctgtgaatttctaaagcacttttatattcattttcagagcggtgaacaaaagcaagccagtaccgtcaaaaaactttataatcatttgaaggactgtattgaaaagctgaatgagctatttcaagacgtccttaatggtgatggtgaatctatgtcaaacacatgtaccgcctatttgaagccagttttgaactccattactttggctactcataagtacgatgagtacttcaacgaatataacaacaattcgaactag

SEQ ID NO: 25365 - DNA, 585 bp, Saccharomyces cerevisiae
atggtgacttctaatgttgtcctagtgagtggtgagggtgaacgattcaccgtagacaagaaaatcgcggagagatccctgctattgaaaaactatctgaacgatatgcatgacagcaacctacaaaacaactcagattcagaatcagattcagactcggaaacgaaccacaaaagcaaagacaacaataacggtgacgacgacgatgaggatgacgacgagattgtgatgcccgtgcccaatgttcggtcttccgttttgcagaaggttatcgaatgggccgagcaccacagagactctaacttccctgacgaagatgacgacgattccagaaagagtgctcccgtggactcatgggacagagaattcctgaaagtggaccaagagatgctatacgaaattattctggcggcaaactacctcaacatcaagcccttgcttgacgctggctgcaaggtggttgctgaaatgatcaggggaaggtctcccgaggaaattagaagaacgtttaatatcgtcaacgacttcactccagaggaggaggctgccattaggcgtgaaaatgaatgggctgaagaccgttag

SEQ ID NO: 25366 - DNA, 1713 bp, Saccharomyces cerevisiae
atgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatccagaagaggtgccaactacgacgctgaagaaatgactcacgatgacaagccattgtacaagagaatgttcagcaccaaataa

SEQ ID NO: 25367 - DNA, 1713 bp, Saccharomyces cerevisiae
atgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatctagaagaggtgccaactacgacgctgaagaaatggctcacgatgataagccattgtacaagagaatgttcagcaccaaataa

SEQ ID NO: 25368 - DNA, 1704 bp, Saccharomyces cerevisiae
atgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataa

SEQ ID NO: 25369 - DNA, 2835 bp, Saccharomyces cerevisiae
atggacgaagcgtcacatctcccaaatgggagcttgaagaacatggaatttacgcctgtaggatttatcaaatccaagcgaaacaccacgcaaacacaagttgtatcgcctactaaggttccaaatgccaataatggtgatgagaacgaaggccctgttaagaaaaggcagagaagaagcattgatgatacaattgactccacaaggctatttagtgaagcttcacaattcgatgacagctttccagaaattaaggctaacattccgcctagtccaaggtcaggcaatgttgacaaaagtcgcaagagaaatttgattgatgatttgaagaaagatgtgccaatgtctcagcccttgaaagaacaagaagtaagagaacaccaaatgaagaaagagcgatttgaccgtgctttagagagtaaattactaggaaaaagacacataacatacgcaaattctgatatttctaataaggaactttacattaatgaaatcaagagtttgaagcatgaaatcaaagaattaagaaaggaaaaaaacgatactctcaataattatgatacccttgaagaagaaacagatgacttgaagaacagattacaagcgctggaaaaagagctggacgccaaaaataaaattgtgaattcaagaaaagtagatgatcattctggatgcatagaagaacgtgaacaaatggaaagaaagttggctgaattagaaagaaaactgaaaactgtgaaagaccaagtgctagaattagagaataatagtgacgtacaaagtttaaaattgagatctaaggaggatgaattgaagaatttaatgaatgagttgaatgaattgaagagcaatgcagaagaaaaggatacacagttggaattcaagaaaaatgaactgaggaaacgaacaaatgaattaaatgagttgaaaatcaagtctgatgagatggatttacaactaaaacaaaaacaaaatgaatcaaaaagattaaaagatgaattaaatgagcttgaaaccaaattcagcgaaaatggttctcagtcttctgcaaaagaaaatgaattgaaaatgctgaaaaataaaatagccgagctagaggaagagattagcacgaaaaattcacagttaatcgcaaaagaaggtaagttagcatcattaatggctcagctaactcaattggagagtaaacttaatcaaagagactcccagttgggctcaagggaagaagaattgaaaaaaacaaacgataagctacaaaaagatatcaggatagcaagagaggaaacagtttcaaaggatgaacggataattgatcttcaaaaaaaggttaaacagctagaaaatgacttatttgtgataaaaaaaacgcacagtgagtctaaaactattactgataatgaactagaatctaaagataaacttattaaaattttagaaaacgatttaaaggttgcacaagagaagtactctaaaatggaaaaagagctcaaagaaagggaatttaactataaaatttccgaatcaaagttggaagatgaaaagaccacgctaaatgaaaaaatttctaacttagccgcagaaaactcacagctaaaaaataaaatagaggacaattcgactgccactcaccatatgaaagaaaactatgagaagcagttagaatcgctaaggaaagatattgaagagtacaaagaaagcgcaaaagattctgaagacaaaattgaggaactaaaaattaggattgctgaaaattctgctaaagtatcggagaaaagatcaaaggatataaaacaaaaagatgaacagatcagcgacctcactcagaatctaaaactacaagaagatgagataagctcattaaaatccataattgacaggtacaaaaaagatttcaatcaattgaaatctgaacagagtaatatccaacatgacctaaatttacaaatactaaatctggaaaataagttaatagagagcgaggatgaattaaagtcactaagagattctcaaaaaattgaaatagaaaactggaagagaaagtataacaatctttcactggaaaatgacagattgttgacagaaaaagaatccgcatcagacaaagagcgcgagatatccatcttgaacagaaaacttgatgaaatggataaagaaaaatggaacttacaggaatctaaagaaaaatataaacgcgaactacagaaggtgattactgctaatgatcgtttgagaagagagaaagaggagttgaatgaaaacagcaataatattcgtatcatggaagacaagatgactaggataaaaaaaaattatttgagtgaaatcacttctttacaagaggaaaataggagacttgaagaacgcctcatattaaatgagaggcgtaaagacaatgattcaactatgcaattaaatgacatcataagctattataaattgaagtatcactcagaagtaagacacaacaacgatcttaaggtgatcaatgattatttaaacaaggttcttgctttggggacccgtcgtttaagattggacacaaggaaaggtgagcacagtctaaacatttcacttccagacgatgatgaactagatcgtgattactacaatagccatgtttatacaaggtatcatgactatgaatacccgcttagattcaatttaaacagaagaggtccctatttcgaacgccgcttaagcttcaaaacagttgcccttttagtgcttgcttgtgtgaggatgaaaaggattgctttttacaggagatcagacgataacagattgcgaatactaagagatagaattgagagtagcagcgggcgtatatcttggtag

SEQ ID NO: 25370 - DNA, 939 bp, Saccharomyces cerevisiae
atgcctgctacgttaaagaattcttctgctacattaaaactaaatactggtgcctccattccagtgttgggtttcggcacttggcgttccgttgacaataacggttaccattctgtaattgcagctttgaaagctggatacagacacattgatgctgcggctatctatttgaatgaagaagaagttggcagggctattaaagattccggagtccctcgtgaggaaatttttattactactaagctttggggtacggaacaacgtgatccggaagctgctctaaacaagtctttgaaaagactaggcttggattatgttgacctatatctgatgcattggccagtgcctttgaaaaccgacagagttactgatggtaacgttctgtgcattccaacattagaagatggcactgttgacatcgatactaaggaatggaattttatcaagacgtgggagttgatgcaagagttgccaaagacgggcaaaactaaagccgttggtgtctctaatttttctattaacaacattaaagaattattagaatctccaaataacaaggtggtaccagctactaatcaaattgaaattcatccattgctaccacaagacgaattgattgccttttgtaaggaaaagggtattgttgttgaagcctactcaccatttgggagtgctaatgctcctttactaaaagagcaagcaattattgatatggctaaaaagcacggcgttgagccagcacagcttattatcagttggagtattcaaagaggctacgttgttctggccaaatcggttaatcctgaaagaattgtatccaattttaagattttcactctgcctgaggatgatttcaagactattagtaacctatccaaagtgcatggtacaaagagagtcgttgatatgaagtggggatccttcccaattttccaatga

SEQ ID NO: 25371 - DNA, 1536 bp, Saccharomyces cerevisiae
atggtaggacactcagctcagcacagatcaaaaagcagcttagtgtctcacctactaatactacttatctttataacgattattattgaaatgtgtttatataataaaatttttaagaaccaaaggtcggatgatattagagacaactttaacaatggcggacatcgagttcccagtaatgtccaaaatcatggaacccatataagagacgaagcctttatatcaggggtctattattccaattggtccccatacaaaccgaggtttcatttccctcacgacataaacttgaagcaagtgtctcacatttactatgcatttttcaaaataaactctagaactggtggtatagaaaacacggatagttggtctgatctagaaatgaatttgtataaatcgctggcaattaaaaattcagaactaattaaagaaagctcgaacaatagtgtccaaaacatcctacccttaggttgcattggtgaactattttatttgaagaatacctgttctgataagaaatttaaagttatcatgtcaattgggggctggtctgatagtgaaaatttcaaaatcataattaaagatgataaactcttacaaaattttgttgattcgtcggtggaaacaatgttcagattaggatttgatggcattgatctagactgggagttccctggtaacaatgaatcagaacctcgcggatatctgaaactggtcagaatgctgcgattaaaactaaacagcctcgaatcccaaatatttgggaaacgtactgaagatcattttcaattatctattgcggcacctgcattcaaggataaattattttacttgccaatcacagaaattgatcaatatgttgactactggaatatgatgacgtacgattattatggctcgtggtcagaaacaacaggatatcacagcaatctattcagtgagacggaattgaatggaaactttgccatgcattatatgatcgatagatttggcgtcaattctagaaaattagtactgggaatggccgcctacggaagaagtttccatatcaaagataacaaattcgaaccattcaatcaaaatactgtattaattaacaaaattttcaaaggagtgggcaagcccactaaagaaatagataaagctgatggcaaggagggcatctggccttacaaaaatttaccaaagattggtacaatagaacaatacgatccaaaatatgtttcagcatattgctttgatgaaaaaaattcaatatttatcagttatgataacactaaatcagtcaaaactaaggctgaatatgtgacacataacaatttaggcggaggcttttggtgggagtcatgtggtgaagcttatgcaaatgagtcaaggtcgttgataaacgcatttaatgaaggcttgcactttaatgtgtcatcaaaaccatcaatatttcaagatgtgagagttaaaaaatattacttgaataaatatggcgatggcggatttttatctccatatttaaagcatttggattcaagaaagcaatga

SEQ ID NO: 25372 - DNA, 573 bp, Saccharomyces cerevisiae
atgggagccaagacgtcaaagctttccaaagatgacctgacatgtttgaaacaatccacctattttgatagaagagaaatccagcaatggcataaaggatttttgagggattgccctagtggccaactagctagggaagattttgttaagatatacaaacagttttttccatttggttctcctgaagattttgctaatcacctttttacagtttttgataaagacaacaatggattcatacattttgaagagtttatcacagttttgagtacaacgtccagaggaactttggaggaaaaactgagctgggctttcgaactttatgatttgaaccatgatggatatattacatttgatgaaatgctaaccattgtggcgagtgtttataaaatgatggggtctatggttacacttaatgaggatgaggcaacgcccgaaatgagggtaaagaagatcttcaagttgatggataagaacgaagatggttacattacgctggacgaattcagagaaggttctaaagtcgatccctctattattggtgccttaaacctttacgatggcttaatatga

SEQ ID NO: 25373 - DNA, 1371 bp, Saccharomyces cerevisiae
atgtcggataagccgattgacatacaatatgataaacaggctactccaaatctgagtggtgtaattactccgccaacaaatgaaactggtaatgactcagtccgggaaaaactttcaaaactagttggcgatgctatgtcaaacaatccctattttgccgccggcggtggtcttatgatccttggtacaggtttagctgtagctagatccggtataataaaagccagcagggtcctataccgacaaatgattgtcgacttagagattcagtcgaaggacaaatcatacgcctggtttctaacatggatggccaaacatcctcaaagggtatctagacacttatccgttaggacaaactacatacaacatgacaatggatcagttagtacaaaattttcgctggttccgggtccgggaaatcattggattcgttataagggtgcttttatcctgattaaaagagaaaggtccgcaaaaatgatagatatcgcaaacgggtcaccatttgagaccgtaaccttaactacactgtaccgtgacaaacatttgttcgatgacattttgaacgaggctaaagacatagccctgaagactactgagggcaagactgttatttacacttctttcggccctgaatggagaaagtttggtcaaccaaaagctaaaaggatgctgccctccgtcattttggacagtggcatcaaagagggtattctcgatgacgtttatgattttatgaagaacggcaaatggtactctgacaggggtatcccatatcgcaggggatatttactctatggccctcccggatctggtaagactagctttatccaggctttagcgggcgaattagactacaacatttgtattttaaacctctccgaaaataatttaacagatgacagattaaaccacttaatgaataacatgccagaaaggagcatactattactggaagatattgacgcggcgttcaacaaaagaagtcaaactggtgaacaaggttttcattctagcgtaacatttagcggtttactgaatgccctggatggcgtcacatcttctgaagaaactattacattcatgactaccaatcatcctgaaaagctagacgcggctataatgagaccaggtcgtattgactacaaagtcttcgttggtaacgcaactccataccaggtagaaaaaatgtttatgaaattttacccaggtgagactgatatatgcaaaaagtttgtaaatagtgttaaagaattggatatcaccgtaagtaccgcccagttgcaaggacttttcgttatgaataaagatgcaccacacgatgcgttgaaaatggtctccagcttacggaacgctaatcatattttctag

SEQ ID NO: 25374 - DNA, 3030 bp, Saccharomyces cerevisiae
atgtcagctgaccctattaatgaccaatcgtctttatgtgtgaggtgcaataaatcaatcgcgtctagccaggtatacgaattagaaagcaaaaaatggcatgaccagtgctttacatgctacaaatgtgacaaaaaattgaacgcagattcagactttttggttctggatataggtacattaatttgttacgactgctcagataaatgtacaaattgtggcgataaaatagacgacacagcaattatactgccttcctcaaatgaggcctattgttccaattgtttcagatgctgtcggtgcagcaaccgtataaagaacttaaagtatgcaaagacaaaacgaggactatgttgtatggattgtcacgagaaattgttgagaaaaaaacaactattactggaaaatcaaacaaaaaattcatcgaaagaagattttcccataaaacttcctgaaagatcagtcaaaaggcccttgtcacccaccagaataaatggtaagtcagatgtcagtacaaacaacaccgcaataagtaagaaccttgtaagctcgaatgaggatcaacagctcactccacaagttttagtatcacaagaaagagatgaatcatcgttgaatgacaataatgataatgataacagcaaggacagggaggaaacatcttctcacgcaaggacggtttctattgacgacattctgaactctactttggaacacgatagtaatagcattgaagagcagagtttggtggataatgaggactacatcaacaaaatgggtgaagacgtaacctataggctattaaaaccacaaagagcaaatcgagattccatagtggtaaaggatccgaggatcccaaattcgaactcgaacgcgaatagattcttttcaatttatgataaagaagagacagacaaagatgatacagacaacaaagagaatgaaatcatcgtcaacacacccagaaatagcactgataaaattacaagtcctttgaacagccctatggctgtacaaatgaacgaagaggtcgaacctccgcatggactggcattaactttatcagaagctacgaaagaaaataacaaatcatctcaaggtattcaaacgtcaacttccaaatctatgaatcatgtctccccgattacaagaaccgataccgtagaaatgaaaacatcaacctcttcatcgacattacgtttgtctgataatggaagtttcagcaggcctcaaacagcagataacttattgccgcataaaaaagtagcaccctctccaaacaaaaaactttcaagatcgttttctttgaagtccaaaaattttgttcacaacctgaaaagtaaaacttcggaaatgctggacccaaagcatccccatcacagcacttctatacaggaatcagacactcattctggctggggtgtttcctctactcatacaaatataagaaaatcaaaagccaaaaaaaatcctgtatcaagaggccaaagtgacagtacaatatacaatactctaccacaacatggaaattttacagtaccggagtttaatcacaaaaaagcgcaaagcagccttggcagtatatccaaaaagcaaaattctaatgatacagccactaatagacgcataaatggttcatttacaagttcaagctcggggcatcatatagcaatgttccgtacgccgcctttggaatcagggccattatttaagaggccatctctgtcatctgagtccgcacaccacagatcttctagcttacagacgtctagatccactaatgcattgttggaagacgattccacgaaagtggatgctactgatgaaagcgctacaagcttggaaaaggacttttactttactgagttgactttaaggaagttaaaattagatgtgagggaactagaaggtacgaagaaaaaattattacaagatgttgaaaatctaagattagcgaaagagaggctgttaaatgatgttgacaatttaacaagagaaaaggataagcaatctgcatcttcccgggagtccttagaacaaaaagaaaacattgcaacatcaatcactgtaaagtcaccaagttcaaattccgacagaaaagggagcatatctaatgccagtcctaaaccacgcttctggaaaatattttcaagtgctaaggatcaccaggtaggcgatctagaatcacagcaacgttcgccaaattcatcttcaggcggaacgacaaatatagcacagaaagaaatatcatcaccgaaattaattcgagtacacgatgagcttccttctccaggcaaagtaccactgtcgccaagtccaaagagattagattatacgcctgatggttcccatttatatggatcttcgctacaagctcgatgtgcgtatgaaaaaagtactgttccaataattatcaggtgctgcattgatcgcattgaaaaagatgatataggcctgaacatggaaggcttatacagaaagtcgggctcacagactttggttgaggagatcgaaaatgaattcgctcagaataattcgttgcatagtgatacattaagtcccaaactgaatgctttactgaatcaagatattcatgcagtggctagcgtattaaaacgatatttgagaaaactaccagatccagttttatcattttccatatacgatgccttgatagatctagttagaaataaccaactaattgagaggctaccattaaacaacgacaagtttttggattcaccacaaaaagtgactatttatgaaatggtgctcaaaagcctacttgaaattttcaaaattttacccgtagagcatcaggaagtattgaaagtattggcagcacatatcggcaaagttcgaaggtgcagtgaaagaaatttaatgaacttacataacttgtcgttggtctttgcaccgagtcttatccacgattttgacggcgagaaagatattgtggacatgaaggagaggaattatatcgtggaatttatacttggaaactatagagacatatttaagcaagcataa

SEQ ID NO: 25375 - DNA, 1908 bp, Saccharomyces cerevisiae
atggcacctgttacaattgaaaagttcgtaaatcaagaagaacgacaccttgtttccaaccgatcagcaacaattccgtttggtgaatacatatttaaaagattgttgtccatcgatacgaaatcagttttcggtgttcctggtgacttcaacttatctctattagaatatctctattcacctagtgttgaatcagctggcctaagatgggtcggcacgtgtaatgaactgaacgccgcttatgcggccgacggatattcccgttactctaataagattggctgtttaataaccacgtatggcgttggtgaattaagcgccttgaacggtatagccggttcgttcgctgaaaatgtcaaagttttgcacattgttggtgtggccaagtccatagattcgcgttcaagtaactttagtgatcggaacctacatcatttggtcccacagctacatgattcaaattttaaagggccaaatcataaagtatatcatgatatggtaaaagatagagtcgcttgctcggtagcctacttggaggatattgaaactgcatgtgaccaagtcgataatgttatccgcgatatttacaagtattctaaacctggttatatttttgttcctgcagattttgcggatatgtctgttacatgtgataatttggttaatgttccacgtatatctcaacaagattgtatagtatacccttctgaaaaccaattgtctgacataatcaacaagattactagttggatatattccagtaaaacacctgcgatccttggagacgtactgactgataggtatggtgtgagtaactttttgaacaagcttatctgcaaaactgggatttggaatttttccactgttatgggaaaatctgtaattgatgagtcaaacccaacttatatgggtcaatataatggtaaagaaggtttaaaacaagtctatgaacattttgaactgtgcgacttggtcttgcattttggagtcgacatcaatgaaattaataatgggcattatacttttacttataaaccaaatgctaaaatcattcaatttcatccgaattatattcgccttgtggacactaggcagggcaatgagcaaatgttcaaaggaatcaattttgcccctattttaaaagaactatacaagcgcattgacgtttctaaactttctttgcaatatgattcaaatgtaactcaatatacgaacgaaacaatgcggttagaagatcctaccaatggacaatcaagcattattacacaagttcacttacaaaagacgatgcctaaatttttgaaccctggtgatgttgtcgtttgtgaaacaggctcttttcaattctctgttcgtgatttcgcgtttccttcgcaattaaaatatatatcgcaaggatttttcctttccattggcatggcccttcctgccgccctaggtgttggaattgccatgcaagaccactcaaacgctcacatcaatggtggcaacgtaaaagaggactataagccaagattaattttgtttgaaggtgacggtgcagcacagatgacaatccaagaactgagcaccattctgaagtgcaatattccactagaagttatcatttggaacaataacggctacactattgaaagagccatcatgggccctaccaggtcgtataacgacgttatgtcttggaaatggaccaaactatttgaagcattcggagacttcgacggaaagtatactaatagcactctcattcaatgtccctctaaattagcactgaaattggaggagcttaagaattcaaacaaaagaagcgggatagaacttttagaagtcaaattaggcgaattggatttccccgaacagctaaagtgcatggttgaagcagcggcacttaaaagaaataaaaaatag

SEQ ID NO: 25376 - DNA, 1668 bp, Saccharomyces cerevisiae
atgtctacagatgaaagtgaagacgtttattctgatctgtattccattatctcccaggtaacatccaatactgccaatgacatcgagcaactcccatatgctttaacgttcaaaacgtcgttaatcttcgttggtgctaccattggtgggcttttattcggctatgatactggtgttatatcaggtgttctgctttctttaaagcccgaagatctatctttggtagttttaacggatgttcagaaggagctgataacttccagtacaagcgtcggatcattttttggctctattctggcatttcctttagcagataggtatggaagaagaattactctcgcaatctgctgttcaatttttatcctagctgcaattggaatggctatagcaagaacattgacgtttttgatttgtgggagattgctggttgggatcgctgttggagtgtctgcccagtgcgtccctctatttctgagtgaaatttcaccttccagaatcaggggttttatgttgacattgaacattattgccatcactggaggtcaattggtttcctatgtgattgcgtcccttatgaaagagattgataattcatggagatatttgttcgcactttctgctattccagctattctgttcctttcaatactggattttatccctgaatcgccacgatggtccatttccaagggagacattctatataccagggattctctaagaatgctatatcctactgcatctacatatcatgtgaatagtaaaattaagcagctgataattgaactcgataagttacgactatacgaagatgcaagtgaacctttactagtacagtcccaatcggttattcgatacatggatagttcaacctcaggaactcttagcccacctaacattaaaagactttcctcgaacacagaaagaactagcaacacaatgtcctcctcatcagcatatctatcggcgttgcgaggcccagctccaaacggtgccctggcatctaacaaaaagaaaagacacagaatggagccacgcacaataagagcgttaatagtaggttgcatgttaatgtttttccagcaaatcactggctttaatgcttttatgtactatgcggcaataatattttccaaatttaatataaaaaaccctctactgcctccaattttgattgcctcaacgaacttcatattcacttttttcgccatgtacaccatggactctttgggaagaagagccattcttttgagaacaattttgattatgactgttgggttacttctttgcagtgtaggtttcggtcatgaccaagtcaatttacttttaatttctgttgtaatttatgttgcagcatatgcttctgcgatgggcagcgttccatggacctgtgtggaatttctccccttgaacaggagatcatttggggcatcatgtatagcctgcacaaattggttgaccaatgcatttgtttcaatgacatatctgagcactattaacaccattggtgatgaaaatacaatgctcatttttgcttttttcacagtttgtgcctggtttttcgtatatttttggtatccagaagtcaaaggtttgtcactggaagaggttggaagggtttttgataatggaattgatgttcattatgtctttcgtacctaccattga

SEQ ID NO: 25377 - DNA, 1449 bp, Saccharomyces cerevisiae
atgagttttaaagggtttaccaaggctgttagtagggctcctcagtccttccgtcaaaagttcaagatgggtgagcagacagaggatcctgtttacgaggatgcagaacgtcgttttcaagaattggagcaggagacaaaaaaattaagtgaggaatcgaagagatactcgactgcggtgaatggaatgctgacacaccaaattggatttgccaaatccatggaggaaattttcaaacctatcagtggtaaaatgagtgaccctaacgctaccataccagaggacaacccacaaggtattgaagcaagtgaacagtatagggcaattgtcgcagaattacaggaaacattgaaaccggatctggctttggtggaagaaaaaattgttacgccatgccaggaactgttgaagattattacttatattcgtaaaatggccaccaagagaaatcacaaaaaattagatttagatagacatctaaacacttataacaagcatgaaaagaagaaggaaccaaccgccaaagacgaagaaagattgtataaagcacaagctcaagtggaagtggctcaacaagaatatgattactataacgacttgctaaagactcaattaccaatactgttcagtttggaagctgaatttgtgaaaccattatttgtctcattttatttcatgcaattgaacattttttacactttgtataatagacttcaagacatgaagattccatattttgatttgaacagtgacattgtagagtcgtacattgccaagaaaggcaatgtggaagaacaaacggacgccttgactattacacactttaaactcggttactctaaggcaaaattggagatgaccagaaggaagtatggtgtagcaaccgccgaaggctcacccgtcagtggcgcatcaagcggtgtcggatatggtgctgggtatgatccagcaactgccacttctccaacccctacaggatacggttatggtgccgcagcaccaagttacgccgctcaacctgctgcccagtatggtactgctgccgccgttggtactgctgctgctgttggtactgctgctggtgctgctgctggcgctgttccgggtacttatccacagtatgctgctgcgcaatctccaccgctcactgggctaggcttccaacaatcaccacagcagcaacagggaccaccaccggcctactctaatcctctaacatcacctgttgcgggcacaccagccgcggccgtagcggcagctcctggcgttgaaactgttaccgcattgtatgactaccaagctcaagctgctggtgatttgtctttccctgccggcgcagttatagaaattgtccagcgtactccggacgtgaacgaatggtggacaggaagatacaatggccagcaaggtgtgtttcctgggaactacgtgcaactcaacaagaactag

SEQ ID NO: 25378 - DNA, 1287 bp, Saccharomyces cerevisiae
atggaggaactaggtattgtgacacctgtcgaaaaggcagtcgaagaaaaaccagccgtcaaatcatacgcatcattgttggctcaactcaatggtacagtcaacaataacagtgccctgtctaatgtgaattctgatatatatttcaaattgaagaaattagaaaaagagtatgaactgctgactttgcaagaagactatattaaggacgaacaacgccatttgaaacgtgaattgaagagagctcaagaagaagtaaagagaatccagtcggttccattagttatcgggcaattcttagaacctattgatcagaacacaggtattgtttctagtaccacaggtatgagttatgtcgttagaatattatcaaccctagaccgtgaactattaaagccatctatgtctgtagctttacatcgtcattcaaatgctttagttgacatcctaccacctgattccgactctagcatatccgtaatgggcgaaaacgaaaaacctgacgtcacttatgcagatgttggtgggttagatatgcaaaagcaagaaatcagggaagccgtagagctgccattagttcaggctgatctatacgagcaaatcggtattgaccctcctaggggtgttctattatatggtccaccaggtaccggtaagacgatgcttgttaaagccgtcgccaatagtacaaaagctgcattcataagagttaatggctccgaatttgttcacaaatatcttggtgaaggtccaagaatggttcgtgacgtctttagactcgccagggaaaatgctccatccattatattcatagatgaggtagattccattgccacaaagcgttttgatgctcaaacgggttccgatcgtgaagtacagcgtatcctgattgagttgttgacacaaatggatggtttcgatcaatccaccaacgttaaagtcatcatggctacaaacagggcagacacattggacccagctttgctgagaccaggcagattagatagaaagattgagtttccctcacttcgtgataggcgtgaacgtcgtttgattttcggtaccattgccagtaagatgtcccttgccccagaagcggacttagactcgcttattattcgtaacgactctctatcaggtgctgttattgcagcgatcatgcaggaagctggtttaagagcagtgaggaaaaacagatatgtcatcttacaaagcgatctggaagaagcttacgccactcaagtcaagacagataataccgtcgataaattcgacttctacaaatga

SEQ ID NO: 25379 - DNA, 4590 bp, Saccharomyces cerevisiae
atgtcatcagatatcagagacgtagaggaacgaaattcgcggagctcgagctcaagctcgagctcgaactctgccgcccaatccattggacagcatccataccgcggtttcgacagcgaagccgcggaaagggtgcatgagttggctagaacactcacatcgcagagtttactatacactgctaactcaaacaatagctcttccagcaaccataatgcgcacaatgcggactcgagatccgtattttctacggacatggaaggtgtgaacccggtgttcactaacccggacaccccgggatacaatcccaaattggaccctaacagtgatcaattctccagtacggcgtgggtacagaacatggcaaatatttgtacttcggacccggatttctataaaccatactcactcggttgtgtatggaagaatctaagcgcctccggagactccgccgatgtgtcataccagtcaactttcgctaacatcgtaccaaagctgcttacgaaagggctcagattactgaagcccagtaaagaagaggacacttttcagatcctgaaacccatggatggttgtcttaatcccggtgaactgttggttgttcttgggagaccagggtcaggttgtactacgctgctaaaatccatatcttctaattcgcacgggttcaagatcgcaaaagactccattgtctcttacaacggtttgtcaagctcggatatcaggaaacattaccgtggtgaagtcgtttacaatgcggaatcagatattcatttaccgcatcttaccgtgtaccagacgcttttcaccgtggcaaggatgaaaacgccgcaaaatcgtatcaagggtgttgatagagaagcgtacgccaatcacgtgacagaagttgcaatggccacatatggtctttcgcatacaagggacaccaaggtcggaaacgatctagtcagaggtgtttctggtggtgaaagaaagcgtgtatccattgcggaagtcgcaatctgcggcgccagatttcaatgttgggataatgccaccagaggtttggactctgctactgctttagaattcatccgtgctttaaaaacccaggctgacattggaaagaccgcggctactgtggccatctatcaatgttctcaggatgcttatgatctttttgataaggtctgtgtcctggatgatggttaccagctttattttgggcccgctaaggatgcaaagaaatatttccaagacatgggctactattgtcctcccagacagaccactgcagattttttaacttcaattacaagtcctactgaaagaattattagcaaagaatttatcgaaaaaggtactagagtgcctcaaacgccaaaggatatggccgaatattggctacaatcagaaagctacaaaaatttaatcaaggatatagactctacattagagaaaaacacagatgaagcacgcaatattatcagggatgctcaccacgctaaacaggcaaaaagggcaccaccttcctctccatacgttgtcaactacggaatgcaagtcaaatacttgttgattagaaatttctggagaatgaagcaaagtgctagtgttactttgtggcaagtcatcggtaactctgtcatggctttcatcttgggttctatgttttataaagtgatgaagaaaaacgatacttccactttctatttccgtggtgctgcaatgttttttgctattttatttaatgcattttcgtgtcttttggaaatctttagtttgtatgaaacaagacctataactgaaaaacacagaacttattccttgtatcatccaagcgctgacgcatttgcgtctgttttgtcagaaatgccgccaaaattgatcactgctgtctgcttcaacatcatcttttatttcctagttgatttcaggagaaacggtggtgtctttttcttttattttttaattaatgtcattgccacattcactttatcccatttatttagatgcgtgggctccttgaccaaaacattacaggaggccatggtccccgcttcaatgttattattggcaatttctatgtatacagggtttgccatccctaaaacgaagattttaggttggtccatttggatttggtatatcaacccgctagcctacctgtttgaatctttaatgatcaatgaattccatgaccgtagattcccttgtgcccaatacatccctgctggccctgcttatcagaacatcacaggtactcaacgcgtctgttccgcagttggtgcttatccaggtaacgactatgtgttgggtgatgacttcttgaaggaaagttacgattatgagcacaaacataagtggcgtgggttcggtattggtatggcatatgttgttttctttttctttgtttatctaattctttgtgagtataatgaaggtgctaaacaaaagggtgaaatggttgtgttcctaagatctaagatcaagcaattgaaaaaggaaggtaaattacaagaaaagcataggcctggagatattgaaaataatgcaggcagttctccagattccgctacaacagaaaaaaaaatactagatgatagttctgagggatcggatagctcttcagataatgccggattaggactttccaaatctgaagcaattttccactggcgtgatttatgctatgatgttcctataaaaggaggtcaaagacgtatcttaaataacgtagatggttgggtaaaaccaggcactttgactgccttaatgggggcgtcaggtgcaggtaaaacaactttactggattgtttggctgaaagagtcaccatgggtgttattactggtaatatttttgtcgatggtcgtctccgtgacgaatcattccctagatctattggttattgtcaacaacaggatttacatttgaaaacggctacagtaagagaatctttgagattttcagcttatttacgtcagccttcgtcagtttctattgaagaaaaaaataggtacgtggaagaagttatcaaaattttggaaatgcaacaatattcagatgctgttgttggtgttgcaggtgaaggtctaaatgtcgaacaaagaaaaagacttactattggtgttgaactagcggcaaggcctaaacttttggtttttttggatgaaccaacttcaggcctggattcacaaactgcttgggacacttgccaacttatgaggaaactagctacccacggtcaagcaattttgtgtactatccatcaaccttctgctatattaatgcagcagtttgatagattattatttttacagaaagggggccaaactgtatatttcggcgatttaggtgaagggtgcaaaactatgatcgattattttgaaagtaaaggagctcacaaatgtccacctgatgcaaaccctgccgaatggatgttagaggttgtaggtgccgctcctggttctcacgctacgcaagattataatgaagtctggagaaactcagatgaatacaaagctgttcaggaagaattggattggatggaaaagaatttaccaggcaggtcaaaagaaccaactgcagaagaacataaaccttttgctgcatctttatactaccaatttaaaatggttaccattcgtttgttccaacaatactggagatcaccagattatttatggtcgaaatttattttgactattttcaaccaagtttttattgggttcacttttttcaaggctgacagaagtttacagggactacaaaaccaaatgttatcaatattcatgtatacggttattttcaatcctatactacaacagtatctaccatctttcgtgcagcaaagggatttgtatgaggcaagagaacgtccttcaagaacattttcgtggcttgcgtttttcctctctcaaatcattgttgaaatcccatggaatattttagcgggtacgattgcttattgtatttactattacgcggttggattttatgcgaacgcctcagctgctggtcaactccatgagagaggtgctttgttttggttattttctattgccttctacgtctacattggttcgatgggtttgttaatgatttctttcaatgaagttgctgaaacagcggcacatatgggaacgctattgttcacgatggcattatctttctgtggtgttatggctacccctaaggttatgccaagattttggatctttatgtatagagtgtcacccctaacttatatgatcgatgcattattagcccttggtgtggctaatgtggacgttaagtgttcaaattatgaaatggtaaaatttactccaccatctggaaccacctgcggtgactatatggcatcatatatcaagttggccggaacaggctacttgagtgacccgtctgcaacagatatatgtagtttctgtgcggtatccaccaccaatgcctttttggccactttcagttctcattattacagaagatggagaaattacggtatttttatctgctatattgcttttgattatatcgctgcaacattcttgtattggttatccagggtacccaagaagaacggtaagatttccgaaaaacccaagaagtga

SEQ ID NO: 25380 - DNA, 1044 bp, Saccharomyces cerevisiae
atgacaactttattacagctcttgtcaaattattataaggctaaattagattcagaacgaatatacaatgaatatgttcagtcgcagtatgagtttgcatctttagacaagttgaacaacaataaaggtgacccaaagaaagtagttgatgagacattatttttgcagaggcaaattgcccagctgaataaacagttacaactttcatttcaagagaatgaaaaactattaagcgtacagaagaatcaaaaagctctttatcaaagtaagttatccagcaaggatgcattcattgatgatttgaaactcaaactgaaagtcgagcagatatctgtagacaaacataataaggaacggacaccttcaacaggccgtgatgaacaacagcgtaattcaaaagcggcacatacatcaaagcccacaattcatcttctttcgccaattgtaaatcgtgataagcctaataatcaaacgaacgacaggggtggcaacgatcctgactcgcctacatcacaaagaagatcaagaggactgagatctttattgagttcaggtaaaaatacaatatttgattcaatatccaaaaatctcgacgatgagataaatgaaaatgcgcatatcagaaatgataccacatcttccaagatagctggcaaatcgccatcaagattatctgcgctgcaaaaatctccagaactgcgtaaagaaaggaacaatatgatattaaaggaacacatactgcgttcaaaagatgaccaaaatatcacgtcatctagaaaactggataatatcgagctatctagtattggtgactctactgcaatgacatcaaggagttctaccgttaatgcaaatgacatcttgggaaatgaagagaacgacgggattacaaagctgaaaagagttaacaagttaaccagctctccagttaaaagggattgcagtacaaacaagaaaagaaaactcacaaagcagcgaattgccacgttacccaactcagatgaagaattgagtaataatttaaatgttgacgagtttgtatga

SEQ ID NO: 25381 - DNA, 546 bp, Saccharomyces cerevisiae
atgtctatttctgaatcttacgcaaaggaaataaaaactgcatttaggcagttcactgactttcccatagagggtgagcaatttgaggattttttacctattattggcaaccccacgctattccaaaagttggtacacacgttcaagacgcatttagaagaaaagttcggcaaagaaaagatcgactttattgcaggtatagaagctagaggccttctatttgggccatccctagcactggcattgggagttggatttgttccaataaggagagttggaaaattgccgggtgagtgtgcttctataacattcacaaaattagaccatgaagaaatttttgaaatgcaggttgaagccattccctttgattccaacgtggttgtcgtggatgatgttctcgccaccggtggaacggcatatgctgcgggcgaccttatcagacaagtgggtgctcatattctggaatatgactttgtgctagtgttagatagtctacatggtgaggagaaattatctgctcctattttttccatattgcactcctga

SEQ ID NO: 25382 - DNA, 111 bp, Saccharomyces cerevisiae
atgcaaccatctaccgctaccgccgctccaaaagaaaagaccagcagtgaaaagaaggacaactatattatcaaaggtgtcttctgggacccagcatgtgttattgcttag

SEQ ID NO: 25383 - DNA, 1902 bp, Saccharomyces cerevisiae
atgagcagtaacaacaacacaaacacagcacctgccaatgcaaattctagccaccaccaccaccatcaccaccatcaccaccaccatcacggtcatggcggaagcaactcgacgctaaacaatcccaagtcgtccttagcggatggtgcacatatcgggaactaccaaatcgtcaaaacgctgggagaggggtcctttggtaaagttaaattggcatatcataccactacgggccaaaaagttgctctaaaaatcattaataagaaggttttggcaaagagtgatatgcagggcagaattgaaagagaaatatcttatctgagactcttaagacacccccacatcatcaaactgtatgatgttatcaaatccaaagatgaaatcattatggttatagagtacgccgggaacgaattgtttgactatattgttcagagagacaaaatgagcgagcaagaggcaagaagatttttccagcagatcatcagtgccgtcgagtactgccataggcacaaaattgtccatagagatctgaagcctgaaaacttactactagatgagcatctgaatgtaaagattgccgattttggtttgtcaaacatcatgactgatggtaatttcttaaagacttcttgtggttctcccaattatgcggctcctgaagttatcagcggtaagctgtacgcaggcccagaagtggacgtgtggtcatgtggggttatcctttatgttatgctttgtcgtcgtctaccgtttgacgatgaaagcatcccagtgcttttcaagaatatcagcaacggtgtttacaccttgcctaaatttttatctcctggagctgctgggctaatcaaaagaatgttaatcgttaatccattgaacagaataagcattcatgaaattatgcaagacgattggttcaaagttgacctgccagaatatctacttccaccagatttgaaaccacacccagaagaagagaatgaaaataatgactcaaaaaaggatggcagcagcccagataacgatgaaattgatgacaaccttgtcaatattttatcatcgaccatgggttacgaaaaagacgagatttatgagtccttagaatcatcagaagacactcctgcattcaacgaaattagggacgcgtacatgttgattaaggagaataaatctttgatcaaggatatgaaggcaaacaaaagcgtcagtgatgaactggatacctttctgtcccagtcacctccaacttttcaacaacaaagcaaatcccatcaaaagagtcaagtagatcatgaaactgccaagcaacacgcaagaaggatggcaagtgctatcactcaacaaaggacatatcaccaatcacccttcatggatcagtataaagaagaagactctacagtttccattttgcctacatctttacctcagatccacagagctaatatgttagcacaaggttcgccagctgcctctaaaatatctcctcttgtaacgaaaaaatctaaaacgagatggcattttggtatacgatctcgctcatatccattagacgttatgggtgaaatttatattgccttgaagaatttgggtgccgaatgggccaagccatctgaagaggatttatggactatcaaattaaggtggaaatatgatattggaaacaagacaaacactaatgaaaaaatacctgatttaatgaaaatggtaattcaattatttcaaattgaaaccaataattatttggtggatttcaaatttgacggctgggaaagtagttatggagatgatactactgtttctaatatttctgaagatgaaatgagtactttttcagcctacccatttttacatttaacaacaaaactaattatggaattagccgttaacagtcaaagcaattga

SEQ ID NO: 25384 - DNA, 1329 bp, Saccharomyces cerevisiae
atggccctctttctcagtaagagactgttgagatttaccgtcattgcaggtgcggttattgttctcctcctaacattgaattccaacagtagaactcagcaatatattccgagttccatctccgctgcatttgattttacctcaggatctatatcccctgaacaacaagtcatctctgaggaaaatgatgctaaaaaattagagcaaagtgctctgaattcagaggcaagcgaagactccgaagccatggatgaagaatccaaggctctgaaagctgccgctgaaaaggcagatgccccgatcgacactaaaacaaccatggattatatcactccatcttttgctaacaaagctggtaagccaaaagcttgttacgtcactttggtgagaaacaaggagttgaaaggtttgctaagctccattaaatatgtggaaaacaaaattaacaagaaattcccatatccttgggttttcctaaacgatgaaccttttactgaagaattcaaggaagcagtcaccaaagctgtttcttccgaagttaagtttggtattttgcccaaggaacattggtcatatcctgaatggattaatcaaaccaaggctgctgaaattcgtgcagatgctgccaccaaatacatatacggtggctccgaatcttatagacacatgtgtcgttaccaatctgggtttttctggagacatgaattattagaagagtacgattggtactggcgtgtggaaccagacatcaagttatactgtgatattaattacgacgtttttaagtggatgcaagaaaacgaaaaagtttacggctttaccgtttctattcatgaatatgaagtgacgatcccaacactatggcaaacgtccatggatttcatcaaaaagaaccccgaatacttagatgaaaacaacctgatgagttttctttcgaacgataatggtaaaacatacaatctgtgccatttctggtcaaactttgaaattgcaaacttgaatttgtggaggtcaccagcctacagagagtattttgacactttggatcatcaaggtggatttttctacgaaagatggggcgatgctcccgttcattctattgctgctgctttgtttttgccaaaggataaaatccattatttttcagacattggttaccatcatccaccttatgataactgcccattggacaaggaggtctataacagtaacaactgtgaatgtgaccaaggtaatgatttcactttccaaggttactcttgtggtaaggaatattatgatgctcaagggttggtaaagccaaaaaactggaaaaaattccgtgagtag

SEQ ID NO: 25385 - DNA, 1755 bp, Saccharomyces cerevisiae
atgggaatacacataccatatctcacgtcaaagacatcgcaatcaaatgttggtgatgccgttggcaacgctgatagtgtagagttcaacagtgagcatgactcaccttcaaagagaggtaaaattacacttgagtcacatgaaatacagagggctcccgctagcgatgatgaagataggattcaaattaaacccgtgaacgacgaggatgacacgtcggtcatgatcacttttaaccaatctctttcgcccttcatcatcactctgacttttgtcgcatccatatccggtttcatgtttggttacgacactggttatatatccagtgcgctgatctcgatcggcacagatctggaccacaaggtacttacttatggggagaaggaaattgtcactgcggctacctctctgggagctttgattaccagtattttcgccggtactgcagctgacatatttggtaggaaacgttgtttaatgggttcgaatctgatgtttgtcattggcgcaatcttacaggtctccgcacacacattctggcaaatggctgttggtagactgatcatgggtttcggtgtcggtatcggctccttgatcgcgccacttttcatcagtgaaattgctcccaaaatgatcagagggagactaactgtcatcaattccttatggttgactggtggtcaattagtcgcttacggttgcggtgctgggttaaactacgtcaacaatggttggagaattcttgttggattgtcactaattcccactgctgtgcaattcacatgcctgtgctttttacctgacactccaagatactacgttatgaagggcgacttggcaagggctactgaggtgttgaagagaagttacactgacacttcggaggaaatcattgaacgtaaggtggaagaacttgttactttgaatcaatctattcctggtaagaatgtccctgaaaaagtctggaataccatcaaagaattgcacacagtaccatctaatctaagggctttgatcattggttgtggtttacaagcaattcaacagtttaccggttggaattcgttgatgtatttctctggtaccatcttcgaaactgtcggtttcaaaaattcttccgctgtttcaatcatcgtgtccggtaccaattttattttcactttagttgcctttttttccattgacaaaataggccgtagaaccatattattgattggattaccaggcatgaccatggctttagtcgtgtgctctattgctttccattttctaggtattaagtttgatggcgctgtcgctgtggtggtttcctccggtttctcctcttggggtattgtgatcatcgtatttattatcgtatttgctgcgttctacgctcttggtatcggtactgttccatggcaacaatcggaactattcccccaaaacgtgagaggtattgggacttcatatgcaactgctacaaactgggctggttcactggttattgcatccacatttttgaccatgttacagaatatcactcctgcaggtacatttgcctttttcgcgggattgtcgtgcttatcaaccattttctgctacttctgttatccagaattatcgggattggagttagaagaggtacaaactattttgaaggacgggttcaacatcaaagcctcgaaagctttggccaagaagagaaaacagcaagttgccagagttcatgaattgaaatatgaaccaactcaagagattatagaggatatatag

SEQ ID NO: 25386 - DNA, 1155 bp, Saccharomyces cerevisiae
atgtccaagagcaaaactttcttatttacctctgaatccgtcggtgaaggtcacccagacaagatttgtgaccaagtttctgatgctattttggacgcttgtttagaacaagatccattctccaaggttgcctgtgaaacagctgccaaaactggtatgattatggttttcggtgaaattaccaccaaagctagacttgactaccaacaaatagtaagagataccatcaagaagattggttatgacgattctgccaagggtttcgactacaagacatgtaatgttttagtagctatcgaacaacaatctccagatatcgctcaaggtctgcactatgaaaagagcttagaagacttaggtgctggtgaccaaggtataatgtttggttacgctacagacgaaactccagaagggttaccattgaccattcttttggctcacaaattgaacatggctatggcagatgctagaagagatggttctctcccatggttgagaccagacacaaagactcaagtcactgtcgaatacgaagacgacaatggtagatgggttccaaagaggatagataccgttgttatttctgctcaacatgctgatgaaatttccaccgctgacttgagaactcaacttcaaaaagatattgttgaaaaggtcataccaaaggatatgttagacgaaaataccaaatatttcatccaaccatccggtagattcgtcatcggtggtcctcaaggtgacgctggtttgaccggtagaaagattattgtcgacgcttacggtggtgcctcatccgtcggtggtggtgccttctccggtaaggactattccaaggtcgatcgttccgctgcttacgctgctagatgggttgccaagtctctagttgccgctggtttgtgtaagagagtccaagtccaattttcatatgctattggtattgctgaaccattgtctttacatgtggacacctatggtacagctacaaaatcagatgacgaaatcattgaaattattaagaagaacttcgacttgagaccaggtgtgttagtaaaggaattagatttggctagaccaatttacttaccaaccgcttcttatggtcacttcactaatcaagagtactcatgggaaaaaccaaagaaattggaattttaa

SEQ ID NO: 25387 - DNA, 3429 bp, Saccharomyces cerevisiae
atggcaatcaatggtaacagtattcctgccataaaggataataccatcggtccatggaaactaggtgaaactctcggtctagggagcactggtaaagtccagcttgctcgtaatggatccacaggacaagaggcggcagttaaggtaatatcaaaagcagtattcaataccggtaatgtcagcggtacttcgattgttggctccaccaccccagatgctctaccatatggtatagaacgcgaaataatcattatgaagttgttaaaccacccaaatgtgttacgtttatatgatgtctgggaaacaaatacagatttataccttgttttagaatacgcggagaaaggtgagttgttcaacttattggttgagagaggtcctctgccagagcatgaagctatcaggttttttagacaaattattattggtgtgtcgtactgtcatgcgttgggtattgtccatcgtgatctaaaaccggaaaatctattattagatcataaatataacatcaagattgcagattttggtatggctgctttggaaactgaaggaaagctactggagacgtcgtgcggatcaccacattatgctgcaccagaaattgtatctggtataccgtatcaaggtttcgcaagtgatgtgtggtcatgcggtgtgatcctattcgcccttcttactggtcggttaccctttgacgaggaagatggaaatataagaacactattacttaaagttcaaaaaggtgagttcgaaatgccttctgatgatgaaatttcgcgtgaagctcaggatttgattagaaaaatcttaaccgttgatcctgaaagaagaatcaagaccagagatatactcaaacatccgctattacaaaaatatccaagtataagagattctaaaagtattagaggcttaccaagagaagacacatatctcacgccattatcagaaagtaattcttctattgacgctacgattttgcaaaatttagtaatattatggcatggaagagatcctgaaggaattaaggaaaaactaagagaacctggcgctaatgcagaaaagacattatatgcactactgtatagatttaagtgtgacactcaaaaagagcttattaagcaacagcaagttaagaagaggcagtcaattagtagcgtttctgtttccccatctaaaaaagtatcgacaactccacaacgcagaagaaatagagaatctttaattagtgtaacatcttctcgtaaaaagccaatatccttcaacaaattcactgcctccagtgcctcctccagcaatctaactacacccggttcttcaaaacgcctttcaaaaaacttctcttcaaagaagaaattatctacaatcgttaaccaatcttctccaacaccagcatcacgtaataaaagagcttcggttataaatgtggaaaagaatcaaaaaagagcctctatcttttctactaccaagaagaacaaaagatcttctagatctatcaagagaatgtcattgataccaagcatgaaacgtgaatcggtgacaacaaaattaatgtcaacatatgcgaaattggcagaggatgacgattgggaatacattgagaaggaaacaaagagaacgagctcaaattttgcaactttgatagatgaaatttttgagtacgaaaagtacgaacaaataaggaaagagaaggaagagctagaacgtaaagtgagagaagcaaaagcacgtgaagagctggaacgtagaagacgtaaacaagaagaaaaagaacgtgcaagaaaattactagaaaaggaagatctgaaaagaaaacaggaggaactcaagaagcaaattgaaattgatataagtgatctagagcaagagctgtccaaacacaaagaggaaaaactggatggtaatattagatctatctctgctcctatggaaaatgaagagaaaaatatcaatcatttggaggttgatattgacaatattctccgtcgccgcaacttttctttacaaactagacctgtgtcaaggcttgatccgggtataatgttctccagtccaactgaggaagtaagtccagtggaaccaaagagaacagaaaatgaaagacttacaacagaaaagaaaattttagaaactatcagaagatcaaaattcttgggttcatcatttaatatcgataaagagttgaaattgtctaaaatggaatatccaagtataattgcaccacaaagattgtcagaggagcgagtggtgtcagattctaatgatggatatgaatctttgatcctcccgaaggatgggaatggcgtatctcaattaaaggatagtaccgcaacaactgctcccgtctctgatggtaggttgaggaagatctctgaaattagagtaccacaatttactagaaaatcaaggcattttagtgagtccaataaaaggctatctgtcctgtcgatgtactctaccaaggagtcgtttaccaacttggttgatattttgaaaaacggtaaccttgatgtcaataaccaacaaagccaaagaattccaacaccaagaagtgcggatgattcagaatttctttttgaaactgtcaacgaagaagctgaatatacaggaaatagttcgaacgatgagagattgtacgatgtcggtgattccactatcaaagacaaatccgcgttaaagctgaactttgcagatcgttttaatggatcgaacgaagcgaaacaaactgataacttacatcttccgatccttcctccgcttaatggtgacaatgaattgcgtaaacagaatagccaagagggtgaccaggcacatccaaagattaaatcgatgataccagaatcaggctcttcttcacatactgaaaaggaagaagaaaatgaggaaaaggaagagaaaaagccagaacaacacaaacaagaagaggatcaagaaaaaagagagaaagtagtagatgatatggagccaccattgaacaaatctgtgcaaaaaattagggaaaaaaatgctggctcgcaggcaaaggatcattcaaaagatcacttaaaagagcataagcaggataaaaatacagcaattggaaatggttccttctttagaaaattctcaaaatcttcggacaaaacaatggaattgtatgccaagatttctgcaaaacaattgtttaatggtttagagaagctgttgcgtggttggactcagtatggtttaaaaaatataaaatcgcaccccaacaatctgaccttaacgggtaaactatcgagtgataatatattctcactacgttcaacactctttgaggttaatatttatccgagaggtaagatgagcgttgtgcagttcaagaaagtttctggttcattcaaagctgtcaaaaagttggtcaatgaagttgagaacgtcctgaataaggaaggcgttctacaaaaatag

SEQ ID NO: 25388 - DNA, 1992 bp, Saccharomyces cerevisiae
atgacgcttggtaatagacgccatgggcggaataatgagggaagctctaatatgaatatgaatcgtaacgaccttgacgatgtttcccattacgagatgaaggaaatacaaccaaaggaaaaacaaattggctctatagaaccggaaaatgaagtagaatattttgaaaaaacagtggaaaaaaccattgaaaatatggaatatgaaggtgaacatcatgcatcttacttacggaggttcattgactcgtttagaagagcggaaggctcgcatgcaaattccccagactcgagcaactctaatgggactactcctatatccacaaaagattccagctctcaattggacaatgagttgaatcggaagagctcatacatcactgttgatggtattaaacagtcaccacaagaacaagaacagaaacaagaaaatttgaaaaagagtataaagccccgtcatacggtgatgatgtccctagggactggtattggtactggtttgctggtcggtaactccaaagttttgaacaatgcaggtccgggtggtttgatcattggttatgctattatgggtagttgtgtttactgtattattcaagcttgtggtgaattagcggttatatacagtgatttgattggtggatttaatacatatcctttgtttttggtcgaccctgcacttggcttttctgttgcttggcttttttgcttacaatggctatgtgtttgtcctctagaattggtcactgcatccatgactatcaaatattggacgacatctgtgaacccggatgttttcgttgttatcttctacgtactaatcgttgttatcaacgtttttggagctaagggttatgcagaggcagatttcttcttcaattgttgtaaaattctgatgatagttggatttttcattctcgccattattattgattgtggtggtgcaggtaccgatggttacataggtagcaaatattggcgtgatcccggagccttccgtggtgatacacccatccagaggttcaaaggtgtcgttgccacatttgtcacagcagcgttcgcctttggtatgagtgaacagctggctatgactgccagtgaacaatccaatccaagaaaggctattccatcggcggcaaagaaaatgatttatagaattctgtttgtgttcttggcgtctttaacgttagttggtttccttgtaccttacacctcagatcaattgctaggggccgcaggttcagccactaaagcgtcgccctacgtcatcgctgtctcctctcatggtgttcgtgtggttcctcatttcataaacgctgtcatcctgttgtctgttctttccgttgctaacggtgccttctataccagttctcgtattttgatgtcgttggccaaacaaggtaatgcacccaaatgtttcgattacatcgatagggaaggtagacctgctgctgctatgcttgtcagtgcattatttggtgtcattgcattctgtgcctcatctaaaaaggaagaggacgttttcacctggttgttagcaatctccggtttgtctcaattattcacgtggattaccatttgtttgtctcacattaggtttagaagagctatgaaagtgcaaggaaggtccttaggagaggttggttataaatctcaagtcggtgtctgggggtcggcttacgctgtccttatgatggtgttagctttaatcgcccaattttgggttgccattgccccaattggtggaggaggtaagttaagtgcccaatcattttttgagaattatttggctatgccaatctggattgctttatacatcttttacaaagtttggaaaaaagattggagtttattcattcccgctgataaagtagacttagtttctcatagaaacatctttgatgaagaattattaaaacaagaagatgaagaatataaagagagattaagaaacggaccatactggaaaagagttcttgatttctggtgttaa

SEQ ID NO: 25389 - DNA, 1503 bp, Saccharomyces cerevisiae
atgtcatttgaaaatttacataaagtcaatgctgaggcattggaagatgcagtggttgagatctgctcctcattgcaggttgatgcagcaaagttggacgaactaacagcgtacttcattgaatgtatggaaaaggggttgaataacacctctgtaggcgaagaaaagacggtggacaagggtctacccatgatccctacatatgtaaccagtttgcccaatgggacggaacgtggtgttttgctggctgcagatttaggtgggactcacttcagagtgtgttctgtgactttgaatggtgacggaacctttgatatgcagcaattgaagtctaagattccggaagaatatctaaatgacaaggatgtcaccagcgaggagctgtttagctacctgggtcgccgtacaagggccttcgttaggaagcatcatcctgagttgttgaagtccacgggggagaacataaaacctttgaaaatgggatttaccttctcatatcccgttgaccaaacctctttgagttccggtactttaatcagatggaccaaaagcttcaagattgaagacacggtcggcaaggatgtcgtgaggttataccaggagcaattagacattcaggggctctctatgattaatgtggtagctttgaccaacgacacggttggcactttcctatcccactgctacacttcaggctctcgtccatcgagtgctggtgagattagcgagcctgtcattggttgtatctttggtactggtactaacggttgctatatggaggatattgaaaacatcaagaagctaccagatgagctcagaacaagactgctgcatgaaggaaaaacccaaatgtgcatcaacatcgaatggggttctttcgacaatgaattgaaacatttgtctgctacaaagtatgacatcgatattgaccaaaaattttctccaaatccaggttaccatctatttgaaaaaagaatttccggcatgtacttgggtgagctgttaaggaacatcctggtggacttgcatgcaaggggcttaatcttgggacagtatcgtaattacgatcaattacctcaccgtttaaagactcctttccaattgtgcagtgaagttctttccaggattgaaatcgatgattcgacaaacttgcgtgaaactgaattgtcgtttttgcagagtttgaggctaccgaccacttttgaagaacgtaaagcaattcaaaatctggtccgttccattacgagaaggtctgcatatctagcagccgttccgattgccgccatcctaatcaagacaaacgctttgaacaaaagatatcacggtgaggtagaaattggttttgacggttatgtcatcgaatactatcctggattcagatccatgctgagacatgctttggcattaagtccaattggcactgagggtgaacgtaagatacatttgcgtctagccaaagatgggtccggtgttggcgcagctttgtgtgctctggtggcataa

SEQ ID NO: 25390 - DNA, 1473 bp, Saccharomyces cerevisiae
atggaaagcaaagaaatatcaattaggtcaagaacccctccatcgaagctatattccatccaatcatgtattggcagaggtaactttggtgatgtgtataaagcagtggatagagttacgcaagaaattgtggcaattaaggtggtcaacctggagcattccgacgaagacattgaactgttagcacaggaaattttttttctggcggaattgaaatctcctcttattacaaactatattgcaacaatgttagaagatgtctctatgtggattgtcatggaatattgcggcggtggatcatgttcagatttactgaagcgaagttacgtcaacggtttgcctgaagaaaaagtttccttcattattcatgaagtcaccttgggtttgaaatacctgcatgagcaaaggaaaattcatcgtgatatcaaagcagctaatattttactaaatgaagaaggtatggttaagttgggtgatttcggagtaagtggccacattcgttccactttgaaaagggacacttttgtaggaacgccgtattggatggctccggaagttgtttgctgcgaagttgatgggtataatgagaaagcagatatatggtccttgggtatcaccacctatgagttactcaagggcttacccccattatctaaatatgatcctatgaaagttatgactaacttaccaaaaaggaagcctccaaaattacaaggtcccttttcggatgcagcaaaggatttcgtagctggttgtcttgttaaaacacctgctgatcggccatcggcatataacttgttatcatttgaatttgttaagaatatcaccataacgaacttgaaaagtgatgttgatctaattaaacagaaaaaggttcaggagagatatacaaaagttcccaaataccctcttcaaaatcgcttgtataaaaacagcaacacagtgaggggaaaggaattttggaattttgaatcgacaagactaagcacaacacaaatttccaaagaggaattatctcccattacacaagactctccaacatcatctttaaatatggaaagtccttatttacttcatgggcaaactgtaacgccgataaccaacccaagttcttcatcatttagaaaatgtacgcaaccagttttcgagcttgattcaggaatggatatagattcaggctgcccaaatgctcaagcagagaccgaaatagttcctctctctaatcataataagaagcataaaaagaacgatattcaggcgttgaagatagaaaagtttgactacttgaaaaacattgtatctcatattctcaacagaatgtatgatcgtgcgcgcgacgatgaaacaagaaaatacgtaaatgaaatgttaaagcaattcattaaaactgaggcaaacgttcctggatttaatgaggtttttatagaagagatctcactaagaattgaagcaataaagaaaggattcgtttaa

SEQ ID NO: 25391 - DNA, 1710 bp, Saccharomyces cerevisiae
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcaccggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttga

SEQ ID NO: 25392 - DNA, 1491 bp, Saccharomyces cerevisiae
atgacggccgcacatcctgttgctcagttaactgccgaggcataccctaaagtcaagagaaacccaaatttcaaagttctcgactcggaagatttggcgtactttcgttcgattttgtcaaatgatgaaatcttaaactctcaagctccagaagagcttgcttcgtttaaccaggactggatgaaaaaatatagaggccagtccaatttaattctcttgccaaactccactgataaagtgtccaagattatgaaatactgtaacgataaaaagttggcagtagtaccacaaggtggtaacaccgacttggtcggagcctctgttccggtatttgatgagattgttctttctctaagaaatatgaacaaagtcagagattttgatccagttagcgggactttcaagtgtgacgcgggtgtcgttatgcgtgatgcgcatcaatttttacacgaccatgaccatatcttcccattggatctgccttctagaaacaactgtcaagtgggcggtgtagtttcaacaaatgcaggtggtttgaactttttaagatatgggtctctacacggtaatgttttgggtttggaagtggtgctacccaacggtgagattatcagcaatatcaatgccctaaggaaggacaatactggttatgacttgaaacaattattcatcggtgcagagggtactatcggtgtcgttactggtgtatccatagttgcagcagcaaagccaaaagccttgaatgccgtattttttggtattgagaatttcgataccgttcagaaattatttgtcaaggctaaaagtgaattatctgagattttatctgcttttgaattcatggaccgtggctccattgaatgtacgatagaatacttgaaggacttgcctttccctctggagaaccaacacaacttttatgttcttattgaaacgtcagggtccaataagagacacgacgatgagaagctgactgctttcctcaaagataccacagattctaaattaatttcggagggtatgatggctaaggacaaagccgattttgatagactttggacctggagaaaatctgttccaacagcttgtaattcttacggtggtatgtacaagtatgacatgtcacttcaattgaaagatttatattccgtatctgcggctgtgacggagagattaaacgcagccggtttgattggtgatgcaccaaaaccagttgttaaatcatgtggttatggtcatgtcggtgacggaaacatccatttaaatatcgcggtaagagaatttacaaaacagattgaggacttactagaaccatttgtttatgaatatattgcatcaaagaaaggttccatcagtgctgagcatgggatcggtttccataagaaaggtaagttacactacaccagaagtgatattgaaattagatttatgaaggatatcaaaaatcactacgatccaaatggaatcttaaacccatacaagtacatttga

SEQ ID NO: 25393 - DNA, 1695 bp, Saccharomyces cerevisiae
atgtctagtgcgcaatcctctattgatagcgatggagatgttcgagatgctgatattcatgtcgcaccacccgtggaaaaagagtggtcagatggatttgatgacaacgaagtcataaacggggataacgttgagccaccaaaaagagggctcataggttatcttgtcatttacttactgtgttatccaatatcctttgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggccttatttttgcccgtcttgctgatactttaggtagaaggctggcaattgtgatcgtggtgttggtatatatggttggtgcaattattcagatcagttcaaatcacaaatggtaccagtactttgtcggtaagatcatctacggtcttggtgctggtggctgttcggtgttgtgtccaatgcttttgtctgaaatagcccccacagatttgagaggtggactggtctcattgtaccaactgaacatgacgttcggtattttcttgggttattgtagcgtttatggtacgagaaaatacgataacactgcacaatggagagtcccccttgggctttgctttttatgggctttgattatcatcattggtatgttattggttccagagtccccaagatatctgattgaatgtgagagacacgaagaggcccgtgcttccattgccaaaatcaacaaggtttcaccagaggatccatgggtactcaaacaggctgatgaaatcaacgccggtgtccttgcccaaagggaactaggagaagcttcatggaaagaacttttctctgtaaaaactaaagtccttcaacgtttgatcacaggtattcttgtgcaaacctttttgcaacttactggtgaaaactacttcttcttctacggaactaccatttttaaatcagtcggtcttactgatgggtttgagacgtcgatcgtcctaggtacagtgaacttcttctccactattattgctgttatggtcgtagacaaaattggccgtcgtaaatgtctgttatttggtgcagctgggatgatggcttgtatggtcatatttgcaagtatcggggtgaaatgtctttaccctcatggccaggacggtccttcttcgaaaggtgcaggtaatgccatgattgtgttcacttgtttctatatattctgctttgcaacgacatgggctcctgttgcttatattgtggttgccgagtcgttcccttcgaaggtcaagtctagagccatgtcgatttcaactgcatgcaactggttatggcaatttttgatcggttttttcacaccattcattactgggtctatccacttctattatggttatgtgttcgtaggttgtttggttgctatgtttttgtacgttttcttctttttaccagaaacgattggtctatctttggaggaaatccaattactatacgaagaaggtataaaaccatggaaatctgcatcttgggtcccaccttctaggagaggtatttcttccgaagaaagtaagaccgagaagaaggattggaagaaatttttgaagttctcaaagaattctgattga

SEQ ID NO: 25394 - DNA, 1773 bp, Saccharomyces cerevisiae
atgacaaattcaaaagaagacgccgacatagaggagaagcatatgtacaatgagccggtcacaaccctctttcacgacgttgaagcttcacaaacacaccacagacgtgggtcaataccattgaaagatgagaaaagtaaagaattgtatccattgcgctctttcccgacgagagtaaatggcgaggatacgttctctatggaggatggcataggtgatgaagatgaaggagaagtacagaacgctgaagtgaagagagagcttaagcaaagacatattggtatgattgcccttggtggtactattggtacaggtcttttcattggtttatccacacctctgaccaacgccggcccagtgggcgctcttatatcatatttatttatgggttctttggcatattctgtcacgcagtccttgggtgaaatggctacattcatccctgttacatcctctttcacagttttctcacaaagattcctttctccagcatttggtgcggccaatggttacatgtattggttttcttgggcaatcacttttgccctggaacttagtgtagttggccaagtcattcaattttggacgtacaaagttccactggcggcatggattagtattttttgggtaattatcacaataatgaacttgttccctgtcaaatattacggtgaattcgagttctgggtcgcttccatcaaagttttagccattatcgggtttctaatatactgtttttgtatggtttgtggtgctggggttaccggcccagttggattccgttattggagaaacccaggtgcctggggtccaggtataatatctaaggataaaaacgaagggaggttcttaggttgggtttcctctttgattaacgctgccttcacatttcaaggtactgaactagttggtatcactgctggtgaagctgcaaaccccagaaaatccgttccaagagccatcaaaaaagttgttttccgtatcttaaccttctacattggctctctattattcattggacttttagttccatacaatgaccctaaactaacacaatctacttcctacgtttctacttctccctttattattgctattgagaactctggtacaaaggttttgccacatatcttcaacgctgttatcttaacaaccattatttctgccgcaaattcaaatatttacgttggttcccgtattttatttggtctatcaaagaacaagttggctcctaaattcctgtcaaggaccaccaaaggtggtgttccatacattgcagttttcgttactgctgcatttggcgctttggcttacatggagacatctactggtggtgacaaagttttcgaatggctattaaatatcactggtgttgcaggcttttttgcatggttatttatctcaatctcgcacatcagatttatgcaagctttgaaataccgtggcatctctcgtgacgagttaccatttaaagctaaattaatgcccggcttggcttattatgcggccacatttatgacgatcattatcattattcaaggtttcacggcttttgcaccaaaattcaatggtgttagctttgctgccgcctatatctctattttcctgttcttagctgtttggatcttatttcaatgcatattcagatgcagatttatttggaagattggagatgtcgacatcgattccgatagaagagacattgaggcaattgtatgggaagatcatgaaccaaagactttttgggacaaattttggaatgttgtagcatag

SEQ ID NO: 25395 - DNA, 3117 bp, Saccharomyces cerevisiae
atggtatggccagaaagtaacgttgagtatagatacagaagcaagcaattcaaaggaaaaagtaataaaaagtatataaaagcgcaaaaaatacaacaagaaagaatttgtttgatgccagcggaaaaccaaaatacgggtcaagatagaagctccaacagcatcagtaaaaatggcaactctcaggttggatgtcacactgttcctaatgaggaactgaacatcactgtagctgtgcgatgcagaggaaggaatgaaagggaaattagtatgaaaagctccgttgtggtaaatgttccagatattacaggttctaaagaaatttccattaacacgacgggagataccggtataactgctcaaatgaatgccaagagatacacagtggacaaagtcttcggtcccggcgcttcccaggatctaatttttgatgaagtggcgggcccattattccaggatttcattaaaggttacaattgcaccgtactggtatatggtatgacgtcaacaggtaaaacatatacaatgacgggcgacgaaaagttatataatggtgaattgagcgatgcagcaggaattataccgagggttcttttgaagttgtttgacacattggaactacaacagaacgattacgtagtaaaatgttcgttcattgaactctacaacgaagaattgaaggacctcttggacagcaatagcaacggctctagtaatactggctttgacggccaatttatgaaaaaattgaggatttttgattcaagcacagcaaataataccactagcaacagtgctagtagttccaggagtaattctaggaacagttctccgaggtcattaaatgatctaacacctaaagctgctctattaagaaaaaggttaaggacaaaatcactgccgaataccatcaagcaacagtatcaacaacaacaggcagtgaattccaggaacaactcttcctctaactctggctctaccactaataatgcttctagtaacaccaacacaaataacggtcaaagaagttcgatggctccaaatgaccaaactaatggtatatacatccagaatttgcaagaatttcacataacaaatgctatggaggggctaaacctattacaaaaaggcttaaagcataggcaagtagcgtccactaaaatgaacgatttttccagtagatctcataccatttttacaatcactttgtataagaagcatcaggatgaactatttagaatttccaaaatgaatcttgtggatttagctggttcagaaaacatcaacagatccggagcattaaatcaacgtgccaaagaagctggttcaatcaaccaaagtctattgacgctgggcagggtcataaacgcactcgtagataaaagcggccatatacctttccgtgaatcgaaattgacccgcctgcttcaagattccctgggtggtaatacgaaaaccgcactaattgctactatatcgcctgcaaaggtaacttctgaagaaacctgcagtacattagagtatgcttcgaaggctaaaaacattaagaacaagccgcaactgggttcatttataatgaaggatattttggttaaaaatataactatggaattagcaaagattaaatccgatttactctctacaaagtccaaagaaggaatatatatgagccaagatcactacaaaaatttgaacagtgatttagaaagttataaaaatgaagttcaagaatgtaaaagagaaattgaaagtttgacatcgaaaaatgcattgctagtaaaagataaattgaagtcaaaagaaactattcaatctcaaaattgccaaatagaatcattgaaaactaccatagatcatttaagggcacaactagataaacagcataaaactgaaattgaaatatccgattttaataacaaactacagaagttgactgaggtaatgcaaatggccctacatgattacaaaaaaagagaacttgaccttaatcaaaagtttgaaatgcatattactaaagaaattaaaaaattgaaatctacactgtttttacaattaaacactatgcaacaggaaagtattcttcaagagactaatatccaaccaaatcttgatatgatcaaaaatgaagtactgactcttatgagaaccatgcaagaaaaagctgaactaatgtacaaagactgtgtgaagaaaattttaaacgaatctcctaaattcttcaatgttgttattgagaaaatcgacataataagagtagatttccaaaaattttataaaaatatagccgagaatctttctgatattagcgaagaaaataacaacatgaaacagtacttaaaaaaccattttttcaagaataaccatcaagaattactgaatcgtcatgtggattctacttatgaaaatattgagaagagaacaaacgagtttgttgagaactttaaaaaggtcctaaatgaccaccttgacgaaaataaaaaactaataatgcagaatctgacaactgcaaccagcgcggttattgatcaagaaatggatctgtttgaacccaagcgcgttaaatgggaaaattcatttgatctgataaatgattgtgactccatgaataacgaattctataatagcatggcagcgacgctatcgcaaatcaagagtactgttgatacatcatcaaattcgatgaatgagtctatttcagtcatgaaaggacaagtggaagaatcggagaacgctatatcccttttgaagaacaataccaaatttaatgatcaatttgagcagcttattaacaagcataacatgttgaaagataacattaaaaattcgataacatcaacacactctcatataactaatgtggatgatatctataatacgattgaaaacataatgaaaaactatggtaacaaggaaaacgctaccaaagacgaaatgatcgagaacatattgaaggaaataccaaatctaagtaagaaaatgccgttaaggttatcaaacataaatagcaattcagtgcaaagtgtaatatcgcccaaaaagcatgcaattgaagatgaaaacaaatccagtgaaaatgtggacaatgagggctcgagaaaaatgttaaagattgaatag

SEQ ID NO: 25396 - DNA, 1206 bp, Saccharomyces cerevisiae
atggaaaaccaagagaaaccgctttctgtagacgaggagtacgatttatggaaatccaatgttccattaatgtatgactttgttagcgagacacgtttaacatggccatctttaaccgtccaatggctccctactcctgttcaagaattagatggtggctttattaaacaagaattaatcatcggtacgcacacttctggtgaagaagaaaactatttgaaattcgcagaaattaatctaccaaaggaaattcttagtaatgaagacccacaagaagaagcaggagaggagtatcagtcctctctacctgctcctaggtcaaatataaggattaccgctaaatatgagcacgaagaagaaatcactagagcccgatatatgcctcaagaccctaatattgtcgccacaataaatgggcaaggcacagttttcctctattctcgctcagaaggtcttcagtcaacactaaaatttcataaggataacggttatgctttatcatttagcactttggtcaaagggcgattgctttccggctcagatgatcatacagtcgctctctgggaagtggggagtggcggtgaccctacaaaaccagtacgaacttggaatgatttacattctgatattattaatgataataaatggcacaacttcaataaagatctattcggcactgtttcagaagattctctcttaaaaataaatgacgtcagggcaaacaatactacgatcgatactgtgaaatgcccgcaacctttcaacacattagcatttagtcatcattcctcaaacctccttgcggccgcaggtatggactcgtatgtttatctatatgatctaagaaacatgaaggaaccattacaccatatgtcgggtcatgaagatgcagtgaacaatttggaattttcaacccatgttgacggtgtagttgtatccagcgggtcagacaatagattgatgatgtgggatttgaaacaaattggagcagaacaaacacctgatgacgcggaagacggcgttcctgaattgatcatggtccacgcaggtcacagaagttcagtgaatgattttgatttgaaccctcaaataccttggttggtagcaagtgctgaagaagaaaatattttacaagtttggaagtgttcccatagtctacccatcgtgggaggtccaccaaaggtgaacaaggatataataagctaa

SEQ ID NO: 25397 - DNA, 771 bp, Saccharomyces cerevisiae
atgtctggtaatagagagcaagtctttcctacgcgtatgacgctgggtttgatgaagaccaagttaaaaggtgccaaccaaggttattctttactaaagcgtaagtctgaagccctaacaaagagattcagagatattaccaaaagaattgatgatgctaagcaaaagatggggagagttatgcaaactgctgccttttccttggccgaagtttcctatgcaacaggtgaaaacattggctatcaagtgcaagaaagtgtctctactgcaagattcaaagtgagagcacgtcaagaaaacgttagtggtgtgtatttgtctcaatttgagtcctacatcgaccctgaaattaatgatttcagattaactggtttaggtagaggtggtcaacaggttcaacgagccaaggaaatctattcaagagccgttgaaactttagttgaattagcctctttacagactgcatttattattttggatgaagtgattaaagtgacgaacagaagggttaatgctatcgaacacgttattatcccaagaactgaaaacacaattgcttacattaacagtgagttggatgagttggacagagaagaattttatagattgaaaaaggtccaagaaaagaagcaaaatgagactgcaaaattggatgctgagatgaaattgaagagagatagagcagaacaagatgcttcagaagtagctgctgatgaggaacctcaaggtgaaacattggttgctgatcaagaagacgatgttatattctga

SEQ ID NO: 25398 - DNA, 1182 bp, Saccharomyces cerevisiae
atgttggtgctagggtctcttagatcggcgctgtcgtgcagttccacagcatcgcttattagtaagagaaacccttgttatccatacggtatactctgtcgaactctatctcagagtgttaaattgtggcaagagaatacttcaaaagatgactccagtttgaacattactccacgattactaaagattatacctaacgatactgatatcgtgactcttgagaagcaggatgaattgattaaaagacgtcgtaaactttcgaaagaagtgacccagatgaagaggctaaaacccgtctcacctggtttgagatggtaccgttcccccatttatccatatttgtacaaaggtcgtccggttagagccctaactgttgttcgaaagaagcacggtggtagaaataattcaggaaaaatcactgtccgtcaccaaggtggtggccatagaaatagaacgaggctgatagactttaacagatgggaaggtggtgcacaaacggtgcaaaggattgagtacgatccgggtagatcctctcatatcgccctattgaagcataatactaccggcgaattgtcttatattattgcttgtgatgggttacgcccaggcgatgtggtcgaatccttcagaagaggtattcctcaaactttactgaatgaaatgggcgggaaagtagaccctgctatcttgagtgttaagactacccaaagaggcaactgtctacctatttccatgatccccataggtactattattcacaacgttggcataacacccgttggacctggaaaattttgtcgctctgctggtacatatgccagagtccttgcgaaattacctgaaaaaaagaaagctattgttagattacaaagcggtgaacatcgttatgtgtctttagaggctgtcgctaccattggcgtggtctccaatattgaccatcaaaacagatctcttggtaaagccggcagatcaagatggttagggataagacccactgttagaggtgttgccatgaataaatgtgaccatcctcacggtggtggccgtggtaaatccaagtctaataaattatcaatgtctccatggggacaactggcaaaggggtacaagactagaaggggtaaaaatcaaaatagaatgaaagtaaaagacagaccaagaggcaaagatgcaagattataa

SEQ ID NO: 25399 - DNA, 1413 bp, Saccharomyces cerevisiae
atgtctctctctcccgttgttgttattggaaccggtttggccgggctggctgctgccaatgaattggttaacaagtataacatccctgtaaccatcctcgaaaaggcttcctcgatcggtgggaactctatcaaggcctccagtggtattaacggtgcttgcaccgagactcaacgtcacttccacatcgaggactccccacgcttatttgaagatgacaccatcaagtctgctaaaggtaaaggtgtccaagaattaatggctaagttggccaatgattctcccctggctattgaatggttgaaaaacgaatttgatttgaaattggacctattggctcaattgggtggccactctgtggcaagaactcacagatcgtctgggaagttgcctccaggtttcgaaattgtttctgccttatctaacaatttgaagaaattagctgagactaaaccagagttagttaagattaacttagacagtaaagtcgtagacatccatgaaaaggatggctccatttctgctgtagtgtacgaggacaagaatggcgaaaagcacatggtgagtgctaacgatgtcgttttttgttctggagggtttggcttttctaaggaaatgcttaaagaatacgcacccgaactggtgaacttgccaacaacaaacgggcaacaaacaactggtgatggtcaaaggcttctgcagaagttaggcgctgatctgattgacatggaccaaattcaagttcatccaactgggttcattgatccaaatgaccgtagctcaagctggaaattcttggctgccgaatccttaagaggtcttggtggtatcctattaaaccctattaccggtagaagatttgtcaacgaattgaccacaagagatgtagtcactgcagctattcaaaaggtttgtcctcaagaggataacagagcactattggttatgggcgaaaaaatgtacacagatttgaagaataatttagatttttacatgttcaagaaacttgtacagaaattgacattatctcaagttgtttctgaatataatttaccaatcactgtcgcccaattatgcgaggaattgcaaacatactcttccttcactaccaaggctgatccgttgggacgtaccgttattctcaacgaatttggctctgacgttactccagaaactgtggtttttattggtgaagtaacaccggttgtccatttcaccatgggtggtgctagaatcaatgtcaaggctcaagtcattggcaagaacgacgaaaggctactaaaaggcctgtacgcggccggtgaagtttctggcggtgttcatggcgccaataggttgggtggttcaagtttgttagaatgcgttgtctttgggagaaccgcagctgaatctattgccaatgaccgcaagtaa

SEQ ID NO: 25400 - DNA, 1557 bp, Saccharomyces cerevisiae
atggcgcccatctttagaaattaccggttcgctatcggtgcttttgccgttattatgctcattttgttgattaaaacatcttccatcggtccaccttctattgcacgtacagttactcctaatgctagtattcccaaaactccggaggacatctctatcttgcccgtcaatgatgaaccaggttaccttcaagattcgaagactgaacaaaactatcctgagcttgccgatgctgtgaagtcacaaacaagtcaaacatgcagcgaagaacataagtatgttatcatgatcgatgccggctctaccggttcccgagtacatatatacaagtttgacgtctgtacttccccacctacattacttgatgaaaaattcgacatgttagagcctggtttatcttctttcgataccgattccgttggtgccgctaactcccttgacccattactgaaagtagcaatgaactatgtccctattaaggcaagaagttgtactcccgttgcggtgaaagctactgcaggcctaagactcttgggtgatgccaaatcttcaaaaattttgagcgctgtaagggatcatttggagaaggactatcctttcccagttgtcgaaggtgatggtgtttccatcatgggcggtgatgaagaaggtgtcttcgcctggattactacaaactacctattaggtaatatcggtgctaatggccccaagttacctactgctgccgtttttgacttaggcggagggtctacacaaattgtttttgagcctactttcccaataaatgaaaaaatggtcgatggtgagcataaatttgatttgaagtttggtgatgaaaattacaccttgtaccaattttctcatctaggttacggtttgaaggaaggaagaaataaagttaactctgttcttgtggaaaatgcattaaaagacggcaaaatattgaagggtgataacactaagactcatcaattgtcatctccatgcctaccgcctaaagttaatgccacaaatgaaaaggttacattagaatccaaggaaacttataccattgactttatagggccggacgagccaagtggtgcacaatgtagatttctgactgatgaaattttgaataaagatgctcagtgccagtctccaccatgctctttcaatggggttcaccaaccttctttagttcgtacattcaaagaatcgaacgatatctatattttctcttatttctacgacagaacccgtccattgggtatgcccttgtcctttactttgaatgaattgaacgatttggcaagaatagtgtgtaaaggcgaagaaacttggaatagtgtcttcagtggcattgcggggtccctagatgaattggaaagtgactcgcacttctgtttggacttatcttttcaagtgtccttattacatacgggatatgacattccattacaaagagaattgagaactggaaagaaaattgccaataaagaaatcggttggtgtttaggtgcgtcattaccattgttgaaagctgataactggaaatgtaaaattcaatcagcttga

SEQ ID NO: 25401 - DNA, 1197 bp, Saccharomyces cerevisiae
atggttagcttaacctttaaaaatttcaagaaggaaaaagttcctttagatctggaaccttcaaacacaattttagagaccaagaccaagcttgctcaatccatttcttgtgaagaatctcaaataaaactgatctactcgggtaaagtgctacaagattccaaaaccgtatcggaatgcgggctaaaagatggggaccaagttgtcttcatggtttctcaaaaaaagtccacgaagaccaaagtaacagaacctccaattgctcctgagagcgccactacccccggaagagaaaattctacagaagcatcccccagtacggatgcttctgcagctcctgcagccactgctcccgaaggctcacaaccgcaagaagaacaaaccgccactacagaacgtactgaatctgcctctacaccgggattcgtggtgggaaccgagaggaacgagaccatcgagagaatcatggaaatgggctaccaaagagaggaagtcgaacgagccttgagagcagcctttaataatccagatagagcggtggaatatctactgatgggtattccagaaaatctgcgtcaaccggaaccacagcaacaaacagccgccgcagcggaacaaccatcgacagccgccaccactgcggaacaaccggctgaagacgacttatttgcacaagctgcccaaggcggtaatgcttcatccggtgcgcttggcacaactggaggagctacagatgctgcgcaaggtggacctccaggttccattggcctcactgtagaagatttactatcgttgagacaggtcgtttcaggtaacccagaagctttagccccattgttggaaaacataagtgctagatatcctcaattacgtgaacatatcatggcaaacccagaagtgtttgtgtccatgttgctagaagccgtgggtgacaatatgcaagatgttatggaaggtgcggatgatatggtggaaggagaggatatagaagttacaggagaggctgctgctgcaggactgggacaaggtgaaggtgaaggttctttccaagttgactatacccccgaagacgatcaagctatttcgcgcctctgtgaattgggctttgaaagagatcttgttatccaggtgtattttgcgtgcgataaaaacgaagaagctgcagcaaatattctattcagcgatcatgccgactga

SEQ ID NO: 25402 - DNA, 2916 bp, Saccharomyces cerevisiae
atggaaggctcaacgggatttgatggagacgctactacttttttcgctccagacgctgtgtttggtgacagagtgcgcagatttcaagagtttttagatactttcacctcatacagagactctgtaaggtccatacaagtttacaacagcaataacgcggccaactacaacgatgatcaagatgacgcagacgaacgagatttgctaggtgatgacgacggtgatgatcttgaaaaggaaaagaaagcagcatcgtccacctcattgaatatactccctcacaggattatcatctcgcttgatgacttgagagaattcgacaggtcgttctggtcgggcattttagtcgaaccagcatacttcatcccgcctgccgaaaaggcgcttactgacctagcagattccatggacgatgttccacatcccaatgcctctgcagtatcgtctcgccatccttggaagctttcgttcaaaggctcatttggtgcacacgcattgtctcctcgtactctaacggcacaacatttaaacaaactggtctctgttgagggtatcgtaactaagacttcgttggtcaggccaaagcttatcagatctgtccactacgcggcaaagactggtagattccattacagagattatacagatgctactacaactctcaccacccgcatcccaacgcctgccatctatccaacggaggacactgaaggtaacaaactaaccaccgaatatgggtatagtacgttcatagaccatcagcgtatcactgtgcaagaaatgcccgaaatggcccccgctggccaacttcccaggtccattgacgtcattctcgatgacgaccttgtggacaagaccaagccaggtgacagagttaacgttgtcggggtattcaagtcgcttggtgctggtggcatgaaccagtccaactctaatacattgatcgggttcaaaactctgatcctaggtaatacggtgtatcctctccacgccagatccacgggtgtcgctgcgagacaaatgttgacagatttcgatataagaaatatcaataaactatccaaaaaaaaggacattttcgatatcttgtctcaatctttagcgccttctatttatggacatgaccatataaagaaagccattttattgatgctcatgggaggtgtggagaaaaatttagaaaatggctcgcatttaagaggtgacatcaatatcctaatggtgggtgatccatccactgccaagtcccaattgctaaggtttgtgttgaatacagcatcactggcaattgctactactggtagaggttcttccggtgtcggtttgaccgcagcggtcactactgatagggaaacaggtgaaagaagactagaggctggtgccatggttcttgctgaccgcggggttgtatgtattgatgaatttgataagatgacagatgtggatagagtcgccattcatgaagtaatggaacaacaaacggtgacgattgccaaagcaggtattcacacaacattaaatgctcgttgtagtgttattgctgccgcaaatcccgtttttgggcagtacgatgtcaatagagatccacaccaaaacattgccctaccggactcgctgttgtctcgttttgatttactatttgttgtgacagacgatatcaatgaaatcagagatagatccattagtgagcatgtcttaagaacacacagatatttgcctccaggttatttagagggtgaacctgtgagagagcgtttgaatttatcattagccgttggggaggatgcagatataaatcctgaagagcattccaactccggggctggtgtagaaaatgaaggagaagatgatgaagaccatgtcttcgaaaagttcaaccccttattacaagcaggtgctaagttagcaaaaaacaaaggtaactataacggtacagaaattccaaagctagtcaccatcccattcttaagaaagtacgttcaatatgccaaggaaagggttattccacagttaacacaagaagccatcaatgttattgtgaaaaattatactgatttaagaaacgatgataataccaaaaaatcgcccattactgcaagaactttggagactttgatcagattagccacagctcacgccaaagtcaggttatccaaaacagtcaacaaggtggatgctaaagtggctgccaatctactaaggtttgcactattgggtgaggatatcggcaatgatatcgatgaagaggaaagtgaatacgaagaagctttgtcgaagaggtctccacagaaatcaccgaaaaaaagacaaagagtcagacaaccagcaagcaactctggatccccaatcaaatctactccaagaaggtcaacggcatcttccgttaatgccacgccatcgtcagcacgcagaatattacgttttcaagatgacgaacagaacgctggtgaagacgataacgatataatgtcaccgcttcctgcggatgaggaagctgaattacaaagaaggcttcaactggggttgagagtgtctccaagacgtagagaacatcttcacgcacctgaggaaggttcgtcgggacctcttaccgaggtcggtactccaagattacctaacgtatcttctgcaggtcaggatgatgagcaacaacagtcagttatttcttttgacaatgtggagcctggtaccatttctactggtagattgtctttaatctcaggtattattgcgcgtctgatgcaaacagaaatatttgaagaagaatcctatcctgtggcctctttgttcgaaagaatcaacgaagaactaccggaggaggaaaaattctccgctcaagaatatttagcaggtttgaagatcatgtcggacagaaataacttaatggttgctgacgataaagtttggagagtctga

SEQ ID NO: 25403 - DNA, 1935 bp, Saccharomyces cerevisiae
atgttaccatcatggaaagcctttaaagcacataatatacttcgtattctgacccgtttccagtcaaccaaaattccagatgcagttatcggtattgatttaggtactaccaattctgcggtagctattatggaaggtaaagttccgagaattatcgaaaatgcagaaggctcaagaactactccgtctgtagtggctttcactaaagacggagaacgtttagttggtgagccagccaaacgacaatccgtcataaactcagaaaacactttgtttgctactaagcgtttaatcggccgccgtttcgaggacgctgaagtccaaagagatattaatcaggttcctttcaaaatcgtcaagcattctaatggagatgcctgggtagaggctagaaacagaacgtactcccccgcccaaataggaggttttatcttaaataaaatgaaggaaacagcggaggcttacttagcgaagagcgtcaaaaatgctgttgtcaccgttcctgcttacttcaatgatgcccaaagacaagctactaaagacgcaggacaaattattgggcttaatgtattacgtgttgtcaacgaaccaacagctgctgccctagcttacggtctagataaatcagagccaaaagtcattgctgttttcgacttgggcggtggtactttcgatatttcaatcctggacatcgataacggtatctttgaggttaaatctaccaatggtgacacccatttgggtggcgaagattttgacatttatttgttgcaagaaattatttctcatttcaagaaagaaaccggtatcgatttgagtaatgaccgtatggctgtccaaagaataagagaagccgctgaaaaggctaaaatcgaactgtcttctacactctctacagaaataaacttgcctttcataactgctgatgctgcaggcccaaagcatattcgtatgcccttttctagggttcagcttgagaatataaccgccccattgattgatagaacggttgatcctgtcaaaaaagcactgaaagacgcaagaattaccgcctcagatatatcggatgttttattagttggtggtatgtcaaggatgcccaaggttgcagatactgtaaagaaattattcggtaaggatgcatcaaaagctgttaaccctgatgaagcagtcgctttaggggccgctatacaggctgcggtcttgtctggtgaagttaccgatgttttgttgctagatgtcactcccctatcattgggtattgaaactttaggaggagtttttacaaaattaatcccaagaaattctacaattcccaataagaaatctcaaattttttcaactgcggcatcaggtcaaacatcggtggaagttaaagttttccaaggtgagagggagttagtcaaggataacaaattaataggtaattttactcttgcgggcattcctccagctccaaaaggtaccccacaaattgaagtcacttttgatatcgatgcgaacggcatcatcaacgtttcagcaaaagatctcgccagccacaaagactcttccatcactgttgccggagcgtctgggctatctgatacggagattgatcgaatggttaatgaagcggaaagatataaaaatcaggatagagccagaaggaatgccatcgaaaccgctaacaaagctgaccagctagctaatgacacagaaaattccattaaggaattcgaaggtaagctagataaaactgattctcaaagactaaaagatcaaatttcatccttaagggaattggtttctcggagtcaagctggagatgaggttaatgatgacgatgttggaacaaaaattgacaatttgcgaacttcatcgatgaaactttttgaacagttatacaagaacagtgacaatcctgaaactaagaacgggagagaaaataaataa

SEQ ID NO: 25404 - DNA, 483 bp, Saccharomyces cerevisiae
atgactgaattgtgtcctgtctacgcccctttctttggtgccattggttgtgcctctgcaattatcttcacctcattaggtgctgcttacggtactgctaagtctggtgttggtatctgtgccacttgtgtgttgagaccagacctattattcaagaacattgttcctgttattatggctggtatcattgccatttacggtttagttgtttccgttttggtttgttattcgttgggtcaaaagcaagctttgtacaccggtttcatccaattgggtgccggtctatcagtcggtttgagtggtctagctgctggtttcgctattggtattgtcggtgatgcaggtgttagaggttcctctcaacaaccaagattattcgtcggtatgattttgattttgatttttgctgaagttttgggtctatacggtttgattgttgctttgttgttgaactccagggctactcaagatgttgtctgttaa

SEQ ID NO: 25405 - DNA, 4380 bp, Saccharomyces cerevisiae
atgagtgatagggaattcgtcacggtagatcccgtcactatcataatcaaagaatgcattaatttatcgacagcgatgcggaaatactctaaatttacctctcaatctggagtggccgctttgctggggggaggaagtgaaatatttagcaatcaagatgactacttggctcacacattcaacaatttgaataccaacaagcacaatgatccatttttatctggattcattcagttaagacttatgttgaataaactgaaaaatctagataatatagattcactaaccatattgcagccatttttattaattgtgagtacaagttccatttctggttacatcacttccctggccctggactctttgcagaaattctttaccttgaatatcatcaatgaatcatcgcaaaactatattggtgcacacagggcgacggtaaatgctctaacacattgtaggtttgaaggatctcaacaactttctgatgattcagttcttttgaaagtcgtgtttttactgcgttcaatcgtcgactcaccttacggagatttattatcaaactctatcatatatgacgtattgcaaacgattctttcattggcttgtaataacagaaggagcgaagtccttaggaatgctgcacaatcaacaatgatagccgttaccgtaaagattttctcaaaactaaagactattgagcctgttaatgtgaatcaaatatacatcaatgatgaaagttacacaaatgatgtattgaaggccgatacaattggcacaaatgtagaatccaaagaagaaggaagtcaagaagatcccatcggcatgaaagtgaataatgaggaagctattagcgaggacgatggcattgaagaagagcatattcattcagagaagagcacaaatggcgccgaacaactagatattgtgcaaaaaacaacaagatcaaattccaggatccaagcgtatgctgatgataactatggattgcccgtggttaggcaatatttaaacttattactatcattgattgcgccagaaaatgaattaaaacattcatactccactagaatatttggcctagagttaattcaaacggcattagaaatttcaggtgatcgattgcagctatacccacggctttttacactgatatcagatcctattttcaaaagcattttgtttatcatacagaacactacaaaattatcactacttcaagctacattgcagctatttactactctagttgttatattgggcaacaacttacaattacagatcgagctcactctaacaagaatattttctattcttttagatgatggtaccgcaaataactcgagttctgaaaataagaacaagccatcaataataaaggaacttctaattgagcaaatatccatcttatggactaggtcgccatctttttttacttctacttttatcaatttcgattgtaatctcgatagggcagacgtttccataaactttttgaaggctttgactaaattggccttaccagaatccgccttaactaccacagaaagtgtaccacccatttgccttgagggattggtctccctagtcgatgatatgttcgatcacatgaaggacattgacagagaagaatttggcaggcaaaagaatgaaatggaaatcttaaaaaagagggaccgtaaaacagagtttattgaatgtaccaatgcattcaatgaaaagcccaaaaagggtattccgatgttaatagaaaaaggtttcattgcttccgactccgataaagatattgcggagtttcttttcaataataacaaccgtatgaataaaaaaacaatcggtttgctactttgccatccggacaaagtaagcttgttgaatgaatatattcgtttgtttgatttttcagggttaagggtcgatgaagctattagaattttgttgacgaaatttaggttgcctggtgaatcgcaacaaattgaaagaatcatcgaagccttctcgtctgcgtattgtgaaaatcaagattacgatccatccaaaatcagtgacaacgcggaggatgacatttctactgttcaaccagacgctgattctgttttcattttaagttattcaattattatgttgaacactgacctacataaccctcaagtgaaggaacacatgtcatttgaagattactctggtaacttaaagggatgctgtaatcacaaagacttcccattctggtatttggatagaatttactgttcaatcagagataaagaaattgttatgcctgaagagcaccacggcaacgaaaagtggtttgaagatgcttggaataacttgatatcttcaactactgttataactgaaataaaaaaagacacacaatctgtcatggataaattaacacccttggagcttttgaactttgatagagcaatttttaaacaagttggcccaagtattgtcagtactttattcaacatttacgtagttgcatctgatgaccatatatctaccagaatgataacaagtttggacaaatgttcctatatttccgcattttttgacttcaaagatctctttaatgatatactaaactccattgctaagggcactactttgattaattcaagccatgacgatgaactttcaactttagcttttgaatatggcccaatgccactggtgcaaattaaattcgaagacactaacactgagatcccggttagtacagatgctgttagatttggtagatcatttaagggtcaactaaatacagttgtttttttccggattattcgcaggaacaaagatcctaaaattttctccaaggaattatggttaaacattgttaatattatactaacattgtacgaagacttgattttgtctcctgatattttccctgatttacaaaaaagactgaaattaagcaacttgcctaagccatctcctgaaatttctattaacaagagcaaagaaagcaaaggtctcttatcaacatttgcttcttatttaaaaggtgatgaagaacccacagaagaggaaatcaaatcctcaaaaaaagcgatggagtgcataaagtcgagtaatattgccgcctctgtctttggaaatgaatcaaatataacagcggatttaataaaaactttactagactccgccaaaactgagaaaaacgcagataattccaggtattttgaagcagaacttttatttatcatcgaattgactattgcattatttctattttgcaaagaggagaaagaattaggaaagttcatacttcaaaaagttttccaactttctcacacgaaaggcctcacgaaaaggactgttcgtagaatgctaacatacaaaattttgttaatttcgttatgtgcggatcagacggagtacttgtccaaattaataaacgatgagctgttaaaaaagggggatatttttacccaaaaattttttgcaactaatcaaggtaaggaatttttgaagagactattttcattgaccgaatcagagttttatagaggatttttactaggaaatgagaatttttggaaatttttaagaaaagttacagcaatgaaagagcagagcgagagcatttttgaatatttaaatgaatcgatcaagacagacagcaatattttgacaaatgagaacttcatgtgggtcctaggactattagatgaaatttcatcaatgggtgccgttggaaatcactgggaaatagaatacaagaaattgacagaaagtggtcataaaattgataaggagaatccatacaagaaatcgatcgaattatcattgaaatccattcaactaacatcacacttgctggaagataataacgatctgcgtaaaaacgagatattcgctattattcaagctttggcacatcaatgcatcaatccgtgtaagcagataagtgaatttgcagtggtaacgctagagcagacgctcatcaataaaatcgaaattccaactaatgagatggaatcggtagaagaattaattgagggcggattactaccgttgctaaattcgagtgaaacacaggaagaccagaaaatcctcatttcatccatattaacaataatttcaaatgtttatttgcattatttgaaactagggaagacaagcaacgaaacgtttttgaaaattttgagtattttcaataaatttgtagaggactcagatattgaaaaaaagctacagcaattaatacttgataagaagagtattgagaagggcaacggttcatcatctcatggatctgcacatgaacaaacaccagagtcaaacgacgttgaaattgaggctactgcgccaattgatgacaatacagacgatgataacaaaccgaagttatctgatgtagaaaaggattaa

SEQ ID NO: 25406 - DNA, 1683 bp, Saccharomyces cerevisiae
atgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgtcgggggccccggtttaatccacgcactggctggtatatacaactcaatgagtaataggtggcctcttctagtaattgcagggagttcttctcaaagtgatatacataaaggcgggtttcaagagttggatcaagttagtcttttgtccccatttttgaagtttaccggaaagttaacccctgacaatattgacatgattactcagaaggctttgaattactgtatacaaggcactgcaggggtttcttacatagacgtccctgcagattttattgagtatgaaaaacccttagaaggaaacgaccgtacaggaaatgaattaccgatgatattaactccaaacatatgtggccctgatccgtcgaagatcaaaaaagtcgtacagcttattttgcaacataaaaataaaaatattctgattgttattggaaagggtgcggtaaaaaactcacacgaaatccgcagactagtaaatacgttcaatctaccatttttacccaccccaatggctaagggaattgtcccagactcttctccactgaacgtttcatctgcaagatctcaagcattgaaaatagcggatattgttcttgttctcggggcaagattaaactggatattgcattttggtacttcacccaaatggaactcagaatccatattcatccagttcgattccaatcccgaaaccttgggggataacaatgtctcacctggtgctgacctttccatatggggagatataggcttgagcgtaaccgctttagttgaggaattgactcgccaagattcctgctggaagtatagtggtgttaagcaagaaatacgagagaaaattcaactgaatcaaactcgtctattgaggaaagagaagactagaggggcacaattgaattacaaccaggtttatggaacattgaggcctcttatcgatgattacaggacaatacttgtgacggagggagcaaatactatggatattgcgcgtatttcattccctacagacgctccaaggcgccgtttagacgcagggaccaacgcgactatggggattgggctcggatatgctcttgcatgcaaggcatctcatccggaactcgatgtggtgctgattcagggtgattccgcatttggattctctgccatggaaattgaaacggcagtaaggtgtcagctggcattggtcatcgttgtgatgaacaatagcggtatttaccatggagaaaaggatatagagggtgatttacctccaacggcactaagcaagaactgccgttacgatctcgtaggcaaaggactgggtgccaatgatttttttgtcaacacaataagcgaactgagcagatgcttccaacaagccgtgcagctttctcggactaaaagagaaacaagtgtcatcaacgttatcattgagcctggcgaacaaaagcaaattgcctttgcctggcagaataaaccgcgtttatag

SEQ ID NO: 25407 - DNA, 2115 bp, Saccharomyces cerevisiae
atgtacaacattccagataatgtcaaaggggctgtagaatttgatccatggttgaaaccgtttgccgatgtactttctgaaagaagatacctagctgacaagtggttgtacgacataactcatgctacgcctgatggttcgtatcagtcactcagtaagtttgctagagattcatacaagtcatatgggttgcatgccaatccggaaaccaaagaaatcacttacaaagagtgggcacccaatgcggaacgtgcatttctagtgggagatttcaataactgggataccacatctcatgagctcaagaacaaggacgaatttggaaattttacaatcacacttcatcctttacctaacggcgatttcgccatccctcatgattcgaagattaaagtcatgtttattttgccagatggttccaagatctttcgtttacctgcgtggatcacaagggctacacagccttctaaggaaacttctaaacagttcgggcccgcatatgaaggtaggttttggaatccagagaacccctacaaatttgtacatccaaggccaaagtttagtgaatctgtagattccttaaggatttatgaagcccacgtcggtatttcgagtccagaaccaaagataaccacatataaagaatttactgagaaggtcttacccagaatcaaatatcttggctacgatgcaattcaattaatggctattatggaacatgcttattatgcatcatttggctaccaagtgaccaatttttttgcggcgagctcccgtttcggcacccctgaggaattaaaggagctgattgatactgcacattctatgggcatcctagttttattggatgtagttcatagccatgcttctaaaaacgtcgaggatgggttgaacatgtttgacggttctgatcatcagtatttccattctataagctccggtaggggtgagcatccgctgtgggattcccgtctttttaattacggaaaatttgaagtgcagcgattcttattagcaaacctggcattttatgttgacgtttatcagtttgatgggtttagattcgatggtgtcacatcaatgttatacgttcatcatggtgttggtgccggtgggtcttttagcggtgactataacgaatatctttctcgtgacaggtccttcgtcgatcatgaagccttagcttatttaatgttagccaatgatttggttcacgaaatgttgccaaatctggctgtaactgttgcagaagatgtctctggttatccaactttatgtttaccccgctccataggtggtactggtttcgactacagattagcaatggctttgcctgatatgtggatcaaactaatcaaggagaagaaagatgatgaatgggagatgggaagtattgtatacactttaactaatagacgatatggtgaaaaagtggttgcttattgtgagtcgcacgaccaagctttagttggtgataagacattagcgttttggttgatggatgccgctatgtacaccgatatgactgtattgaaggaaccatccatcgttattgaccgtggtattgctctacacaagatgattaggctgatcactcactcgctgggaggcgaggcttatttgaacttcgaaggtaatgagttcggtcatccagaatggttggatttccctaatgttaacaatggcgatagctacaagtatgctcgtaggcagtttaatttggctgatgatcccttactgcgttaccagaatttaaatgagtttgatagatcaatgcaattatgtgagaaaaggcataagtggctgaacacgaaacaggcttatgtttcattaaaacatgaaggtgacaaaatgattgtgtttgaaagaaataatctgttgtttattttcaacttccatcctacaaacagctacagcgattatagagttggtgtcgaaaaagctggtacttatcacatcgtgttgaactcagatcgtgctgaatttggtggacataacagaatcaacgaaagttccgaattctttaccaccgatttggaatggaacaacaggaagaacttcctccaagtttatattcctagtagagtcgctttggtgcttgccttaaaagaatga

SEQ ID NO: 25408 - DNA, 1008 bp, Saccharomyces cerevisiae
atgaataatggagacaataaaacgacattagaaaactcaaaaaatgcgtcactagctaatggaaattatgcgattcccacaaaactaaataggctgaaaaagaatgctgaccctagagttgctgcaatttcaggtgctttatctggtgcactatccgcaatgctggtctgtccttttgacgttgcgaaaacaagattacaagcacaaggtctccaaaacatgacacaccaaagtcaacattataaggggttttttggtacatttgctactattttcaaggatgaaggtgctgctgggctttataaaggtctacagccgacggttttaggttatattcctactttgatgatttacttttccgtctatgatttctgtagaaaatattcggtcgatattttcccacatagtccgtttctctcaaacgcttcttctgcaattactgcaggtgccatctctacagttgcgacaaatccgatttgggtagtaaaaacaagacttatgctgcaaacaggtatcggtaaatattccacccattataagggtaccatagacacatttagaaagatcattcaacaagagggtgctaaggctctttatgccggcttagtaccagccctgctggggatgctgaacgttgctatacagtttcctttatatgaaaatttaaaaataaggttcggatattcagaatcgactgacgtatcgacagatgtgacgagctcaaactttcaaaaattaatattggcctctatgctatctaaaatggtagcatctaccgtgacttatcctcacgaaatacttcgaactcgaatgcaactgaaatccgatcttccaaatactgttcaacgccatctccttccattgattaaaattacgtataggcaagagggcttcgccggcttttactctgggtttgcaactaatttggtaaggacagtacctgctgctgtggtaacactagtatcgtttgaatattctaaaaagtatttaactactttttttcaataa

SEQ ID NO: 25409 - DNA, 1893 bp, Saccharomyces cerevisiae
atgctcatagaaaacactaatgatcggtttggtatcgtcatagatgcagggtcttcgggttcgagaatccatgtgtttaagtggcaggacacggaatcgcttcttcatgcaacaaaccaggactcacagtccatattacaatcagtacctcatattcatcaagaaaaagactggacttttaagctgaatccaggcttgtcgagttttgaaaaaaaacctcaagatgcgtacaaatctcacatcaagccgttactagattttgctaagaatattatccctgaatcacattggtcgagttgtcccgtttttattcaagcaaccgcgggcatgcgccttttacctcaagacatacaatcttccattttggatggtttgtgtcaggggctcaaacaccctgcagaatttttggttgaggattgctcagcacaaattcaagtcattgatggtgaaaccgaaggtttatatggctggcttggcttaaactatctatatggacactttaatgactataatccagaggtctctgaccattttacatttgggtttatggacatgggcggtgcctctactcagattgcgtttgcaccgcatgattcaggagaaatagctagacatagagatgacatcgccaccatcttcttgaggagtgttaacggagatttgcagaaatgggacgtttttgttagtacgtggttagggtttggtgccaatcaggctagaagaaggtacttggctcagttgatcaatacccttccagaaaacacaaatgattacgaaaatgatgacttctctacaaggaacttgaatgatccatgtatgccgcgaggaagcagcacggattttgaatttaaagataccatatttcacatcgcgggttctgggaattacgaacaatgtacaaaatctatttatccgttacttttaaagaacatgccttgtgatgacgagccgtgcttgtttaatggtgttcatgctcctcgaatagactttgccaatgacaaatttataggtacttctgagtactggtacactgccaacgacgtattcaaacttgggggcgaatacaactttgacaaatttagcaaaagcctaagggagttttgcaattccaattggacgcaaatattagcgaacagtgataaaggcgtgtataattctattccggagaattttttgaaagatgcatgctttaagggcaattgggtccttaatatacttcatgaagggtttgatatgcctcgaatagatgtcgacgcagaaaatgtcaatgacaggcccttatttcaaagtgtggaaaaagtcgaagaacgagagttatcgtggacactaggcagaattttactttatgcctcaggtagcatattggcaggtaatgatgacttcatggtgggtattgcgcccagtgaaagaagaactaagctcactggtaagaaattcatacctggcaagttactggagtctgatcaactacgcaagcaaagttccagcctttctaataaaggatttttgatgtggttcgcaattatttgttgcatattttacttgatctttcataggtcacacataatcagaagacgtttttccggtctgtacaacattaccaaggactttaagacaggcataaggagaaggttgaaatttctaaggagatcagatccattttccagattggaggaaggtgaacttggaacagacgtagatggcttcaaagatgtgtacaggatgaagagtagcagtatgtttgatcttggtaagagttcagccacaatgcaaagggagcacgaaccacaaaggacagcaagtcagtccgctaatctcgctccgtcaaacttacgacctgcgttttctatggctgatttttccaaatttaaggacagtaggctatatgattga

SEQ ID NO: 25410 - DNA, 4011 bp, Saccharomyces cerevisiae
atgaggtcctcgaagtctccttttaaaaggaagtctcacagtcgtgagacatcacacgatgaaaacacatcgtttttccacaagagaacaatatccggtagcagtgctcaccattctagaaacgtcagtcaaggtgcagtaccctcttccgcaccacctgtttctggtggaaattattcgcataagagaaacgtgtcgagagcttcaaattcctctcaaacttcgaattttttagccgaacaatatgaaagggataggaaagccataattaattgctgcttttccagacccgaccataagacaggtgaaccgccgaataattatattacacatgtccggattatagaagattcaaaattccctagttcaagacctcctccagattcaaaattggagaacaaaaagaaaagactccttattttgagtgccaagcccaacaatgccaagctaatacaaattcataaagcaagagaaaactcagacggctcttttcaaattggtagaacttggcagttgaccgaactagtaagagtagagaaggacctggagatatctgaaggcttcattcttaccatgagtaaaaaatactactgggaaacgaattctgcgaaggaaagaactgttttcattaaatctctaattactctatacattcaaacattcgaaggtcatgtccctgaattggtcaattgggatttatcccttttttatcttgacgagaggagttatcaaagagcagtcatcacaaatcgccccggttccgtatctccaataaagtcacctacaagtaatttcacgacaaacactacccaatcggtgggctctgtccccttttcagcacctactgagaggacaagaaggtctgaaacagaaagcgttaatccagtgtcaacgcctgcaagcgtggaatatcatgcaggaatgaaatctctaaataaggccccctattcttccaattcgacattgaatgaagtgaataaaagatacgagttagagcaacaacagcaacaagaagaggctgaactgagacgattagaagagcaaaaaagacttcagttacaaaaggaaaatgagatgaaaagattagaagaggaaagaagaataaagcaggaggagaggaaaaggcaaatggaattggaacaccaacgacaactcgaagaagaggaacgaaaacgtcaaatggaactggaggctaaaaagcaaatggagttgaaacgtcaacggcaattcgaagaagagcaacgcctaaaaaaagagagagaactattggaaatacagagaaaacaaagagaacaagaaacagctgagagattaaaaaaagaagagcaagaagcgcttgctaaaaaggaggaggaagaaaaaagtaaaagaaacaaagtagacaatgaaagttatactcaagaaataaatggtaaggttgataaccttttggaggacttaaacgcagttttggcggaagaaacagaaaccacccctactatgcaaaatggtacttacgtgcccgagagaagtacagctagagctcatgaccaattaaaaaaaccactaaatattgccaaagttgagtcactcggtggaagcgatttgaatgactcgatcagtttgagtgacgagatagcaggtttgaatacatctaacttatcaggagaggaccaagatgagaagaacgatctttcgttcgagaagggagatgaggttaggtatagcaataattttgaaggtgaagctcctcacgtgtaccatgaagtgtcaattattcaagaagaagcacctgccgtttcgcagaaattaatccttccggaagagaataacgaatctgaagcgctgattgaatctaaagaggagataaaaacgatggaaaatattgacgatgaggttttattagaaatattaacagatatcaattggtccattgaagacgatgctgatagtatgattgaaaggattgacttaagattggcggaaacggaatacttattcaaccaaaatttattatctttgcaaaaaattgggcctaatatccgcccctacgaagacaaggtcaatgacgaatgtcatcgcataatccccactctctctttattcttgatggaaatgagcaatttttctaatgatatcgaaaacgtagagagccaagataacggattacaagttgaaagtgctaacaagaaacttctatggaacacacttgatgaacttttgaaaactgtatctcttgatgaaatttccctaaatcagttattagaatgtccaataagagagaagaacttgccatggatggaaaaccaattgaatttattattaaaagcatttcaagcaataggcagcgatggaaatgaagtagaatataatctaagagaaatttccggactaaagcagaggctacagttttatgagaaagttaccaagatatttcttaacagaattgtggaggaaatgcagaagaaattctcaaatatacgtggacaagatatctcacacgatcaaatgattagaattttgacgactttattgatattttctcctttaatactgttctgtaaagaaatttcacaaaaatcgtatcaagcaattgtggaaaattggaacgtcagtattcaaccagtatacatggagttatggactaagaaaatatcacaattacaaggcattgacacaaatgatgaaaaaatgaatgagctgagcttaagccagttactaaatgaatgggacacatttagaaaagagagaaaaacaaatgatatcaacccggttttcaagaatagtttttctcttcttaccgagtgccttcaaaccatgaggcaagaatgtattgtttatcaaaattttgtcgaagtgttctttcatatatcttcaaagcataatttcgaagaatacattaaacatttcaatgatccagatgctcctccaatattattagatactgtgaaagtaatgcaatctgatagagaagcagccgttattgaaacccagttggtctcaagaatattccaacctattgtcactaggctgtcctcatattttgtagaattagtgaaagccgaaccaacggtagccccagccttaactttttacttggagaatgaaattaaaagcttagaatcatccaaccatgaatttttattgtctgcagtgactagaatgtacacacaaataaaacaagtgtggtctgataatgtagaagagcaggttttgcacttcgaaagaatttctaacgcaaccaccaatggagaaattcttccaggtatacttgatttaccagtaggcttgaagaattcagaagatttgttccaatttgctaagaggtctatggatattaaagataccgatgaaggctacgagtccatcgaattaatgaattcgagcttcaggaagctaagcatagctgccacacgatcgataactcacaaagaagttaattcaagcattaatccaaacctttcagatactgctgctttaaataatgactatatggaaactatttctctcctagtgaacagtaactggctaactgaaatgctttccatgttaaacttcaataaggatggtatatttgatacgtcattgcaaaacgttaagaaagttttcgatgtggaaaaagaatcttatgcttcctttctactccgcgatactatgcctaaactaacagcctttgtttatggtgtgagcaacatcattgaaaataccaacaatgtgaacatgaccaatccttcaagatgggccgcatatagcaggcagaacctagagaacattcttttagcatacacttcccatgaaattgaaactctagtaaaaaggctgcacactcatatggtaaatgacttcggttaccaccaagaaaatgccataaacaacgtcctatgcgataagttgtggtcgtgcattcaaggtcaaaccgtctcactatacttgaaactatacactgtaattgataaacactatagagggacaaacatacgcttcacgaagaacgatatcataagtgcgttcgaggaatacaagaatgcctaa

SEQ ID NO: 25411 - DNA, 765 bp, Saccharomyces cerevisiae
atggcttacactaagatcgctttattcgctgctattgctgctttggcttccgctcaaacccaagatcaaattaacgaattgaacgttattttgaacgatgtcaaatctcacttgcaagagtacattagcttagcttctgattcttcctctggattttccttaagcagtatgccagctggtgttttggatatcggtatggctttagcttccgccactgacgactcctacactactttgtactctgaggttgactttgctggtgttagcaagatgttgaccatggttccatggtactcctctagattggaaccagctttgaagtctttgaatggtgatgcttcttcttctgctgccccaagctcttctgctgctccaacttcttctgctgccccaagctcatctgctgccccaacttcttctgctgcctcaagctcttctgaagctaagtcttcttctgctgccccaagctcttctgaagctaagtcttcttctgctgccccaagctcttctgaagctaagtcttcttctgctgccccaagctcttctgaagctaagtcttcttctgctgctccaagctccactgaagctaagataacttctgctgctccaagctccactggtgccaagacctctgccatctctcaaattaccgatggtcaaatccaagctaccaaggctgtttctgagcaaactgaaaacggtgctgctaaggcctttgttggtatgggtgctggtgttgtcgcagctgccgctatgttgttataa

SEQ ID NO: 25412 - DNA, 597 bp, Saccharomyces cerevisiae
atggatattattctgggcatccgtgtacaggattctgtcattctagcgtcttctaaggcagtcacaagaggtatttctgttttaaaagattctgatgataaaacgagacaattatcgccacatacattgatgagttttgccggtgaagctggtgacaccgttcaattcgccgagtacattcaagccaatatccaattatactccattagagaagattatgagctctctccacaagcagtatctagttttgttaggcaagaattagccaagtcaattaggtcgagaagaccataccaagtcaacgtattgattggaggctatgacaaaaagaagaacaaaccggaactatatcaaattgactacttgggtactaaagtcgaattaccctatggtgctcatggttactcggggttttacacattctctttactagatcatcattatagacctgatatgactactgaggagggtttagatttattaaaactatgtgtacaagagcttgaaaaaagaatgccaatggacttcaagggcgtcattgttaaaatcgtggataaagatggcataagacaagtagatgacttccaggcacagtga

SEQ ID NO: 25413 - DNA, 3438 bp, Saccharomyces cerevisiae
atgtctgatatatcgaaactcataggagctattgtgggatctgatgaccccgttatcattgaatttgtgctgaatatcataaataaatccggcaatttacaagagtttatacgaaatattcaaaaattggatgccggtatatcctacgaagacagtattaagatgtataatgcatttttaggaaagcaggaagaagaaaaggtacgaaataaagttaaaagttcaccgttaagtcaaaaaattaatcaggtactgaaagatgacgttaatttggacgaccctgttgtgactgaattcgtcctgagcattttgaataaatctaaatcaataactgagttccaggaacaactgaacttgatgcaaagcggactcgataatgaaacaattttcaagatatatcaaattgcatcaccaccagtaatgaaagaagaagtctcagttcttccaagcaccaagataccagcaaagatagaagcaaagattgaagaagaggtacaaaaaatagaaagtttagaccccagccctgtccttcacaaagtttatgaaggtaaagtgagaaacataactacttttgggtgtttcgtccaaatttttgggacgcgaatgaagaattgtgatggcttagttcatatttcagaaatgtcagaccaaagaacattagatccacatgatgtggtgagacaaggccaacatatctttgtcgaagtgataaaaatacaaaataatggaaaaatatcgctctccatgaaaaatattgatcaacatagtggagaaatccggaaaagaaatactgaaagtgtcgaagatagaggtaggtccaacgatgctcatacaagcagaaatatgaaaaacaaaattaaaaggcgtgctttgacttcaccagaaagatgggaaattcgccaactaattgccagcggtgctgcttccatcgatgactatcctgaattgaaggatgaaatacccataaatacttcctatttgaccgcgaaaagagatgacggcagtatcgttaacggtaatacagagaaagtggactcaaaattggaagaacaacaacgagacgagacggatgaaattgatgtcgagctgaatacagatgatgggcccaaatttttaaaggatcagcaagtcaagggggccaagaaatatgaaatgcctaaaattacaaaagtcccgagaggatttatgaatcgttcagcaatcaacggctctaatgcaatacgagatcatagagaagaaaagttaaggaaaaaaagagagattgaacaacagattaggaaacaacagtcgtttgatgatcctacgaaaaacaaaaaagattccaggaacgaaattcaaatgttgaaaaaccagctgattgttactgaatgggaaaaaaatagaatgaatgaatctatctcgtatggcaaaagaacttccttaccaatcagtgcacagcgtcaaactttgcctgtatacgcgatgaggtctgaattgatacaggctgtgcgtgacaatcaatttctggtcattgttggtgagacaggttcgggtaaaaccactcaaattactcagtatttagatgaagaagggtttagtaactatgggatgatcggatgtacccaacctcgtagggttgccgctgtatccgttgctaaaagagtggctgaagaagttggctgcaaagttggccatgacgttggctataccattagatttgaagatgttactggcccagataccagaataaaatatatgactgatggtatgttacagagagaggcgttgttagatcccgagatgtcaaaatattcagttatcatgttagatgaagctcacgaaagaactgtggcaactgatgttttatttgcgttgttaaagaaagcggctattaaaaggccagaattaaaagtaatagttacatcggctactttgaactctgctaaattttctgagtactttttaaattgtccgattatcaatatacctggtaaaacttttcccgtggaagtactctactcacagacgccccaaatggattacatagaggcagctttggattgtgtaatagacatccatattaatgaaggcccaggcgatattttagtctttttgactggacaggaagaaatagactcatgctgtgaaattttatatgatagggtgaaaactttaggtgacagcatcggcgaattactgattttgcccgtttattctgctttgccaagtgaaatccaatcgaaaatttttgaacccactccaaagggcagtcgaaaagtcgtatttgccacaaatattgcggaaacttcaatcactattgatggaatttattatgtcgtggaccctggatttgcaaaaatcaacatttataatgcaagagcaggtatcgagcagttgatagtgtctccaatctctcaggcacaggcaaatcaaagaaaaggtagagctggaagaacaggccctggaaaatgctatcgactttatacagaatccgcattttacaatgaaatgttagaaaacacggttccagaaattcaaaggcagaatctttctcatactattttgatgctaaaggccatgggaattaatgatttattgaaatttgacttcatggatccccctcccaaaaatttaatgcttaacgcactgacagaattataccacctgcagtcactagatgacgagggaaaactaacaaatttaggtaaagagatgtccttatttccaatggatcccactctatcacgctctttattgtcatctgttgataatcagtgctcggatgaaattgttactataatctcaatgttgtcagtacagaacgttttttatcgtccaaaagataggcaattggaagcagatagcaagaaggcaaagtttcatcatccatacggtgaccatttaacattattgaacgtttatactagatggcagcaggcaaattactcggagcagtattgcaaaacaaactttctgcattttagacatttgaaaagagcaagagatgttaaaagccaaattagcatgatatttaaaaagataggcttaaagttaataagctgtcatagtgatcctgatttaattcgtaaaactttcgtgtcagggttcttcatgaacgctgctaagcgagactcacaggtaggttataaaaccatcaatggtggtacagaggttggaatacatccctcgagttcattgtacggaaaagagtatgaatacgtaatgtatcatagtatcgtattaactagccgggaatacatgtcgcaggtaacatccattgagccccaatggcttctcgaagtagcgcctcatttttataaagctggagatgctgaaagccagtctaggaagaaagcgaaaatcattcctttgcataacaagtttgccaaggatcaaaattcatggagactaagctcaataaggcagtcaagggaaagggcattaggtatcaagaggtaa

SEQ ID NO: 25414 - DNA, 1620 bp, Saccharomyces cerevisiae
atgttattaccattaacaaagctaaaaccgagagcaaaagttgctgttgtagggggtggcgtttctggactatgttttacttattttttaagcaagttgagaccggatgttgaaatcacactgttcgaatcgcagaacagaactgggggttggatatattcttgtaacacaagagatatgagtgggaacccaattatgttggagaagggacccagaacattgaggggcgtatcagacgggaccgttctgattatggatacccttaaagacttgggcaaggaagcagttattcaaagcattgataaaggttgcattgcagacaaaaagtttctactagaccccagtgataaactcgtgcaggttcctaattcgatatctacaacagtaaaatttctgctgaatccgttgggaaaaggactcatcacgggtatgatgggagaatggttcagaaaaaaatctccacatcctggccaagacgaaagtgtcgaatccatttgtgacagaaggtttgggaataactacatatcaaacaatatgatcagtgccttactaagaggtatctatggggatgacgtttccctattaagtgccaagagaacgtttaagaaaatatactacaatgaactaaagcacggatctaacacacaagctatgattgataatatgcgcggaaagtcaagaagtaaaaaaactgagaacctgcaccaatctttaactggctgccttaacgactactcaaatgcgtttggaaaagacaggtcaaagttattagacttatccaacacgctaaagaaatatcccatgttgggtcttgctgggggactagaaacgtttcccaagatagtcagaaatgctttgaacgaatttaaaaacgtcaaaatagttactgggaacccggttacgcaaataatgaaacgccctgctaacgaaacgacaatcggattgaaagcgaaatctggcgaccaatacgaaacatttgaccatttaagacttacgataacacctcccaaaatcgctaaattgctaccgaaggatcaaaattcattatccaagttattagatgagatacaatcaaacacaataattttagttaattattatttgccaaacaaagatgtaatagatgccgatctacaaggctttggatacttggttcccaaatccaataagaatccagggaaattgcttggtgtaattttcgattctgttatcgaaaggaatttcaaaccactttttgacaaactctccacaaacccaaacgccctcaacaaatatacaaaagtgactgcgatgataggaggttgtatgctcaatgaacacggtgttcctgtagtgccatccagggaggtaaccattaatgcagtcaaagatgcgctgaacaaccacctcggcatcagtaacaaggatctggaagctggtcagtgggaattcactatcgccgatagatgtctgccaagatttcatgtaggttatgacgcatggcaagaaagagctgaaaggaagttgcaagaatcttacggccaaacagtttctgtggggggaatgggattttctagaagtcccggtgtccctgacgttattgtagacggctttaacgacgccttacagctaagcaaataa

SEQ ID NO: 25415 - DNA, 2235 bp, Saccharomyces cerevisiae
atggccgctccagattatgcacttaccgatttaattgaatcggatcctcgtttcgaaagtttgaagacaagattagccggttacaccaaaggctctgatgaatatattgaagagctatactctcaattaccactgaccagctatcccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaacgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagtgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatggaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttaaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcaccgatgggctacaaggattcgaaaaattgcataacatcaaagtcggacttgagcctttaactctcgaggatgatgttgtgacgccaacttttaaaataaagcgtgccaaagcatcaaaattcttcaaagatacattagaccaactatacgccgaaggttcactagtcaagacagaaaagctttag

SEQ ID NO: 25416 - DNA, 1035 bp, Saccharomyces cerevisiae
atgagtgcgggtatcggagaatcacgtacagagttgcttacatggttgaatggcctccttaacttgaattacaaaaaaattgaggaatgtgggacgggagcagcatattgtcaaataatggattcaatttatggagacttgccgatgaacagggtaaaattcaatgccacggccgaatatgagtttcaaaccaactataaaattttacagagttgctttagcagacatggaattgagaaaacagtgtacgttgataagttaatcagatgtaaatttcaagataatttagagttcttgcagtggttaaagaaacattggattcgacataaagatgaaagcgtgtatgatccagatgcaaggcgcaagtatcgtcccattataacgaataatagtgcaaccaaaccccgtacagtatccaaccctaccactgcaaagaggtcatcaagcacaggcactgggagtgccatgtcaggaggattagcaacaagacattcttcgctgggaataaacggtagcagaaaaaccagtgttacccaaggtcagttggtagcgatacaagcggaattaactaaatcgcaggaaacgatcggttcattgaatgaagagatagaacaatacaaaggaacagtaagtactttagagattgaaagagaattttacttcaacaaactacgcgacatagaaatcctggtccataccactcaagatttaataaatgaaggtgtttataaatttaatgatgagaccatcaccggccatggtaatggaaatgggggagcattattacggttcgtcaagaaggtggaaagtattttatatgctactgcagaaggatttgaaatgaatgatggtgaggatgaattgaatgataaaaatctgggtgaacatggaactgtgccgaatcagggcggctatgcgaacagcaatggcgaggtcaatggtaacgaaggtagtaaccatgatgtgataatgcagaacgacgaaggtgaggttggcgtgagcaacaacttgatcatcgacgaggaaactttttaa

SEQ ID NO: 25417 - DNA, 2286 bp, Saccharomyces cerevisiae
atgatgatgtggcaacgatatgcaaggggtgcgccacgctcattgacatcactctcatttggtaaagctagccgcatatcaacagtgaagccagtgcttcgctcgcgcatgccagttcaccagcgtttgcagacgttatctggtctggcaaccagaaacacaatacaccgttctacccaaatacgttccttccatatctcatggacaaggttaaatgaaaataggccaaacaaagagggtgagggcaagaacaatggtaataaagataataatagcaataaagaagatggcaaagacaaaagaaatgagtttggttcattatcagaatacttcagatctaaggaatttgctaatacgatgtttttgaccatcggattcacaattatatttactttgctcacaccttccagtaacaactcaggagacgactctaaccgcgtcttgactttccaggatttcaaaacaaaatacctggagaagggtcttgtgtccaagatttacgtcgttaataagtttctcgtagaggccgaattagtcaatacaaagcaagttgtatcgttcaccattggttcagtagatatttttgaggaacagatggaccagatccaggacctcttgaacattcctcctcgggatcgtatccccatcaaatacattgagagatcttctcccttcacatttttgttccccttcctgcccaccatcattctgcttggtggcctttacttcataaccagaaaaataaatagttcaccaccaaatgccaatggtggtggtggaggaggcctcggcggcatgtttaatgttggaaaatccagagcaaagctcttcaataaggaaacagacattaaaatttcatttaaaaatgttgccggttgtgatgaagctaaacaggaaatcatggaatttgttcactttttgaagaacccaggtaagtacactaaattgggtgccaagattccacgaggcgctattctttctggacccccaggtaccggtaagactctcttggccaaggccaccgcaggtgaggcgaacgtgcccttcttgtcagtatcaggttctgagttcgtcgaaatgttcgttggggtgggtgcttcacgtgtaagagacttgtttactcaagcaaggtctatggccccctcgattatctttatagatgaaattgacgctatcggtaaagaaagaggcaaaggcggcgctctcggtggcgctaacgatgaaagagaagctacgctgaatcaattattggtggaaatggacggattcactacttccgaccaagtcgtagtccttgcgggtacaaataggcccgatgtgttggataatgctttgatgagaccgggaaggttcgatagacatatccaaattgattctcctgatgtcaatggtaggcagcaaatatacctggttcacttgaaaagactgaatctggatccccttcttacagatgatatgaataatctttctgggaaattggctacgcttactccaggttttactggtgcagatatcgctaatgcttgtaatgaggctgcattaatcgctgccagacataatgacccatatatcactatccatcactttgagcaagccattgaaagagtcattgcgggactagagaagaaaacaagagtcctttctaaggaagaaaaaaggtcagtggcctatcatgaggcaggacatgccgtttgtggttggtttctaaaatatgcggatccacttctgaaagtaagcatcatcccgcgtggacaaggtgctttaggctatgcccagtacctaccaccggatcaatatttgatatctgaggagcaattcagacatagaatgatcatggctcttggtggccgtgtttctgaggagctacattttccatcggtgactagcggtgctcatgatgatttcaaaaaggttacacagatggcaaatgccatggttacatccctaggaatgtcacccaagattggctacctgtcgtttgatcagaatgatggaaacttcaaagttaacaaacccttcagtaataaaacggcaagaaccattgatttagaagttaaatctatagtagatgatgcacaccgagcttgtacagaattgctaaccaaaaatttggacaaagtcgatcttgtcgcaaaagaattgctacgtaaggaagcaattactagagaagacatgattagattattgggtccaaggccattcaaggaaaggaacgaggcttttgaaaaatatttggatccaaagagcaataccgaaccgcctgaggcacctgcagcaacaaattaa

SEQ ID NO: 25418 - DNA, 1350 bp, Saccharomyces cerevisiae
atgggtctctgcgcatcttcagaaaagaacggcagcactcctgacacgcagaccgccagcgctggtagtgacaacgttggcaaagcgaaggtaccaccaaagcaggagccacagaagactgtgagaacagtcaacacagcaaatcaacaagaaaagcaacaacagaggcagcagcagccgtctccgcataatgttaaggaccgcaaggagcaaaacgggagcattaataacgcgatatctcccacggctacggcaaatacaagcggatcgcaacagatcaatatcgactctgccctgagagacaggtcgagtaacgttgcagcacaaccatcattgtcggacgcttcaagtggcagcaacgacaaagaactgaaagtgctactgctgggtgccggtgaaagtggtaagtccacggtattgcagcagttgaagattttacaccagaacgggtttagcgagcaggaaattaaagagtacatccccttgatctatcagaatctattggaaattggcaggaacctcatccaggcgagaacaaggtttaacgtcaacttggaaccggagtgtgaactgacgcaacaagacctgtcgagaaccatgtcctatgaaatgcccaataactacacgggccaattcccggaagatatcgcgggcgtaatatctacgttgtgggccttgccctcaacacaagatttagtcaatgggcctaacgcatcgaagttctatctaatggactcgactccttacttcatggaaaatttcaccaggatcacttcgcccaattacagacccacccagcaggacatattaagatcgagacagatgacgtcagggatttttgacaccgtcattgatatggggtcggatatcaagatgcatatttacgacgtgggtggacagcgttccgaaagaaaaaaatggatacactgcttcgacaatgtcactctggtcatattttgcgtttctctatcggagtacgaccagacgctgatggaggacaagaaccagaacaggtttcaggaatcgctggtgcttttcgataatattgtcaacagtagatggttcgcgcgcacgtctgtcgtactctttctgaataaaatcgacctttttgctgaaaaactaagcaaagtgcctatggaaaattacttcccagactacaccggcgggtcagacatcaacaaggctgctaagtacatactctggaggtttgttcagttaaacagggcgaatctaagcatatatcctcacgtgacacaggccacagacacgtcgaatataagattagtatttgccgccatcaaagaaacaattttggaaaatacattgaaagactctggagtgttacaatga

SEQ ID NO: 25419 - DNA, 1572 bp, Saccharomyces cerevisiae
atggctagcactgcagtaatgatggacgtggattcttccggggtcaatgacttgcaccattctgagaagaaatatgcggaagaagatcaggttcaggaactattgaaagttttgaatgagatctccaagaccactttaacgctggacccaagatatatatggaggagtttaaaggacttgagctctttaaggaaccaggagcttttgaatgcggaaactttatgtttcacagtgaatgtgctgtaccctgattcttcttcattcaagaagaatctgctgaagttcattacttctaaccataaatcgtccgtaccggggtcagctgagcttagaaactcatatccagcctctttttattccgtaaacactgagaaaaagaccattgaagtgacagctgaaattaattgcttcatgcatctactagtccagttgtttttatgggacagtaaagaattagaacaattggtagagtttaataggaaggttgttatcccaaatttattgtgttattacaatttgcgttccttgaatttaatcaacgctaagttatggttctacatctacttgagtcatgaaacgttagcgcgcagctccgaggagattaacagcgacaaccaaaatataatcttaaggtccacgatgatgaagtttttgaaaatcgcttccctgaagcacgacaacgaaaccaaagccatgctgattaacttgatcttgagagattttttgaataatggcgaggttgatagcgcgtctgatttcatttctaaactagaatatcctcacacagacgtttccagttcattggaggcaagatatttcttctatttatcgaaaattaacgccattcaactggattattccactgcgaacgagtacattattgcagccataagaaaagccccacataattccaagagtttagggttcttacagcaatcaaacaaactgcattgttgtattcaattactcatgggtgatattccagaattatcatttttccatcaatcaaatatgcagaaatctctccttccttattaccatttgaccaaagccgttaaattaggtgacttgaaaaaattcacatctacaatcacaaagtataagcagttgctattgaaggatgacacctatcaactctgtgttagattaagatctaatgttatcaagacaggtatcaggatcatctccttaacgtataaaaaaatttcattaagagatatttgtttgaaactgaatttggattcggagcaaactgtagaatacatggtttcaagggctattagagatggtgttattgaagccaagattaatcacgaggatggctttatcgaaaccacagaattactaaacatttatgatagtgaagatcctcagcaagtatttgatgaaagaatcaaatttgccaaccaattacatgatgaataccttgtttcaatgaggtaccctgaggataaaaagactcaacaaaatgagaaaagtgaaaatggtgaaaatgatgatgatacgctagatggtgatttgatggatgacatgtctgatatctcggatctcgacgatttgggattcttataa

SEQ ID NO: 25420 - DNA, 861 bp, Saccharomyces cerevisiae
atgacttacacattggcaattttaggctgcggtgttatgggccaagcacttctttccgccatttataatgctccaaaggcggctgatgaaactgctgctgcattttacccttccaaaattatcacatgtaaccatgatgaacctagtgcacaacaagttaccgatctagttgagacattcgacgaatctcctaacggtattaaagtcgaaagcacttacggtcacaacgtgagcgctgtcgaagaagcttctgtagttcttcttggtaccaagccatttttggccgaagaagtgttgaatggtgtgaagagcgtcattgggggaaagctacttatttccctggctgctggctggacaattgaccaattgagtcaatacactagcactgtttgccgtgttatgacgaacacacctgccaagtacggatatggttgtgcggtggtgtcctactcagctgatgtttccaaagagcaaaagccactggtcaacgaattgattagccaagttggtaaatacgttgagcttccagaaaagaacatggatgctgctacggctttagtcggttcaggccccgcttttgttctcttgatgttagaatccttgatggagagtgggttgaaattgggaatcccattacaagagagtaaggagtgtgccatgaaagttctagaaggaacagtgaagatggttgagaaaagcggtgctcatccatccgttttaaagcatcaagtttgcacaccaggtggtacaactattgccgggttgtgcgtaatggaagaaaagggcgtcaagagcggtattatcaatggtgttgaagaggcagcccgtgttgcgtcacaattaggccaaaagaagaaatag

SEQ ID NO: 25421 - DNA, 2772 bp, Saccharomyces cerevisiae
atgtcaagcggcagtactattgtttcgtctgacaagtcggggcgaacatttaagcatgaggaagaactacccaagttaccattacctaaactctgtgacactttgcagcgtctgaaggagagtttagagccattgtattatgctgatggttactatcaacatcctttagatccagaacaaattgagaagctgtcatccataataagagattttgaagagaatcccgtaagtgagaagctgcaatctaaactacagagctaccatgacactagggattgctaccttgatgaattacacttagacatcaataaccagacctccactagggagattcaggacgatgtcctacccaggaatcccttcttggttctcgcagatgacgctttgccaaacatcactcaagctgataggtcagccgtcctagtgcactctgcggccaggtttatttctgctttgaaacaagatttgttgccaccagatatcaatgccaccaatggcaaaccactgtcaatggctccatttctgaacttgttcggtactactcgtagtcctgtttttcagcgcggtgaggttgaaaattttgatttgaacaaaccttacacagcatctgatttagaagaccctgattattcaagcgatgaggacgataacgacgaacccacccaaaaagactttgatgaccgtaaaagaaaacacgaagaagacatattcactggcaatggtataactataaaaagacatccggatagcaaacacatcttgatcatctccaggggccaatactatacactggaagtacttgattcgacgaataaaattatatacactgctgcagaattaaccacaattttcaaccatataataaaagattcttctggcattgaaaaatcaactgcgttaggtagtttgacctctcactcttttagaaactggaaatatgcaaggaagagactacagaaaaggtatcctaatgaattacatcgcatagactctgctctgttcgtgttagtgctggacgaatcacaagaagaaactaccaatgatggcgatgataccgctgatatcagtcaaatgtttaacaggactatcactgagcgagacaagaaatgtacttccgccaattgtaagagagtgttttacggtacttctataataaatagcaaaggccatcaagtgggttcatgtgtttctcgttggtatgataaattacagttagttgtcactgcagatgcaaaagccacagtgatttgggattccttcacatgtgacgggtcagtcgtgcttcggtttacttctgaaatttatacagaatcagtcttgagattagctagagacgttaacgccggtgacccacagttttcactctggcctaacgtgacacaaatggatcctgaaactaaaaaactgatgacggcgaccataagtgccgacggcggaggcccttctgaaattgaccctaagttggttgtaaataaaatcgattggtctttcagtaacatcctgaacacacatgtccatttgtcagaaaccaaactagctgatctgatttccaagtatgatattgttcgcgcttctattccattgggcagaaggtcagctcaaagattaggagtcaagcccgattcgatggttcaagtagctttacaaatagctcactatgctttgtatggaagaatggtgtttggattagaaccagtatccacacgtggtttcaaaaactcgagatcatcttttattaacattcaaagtcaagcgctgttggaactatgtcaattgtttatttctagctccattgatgggacagataaattagacaaatttatccaaacctgcgaaacacataataacatggttaaacatgcaaagtctggggtaggttatgaaaaacacttcaatgcattgaaatatctcttcaaatttcatgaccattttggtatccacttaagtggtgatgaatcatctgctgcgaaagatcttttcgaaaatccacttgttttacctttctcacagcctgagttgattgttgccaactgtggtaatgctgctaccacgacatttggtataactcctgctgtacctcatggctttggaatagggtacatcattaaagatgatcaagtagatttgaccgtgacatcgcaatttcgacagggtgacaggttaatgtttatgttaagttgggtgttaggcgaaattcgttcctactggaggatgtcacgcggcacttctcataataaaactggcgtgaagatcagtccagtggtcgataaattgtatgaaatggacaatgcagtcaataatcctccgaaacgtaacggccatacagtcaatggctcccgcaaaacatcttcttcatcacaggtaaatttgaacaggtatggcgggtttttcgatttggaaggccacattgacagtaggaatatatctaaaacaccatcgatgaagaatttgcagaaaaccttcaatggcttgaccatgagcgcagacaatgatcattcaagttccgcagtttccgttcccacagaaaaggaaaaattaaatacaggccatgaaattttacagatccaaccgcgggaagtggcaagtaatgggttggaagcagatgatgagacagatattgaaatagttgctggcaatgctgatggcacatcctcttcggcatcttcagctacatctctaaattccaagaaacgtaacgtcatcaactcaagattcgatattgattttgaccgcagtcgtgtgggtagaaaggtggcgaccttagatcaataa

SEQ ID NO: 25422 - DNA, 1584 bp, Saccharomyces cerevisiae
atgagtgacttacaagaccaagaacctagcattattatcaacggtaatttggaaccagttggtgaaccagatatcgttgaagaaacggaagttgtagctcaagaaacacaagaaacacaagatgctgataagccaaagaagaaagtcgccttcactggcttggaagaagacggggaaactgaagaagaaaaaaggaaaagggaatttgaagaaggtggtggtttgcccgaacaaccattaaaccctgatttttcaaaattaaacccactatccgccgaaattatcaacaggcaagctacaataaacatcggtaccatcggtcatgtcgcccacggtaaatccacagtagttagggctatttcaggtgtccaaacagtccgttttaaggatgaattagaacgtaacattactattaagttaggttacgctaatgctaaaatttataaatgtcaagagcctacatgtcccgaacctgattgttatagatcattcaaatctgataaagaaatcagtcctaaatgtcaaagaccaggttgtccggggcgttacaaattggtccgtcacgtttcttttgttgactgtcccggtcacgatatcttaatgagtactatgttatcaggtgctgctgttatggatgctgcgttactgttgattgcaggtaatgaatcttgtccacaacctcaaacctcagagcatttagctgccattgaaatcatgaaattaaagcacgtcatcatcttacagaataaggtcgatttaatgcgtgaagaaagtgccttagaacaccaaaaatccatcttgaagttcatcagaggtaccattgctgacggtgctcctattgtaccaatatccgctcagttgaagtataacatcgacgcagttaatgaatttattgtcaagactattcccgtaccaccaagagattttatgatttctccaaggttaattgttattcgttcatttgatgttaataagccaggtgctgaaatcgaggacctgaaaggtggtgttgccggtggttctattttgaatggtgttttcaaattaggtgatgaaattgagattagaccaggtattgtcaccaaggatgataagggtaaaattcaatgtaaaccaatcttttctaacattgtctccttatttgccgaacaaaatgacttgaagtttgctgttcccggtggtctgattggtgttggtactaaagttgatcctaccttgtgtagagctgatcgtcttgtcggtcaagtcgtcggtgctaagggtcatttgccaaacatttatactgatatcgaaatcaactactttttgctacgtcgtctattaggtgtcaaaacagatggtcaaaagcaagccaaagtcagaaaattagagccaaatgaagttcttatggtcaacattggttctaccgctacgggggctcgtgtggttgccgttaaagctgatatggcaagattacagttaacgtcgcccgcttgtactgaaattaacgagaagattgctttgtcgagacgtatcgaaaagcattggcgtttgattggttgggcaaccattaaaaagggtactacattggaacccatcgcttaa

SEQ ID NO: 25423 - DNA, 831 bp, Saccharomyces cerevisiae
atggttgaatcagatgaagatttcgcacctcaagaattcccacacacggacacagacgttatcgtaaatgaacacagagacgaaaatgacgggtatgcctcagatgaagttggtggcacattaagcagaagggcctcaagtatattttctataaatacaactccattggccccccctaatgctactgatatccaaaaatttacaagtgacgaacatcatttcagcatgatgaggaatttgcatatggcagattacattactatgctgaatggattttctgggttttactctattgtaagttgtctgagatttacgcttacaggtaaacctcattacgtccagcgtgcccatttctttattttattgggtatgtgtttcgatttccttgacgggagagtagcacgtctgagaaataggtcttccttaatgggtcaagaactggactctttggccgacttggtttcctttggtgtggctccggctgcaattgcttttgccattggatttcaaactacattcgatgtcatgattttatctttctttgtcctttgcggcttagcgagattagcaaggtttaatgtcaccgttgctcaattacccaaagattctagcacaggtaaatctaaatattttgagggattgcctatgccaaccactctagctttggtgttgggtatggcatattgtgtcagaaagggtttaatttttgataacatcccattcggcatttttagagaagaccaaatattggaatttcatccaattattctagtattttttatccatgggtgtggaatgatttcgaagagcttgaaaattccaaagccatag

SEQ ID NO: 25424 - DNA, 1185 bp, Saccharomyces cerevisiae
atgaattacctgcgagatagatttcctccggataatgaccaaagaccctttagatgtgaaatttgttcacgaggtttccacagacttgaacataaaaaaaggcacggaagaacgcacactggcgagaagcctcacaaatgtaccgttcagggctgtccgaaaagcttcagccgaagcgatgaactaaaaagacatttgaggacacatactaaaggcgtccaaaggcgcagaataaaatccaagggctcgcgaaaaaccgttgtgaatactgctaccgccgcccctaccaccttcaatgaaaacactggtgtttcgctcacggggataggtcaatctaaagtgccacctattcttatctccgttgctcagaattgcgatgacgtgaatatacgaaatactggaaataataatggcattgtggagacacaggcacctgcaattttagtgcctgtgataaatattccaaatgaccctcatccgattccaagtagcctctccactacttctatcacctccattgcatcagtatatccctctacttctccattccagtacctgaaaagcgggtttcctgaagatcctgcatctacaccgtatgtacattcgtccggaagttctttagccctgggtgaattgtcttcaaactcctctatattttcgaaatctaggaggaatttggccgccatgagtggtcctgattctttgagtagttctaaaaaccaatccagtgcttcgcttctttctcaaacttcacatccatcaaagagcttttcaagaccgccaacagacttaagtcctctgcgaagaatcatgccttctgtaaacacaggagacatggaaatttcaaggacagtatccgtttcgagcagttcatcatcactcacttctgttacgtatgatgacaccgcggctaaagacatgggcatgggaatattttttgataggccacctgtaacacagaaagcttgcaggagcaatcataagtacaaggttaatgctgttagcagagggagacaacatgaaagggcacaatttcatatatctggagatgatgaggacagtaacgttcaccgccaagaatcaagagcatccaacacaagtcccaatgtatcattgcctccgataaagagcattttgcgacaaattgataatttcaacagtgctccttcttacttcagtaaataa

SEQ ID NO: 25425 - DNA, 672 bp, Saccharomyces cerevisiae
atgagcagcgaggactacgggtatgattacgacctactatttaaaattgtactgatcggtgattccggggtagggaaatccaatctattgtcaagatttacgaagaacgaattcaatatggattcaaagtctacaattggggttgagtttgccaccagaactttggaaattgatggcaagaggatcaaggcgcagatttgggatactgcgggccaggaacgttacagagccattacttctgcttattatagaggagctgtaggtgccttgatcgtttacgatatcagtaaatcaagctcatatgaaaattgtaatcattggttatcagaattaagagaaaatgcagatgacaacgtcgcagtggggcttatcggtaacaagtctgatttggcccatttacgtgctgtacctacggaggagtccaagacttttgcacaggaaaatcagttattattcacagaaacaagtgctttgaacagtgaaaacgtggataaggcttttgaagagttaatcaataccatctatcaaaaggtcagcaagcatcaaatggaccttggtgactccagtgccaacgggaatgccaatggtgcgtccgctcctaatggaccaacgattagtctgacaccaacaccaaacgaaaacaaaaaggcaaatggaaataactgttgttaa

SEQ ID NO: 25426 - DNA, 555 bp, Saccharomyces cerevisiae
atgtcgtcgcttatttcaaaaaccattaagtatgatccagccaaggataaattaatcacattagcatgtggatgtttttggggtacagaacatatgtataggaagtatttgaatgaccgtatagtggattgtaaagtaggttacgctaatggagaagagtctaaaaaggatagcccctctagtgtctcttataagagagtttgtggtggtgacacagattttgcggaggttttacaagtatcctataatcccaaagtgataactttgagagaattaactgatttcttttttagaatccatgatcctactacatctaattcacaaggacctgataaaggtacacagtatcgcagtggattgttcgctcattcagatgctgatttaaaagaattagccaaaataaaggaagaatggcaaccaaaatggggtaataagattgccacagttattgaaccaatcaagaacttttacgatgctgaagaataccaccagttatatttagataagaatccacagggatatgcatgccctactcattatctgagagaaatgtag

SEQ ID NO: 25427 - DNA, 1350 bp, Saccharomyces cerevisiae
atgtctgctccagctcaaaactacaaaatcgctgatatctctttggctgccttcggtagaaaggaaatcgaattggctgaacatgaaatgccaggtttgatggccatcagaaaggcttacggtgacgtccaacctttgaaaggcgcccgtattgctggttgtttgcacatgaccattcaaactgctgttttaattgaaactttagttgctttgggtgccgaagttacctggtcctcttgtaacatctattcgactcaagatcatgccgccgctgctattgccgcttccggtgttccagtttttgcctggaagggtgaaactgaagaagagtatttgtggtgtattgaacaacaattgtttgccttcaaggacaacaagaaattgaacttgatcttagatgatggtggtgatttaaccactttagttcatgaaaagcaccctgaaatgctggaagactgctttggtctttccgaagaaactaccaccggtgttcaccacttatacagaatggtcaaagaaggcaagttaaaggttcctgccattaacgttaacgactccgtcactaagtccaagtttgacaacttgtacggctgtagagaatccttagtcgacggtattaagagagccactgatgtcatgttggctggtaaggttgccgttgttgctggttacggtgatgtcggtaagggttgtgctgctgccttaagaggaatgggtgctcgtgtcttggttaccgaaattgacccaatcaacgctttacaagctgccatggaaggctaccaagttgttaccatggaagatgcatcccacattggtcaagttttcgttaccaccactggttgtagagatattatcaacggtgaacatttcatcaacatgccagaagatgccattgtttgtaacattggccatttcgatatcgaaattgatgtcgcctggttaaaggctaacgctaaagaatgtattaacatcaaaccacaagtcgaccgttacttgttgtcttctggtagacacgtcatcttgttggctaacggtagattagttaacttgggttgtgctactggtcactcatctttcgttatgtcttgttccttctctaaccaagtcttagctcaaattgctttgttcaagtctaacgataagtctttcagagaaaagcacattgaattccaaaagacaggcccattcgaagttggtgtccacgttttgccaaagatcttggatgaagctgtcgctaagttccacttgggcaacttgggtgttagattgactaaattgagtaaagtccaatctgaatacttgggtattccagaagaaggtccattcaaggccgaccactacagatattga

SEQ ID NO: 25428 - DNA, 1584 bp, Saccharomyces cerevisiae
atgccaatggatttccaacctacatcaagtcattcgaactgggtcgtgcaaaagttcggtggtacatctgtcggtaaatttcccgtccaaatagtggatgacattgtgaagcactattctaaacctgacggcccaaacaataatgtcgctgtcgtttgttccgcccgttcttcatacaccaaggctgaaggtaccacttctcgtcttttgaaatgttgtgatttggcttcgcaagaatctgaatttcaagacattatcgaagttatcagacaagaccatatcgataatgccgaccgcttcattctcaatcctgccttgcaagccaagttagtggatgataccaataaagaacttgaactggtcaagaaatatttaaatgcttcaaaagttttgggtgaagtgagttcacgtacagtagatctggtgatgtcatgtggtgagaagttgagttgtttgttcatgactgctttatgtaatgaccgtggctgtaaggccaaatatgtggatttgagccacattgttccctctgatttcagtgccagcgctttggataacagtttctacactttcctggttcaagcattgaaagaaaaattggccccctttgtaagtgctaaagagcgtatcgttccagtctttacagggttttttggtttagttccaactggtcttctgaatggtgttggtcgtggctataccgatttatgtgccgctttgatagcagttgctgtaaatgctgatgaactacaagtttggaaggaagttgatggtatatttactgctgatcctcgtaaggttcctgaagcacgtttgctagacagtgttactccagaagaagcttctgaattaacatattatggttccgaagttatacatccttttacgatggaacaagttattagggctaagattcctattagaatcaagaatgttcaaaatccattaggtaacggtaccattatctacccagataatgtagcaaagaagggtgaatctactccaccacatcctcctgagaacttatcctcatctttctatgaaaagagaaagagaggtgccactgctatcaccaccaaaaatgacattttcgtcatcaacattcattccaataagaaaaccctatcccatggtttcctagctcaaatatttaccatcctggataagtacaagttagtcgtagatttaatatctacttctgaagttcatgtttcgatggctttgcccattccagatgcagactcattaaaatctctgagacaagctgaggaaaaattgagaattttaggttctgttgatatcacaaagaagttgtctattgtttcattagttggtaaacatatgaaacaatacatcggcattgctggtaccatgtttactactcttgctgaagaaggcatcaacattgaaatgatttctcaaggggcaaatgaaataaacatatcctgcgttatcaatgaatctgactccataaaagcgctacaatgtattcatgccaagttactaagtgagcggacaaatacttcaaaccaatttgaacatgccattgatgaacgtttagaacaattgaaaagacttggaatttaa

SEQ ID NO: 25429 - DNA, 903 bp, Saccharomyces cerevisiae
atggagtccaataaacaaccacgtaaaatccaattatatacgaaagagttttatgccacatgtaccttaggtggtataattgcgtgcggtccaacacattcttcgatcactccactagatcttgtcaaatgtaggctacaggtcaatcccaagttgtatacttcaaacttacaagggttccgtaagattatagctaatgaaggctggaagaaagtatacactgggtttggtgctacattcgtcggatattcgctacaaggtgcaggtaagtatggtggttatgagtatttcaagcatttgtattctagttggttaagtcctggtgtcactgtgtacttgatggcctcagcgaccgctgaattcctcgctgatatcatgttgtgcccatttgaagctattaaagtgaaacagcagactactatgccgcccttttgcaataacgttgttgatggatggaaaaaaatgtatgcagaaagtggaggtatgaaagcattttataaaggtattgttcccctatggtgcagacagattccttacacaatgtgtaagtttacctcattcgaaaaaattgttcaaaaaatatacagtgttttacctaaaaagaaagaagaaatgaacgcattacagcaaatatcagtcagttttgtaggtggttatctggcaggtatattatgtgctgcagtctcacatcctgcagacgttatggtttccaagatcaatagcgaaagaaaggccaacgagtccatgtctgtagcctctaaaagaatatatcaaaaaattggctttactgggttgtggaatgggttaatggtgagaattgtcatgatcggtactttgacaagtttccaatggctaatttacgattcgttcaaggcttatgtaggcttaccaaccaccggttag

SEQ ID NO: 25430 - DNA, 894 bp, Saccharomyces cerevisiae
atggatttggtgaaccatctaaccgatagactactgtttgcaatcccaaagaaaggtcgtttatattctaaaagtgtttctattttgaatggtgctgatattacctttcaccgctctcaaagattagacattgcactaagcacaagcttacctgtagcgttggtctttctgcccgctgcagatattccaacttttgttggtgaaggtaaatgtgatcttggtataactggtgttgaccaagttcgtgaatctaacgtcgacgtagacttagcaatcgatttgcaatttggtaactgtaaattgcaggtacaagtccccgtaaatggcgagtataaaaagccagaacagttaattggcaaaaccattgttaccagtttcgtgaaacttgctgaaaaatactttgccgatttggaaggtactactgttgaaaaaatgaccacaaggataaagtttgtcagtggttccgtggaggcatcatgtgctctgggaattggtgatgctattgtagatcttgtagagagtggtgagacaatgagggcagcaggtttagttgatattgccaccgtcctaagcacaagtgcctacctaatagaatcaaagaacccaaagagcgataagagtttgattgctactatcaaatcaagaattgaaggtgtcatgaccgctcaaaggttcgtttcatgtatttataacgcacctgaagacaagctgcctgaactgttgaaggtgacgcctggccgtagagcaccaaccatttccaaaattgacgatgaaggatgggttgctgttagttccatgattgagagaaaaacgaagggtgttgttttagatgaattgaaaagactcggcgcatctgatatcatggttttcgaaatttctaattgtcgtgtataa

SEQ ID NO: 25431 - DNA, 1263 bp, Saccharomyces cerevisiae
atgtctatcaaaggtgattccccctcatcaacaaatgccagtagtagtccgaagtctacatattcaatacaatcggatgataaagcaaaccttggcagtggtaacgtcgatatacgtacagataattcacaacaggacagtaataatagacgcgatattgtggtagtgacgagggtagcttctgaagagactttagaatcacaatcatctacttcatcaatgggaattagaccagaatcatcttttaactatgaggatgcttctaaccaagctagggtcgaaatgaataacagggtacatggctcaaatatgaacacaattaacaaatattatccagtacgattcccaaagaataacgaaaggcaattgagcgacacaaataatttaaatgagaaagtgcaaggcacacatacagttcaatcatccacccaggaagacaaaatactcgacggtgacacaagcaactcacaagtaaccccgtctttgaacattgcagagtttcccacagacaagcttcttaaaatgctgacagcgttactaactaaaattattaagtcaaatgataggacggcagcgacaaatcctagtttgacacaagagattgagaatggtaggtgtcttgctttaagtgacaatgaaaagaaatacttaagccccgttctggggtttagagggaagcacgtaccacaaattggtcttgaccaatatttccagaggatccagaaatattgccccacaacgaatgatgtatttttatcgctcctcgtgtactttgatagaatatccaagagatgcaatagtgtcactacgacccctaaaactaatactgcaaaacatgaatctccctcaaatgaaagctctctagataaagctaacaggggcgctgacaaaatgtccgcatgtaacagtaacgaaaataatgaaaatgacgattcagatgatgaaaatacaggagttcaaagggattcaagggctcatcctcaaatgttcgtaatggattcacataatattcacagattaatcatagcaggtattactgtcagtacgaagtttctgagcgatttcttctatagcaattcaagatactcaagggtaggtgggatatctttacaagaactcaaccatttggaactgcagtttctagttttgtgtgattttgaacttttgatatcagtcaatgaattgcagagatacgcggacttactatacaggttttggaacaacgcaaaagctcaatcgcaagcactagttacgggcatgtag

SEQ ID NO: 25432 - DNA, 1329 bp, Saccharomyces cerevisiae
atgtcaagaagagtggttatcacaggattgggctgtgtaacgccgttgggaagatcattaagtgagtcatgggggaatctgctctcttccaaaaatggactcacaccaatcacatctttgcccaactataatgaggactacaaactcagagaaaaaagtatcccatcaacgataacagtggggaagattccagagaattttcaaaacgaaaattcagccatcaataaactgctgttcactagccaggatgagagaagaacctcaagctttatcaagctagcactacgtacaacttatgaagcgcttcacaatgctggtctcttgaacccaaatgatataaccatcaatacatctctgtgcaatctggatcactttggttgcctgataggttctggtataggatccattcaagacatataccaaacttctctacaattccataacgacaataaaagaataaatccatatttcgtccctaaaatccttacaaatatggcagctggtaatgtttccatcaagtttaaccttagaggattatcccatagtgtttccacagcatgcgcaacaggtaataactccattggcgatgcattcaattttattcggttaggcatgcaagacatctgtgtcgccggtgcaagtgaaacgagtttgcatccgttaagtttagcaggtttcatcagagcaaagtcgattactacaaacgggatctctagaccctttgatacacaacgttctggattcgtacttggtgaaggatgcggaatgattgtcatggaatcgctagaacatgctcaaaagagaaatgcaaacataatttctgagctcgtgggctatggtttaagcagtgatgcctgccatattacctcccctcctgctgatggaaatggtgccaaaagagcaatagagatggctctaaaaatggctagattagaaccaactgatgttgactacgtcaatgcacatgctacatcaactttactaggcgataaagcagagtgtctggcagtagcctcagcactcttaccaggaagatccaaaagcaagccactgtacatatccagtaacaaaggtgcaattggccatcttttaggtgcagctggcgccgtagaaagtatatttacaatttgttccttgaaggatgataagatgccgcataccttaaacctggacaatgttctgactctagaaaataacgaggccgataagctacatttcataagagacaaacctattgtgggagctaatccgaagtacgcattatgcaacagcttcggatttggaggagttaacacatctcttctcttcaagaaatgggaagggagttaa

SEQ ID NO: 25433 - DNA, 753 bp, Saccharomyces cerevisiae
atgggattgactactaaacctctatctttgaaagttaacgccgctttgttcgacgtcgacggtaccattatcatctctcaaccagccattgctgcattctggagggatttcggtaaggacaaaccttatttcgatgctgaacacgttatccaagtctcgcatggttggagaacgtttgatgccattgctaagttcgctccagactttgccaatgaagagtatgttaacaaattagaagctgaaattccggtcaagtacggtgaaaaatccattgaagtcccaggtgcagttaagctgtgcaacgctttgaacgctctaccaaaagagaaatgggctgtggcaacttccggtacccgtgatatggcacaaaaatggttcgagcatctgggaatcaggagaccaaagtacttcattaccgctaatgatgtcaaacagggtaagcctcatccagaaccatatctgaagggcaggaatggcttaggatatccgatcaatgagcaagacccttccaaatctaaggtagtagtatttgaagacgctccagcaggtattgccgccggaaaagccgccggttgtaagatcattggtattgccactactttcgacttggacttcctaaaggaaaaaggctgtgacatcattgtcaaaaaccacgaatccatcagagttggcggctacaatgccgaaacagacgaagttgaattcatttttgacgactacttatatgctaaggacgatctgttgaaatggtaa

SEQ ID NO: 25434 - DNA, 2592 bp, Saccharomyces cerevisiae
atgccatctgctagcttactcgtctcgacaaagagacttaacgcttccaaattccaaaaatttgtgtcttcattaaacaaatccaccatagcaggatttgcatctgtacccttgagagctccaccatccgttgcatttacgagaaagaaagtcggatactcaaagaggtatgtttcatctactaacggcttttcagctactagatccactgtgatccaactgttgaacaatatcagcacaaaaagagaggttgaacaatatttgaaatatttcacttccgtctcacaacaacaatttgctgtgatcaaggtgggtggtgccattatcagcgacaatctacacgaactcgcttcctgcttggcatttttgtatcatgttggtctatatccaatagttttacatggtaccggtcctcaggttaatggaaggctagaagcgcagggaattgagccagactatattgatggtattagaatcacggatgagcacacaatggccgtagttagaaaatgttttttggaacaaaatcttaagctagttactgcattagaacagctaggggtccgtgcaagacccattacttctggtgtttttactgctgactatttggataaggacaaatacaagctagtgggcaatattaaaagtgtcacaaaagagccaattgaagcatctattaaggcaggtgccctaccaatcttgacctctttagccgaaactgcttctggtcaaatgttgaacgtcaacgccgacgtagctgctggtgaattagcccgtgtttttgagcctttgaagatcgtttacctgaatgagaaagggggtattatcaatggctccacgggagaaaaaatttcgatgatcaatttggatgaagagtatgacgatttaatgaagcaaagttgggtgaagtatggtaccaaattaaaaattagagaaattaaagagcttttggactatcttcctcgttcttcttcagttgcaatcattaacgttcaagatctacaaaaagaactgttcactgattctggtgcgggtactatgatcaggagaggttacaaattagtgaagagatcctccattggcgaatttccatccgctgatgctctaagaaaagctcttcaaagggacgctggcattagttccggtaaagaatctgttgcttcttatttaagatatttggaaaactctgattttgtctcttatgctgatgaacctcttgaagcagtggccattgtaaagaaagatacgaacgttcccacactagacaaatttgtctgttctgacgcagcctggttgaataacgtcacagataatgtattcaatgttttgcgccgtgattttcctgctttacaatgggtagtcagtgaaaatgatgctaacattgcatggcattttgataagtctcaaggttcatatctaaaaggcggaaaagttttgttctggtatggtatcgatgatataaatacaatatccgagctcgttgaaaattttgtgaagtcgtgtgacactgcttctaccctcaactcatcagcaagtagtggagtatttgctaacaaaaaatcagctaggtcgtactcaactagatccactcctcgtcccgagggagttaacaccaaccctggtcgtgtcgcgcttattggtgctagaggttacacaggtaaaaatttggtatctttgatcaacggccacccatatttagaagtggcccatgtttcttctcgtgaattgaaaggtcaaaagttgcaagattatacaaaatccgaaattatatatgaaagtttgcaaatacaggatattaggaaactggaagaacaaaatgctgtggacttttgggttatggcattacccaacaaagtctgtgaacctttcgttgagacaatccaaagtgttcatggtaagtctaaaattattgatctgtccgctgatcacaggtttgtatcagaatcagactgggcttacggtttgccagaattgaatgatagagcaaaaattgcaaacgctgccaaaattgctaatcccggttgttatgctactggttcgcaattaactatttctccgttaacaaagtatatcaatggtcttccaactgtgtttggtgtttcagggtattcaggcgcggggacgaagccttctccaaaaaacgatcccaaattcttgaacaataacttaattccttacgctttaagtgatcatatacacgaacgcgaaatctcagctcgcattgggcacaatgttgcattcatgccccatgttgggcagtggtttcaaggtatctctttgaccgtctctattccaataaaaaaaggttccttgtctattgatgagatcaggaaattatacagaaatttttacgaagacgaaaagctagtacatgtcatcgatgatatcccactggttaaagatattgagggcacccatggtgtagttattggtggtttcaagctgaatgatgctgaagatcgtgtagttgtttgcgcaaccatcgataacttacttaaaggcgccgctactcaatgtctgcaaaatattaatcttgctatgggttatggagagtatgctggtatccctgaaaataaaattattggtgtctga

SEQ ID NO: 25435 - DNA, 2667 bp, Saccharomyces cerevisiae
atgtacgtttataaaagagacggtcgtaaagaacctgtccaattcgataagattaccgctcgtatatcacgcttatgctatggtttagatccaaaacatatcgacgccgttaaggtcacccaacgtatcatttctggtgtctatgaaggtgtcacaacaatcgaactagacaacttagccgctgaaacatgcgcttatatgactactgttcatccagattacgccaccctagcggccagaattgccatttctaatttacataaacaaaccacaaaacaattttctaaggttgtcgaagatctttatagatacgtcaatgctgctactggtaagcccgctcccatgatctctgatgatgtctacaatattgtcatggaaaacaaggataaattgaactccgcaattgtctatgacagagattttcagtacagttattttggttttaaaactttggaacgttcttatttactaagaatcaacggtcaagtggccgaacgtccacaacatttaattatgagagtcgcactaggcatccacggtagagatatcgaggctgctttagaaacgtataacttgatgtctctaaaatattttactcacgcctctccaacgttgttcaatgccggtactccaaaacctcaaatgtcctcttgtttcttggttgccatgaaggaggactctatcgaggggatttacgacaccttgaaggaatgtgctttgatttccaaaactgctggtggtattggtctacatatccataacattcgttcaactggttcttacattgctggtacaaacggtacttctaacggtttaattcctatgattcgtgttttcaataacactgcccgttatgttgaccagggtggtaataaaagacctggtgcgtttgccctttacctggaaccatggcatgctgatatatttgattttattgatattaggaagaaccacggtaaagaggaaattcgtgcaagagatttgttccctgctctatggattcctgatcttttcatgaagcgtgtcgaagaaaatgggacctggacattattctctccaacatcagctcctggtttaagcgattgttacggtgacgagtttgaggctctatatacccgctacgagaaagaaggtcgtggtaagactatcaaagcccaaaaattatggtattccattttggaagctcaaactgaaactggtacacctttcgttgtttacaaggatgcttgtaacagaaaatctaatcaaaaaaacttaggtgtcatcaagtcatcaaacttatgctgtgaaattgttgaatactcagctccagatgaaactgctgtttgtaacttggcttccgttgccttaccagcattcattgaaacttctgaggatggtaagacttccacatacaacttcaaaaaattacatgaaattgctaaagttgttactcgtaatttaaacagagtcattgatcgtaattactaccctgttgaagaagcgagaaaatccaatatgagacatagaccaattgctttgggtgttcaaggtctcgctgacactttcatgctgttacgtttgccatttgattctgaggaagcccgtttgctaaatatccaaatctttgaaactatttatcatgcctccatggaagcttcttgtgaactagctcagaaggacggtccatacgaaactttccaaggatctcctgcttctcaaggtatactacagtttgatatgtgggaccaaaaaccctacggcatgtgggattgggacaccttaagaaaagatatcatgaagcatggtgttagaaattccttgaccatggcaccaatgcctactgcatccacatcccaaatattgggttataatgaatgtttcgaaccagtcacttccaatatgtactcccgtcgtgtcttatccggtgaattccaggttgtgaacccttacttactgcgtgacttggttgatttaggtatttgggatgagggtatgaaacagtatctgattacacaaaatggctccattcaaggcttaccaaacgttccacaagaattgaaggacttatacaagactgtttgggaaatttcacaaaagactatcattaacatggcagccgatcgttctgtctatattgatcaatctcattctttgaatttgttcttacgtgccccaactatgggtaaactaacaagtatgcatttttacggatggaagaagggattgaagaccggtatgtactatttgagaacccaagctgcatctgctgcaattcaatttactattgatcagaagattgcggatcaagctacagaaaacgttgctgatatttccaacttgaagcgtccatcatatatgccttccagtgcaagctacgctgccagcgatttcgtgcccgcagctgtgactgcaaacgcaactattccatctctagatagctcctcggaagcttcaagagaggcatctccagctccaacaggtagccactcattaactaaaggaatggcagaattaaacgttcaagagtctaaggtagaagttcctgaagtacctgccccaactaagaatgaagaaaaagctgcccccatcgttgatgatgaggaaaccgagttcgacatttacaactctaaggttatagcatgtgctattgataacccagaagcttgtgaaatgtgttcgggttaa

SEQ ID NO: 25436 - DNA, 1563 bp, Saccharomyces cerevisiae
atgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaatccatctaacgaagaaaagataacaactgtatacaaggctatggaagatgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacaggtaaaaaccattttacctactcaattaaggaaccattaggcgtttgcggccaaataatcccttggaacttccctttattgatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatctagataaagccgtcaagaacattgccttcggtattttttacaactctggtgaagtttgctgcgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaaggagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttga

SEQ ID NO: 25437 - DNA, 2787 bp, Saccharomyces cerevisiae
atgaaggacagtgtagactgcccaagcattctacccaccgaccgcacttcagtgctttccgagactagcactttggtcggatcgagttcgcatgtatattcgaggcatgctcctatgaacagttatcataacagcatgaacagcaacatataccacagccccaaagccagtagccctttggtgagctataagacatcttcgccggtgttattgaagagggcgaccgctcctgtcctgccaagcttcaagcccaaggaacagcgatataataagccgcagggttgttcgctaattactgctgtagaactgggcaagattattgaaaccttaccagatgaaaaggtgctcttacttgatgttaggccgtttaccgaacatgccaaatccattatcacaaactccattcatgtatgtttgccttccacgctgctgaggaggaaaaatttcaccttttccaaactcttggacaacttaactcctagcgagcaaagcgtgttgaaatctaaactggccatcgataaccttcggattatcatttatgatagcaccgcaaatcaaacggaaagttctgtttctttaccttgttatggaatagcgtccaagctaatagagtttgatactaatgttaaaaaaaccgtgtctatactaatgtgtggttttcctcaattcaaaattctatttccagaccatataaacaccaacacatttaactcagattgcattagttcggctgaacctaaaagccccaagacaaaccttatgaacagtctacacaacacagcgccgcatatgacggcgacaacaccactatcgtctccgcaaatgaaccttaagttgaaagttcctgacgatagtaggtcagatcattcaaacttttccagttctccctctccgcgtaacgtcctatcagattctcccatgtcttcttcttcccccatatctgccttatttaagttccagctgcctgcaccacaaacaaacataaaccaaatgttcaaattttcgcaaaatgaagaaataatgggtttagagacgtatttgagtgcagtcaacatcaaagaagaacatgaaagatggtataataacgattctgccaaaaaatctttacaaaacttccaattcccaaagaaccaaaattctctagaaaaggacactaataaagacaaactagggtttcagatcagatacgaaaacctgagcaaaaattacgaaaaggaggtcattgactccgttatacctgaatggttccagcatctgatgtcaatacccaagatcgagttggtttctcagtttcaaaaattagattttttggaaaaaaggcgcttgaaccattctgtctctttcaggaagaaggaaaactcgtttatacttgaaaagccatcatcatatcctgaacagttaacatcaacttcttcttcaacaatcatgcctccaaaatttcctgacgtgaacaaagtacaaaagaggtcgcattctcagccaatcttcactcaatacagtaaatataaatcgatgctcagccttgaatcagattccgattcggagtcagatgacgttataatatcatcaggcgttgaattaggagccaagaacaggtacaaggatatttttccctacgagcattcgagagtgattctaaaaaaaggtttgcaatcatcaaaaggtatcaagcattcacattctacttccgatggtggcatcctcgacaattatatcaacgcaaactatttgtctctgccaaggttttctgtagagcaaaattcgtcatttcaaacaactacaaccacaacaagaagagtgcgctatatagcgacgcaagctccaatgccctccactgtacatgacttttatacatgcatattgaataatggcgttccgttggttctctcattgacaaatgatttcgaaaatggcattgagaaatgttatcgatattggcaagaaggtaattataacggtattcacgttaaattgttagaaaaaaaaatattaaagatgcctagcactactagcatgaggaaaaatactatgggaacacaaaatagtagtttatattcagctggtgttcagggaaatagtagtaactatagtactgataatgataatgataatgacaacaataataataacaataacaatagtaatattcctgttactgctgctgcttgtgatgatgatgatgatgatgatgatgacgcaattctcataagacaaattctgctaacatatcatgatcaagagaaaccttatgaattgttacagattcaggtgaaaaattggcctgatttgggcactttactcaatcctatctcaatcttacaagcaatcaatgtcaagaatcacataatagatacactatttgccagaaattactatcaaaacgaccaacttcctaccattttggttcattgttccgcaggttgtggaaggactggtactttgtgtaccattgattccattctatccaatttcgaaatgtttgaaatgttgcagaaagagtttgttaaattaaaatacccggcaaagttattcgatccaatttcatggacaattaatatttttagaaaggaacgaatatccatggtccagaacattaatcaatttattttcatttatgactgcttgctattttactttagattacgtcttgatgacataacagagagaacggatggtgatggaagtaacaaggacaatatatcattaagtgcattaattgaacaaatcgaaaaattagagatcttgcagacattcgtggatgataagttgaaagaattgccacaatag

SEQ ID NO: 25438 - DNA, 1536 bp, Saccharomyces cerevisiae
atgttacataggataaacccagtacggttttctatgcaatcttgccaaagatacttctcgaagttggtatcgccattggaacagcataaaagtaatacttttactaatagagtcagaatccccattgaggcaggccaaccactgcatgagacaaggccgttccttataaagtcgggcgagttgacaccaggcatttcagccttggaatactatgaaagaagaattaggttggcggaaacattgcctcccaaaagttgtgtgattttagctggtaacgatatccaatttgcatctggagcagtattttatccgttccaacaggaaaatgacctgttttatcttagtggttggaatgaacctaattcggtcatgattttagaaaagccaacggatagtttaagtgatacaattttccacatgctggttccgccaaaggatgcgtttgctgaaaagtgggaaggatttaggtctggggtttatggtgttcaagaaattttcaatgccgatgaatctgcttccattaacgatttgtctaaatatttgcccaaaataattaacaggaatgatttcatctattttgatatgctatcaacttctaatcccagttcgtccaattttaaacacatcaagagcctgttagatggcagtgggaatagcaatcgatcattgaattccattgcgaataagaccatcaaacccatcagtaaaagaattgcagagttccgtaagatcaagtcccctcaagagttgagaattatgaggagagctggccaaatatcaggaagatcgttcaatcaagcctttgctaaaagatttaggaatgagagaactttagattcctttcttcattacaagtttatatccggtggttgcgataaggacgcatatatccccgtggtcgctactggttcgaattctttgtgtatccattacacaagaaacgatgatgtgatgtttgacgacgaaatggttcttgtagacgctgctggctccttgggtggttattgtgctgatatttcgagaacgtggcccaatagtgggaaattcactgatgcacaaagagatctctacgaagctgtattaaatgttcagcgtgattgcattaagttatgtaaagctagcaataactattccctccacgacatccatgaaaagagtatcacactcatgaaacaggaattgaaaaacttgggcatagataaagtctccggttggaatgttgaaaaattgtatccgcactatattggacacaatttaggtctagatgttcacgatgtgcctaaagtttccaggtacgaaccattaaaggttggacaagttattactattgaaccgggtttatatattcctaacgaggaatcatttccatcttactttagaaacgtcggaataagaattgaagatgacatagccattggtgaagatacttacactaatttaactgttgaagcagtgaaagaaattgacgatttagaaaatgtcatgcaaaatggcttatctacaaaattcgaggaggaccaagtggcaccactgtaa

SEQ ID NO: 25439 - DNA, 1395 bp, Saccharomyces cerevisiae
atgggacaaattctatcaaacccggtaattgataaagagagccactccggtgctgactccttgaccgcgtttggactgtgtgcaatgcaagggtggcggatgtcaatggaggattcacacattctagagcctaatgttttgacaaagtccgataaggaccatattgcattttacggtatattcgatggtcatggtggcgctaaagtagcagaatactgtggtaataaaatagtggagatcctgcaagagcagaaatcgttccatgaaggaaatttaccaagggctttgattgatactttcataaacacagacgtgaaactgttacaagatcctgtgatgaaagaagaccatagcggatgtacggctacatccatattagtatcaaagtcccagaacttgttagtatgtggtaacgctggtgacagtagaaccgtactcgccaccgacgggaacgcaaaggcattatcatacgatcacaagcccactctagcaagcgaaaaatcacgtattgtggcagctgatggcttcgtagaaatggatagggtcaacggtaacttggcgctctctcgtgccattggtgattttgagttcaaatccaaccccaaattgggccccgaggagcaaatagtgacatgtgttccggacattctcgagcattctctagattacgatagggacgagtttgtaatcttagcctgtgatggtatctgggattgtttgacttcccaagattgtgtggacttggttcatctcggccttcgcgaaggcaagacattgaatgaaatttcttcgcggatcatcgatgtctgttgtgctcccaccacagaggggacgggtattggatgcgacaacatgagtatagtggttgtcgcgctgctgaaagaaggtgaagacgtcgctcaatggagcgaccgtatgaagtccaaggcccaccgcacatcagtgcgttcttttgcagacaagagaagaagggtgtttagttactacgatttttccaaatgtaacgacgaacaggtgttcgctatcactacgaagaaacctcaggacaaattcactcgcgaccacgaagccgctgtggcctcggtgactgccgccgataacgacgatccaatggacatagacgacacggacgctgacacagatgcagaaaatcttgacccttccagccaatccaagagcaagacctccggccccattgatctagcatccttggaggcgctacttggtgctacaggaggagtgaagacagacagcaacgggaacaaagtcacctacactcttccccagtctgccttggcccaactgctccaaaccatgggccatgacccggcttcctcccatcccgagaatgacagtaacactgaccacaaggccggccgttcccacttgcaatga

SEQ ID NO: 25440 - DNA, 2304 bp, Saccharomyces cerevisiae
atggttcaatctgctgtcttagggttcccaagaatcggtccaaacagagaattaaagaaggccactgaaggttactggaacggtaaaatcactgtcgatgaattattcaaggtcggtaaggatttgagaactcaaaactggaagttgcaaaaggaggctggtgttgatatcatcccatccaatgacttctccttttacgaccaagttttggatttgtctttgttgttcaatgtcattccagaccgttacactaagtacgatctatctccaatcgacactttgtttgctatgggtagaggtttacaaagaaaggccactgaaactgaaaaggctgtcgacgtcactgctttggaaatggttaaatggttcgactctaactaccattacgttagaccaactttctccaagaccactcaatttaagttgaacggccaaaagccagttgacgaatttttggaagccaaggagttaggtattcatactagacctgtcttgttgggtccagtttcttacttattcttgggtaaggctgacaaggattctctagatttggaaccattgtccctattggaacaattgttgcctctatacactgaaatcctatctaaattggcttctgctggtgccactgaagttcaaattgacgaacctgtcttagttttggacttgcctgccaacgcccaagccgccattaagaaggcttacacttacttcggtgaacaaagcaatctaccaaagattactttggctacttacttcggtaccgttgtccctaacttagacgccatcaagggcttgccagttgctgccttacacgttgactttgttagagctccagaacaatttgatgaagtcgttgccgccattggtaacaaacaaaccttgtccgttggtattgttgatggtagaaacatttggaagaatgatttcaagaagtcttccgctatcgttaacaaggctattgaaaagttgggtgctgacagagtcgttgttgccacttcttcttctctattgcacacaccagttgatttgaacaacgaaaccaagttggacgctgaaatcaagggctttttctctttcgccactcaaaaattggatgaagttgttgtgatcaccaagaacgtttccggtcaagacgttgctgctgccctagaagctaacgctaaatctgttgaatccagaggtaaatccaagtttatccacgatgctgccgttaaggccagagttgcctctatcgacgaaaaaatgtctactagagcagctccatttgaacaaagattgcctgaacaacaaaaagtcttcaacttgccattgttcccaacaacaactattggttccttccctcaaaccaaggacatcagaattaacagaaacaaattcaacaagggcaccatctctgctgaagaatatgaaaaattcatcaattctgaaattgaaaaggtcatcagattccaagaagaaattggtttggatgtcttagtccacggtgaaccagaaagaaacgatatggttcaatacttcggtgaacaaatcaacggttatgctttcactgttaacggttgggttcaatcttacggttccagatatgtcagaccaccaattattgttggtgacttgtccagaccaaaggctatgtccgtcaaggaatctgtttacgctcaatccatcacttctaagccagtaaagggtatgttgactggtccaattacctgtttgagatggtctttcccaagagacgatgtcgaccaaaaaactcaagctatgcaattagctttggctttgagagatgaagtcaatgatttggaagctgccggtatcaaggttatccaagttgatgaaccagctttaagagaaggtttaccattgagagaaggtactgagagatctgcttactacacctgggctgccgaagctttcagagttgctacttctggtgttgctaacaagactcaaatacactctcatttctgttactctgacttggatccaaaccatatcaaggctttggatgctgatgttgtttccatcgaattctctaagaaggacgatgctaactacattgctgaattcaaaaactatccaaaccacattggtctaggtttattcgatattcattctccaagaattccatcaaaggatgaatttatcgccaagatttcaaccatcttgaagagctacccagctgaaaagttctgggttaacccagattgtggtttgaagactagaggctgggaagaaactagattgtctttgactcatatggtcgaagccgccaagtacttccgtgaacaatacaagaattaa

SEQ ID NO: 25441 - DNA, 618 bp, Saccharomyces cerevisiae
atgtcggatccaagttctattaacggtggtatcgtcgttgcgatgacaggtaaagactgtgtggccattgcctgtgatttgcgtctcggaagccagtcactaggtgtgtcgaacaagtttgaaaaaatcttccactatgggcatgtgttcttagggattaccggtctggctaccgacgtgactactctgaacgagatgttccgctacaagacgaacctatataagttgaaggaagaaagggccattgagcctgaaacgtttacccaattagtgtcaagttcactttatgaaagaagattcggtccatactttgtggggccggtggtagcaggtattaattccaagtccgggaagccctttattgcgggattcgacctaatcggctgtatcgacgaggccaaggattttatcgttagcggtactgcatccgaccaactgttcggtatgtgtgagtccctgtacgaacctaatctagagccagaagatcttttcgaaactataagtcaggccctactgaatgctgctgaccgtgacgctctatcaggctggggagctgtagtatacatcatcaagaaggatgaagtggtgaagagatacttgaagatgagacaagattga

SEQ ID NO: 25442 - DNA, 1203 bp, Saccharomyces cerevisiae
atgtctcaagttcaagaacaacatatatcagagtcacagcttcagtacgggaacggttcgttgatgtccactgtaccagcagacctttcacagtcagtcgttgatggaaacggcaacggtagcagcgaagatattgaggccaccaacggctccggcgatggtggcggattgcaggagcaagcggaagcgcaaggtgaaatggaggatgaagcatacgatgaagctgccttaggttcgtttgtgccaatagaaaaactgcaagtgaacgggattactatggcggatgtgaaaaaactaagggagagtgggcttcacactgctgaagcggtagcatatgctcccagaaaggatttattggaaatcaaaggtatatcggaagctaaggcagataagttgctaaacgaagcggcaaggctagtgcctatgggatttgtcacggctgctgattttcatatgagaagatcggagctgatttgtttgacaacgggttctaagaatttggacactcttttgggtggtggtgtggaaactggttctattactgagcttttcggtgaattcaggacaggtaagtcccagctatgtcacactttggccgtgacatgccaaattccattggatattggtggcggtgaaggtaagtgtttgtatatcgataccgaaggtactttcaggccggtaagattggtatccatagctcagcggttcggattagacccggatgatgctttgaacaacgttgcgtatgcaagagcctataacgccgatcatcagttaagacttctggatgctgctgcccaaatgatgagcgagtctcggttttccttgattgtggtcgattctgttatggctctataccgtacggatttttctggtcgtggtgaactaagcgcaaggcaaatgcatttagccaaatttatgcgtgctttgcaaaggctggccgaccaatttggtgttgcagtcgtcgttactaaccaagtggtcgcccaagttgatggtggtatggcttttaatccagatccaaagaagcctatcggtggtaatattatggcacattcttccaccacgcgattaggtttcaaaaagggtaagggatgtcaaagattatgcaaagttgttgactcaccttgcttaccagaggctgaatgtgtgttcgcgatctatgaagatggtgttggtgaccccagagaagaagacgagtag

SEQ ID NO: 25443 - DNA, 2265 bp, Saccharomyces cerevisiae
atgataaaaagatggttatctgtgaataggaaaaagtcacacccggagaagaacactcaaggtaatgacgaaattaatcggaaagcaactagcctgaagaaaacgaaaggttctggagatccctccatagcgaaatcaccaagtgctaagagtagtacatcaagcataccttctaatcttgcgagccatgaaagaagaagcaagtttagtagtcaaacggataaccttgcaggaaataaacattaccatgagcattaccataatatggcaagtacttcagatgaaagagagtacgattcctcgactacatatgaagatcgtgcgttcgatacagagtcctccatactatttactactattacagatttaatgccatatggggatggttccaataaagtgtttggttatgaaaattttgggaatacttgctactgcaactccgttctacaatgcctttataatatccccgaatttaggtgtaatgtgctgcgatatcctgaaagagtagccgcagtaaacagaatacgcaaaagtgatttgaagggttcaaaaataagggtattcactaatgaaagttttgaaacatctactaatagcggaaattctaatacggggtaccaaagcaatgataatgaagatgcacataaccaccaccaccttcagcagagtgatcaagataactcctcttcttctactcaagaaaaacagaataattttgaaagaaaaaggaactcgtttatgggttttggaaaagataaatcgaactataaagattctgcaaagaaagatgataacaatgagatggaacggcctcagcctgttcacacagttgtaatggcctctgatacattaacagagaagcttcacgaaggctgtaaaaaaattattgtgggaagaccgcttttaaagcaaagcgattccttatcaaaagcttcaactacagattgtcaagcaaattcgcattgccagtgtgattcacaaggcagtaggattacatcagtggatgatgatgtccttgttaaccctgagagctgtaacgatgctgtcaacaattctaataataataaagagaatacgtttccaacaagtgaacaaagaaaaaaagccgctttaattagaggccccgttcttaacgtagatcatttactttatccaaccgaggaagctacactttacaatggactaaaagatatatttgagtctattactgaaaacttgtcgctaaccggtatcgtttcacctacagagtttgtcaaaattttaaaaaaagaaaacgtcttgttcaacactatgatgcaacaagatgcccatgaatttttaaactttttattaaatgatttcagtgaatatattcaacgcaataatcccagaatgagattcggaccacaaaagacagacaacagcaacgacaactttataacggatttattcaaaggtacactgacgaataggatcaaatgtttaacttgtgacaatatcacctcaagggacgaaccatttttagactttccaatagaagtacagggtgatgaagagactgatatccagaagatgttaaaaagctatcatcagcgtgagatgttgaacggggttaacaaattttattgtaacaaatgttatggtttacaagaagcagaacgtatggtcggactgaagcaactgccccatattctgtcattgcacctaaaaagattcaagtattcagaggagcaaaagtcaaacatcaaactttttaacaaaatactctatccactaactttggatgtttcttccacttttaatacatcagtatataaaaaatatgaactaagcggcgtcgtcatccatatggggagcggtccacagcatggtcattacgtatgcatttgcaggaacgaaaagtttgggtggcttttgtatgatgacgaaacggtggaatccataaaagaagaaactgtgttacaattcacaggtcatccaggtgatcaaactacagcctacgttttattctataaagaaacacaggctgataagaccgaaaatcaaaatgaaaatatagacacttctagtcaagatcaaatgcagactgacaataacattgaacagttaataaaatgcgatgattggttaagggatcgtaaattgagggcagctgcaaatattgaacgcaaaaagaccttggggaatatacctgaagttaagactgcagaaaccaagacgccattaaatgataaaaaacgcaataagcaaaaaagaaaatcgagaatattgagcttcatcaaataa

SEQ ID NO: 25444 - DNA, 957 bp, Saccharomyces cerevisiae
atgtctacaaacagtattaagttgttagctggtaactcacatcctgggcttgctgagcttatttcccaaaggcttggtgtaccgttatctaaagtgggggtatatcagtattcaaataaagagacgtctgttacaataggggaaagcattcgtgatgaagacgtatatatcatccaaactggttacggggaacatgaaatcaacgatttcttaatggaattacttatcttaattcacgcttgtaagacggcatcagtcagaagaattacggcagtaataccaaatttcccttatgctagacaagataagaaggataaatcgcgggcgcccatcactgcgaagctgattgccaatcttttggaaactgcgggttgtgatcatgttattactatggatctccatgcttcacaaattcaagggttttttcatatcccggttgataatttatacggtgaaccaagtgtgttgaattacataaggaccaaaacagatttcaataatgcgatactggtatcgcctgatgctggtggtgcgaaaagggtggcttctttagcggacaagctggatatgaattttgccttgattcataaggagaggcaaaaagctaatgaagtttcgcgaatgctgcttgtcggtgatgttgctggtaagtcatgcttgttgattgacgatatggctgacacgtgtggtacgctggtgaaagcctgtgacacattaatggatcacggtgctaaggaggttatcgctattgtcacacatggtatattttctggctcagctagggagaagttaataaatagtaggttatcaagaattgtttgcaccaacacggtacctgttgatttggatttggacattgtcgatcaggtggatatcagccctacgattgcagaagctatcagaagattgcataatggagaatcagtctcatatttatttacacatgcgcctgtttaa

SEQ ID NO: 25445 - DNA, 753 bp, Saccharomyces cerevisiae
atggctacaaagcaggctcacaagagattgacgaaagagtacaagttgatggtggaaaaccctccaccatatattcttgctcgccccaacgaagataatattttagagtggcactatattatcacaggacctgcggatactccttacaagggcggtcaatatcacggtactttaactttcccgtctgattatccatacaaaccaccggctatcagaatgataacaccgaatggacgtttcaagcccaacacacgattatgcctttctatgagtgattaccaccctgatacttggaatcctggctggtctgtctcaaccattttgaacgggttactaagtttcatgaccagtgatgaagccacgacaggatcaattacaacatcagaccatcagaagaagacattagcaagaaattccataagttataacacttttcaaaatgttagattcaaattgatttttccggaagttgtacaggaaaatgtagagacattagaaaagagaaaattggatgagggggatgcggcaaatacaggtgatgaaacagaagacccttttacaaaggctgcgaaggaaaaagtcatctcgttggaggaaattctagaccctgaagacagaatacgcgctgaacaagcgttgagacaatcagaaaataattccaagaaagatggcaaagaacctaatgatagttcttcaatggtttatattggtatcgctatttttttgtttttggttggcctttttatgaaatga

SEQ ID NO: 25446 - DNA, 1293 bp, Saccharomyces cerevisiae
atggcagagaaaatcttggaaaataaagaccctaaactagaagcgatgacagtggaccatgaagtttcagcgccgaagccaatccccgtggatgaacctacgctgactagagtcgccagaccgttaagacatgtaagacatattcccgttaagtcattagtttttcattctaaacacggtcccattactttttcatatgagaacaaaattaagttgcccataagtaaaaacaaactggtagttcaagtgaactatgtaggtttgaaccctgttgatatgaagattaggaatggttacaccaagcctatttatggtgaagccggcattggaagagaatacagcggagtgataacacatgtcggtgataatttgacaaatagatggaacgtgggtgacgatgtgtacggcatttactatcatcccaagttagccattggcgccctgcaaagttcgttgctcattgatccgcgtgtcgatcctattttaatgcgacccaaaaatactctatcaccagaaaaggcagcaggctccttattctgtttaggaacagcacttaatctgttagctcaactaaaggagaaggatcaattgaatacagaatctaatgttttaataaacggtggtacaagctctgtagggatgtttgctatccagttattgaagcgttactataaagtttctaaaaagctagtagtggtaacgtcaggtaatggtgcagcagtcctgtcagaacatttcccggatttgaaagatgaaatcattttcataaattatctgtcatgtaggggaaaatctagtaaaccactcagacgtatgttggataccggtaaagttgtagattatgatgattttaatactctcaaagaaaccgaagattatactcagggtaaatttaatgtcgtgttggacttcatcggtggttatgatatcttgagtcactcgagttctttaattcacgctaaaggtgcttatattacaacagttggtgattatgttggaaattataagaaagacgtctttgattcttgggataaccctagcgccaatgcaagaaaaatgtttggatcaatgttatggtcatacgattattctcatttttactttgaccccaatatcaagattatccccaagaagaatgattggatacatgaatgcggcaagctgctaaatgagggagtcgtagattgcgttgttgataaggtttattcctggaaaaatttcaaggaagcattttcctatatggctacacaacgtgctcaaggtaagcttataatgaaagttgaaggtttttga

SEQ ID NO: 25447 - DNA, 1929 bp, Saccharomyces cerevisiae
atgtcaaaagctgttggtattgatttaggtacaacctattcatgtgttgctcattttgcaaacgatagggttgaaattatcgctaacgatcaaggtaatagaacgacgccttcttatgtggcttttactgacacagaaaggctaattggtgacgctgcgaagaatcaagctgcgatgaacccacataatacagtattcgatgctaagcgtctgatcggacgtaaattcgatgatccagaagtgacgaacgatgctaagcattacccattcaaagtgattgacaagggaggtaaaccggtagtgcaagtggaatataaaggcgagacaaagacatttactccagaagaaatttcctcaatgatcttgacaaagatgaaggagactgctgagaactttttaggaacagaagtgaaagatgctgtagtaacggttccagcctatttcaacgattcacaaaggcaagcaacaaaagatgccggtacaatcgcgggcttgaacgttcttcgtatcattaatgaacctacagctgccgctattgcgtatgggctggacaagaaatcgcagaaggagcacaacgtcttgatctttgatttaggtggtggtacttttgatgtctctctgctatccatagatgaaggtgtctttgaggttaaggctactgctggtgacactcacttgggtggtgaagatttcgatagtaggctggttaactttctagccgaggagttcaaaagaaaaaataaaaaggatctaacaactaaccaaaggtccctaaggaggttaaggaccgccgctgaaagggccaagagaactctgtcttcgtctgctcagacatctatagaaatagattcattatttgagggtatcgatttctatacttccattacaagggcaagatttgaagaattatgtgctgatttgtttagatctacattggagccagtggaaaaagttttggctgattcaaaattagataagtcacaaattgatgaaattgtacttgttggtggttcaacaagaattccaaaagtacaaaaactggtttctgattttttcaatggtaaagaaccaaaccgttcgattaaccctgatgaggccgtcgcttatggtgctgccgtacaggctgccatcttaacgggtgaccagtcgtcgacgacccaagatttactgttgctggatgttgcaccattatctctaggtattgaaactgcaggtggtattatgacaaagttgatcccaagaaattcgactatcccaacaaaaaaatcggaagtgttttccacctacgctgacaaccaacctggtgtgttgatacaagtttttgagggtgaaaggacaaggacaaaagacaacaatctactgggtaaatttgagttgagcggtattccacccgctccaagaggcgtaccacaaattgaagttacatttgatatcgatgcaaatggtattctgaacgtatctgccgttgaaaaaggtactggtaaatctaacaagattacaattactaacgataagggaagattatcgaaggaagatatcgataaaatggttgctgaggcagaaaagttcaaggccgaagatgaacaagaagctcaacgtgttcaagctaagaatcagctagaatcgtacgcgtttactttgaaaaattctgtgagcgaaaataacttcaaggagaaggtgggtgaagaggatgccaggaaattggaagccgccgcccaagatgctataaattggttagatgcttcgcaagcggcctccaccgaggaatacaaggaaaggcaaaaggaactagaaggtgttgcaaaccccattatgagtaaattttacggagctgcaggtggtgccccaggagcaggcccagttccgggtgctggagcaggccccactggagcaccagacaacggcccaacggttgaagaggttgattag

SEQ ID NO: 25448 - DNA, 1098 bp, Saccharomyces cerevisiae
atgtctttttttaatcgatcaaatacaacctcagctttgggaacgagtactgcaatggcgaatgaaaaggatttggccaatgatattgtcattaatagcccagcagaggactcaatatcggatattgcgttttcaccgcaacaagatttcatgtttagtgccagttcctgggacggtaaggtacgtatttgggatgtccaaaatggtgtacctcaaggtagagcgcagcatgaaagctccagccctgtattatgtaccagatggtcgaatgatggtacaaaagtagcctcaggcgggtgtgataatgccctgaaattgtacgatattgccagtggtcaaacacagcaaattggaatgcattctgcgccaataaaagtattacgttttgtacaatgtggaccatcgaacacagagtgtatagtaaccggatcctgggataaaaccataaaatattgggatatgagacaaccccagcccgtatccaccgtaatgatgcctgaaagagtatattcgatggataataaacagtctctgttagtagtggctactgccgaaagacatatcgctattatcaatctagcaaacccaacaacgatttttaaggcaaccacgtcacctttaaaatggcaaactcgatgcgtggcatgttataatgaagccgatggatatgcgattggttcagtggaaggtagatgctccataaggtatatcgatgatggtatgcagaaaaaatcaggcttttcatttaaatgccatcgtcaaaccaatcctaatagggcacctggctccaatggtcaatctctagtgtatcctgtaaatagcattgcatttcatccattatatggtacttttgttacggctggtggtgatggtaccttcaatttttgggataagaatcaaaggcatagattgaaaggctatcctactttgcaagcatctattcctgtatgcagcttcaataggaatggtagcgtatttgcgtacgctctaagttatgattggcatcaaggccatatgggcaacagacccgactatccaaacgtcattaggctacatgccacaactgatgaagaggttaaagagaaaaagaaaaggtga

SEQ ID NO: 25449 - DNA, 1785 bp, Saccharomyces cerevisiae
atgcacttggctgctatgatgctaggaaatcctatggcacctgcggttcaaatgcgcaatgttaatatgaaccctataccaattcctatggttggtaaccctatcgttaataatttttccattccaccatacaataatgcaaaccccacgactggtgcaactgctgttgctcccacagcgccgccttccggcgattttacaaatgtagggccaacccagaatcggagtcaaaacgttactggctggccagtctataattatccaatgcaacccactacggaaaatccagtgggaaacccgtgtaacaataataccacaaataatacaactaataacaaatctccagtgaaccaacctaaaagtttaaaaactatgcattcaacagataaaccaaataatgtcccgacgtcaaaatctacaagaagtagatctgcaacctcaaaagcgaagggtaaagttaaagccggtctagtggctaagagacgaagaaaaaataataccgctacagtttccgcgggatcgacgaacgcttgttcgccaaatattaccacaccaggctcaacaacaagtgaacccgctatggtaggttcaagagtaaataagactccaagatcagatattgctactaacttccgcaatcaagcaataatatttggcgaggaagatatttattctaattccaaatctagcccatcgttggatggagcatcaccttccgctttagcttctaaacagcccacaaaggtaaggaaaaatacaaaaaaggcatccacctcagcttttccagtagagtctacgaataaactcggtggcaacagcgtggtgacaggtaaaaagcgcagtccccctaacactagagtgtcgaggaggaaatccactccttctgttattctgaatgctgatgccactaaggatgagaataatatgttaagaacattctcgaatactattgctccgaatattcattccgctccgcccactaaaactgcgaattctctcccttttccaggtataaatttgggaagtttcaacaagccggctgtatccagtccattatcttcagtgacagagagttgcttcgatccagaaagtggcaagattgccggaaagaatggacccaagcgagcagtaaactcaaaagtttcggcatcatccccattaagcatagcaacacctcggtctggtgacgctcagaagcaaagaagttctaaggtaccaggaaacgtggttataaagccgccacatgggttttcaaccaccaatttgaatattactttaaagaactctaaaataatcacttcacagaataatacagtatcccaagaattgccgaatgggggaaacatactggaggcgcaagtaggcaatgattcaagaagtagtaaaggcaatcgtaacacattatctactccagaggaaaaaaagccgagtagtaataatcaaggatatgattttgacgccctcaaaaattcaagttctttgttgtttcctaatcaagcttatgcttctaacaatagaacaccaaacgagaattcaaatgttgctgatgaaacctctgcatctacaaatagtggcgataatgataacacattaattcagccctcatccaatgtgggtacaactttgggtcctcagcaaaccagtactaatgaaaatcagaatgtacactctcagaacttgaagtttgggaatattggtatggttgaagaccaaggaccggattacgatctcaatttactggatacaaatgaaaatgatttcaattttattaattgggaaggctga

SEQ ID NO: 25450 - DNA, 3282 bp, Saccharomyces cerevisiae
atgccatttgatgttttgatatcaaaccaaaaagataataccaatcaccagaacatcacgccaatatcaaaatcagttcttttggcgcctcattcaaaccatccagtgattgaaatagctacgtattcagaaaccgatgtatacgaatgctatatacgtgggtttgaaactaaaatagtgatgagaagaactaaagatgattggattaatattacccaggttttcaaaatagctcaattttcgaagacgaaaagaactaaaatactggaaaaggaatcaaatgatatgcaacatgaaaaagttcaaggtgggtatggtaggtttcaaggtacttggatcccactggattcagcgaagtttttagtcaataagtacgaaataattgaccctgtggtcaactccatcttaacttttcaattcgatccaaataaccctccaccaaagagaagcaaaaatagtatattgaggaagacttcgccgggaacgaagataacttctccatcgagctacaataaaacaccaagaaaaaagaacagtagttcatcaacatcggctacaactacagctgcgaataagaaaggcaagaaaaatgcatcgatcaaccagccgaatccaagtcctttacaaaaccttgttttccaaactcctcaacagttccaagtaaattcatcaatgaatataatgaacaataatgataaccacaccacgatgaatttcaacaatgacacaagacacaatttaataaataatattagtaacaacagcaatcaatctactattattcaacaacaaaaatccattcatgaaaactctttcaataataattattcggcaactcagaaacctcttcaattttttccaattccgacaaatttacaaaacaagaacgttgctctgaataaccctaataataatgacagtaatagttacagccataacatcgacaatgtcattaacagcagtaataacaataataatggcaataataataacttgatcatagttccagacggacctatgcaaagccaacaacaacaacaacatcatcatgaatatttgacgaataacttcaatcattccatgatggactccattacaaatggcaatagtaaaaaaaggaggaaaaagctgaatcaatctaatgaacaacaattttacaaccagcaagaaaaaatacaaaggcatttcaaattaatgaagcaacccttattatggcaatcctttcaaaatccaaatgatcaccataatgagtactgtgacagtaacggcagcaacaataacaacaacactgtagcatccaatggctcctccattgaagtattttcatcaaatgaaaatgataacagtatgaatatgtcttcacgatctatgacaccgttcagcgcaggaaatacttcatctcaaaacaagttggaaaacaaaatgacagatcaagaatacaagcagacgatattaacaatactatcatcggaaaggtcttctgatgtagatcaagcgttgttggctactttatatccggcgcccaaaaattttaacataaattttgaaattgatgatcaaggtcacactccactccattgggctacagctatggcgaatattcctttgataaaaatgctaattaccttaaatgctaatgcattacagtgtaataagctcggttttaattgcatcacaaaatcaattttctacaacaattgctacaaggagaatgctttcgatgaaataatatccatcttaaaaatatgtcttataactcccgacgtaaatggaagattgccatttcattatttaattgaattgagcgttaataagtccaaaaatccaatgataataaaatcttatatggattcgataatattgagcttgggtcagcaggactacaatttgttgaagatatgtttgaactaccaagataatatagggaacactccactgcatttatctgctttaaacttgaacttcgaggtttacaacagactggtatatcttggtgcgtcaacagatatattgaatctagataacgaatcgcctgcgtcaataatgaataagtttaatactccggctggcgggtcaaacagcagaaacaacaacaccaaggcagatcgaaagttagctcgaaaccttcctcaaaagaattattaccaacaacagcaacagcaacagcaaccacaaaacaatgtcaaaattccaaaaattataaaaactcaacatcctgataaagaagattctactgcagatgtcaatatagctaaaacagattctgaagtcaacgaaagtcaatacctgcattccaaccagccaaattctacaaatatgaacactattatggaagacttgtcgaatattaattctttcgtgacgtcgtctgtcattaaagatataaagtctacgccgtccaaaattcttgaaaactctcccattttatacagaagaagatcacagtcaatatcagatgaaaaagaaaaggcaaaggataatgagaatcaagttgaaaagaaaaaggatcccttgaatagtgtgaaaactgccatgccatcattggaatcgccttcttcccttctgccgatacagatgtctccactaggaaagtactcaaaaccgctttcgcagcagatcaacaaattaaatacaaaagtttcttctctacaaagaataatgggtgaagaaattaaaaatctggacaacgaagtagtagaaaccgaatcctctatttctaacaataagaagagattgattacaatagcacatcaaatagaggatgctttcgattccgtatcaaacaaaactcccataaattcgatatcagatttacaatcaaggattaaagaaacatcgtcaaagttgaattctgaaaagcaaaattttattcaaagcttggaaaaatctcaagctttaaaactggctacaattgtccaggatgaggaatcaaaggttgatatgaatactaactcaagttcacatccagaaaaacaggaagatgaagagccaattccaaagtcaacgtcggaaacttcttctcctaaaaacaccaaagcggacgccaaattttctaatactgtacaagaatcatatgatgtaaatgagacgttgagactagcaacggaactaactattctacagtttaaaagaaggatgacaacattgaaaataagcgaagctaaaagcaaaattaattcatcggtgaagttagataaatacagaaacttgattggtatcacaattgagaacattgactcaaaattggacgatatagaaaaggatttgagggcaaacgcataa

SEQ ID NO: 25451 - DNA, 3123 bp, Saccharomyces cerevisiae
atgagtaatgacagggaagtacccacactctcgcagctcaacacaactgtcagcagagataaagacgtatcggacactttgtcaccggattttgacagcaaaggaagtgcaaccgggcgtgacggtggcaatttcccaatgtatattgccattaatgagtattttaagcgaatggaagatgaactagatatgaagcccggtgacaagatcaaagtaataactgatgacgaagaatacaaggatggctggtattttggtcgaaatctgagaaccaatgaggaaggtttatatccggtggtctttactcaaaagataacagtggagaaggctccgacattgatgagagccaagtctaccaaaaggatatatagtccattaaccaatgaagatcctcttctttccagcacttttatcagtgaaaacgattcaaacagtgaactgccaaccccgcaaccaattgaaaccgccgcctctatttcgagaactgccaatggaaagatcgaaagaaacttgtctttaaagaatacaatgagtgacatagacaatgcactactggagtttaaagacgactctataggtccaccagatcgtttcatcaattcgggcagagacgaggaacatagcattacgcatgaaacaattctatcagccactgatggactggatgtagtcgaatctaacagtaagccaacaacgagtagttctactgggttcctgaacggagatttggaaaatcaagctactttaattaatggaattgatactactaaattgaaccctgtagaagcagagttttggtcacccgaagaaataacagcttattttattatggaaggatacgatgtccaatctgcctctagattccagaagcacaaaatatcgggtaaaattttgttagaattagagcttgttcatttaaaagagttggacataaattcttttgggacaagatttgagattttcaaagaaatagaaaaaatcaaagaggctattagaactaatggccgctccctgaatagagctagtaagaccaataacgctaacatttataaccaattgatgcctcccgcaaacgttgaccagagagcttcctacagaggccatgttagaaagacttcacagtcgttagaggaccttccgtcacaacagaattttatccccactcccagaaatactaggaactcctcagcttccaagcaccggcctaaatctttagtttttgattcacaagaggctaatgctaatatagctccagatgttcaaattcctcaggtggtagaggaaatggcaggtaatgaaaatttgtttgtttctccgaggagagcccccaaacccccatcttaccctagtccagcacaacctccaaaatcgcccctattgaataacacaaggacgtcaccttctcctgctcaactttattcatggcaatcacctactttatctttctcagggcctaaaagaacttcttatatcgatcaatattcttcatcagattctaatttcaattcccgttccgcactcccaaagaacaaccaaggcggtgggaaggcgttgtcacctattccatcccccacccgtaattctgttagaaatgaagatagtgaaggcaagctaacatcgtcttcgaagaggaattctgtcccttattatggatacgctcctgaatcttcttcggatagaaaatcctcttgttccagccatgaggaagagcagtttcaagaaacaatgaacacattcgaaagacccacgtccagtatatacgctgatggatctaccattgcatccataagtaatgacaaattggcacatgagaaggaggggaagaaaaaaccaacgagacactcgtcttcattatcttctaaatcaaaaagcgattccaggaggaactcgtctttaaagagaagcagcagtgcatcgcgaactagttcattcaaaaaaagttccttcatgctaagtccctttaggcaacaatttactgataatgctgctcgctcttcaagtcctgaagagaatcccataacctcaatgccgtcagaaaaaaacagctcaccgatagttgataaaaagtcttccaaaaagagtagatctaaaagaagatcagttagcgcaaaggaagctgaaatctttaccgaaactgtgaaagatgataaaaataagaggtctgcgagtgaggctattaaaggtgaaacgctcaagggcaaaagcttgcgtcaaatgaccgctagacctgtagccaagaaaaagcaaacttctgcatttatagaaggtttaaggagtattagtgttaaagaggcaatgaaggatgctgacttttctggttggatgagcaagaaaggcagcggtgccatgagtacttggaagacgagatttttcacattgcatggtactagattgtcatacttcagctccactacggacacgagagaaagaggtcttatcgacattactgctcatcgcgttgtgcctgctaaggaagatgataaactagtttcattatatgcagccagtacaggtaaaggacggtattgtttcaaactattacctccgcaaccaggatcaaagaaaggtttgacatttacacaacctcgcacgcactattttgcagtagataataaagaagagatgagaggttggatggctgcactaattaaaaccaccattgatatcgacacatcagtgccaattatcagttcctatacaacacctacggtttccttgagcaaagcgcaagagatgttagcagaagcgagagaagagaccaagctaagggaacagcaaatgctagagaacgaggaagatgaggaccagtttttatgggatcaacagcagcttcaacagcagcaacatgacaataatcaagggcaagctgatcgcacaatatcagcgtcaacccaacgaacttccgacgaggataatactatatctactccgaatttgtcctctgctaacaatacaaccattggctcaaatggattttccagtccgttcttactagcttccggattgttatcgcctggagtggctcgcaatagtagtatgcgtggaacagagaaaaagggtaaattctcaacggaagaggattacttcggggataattcaaaacataaaaccgacaaaatataa

SEQ ID NO: 25452 - DNA, 1104 bp, Saccharomyces cerevisiae
atgtcaatatcatcaaagataagaccaactcctcgtaaaccttcacgtatggctaccgaccattcttttaaaatgaaaaaattttatgccgatcctttcgctatatcatcaatttctttggcaattgtatcgtgggtcatcgccatcgggggctccatctcatctgcatccaccaatgaatccttcccacgttttacttggtggggtatagtataccaatttctaattatttgttctttaatgctgttctattgttttgatttagtcgatcattacagaatcttcatcaccacatctattgcagtggcatttgtgtataatacaaacagtgcaacgaatttagtgtatgcggatggtcccaagaaagctgctgcttcagcaggtgtcatcttactttccatcataaatttaatctggattctgtactacggcggtgataatgcttccccaaccaatagatggattgattcgttttccattaagggtatcaggccttcgccattagagaattctcttcatagagctcgtcgaagaggcaataggaacacaacgccttaccaaaataatgtctataatgatgctatacgagactcaggctacgcgacacagtttgatggatatccacagcagcaaccttctcacacaaattatgtatcttctacggcattggctggttttgagaatactcagccaaatacttcagaagccgttaatcttcacttgaacactctacaacaacgtatcaatagcgcaagcaacgcgaaggaaaccaatgataatagcaataatcaaaccaatactaatataggtaatacgttcgatactgatttttcaaatggcaatacggaaactacgatgggagacactttgggtctgtatagcgatatcggtgatgataatttcatttacaaggcaaaagcactgtacccatacgacgctgatgacgatgatgcttacgaaatctcatttgaacaaaatgaaatcctacaagtctctgacattgaaggcagatggtggaaggcaagaagggcaaacggtgaaacaggtattattccaagcaattatgttcaactaatcgatggtccagaagaaatgcatcgttaa

SEQ ID NO: 25453 - DNA, 1620 bp, Saccharomyces cerevisiae
atgtcccaacgatcttcacaacacattgtaggtattcattatgctgtaggacctaagattggcgaagggtctttcggagtaatatttgagggagagaacattcttcattcttgtcaagcgcagaccggtagcaagagggactctagtataataatggcgaacgagccagtcgcaattaaattcgaaccgcgacattcggacgcaccccagttgcgtgacgaatttagagcctataggatattgaatggctgcgttggaattccccatgcttattattttggtcaagaaggtatgcacaacatcttgattatcgatttactagggccatcattggaagatctctttgagtggtgtggtagaaaattttcagtgaaaacaacctgtatggttgccaagcaaatgattgatagagttagagcaattcatgatcacgacttaatctatcgcgatattaaacccgataactttttaatttctcaatatcaaagaatttcacctgaaggaaaagtcattaaatcatgtgcctcctcttctaataatgatcccaatttaatatacatggttgactttggtatggcaaaacaatatagagatccaagaacgaaacaacatataccataccgtgaacgaaaatcattgagcggtaccgccagatatatgtctattaatactcattttggaagagaacagtcacgtagggatgatttagaatcgctaggtcacgtttttttttatttcttgaggggatccttgccatggcaaggtttgaaagcaccaaacaacaaactgaagtatgaaaagattggtatgactaaacagaaattgaatcctgatgatcttttattgaataatgctattccttatcagtttgccacatatttaaaatatgcacgttccttgaagttcgacgaagatccggattatgactatttaatctcgttaatggatgacgctttgagattaaacgacttaaaggatgatggacactatgactggatggatttgaatggtggtaaaggctggaatatcaagattaatagaagagctaacttgcatggttacggaaatccaaatccaagagtcaatggcaatactgcaagaaacaatgtgaatacgaattcaaagacacgaaatacaacgccagttgcgacacctaagcaacaagctcaaaacagttataacaaggacaattcgaaatccagaatttcttcgaacccgcagagctttactaaacaacaacacgtcttgaaaaaaatcgaacccaatagtaaatatattcctgaaacacattcaaatcttcaacggccaattaaaagtcaaagtcaaacgtacgactccatcagtcatacacaaaattcaccatttgtaccatattcaagttctaaagctaaccctaaaagaagtaataatgagcacaacttaccaaaccactacacaaaccttgcaaataagaatatcaattatcaaagtcaacgaaattacgaacaagaaaatgatgcttattctgatgacgagaatgatacattttgttctaaaatatacaaatattgttgttgctgtttttgttgctgttggataaagcgatttttatacttttctctttttcctttttttttttga

SEQ ID NO: 25454 - DNA, 3429 bp, Saccharomyces cerevisiae
atggataggagtgataaaaaagttaacgtcgaagaggtcaatgtaccttcaaacttacaaatagaattagaaaaatcaggcaccagtagcagtgtatcactccgaagcccgactaagagtagcgctaccaatttggcgggcatggccgaaggtgcaagagataatgcatcaatagcgtcttcatcggtagattccctcaacatgctattagagcggcaaagagtaaggcagttaaaccatccacagcaccaacagcatataagtagttcactagctaagaccccgacaacgacttcatcattttgttcgagcgggagttctaagaataaagttaaggaaactaatcgaatatctctaacatacgacccggtgtcaaagaggaaagttttaaacacttatgagatcatcaaagaattaggccatggacaacatggaaaagtaaaattagcaagagatatattgagtaagcaattagtagcgattaaaatagtggatagacatgaaaagaaacagaggaagtttttcacgtttatcaaatcaagtaaaatatccgaaaatgataaaataaaacgagaaattgccattatgaaaaaatgccatcacaaacatgtcgtacaactgatagaagttctggatgatttaaaatcaagaaaaatttatttagttctagagtattgttctcgaggcgaggtaaaatggtgtccaccggattgtatggaatcagatgctaagggtccctctttactaagttttcaagaaacgcgagagattttaagaggcgttgtgctcggcttagaatatctccattaccaaggaatcattcaccgagatattaagcctgccaacttattaatatcaggagatggcactgttaagatttccgattttggtgtttctttagctgctagcagcacgaatagttccgatagtagcgaatccttagacgagttagaattagccaaaacagtgggcacgcctgcattttttgctcccgaaatgtgcttgggtgaagatgcattcaccaggtataacttaacaaaggaaaatttatttcgtggttcttgcatctcattcatgatagatatttgggctgtgggtgtgaccttgtactgtcttctttttggaatgctgccttttttttctgattttgagctcaaattatttgaaaaaattgtaaacgacccgttaaaatttccaacatttaaagaaatacagtccaacaaagtatctaaagtatcttgtgaggaggaatacgaaatggcaaaggaccttttattgaaattgttagaaaaaaatccccaaaaaagaatgactatacctgccattaaaaaacatccttttgtttcatgggattttgaccacgtaccggagaacgatgaaaagttactatcttctgtccttgagcaaaaattacgtttccaatgtaaccaaactgatcaatttgaacccatttctatttcaaagcacgaattgaaaaacgctgtctccggtgtcgggaaaaaaatcaaagagtccgtactaaaaagtatcccgctaaaggatccgtcagatctctctaataaaaactaccttcatccaacggaaaccactaggggcagaggggatgccaatgttattgtcagcgaaggttcagtgttatcgaatattaaggaattaagtgctaatgatggatgtttgaacactgatagcgacactaatattaatatcaacgacgatgatcattatagtggtgatgataacgatggacatttaacgaaaagagaactagaacgagaattaaacaaattcgatgataaacacgaggccggaaatatggttaatttacctatcaattcctcatttgcatccttggacagcttctacatagataattttgcgatggctagaatgggaatgagttctccagaagcgggagattcggtttcgtctgtaccaaaccttccttctgcaccgtcttcaacaaggcttggacgatcaccagtctttagtggagtcaccaaccaaccaagtccaattcgccccgttttgccacaacaaaagtcatcgttttgtgcaacaggtcggtatgataagagtcacaatagtcttcttagaaattcttcatctcatctaacgtcatacaactccggcagaccatcttcaaggactggccgaatgaattcacgcaaccaaaacttaccgaaaataccaaatagcctttcaaaaatctcaacaacgaaattgactgaactaagagttccaaaggattcagaaattccatcacctgcaaaaaaccctaacgctgatcgtttgagaaggtttcccgtaaagaaaaataccaaaacacccgccataaaagatcctccgagaataaacattaatagcagcgataagtcaggctccaaaaattctcctataaaatccttataccaacggatgaaacagtctaaggataattcaaaaaccttcgaggtacgtagaggaaactttttcagtcattttaatggagatgatgatgatagcagtagccagtcgtccgtaaccagttctggttcagaatctgattctgaattatcatccacttcatcgtcctgtacatctggaacccaatctcggaatagctccaacaataatgcatattcagaaacggagtcattacctttcgagtttggtgttgattcagaagatggaagtggagtattattaagagatttacctaacgaagatcaaataaggccgtttctggatatacaaccatgtcgacgcatgaaagttaaaagttcattgaacctcgaaccaccttctgtctcatcttcttcatcttcatcctccgacgaagatgagctaattttaaatgtcgggactgcaggtcatcgaagaaggcataattcttcaaaacttagtgaactatccaatagtccgcagaagggatcaaataatttcatgtattccaatggaagtgttcatgacagtgagacgacgataacgccgcaaaatatggatgacttgacgctgcatcaggcactgagccgcagccaacccattagtaagcctggcccattagtattaccaaagcgtttagaccaaaagaaagctacgacggaaacctcaaatttaacagatatcgttgaatttaacggtaataacgatcatcgaaaggacaaaaatttcgataaagttctttattcaagggacttgttaaaagatgctctaagttccactaatgcaggcagaaggagatccataccttcaaataaaataagaggacgaaaggacgcaagtattaccatgagtactaatgttggtaatgatgaacatgctagaaataccagctgccatggtgataaaggacaagaaaatggcgctataaaacaaaggacccatgaaagatcgcgatctttaacagtcgctgaactaaatgaagagaagagaaggagtgcacttccatga

SEQ ID NO: 25455 - DNA, 1464 bp, Saccharomyces cerevisiae
atggactcacaaccagttgacgttgataatatcatcgatagattattggaagtaagaggatctaaacctggtcaacaagttgatctagaagaaaatgaaatcagatacttatgttcgaaagccagatctatattcataaagcaacccattttactagagttagaagccccaattaaagtatgttaatgttgaacttcgcagtcaagagatagaatgcctagagcttcaggtgttttatgtgttctactcctgttgcggcagtaagatagttacagcagttatttccgtttgactgaaagaatttaccaagcatctgatgttagcctactcatatgtcgagatagccgagataatgtgtgtgtttagctcttcatttttctatcttattaggcatttttttaccaagatttccttatgttttgtatcatcatccggccggcgcctcccatattcagaaaaatcccccttgctcacactaaaaaaagaaggcattttttcgttatgaagaaaacgaatcttttttttttttgagcccgagagaaaggtcggacgaaaaccaagaaatgtggatttgcagaaggcattgggagaaatgaagcgtttttgacagcagtaattgttctcttaaagtcaacggaatgagctagatttagtgacaaattcatttactaacttatttttttctattttttttttttttagatatgtggtgacattcatgggcaatactatgatttactacgtctatttgagtacggtggattcccgccagaatctaattatctatttttgggtgattatgtcgaccgtggtaaacaatccttagagactatttgtctattactggcttacaaaattaagtatccagaaaactttttcattttaagagggaaccatgaatgtgcttccattaatagaatttacgggttttatgatgaatgtaagagacgttataatatcaaactttggaaaactttcacggattgtttcaattgtttaccaattgctgcaattattgatgagaaaatcttctgtatgcatggtggtctctcaccagatttgaatagtatggaacagatcagaagggtgatgaggccaacagatattcccgacgttggcttattatgtgacttattgtggtcagatccagataaagatatcgtaggttggagtgaaaatgatagaggtgtttctttcacttttggtcctgatgtagtgaacagatttttacagaaacaagatatggagttgatttgcagggcccatcaagttgtggaagatggttatgaattctttagtaaaagacaattggtgacacttttcagtgctccgaattattgtggtgaatttgataacgctggtgcaatgatgagtgttgatgaaagtttattatgttcttttcaaattttaaagccagcccaaaaaagtctaccaaggcaagctgggggtagaaagaaaaaataa

SEQ ID NO: 25456 - DNA, 2418 bp, Saccharomyces cerevisiae
atgggctcagaacaagccttaagtgaggttgtcgaatctgctaaagagcggttcggcaggcttaggcatttagttcagaagtttcttgatgatgacgacgtgccacaagagtgtctgcctttgctccaagaatgcgcagaaatatggtctagttatgtggacgcatgccaggatataaccatgcaggcccctaaagaagatgcaaaccggttgtcaaaggggtttctccgattgaatgaaacagcttttttatattacatgatcgtatatacgctcttggaggatactctaccaagactaaaggaattttcgagcaacaaggaccagaatgttagaaatttgtacggggagagaatccagcttttgcataatgacccaaatattgagcggattcgaaatgtcattgaaaattaccctaaatttatacagttgcaaactatagagcctggaaaattaagttcaatgttgcattttcatggtgacgctctcttgcttatcgatgtacggcccaggtctgaattcgttagggcccatatcaaatgcaaaaacattatatgcatcgatcctgcctcatttaaggattcttttacagaccaacaaattgaaagtgtctctttgatcacttcgccgcactcagatatcactttcttttcaaatcgagacaagttcaagttcattattttatatactgacactcaattgcataataatttccagcaaaggcaaactcgcatccttgcgaagattctttcccaaaattcagtaattaaaccgctgagtgggacgaaaatactcattttggaaaatgggttctcaaactgggttaaattaggtggggcgtatcaatcatctgtcagtgaaacagcgcatcttacatcctcgtcttcaacgccagcttttggtagtccgcaagtcccaacaggcttgttcaatcagaaatctctatctccaaataaagataagagtatgccgatggtatccatgaatacgcagcctttgctaacaacggtgcaaaggcctcaattacccttatactattcagatttgcccattataccgcaaccaagccccaacagaaattctcccaccgttcaaaaatttagtccacatccaccaaccactctctcaaaactcaatacaccctcgaccattcaaaataaagcaaacactgtggaaagaatatcgccagatatccgcgctgcacaagcccatgcctatttgccccctgcatcgaatgtattctcgccacgtattccgcctttaccacaacagaacttgtcttcgtcgaggcagaccatcctaaacaactcacaagtgcttgatctagatcttatagtaggattggaaaatataggtaactgttgttatatgaactgtatacttcaatgtttggtgggaacacacgatttggttcgaatgtttttggataacacatatctgaattttattaattttgatagttcaagaggttctaaggggttgctagctaaaaatttcgccatcttggtcaataatatgcacagacacggtgcattcacacctcctaacgtaagaacgataccagttcagactattcagtttaaaaaaatttgcggccatatcaaccccatgtatagtgattcaatgcagcaagattgtcaagaattttgtcaatttttgcttgatggcttgcacgaggatttgaaccaaaacggcagcaaaaagcatcttaaacagttatcagatgaggaagaacgaatgagagaaaaaatgtccatacgcaaagctagtgctctcgagtgggaaagatttttgcttaccgacttcagtgcgataattgaccttttccaaggacagtacgcatctaggctacaatgtcaagtttgtgaacatacctccacaacttaccaaacattctctgttctttctgttcctgtcccacgcgttaaaacttgtaacatattagactgtttccgggaattcaccaaatgcgaaaggttaggtgtcgatgaacaatggtcatgtcctaaatgcttaaaaaagcagccttccactaaacaactgaagattactagattgcctaagaaactaattattaatttgaaacgatttgacaatcaaatgaataagaataatgtgtttgtccaatatccttactccttagatcttacaccatattgggcgagagattttaatcatgaagctattgttaatgaggacattcctaccaggggccaagtaccaccatttagatacagactgtatggggttgcatgtcattcggggagtttgtatgggggacactatacttcatacgtttataagggaccaaaaaaaggttggtattttttcgatgactcgctttatcgtcctataacgtttagtactgaatttatcacacccagtgcatatgttttattttacgaaagaattttttga

SEQ ID NO: 25457 - DNA, 723 bp, Saccharomyces cerevisiae
atggccgatgaggaacgtttaaaggagtttaaagaggcaaacaagatagtgtttgatccaaataccagacaagtatgggaaaaccagaatcgagatggtacaaaaccagcaactactttccagagtgaagaggacataaaaagagctgccccagaatctgaaaaagacacctccgccacatcaggtattgttccaacactacaaaacattgtggcaactgtgactttggggtgcaggttagatctgaaaacagttgcgctacatgcccgtaatgcagaatataaccccaagcgttttgctgctgtcatcatgcgtattagagagccaaaaactacagctttaatttttgcctcagggaaaatggttgttaccggtgcaaaaagtgaggatgactcaaagctggccagtagaaaatatgcaagaattatccaaaaaatcgggtttgctgctaaattcacagacttcaaaatacaaaatattgtcggttcgtgtgacgttaaattccctatacgtctagaagggttagcattcagtcatggtactttctcctcctatgagccagaattgtttcctggtttgatctatagaatggtgaagccgaaaattgtgttgttaatttttgtttcaggaaagattgttcttactggtgcaaagcaaagggaagaaatttaccaagcttttgaagctatataccctgtgctaagtgaatttagaaaaatgtga

SEQ ID NO: 25458 - DNA, 1263 bp, Saccharomyces cerevisiae
atgcataaatttgatctagagctctcgagaagagcgaaccctttgctttttagtgcagaacgatacgaagagtatccattgaaatacgatgaattgaaacagtaccttctctcccaaaatccgtcacatccgcatcacaatagtagaccatacacttccattgactattttgactatcttctgtatagaagtaaaaatgacgagtcagaaatagaccttgacaaaaagctagtgtctgagttcgccctatactacgttcaaaaagagcacttgaactctgatgatctaaatcccacactcaatgagttgctgaagctgcagccgaagtctgcggattggtatgaaatgatgctgaggatccttgaatccattaacactacagggatagaccagcttacgaaggaaaacaacaacagtttcccaaattctaaaagagcgaggtcttccactaatatgggtggcacagataaatttaacaagggtgcttaccatactgacaaagctgatgacgataaaaatgaaatacttcaagaattaacgtccttcttgatgtcaaactccattcagaaaggcattgatatcaagccaataccattagatgaccctgtgaagttcttgaaaaatgggataaattctatcttggatacctgcgtcagtctagaaaaaaatacgtcatcaccacctatttcgcctaacgccgctgcaattcaagaggaagactcctctaaaaaattagaagaactagaaacggcatttagtgatttgcaactggcacacaatttcttgactaagcaattcgagaatgaccgtgccgaatatgtacaagatatcgagaagctaacgcggactaacagagaattacaagataagttattaaacaaccactcgaatttgagtaaaactgaaaagaaattacacgaattggagcaggaaaataaagaacttgaaaaagccaacaacaagctgaattcaagcagacataatttcggcatgtcatcaccagcgagttcgccggtgacttgggatccaagttcaccttcctctgtaggaagccccacaagcggttctggatcacgttcactttcaataatgacaagtgagtttaaaaaagtgcttacgagtacacaaagaaagtatgaaaaagaattgtcggatgagcgtgaacatagattcaagctggaaagggagcttgctttgctgaaaaatgcagaggcaaacacctcgctggcgcttaatagagacgatccaccagatatgctatga

SEQ ID NO: 25459 - DNA, 2739 bp, Saccharomyces cerevisiae
atgaacatgcaagacgctaacaaagaagagtcgtactcgatgtacccgaaaacctcttctccaccaccacctacgccaaccaatatgcagattcctatttatcaagcgcctttgcagatgtacggctacactcaggccccatatctataccccacacaaatacctgcctattcgtttaatatggtcaaccaaaaccagccaatctaccatcaaagtggcagcccacatcacttgcctccgcaaaacaatattaacggcggaagcactaccaataacaacaacattaacaagaagaagtggcactctaatggcattaccaataacaatggaagcagcggtaatcaaggcgccaactctagcggtagcggcatgagctacaacaaatcccacacctaccatcacaattactctaacaatcatatccccatgatggcctctccaaacagtggcagcaatgcgggcatgaaaaaacagaccaactcttccaacggcaacggttcttcggctacttcaccatcgtactcttcctacaactcttcttcacagtatgatttatacaagtttgatgtcactaaattaaagaatctcaaggaaaattcatcaaacttgattcaattgccactgttcataaacactacggaagcagaatttgctgcggcaagtgtccaaaggtacgaattaaacatgaaggctttgaacctaaactctgaaagcttagagaactcatctgtagaaaagagctctgcccatcatcacacaaaaagccatagtataccaaagcataatgaggaagtaaagacagaaacacatggggaagaagaagatgctcatgataaaaaaccacatgcgagcaaagatgcgcacgagcttaaaaagaaaactgaagtaaagaaagaggatgctaagcaagaccgtaacgaaaaagttatacaggaacctcaagctactgttttacctgtagtggataagaaggaaccagaggaatctgttgaagaaaatacttccaagacatcttcaccttcaccatctcctccagcagcaaaatcctggtccgccatagcatcagatgcgattaaaagtagacaagctagtaacaaaacagtctccggatcgatggtcactaaaacaccaatttctggtacgaccgcaggcgtttcatcaacaaacatggctgcggcgactataggtaaatccagctctcccctgttgtccaagcagcctcagaaaaaggataaaaaatacgttccaccttctacaaagggtattgagccactgggttcgattgcgttaagaatgtgttttgatcccgatttcattagttacgttttacggaataaagatgttgaaaacaaaataccagtccattccattattccaagaggcataattaacagagccaacatttgttttatgagttctgtgttacaagtgttactctactgtaagccatttattgatgtaattaacgttctcagtacacggaataccaattcaagagtcggcacatcatcctgtaaattattagatgcttgtttgactatgtataagcaattcgataaggaaacctatgagaaaaaattcctagagaatgctgatgatgctgaaaaaaccacggaaagtgatgcaaaaaaatcatcaaaatccaagagtttccaacactgcgccactgccgatgctgtcaaacctgacgaattttacaaaactttgtctactataccgaagttcaaagacttgcaatggggccatcaggaagacgcagaagaatttttgacccacttattggaccaattacacgaggaattaatttctgcaattgatggcttaaccgataatgaaattcaaaatatgctgcaaagtattaatgatgaacaattgaaagttttctttattagaaatttgtcacgttatggaaaagcagagtttatcaaaaatgctagtcctagactgaaggagttgatagaaaaatatggcgtgatcaatgatgactctaccgaagaaaatggttggcatgaagtgagcggatctagcaaaagaggcaagaaaactaagaccgctgccaagaggactgtcgagattgttccatcaccaatctccaaacttttcggtggccagttcagatctgtgttagatataccgaacaataaggaatctcaatcgattacactcgatccgttccaaacaattcaattggacatttcagatgctggtgtgaatgatctagaaactgcattcaaaaaatttagtgaatacgaattgctaccctttaagtcctcgtcagggaatgatgtcgaggccaagaagcagacttttattgataaattgccgcaagttcttttaatccaattcaaaagattctcattcataaataatgtgaacaaagacaacgcaatgacgaactataacgcgtacaatggacgtattgagaagatcaggaaaaaaattaaatatggtcacgagttaatcatacctgaagaatcaatgtcttccataacattgaaaaacaacacctcagggattgatgatagaagatataagctaaccggagttatataccatcatggggtaagttccgatggcggtcattacacagcggatgtttatcatagcgagcacaacaaatggtatagaatagatgatgtaaatattaccgaactagaggacgatgacgttttgaaaggtggcgaagaagcttctgattcgaggactgcctatattttaatgtatcaaaagagaaattaa

SEQ ID NO: 25460 - DNA, 6504 bp, Saccharomyces cerevisiae
atgaaaggtcttctctggtctaagaacaggaaatcttcaacggccagtgctagttcaagctcaacttccacgtctcataagacaactactgcgtctacagcatcgtcgtcgtcgccgtcatcatcctctcaaactattcgaaactcgacaagcggtgcttctccatacatgcattcccaccatcaccatggccagggacacagtcaccacagaggggaagacaacaacagagataagagaaaaagctccgtatttccaccctccaagcagtacacatccactagttccagtcaggtgaacttggggatgtatcattcggatactaacaccagatcttctagaagcatagcctctacgctaaaagacgattctccgtctgtctgctccgaagatgaaataagcaattcttctagccagaagtccaatgcccaggatgagactcccattgcgtacaagaagagtgcccattcgaaagactcattgttgccttcacgttcctcgtctttatcacctcctcagtctcgatgtagcactggaactacgctagagaaatcgttgaacacttcaggtatcagtaacagtagcggcactaataataacaatagcaataataacaacgataacgagcaaaagcaaagaaatgttatccacttaaactctgaaaactatgatacaactgtttttaagactggatgggttaataagtcccatggccagactgttgctacaaactataatagctcaatgacagccccttcctcttcctcttcgtcctcctctcagaatctccgtaatgatgcgtattctagaaacagggaaagcaggttttatgggaacgacggttcgtctttaaaaaatgatgacagcagtagtactacggccactaacagtggcaatgatgtggcctcagcaagaagcagcatggctatagatcctcaaatgctagtacctgattaccgtctttatagggctcaattgaaaggttgcgttctcaacctttacaaaagtggtttgaatagtaacattaagttttttgatccaactttaccagcttcaaatagtagtatagcaaatgaaaaccatcaacagaaaaaacaacaaacaaacaaccaagcacaagcggaagctctgcaccaaaagcaatcatttggccaaatgggtgaacctattacactggacctgaagtatttatctgaagtttacccgcacccagatttaagacaagacagtgatggtaaaattatatcaggcacaatagaaagtttatgtcacacagtcttattttaccccggtccaaagcaatcggacgtacctaatgagaaatcattatctaagacacatagagctgttattaatctgttattgatgtttccattactagatcatttcattaagtttctaaaggtattcaaccaattcggtctttcttttaccaagaataaatcaagattgacaaataattccacacaattctacaacatatcccctgctgtcgatgactccatgactcaaagattagctttaactgctaaaacaatccttgatgtatttccgggatttttgctggatgaaccaatgctgaagactataatttccttattagatactatatctttgcataacgatgaaatttccaacaatttgaaaattaaaatcgccaataaacataacgaattaatgaaacttaccgcattcactcgatctcttccaatggcaacatcatctacacatgaattagagattatattggatccaagtcatttcctgtctttagacattacaacattggctgatgaagttcatcatatcaatttaaagtttgataaagtatgggcaccgaaatttgactattctctgctgtatgattcgaagtttattaatcgaagaattgtctcgttaaatccattggtattcaacaacgaccaaaatatccattttcttggaaggctactaatatcacatttatttccaacaaatcctgagtttagtaaaaaagtgactccaaaagtgagagctgagttattagataaatgggtccaaattggctgtagatttgaacatttaggagacatggtatcatggctagctgtcgccactatcatttgttcaattcctgtactaaggtcatcttcatggaaatatgttcctgatcagtcattgaaaactatttttaaagattgggttcctaccattattcagttagagaggcgacaaaggacatctaaatctacaagtagtgttttcatactcgctcctccaaatctggatgacgactttacgagagctaacgtgatttcttattttggcgatttattaattcatgctgatgatttaccatctgatacgaaattcaagtacttggaaaagaaaattaacagaacaaaaaacgcttttcataaatggcaacaaagattacaagcaatcgactctacgagacataaaactaattcgacagaaaacgtcagggataatgattctcctaataacgttgtttatcagctctggaaatttcatttatcacaacctccgttgaacattgaaggaataatgaaattaagtgtccaacacgaacctccaataatcgaccagaaagcgtattctactattggttctcaaaggagtgctttagtaactggaagttatttacccattttattcaatgaactattcccaaattattcactatttcctaagaatacattagtgggtgctgccagtgatgcgaagttgccgcctccaagatcatccgcgcgcctctcaaaatcactttcaatcagtgaaccaattccaatagcttcaaacagtcacactatgggctcattaacagatgatgctatgtcctcaaaaaatgataataataaagttacaggtgttggaaaaattgacggacctgtgatcaaagagatgtcgtcaaaacaatcaaataaacagagactattaaaatctgtgagagatgtttttaatattgacatggatgtgtttcatatatcagatgagttagtatttaaatcggtatacgataatgatggtaaatcccgtcctgctagtatggtcatagaaacaccaaagagattctcacaacactcttccatgcttattaataatccagctactccaaaccaaaagatgagagattccttggataccactggaagactaagtaagacattagaaaatatggactttttcaacaatattggtcaagtatcagattcactaaaagaatcgattattcgtgtcgtattgaaatcgtcgtcgctagaaaagatttttgatttactggtattaacttcaaatatcttttcaaaattggtagacactaaagaccttgagaattattactatcatcaaagacaaaggggtcattctaccagagggctttccgatgataacataggactactagattatgcattcgttaaactaactatggacaatgatattttcacagaaacattcttcaacacttataaaagctttactactacaactacggtattagaaaatatggcaaaacggtatgttggtgcaaagagttgcagcgtgtcaatttccaagattttagatcgcagtgatgattctaaaatgaagataaatgaggatacaaatttagtgtcctcttcattatacgaccaaaattttcctgtttgggatatgaaagtaactgacgatgaaaacataaaccttatttatatggcaaaaatccaaatcggcgccgcggaagctatactacatttagtgaaaaatcattactctgactttactgacgatttatgtaacaactctactctattggatattataaaaataatggaacaagaagtatccactgaatggcctacgcgaattgcaaactcaaagttacaaaaaagcctaccagaaaattttgtgattgaaacagaaaatttgttgactacgttaactgatctatttcatggtattaaatcagcataccaaaagcaactatacagacctattggtgtcaatagaactcagaagagaataactgacattttgaattcctttaacacattctcttttacagatcttaacaacatcattgatgatccttcctttagcgatgacatgattagatcttttcaaaagttacactcaaccaattacgaagatatactagaatggatctaccagttagataactttatttctaagaagttcaatttagtttctaagaaagattggatagttcttttccaggagttggaattgctttcaaaggaatctctggtctcttttttcaattatccgctacattttaagtcaagcaaattgataaaccccggatatttgcaattgcacgagtttgaaatttccaatctttttacttggatttctacattgattcttaaggatgataatggtacggagagtcttttttttgaaaaactaccacaatctataaaattgttaataaagttacacacgagtctaactacgtttttcgtgatggaaatttcaaacgtcaacaaaagcagtagtgaaaggttaactacttgtaaagttatattacaaattttgaactacatccgctggaaaaacggaagtttggatttatttgattcagaggaggatgaaagtcctcatgctatttgtccacacattccagcttttattgaaactgctattgcgcatgccataatatcaccagagtctagaaactatgaactttcgtggatcaaagcttctgaaaaactttcggaccctactaaaggaacccaaaatctaagatcgattagtaacgttttagagaagatagatgacatacatataaagagattcattgagattgatgatgtattcagcaaaaactgcaagaatttatgcccctgccctggttggttcatttcaaggttactagaaatatctcagtttgtccctaacatgagtatcactaattcgaaacttattaattttgacaaaaggagatttgttaacaacataatatctaatgtcttggatttaattccgaacgaaagggagtttccacttgatattgaaatgagtgacgaaaatccttcgaaaagaactacatttggccgcattctgttcaataattttgaagatgttaataaagtatacagaaagaagactaaaaaagtatcagaatcagaagccatatcggagagatttcaagagcagggagtatttaatgaaatactagtcaatgaaattgaaaaaataaagagggaagccagaaaattagaggttttactcgatcaagaaaagatcttgaagaactctgctgctttacatcaggccgttccgaaaaagaataggaagtctgttattatctcaggtactcatagtgacaacgatcatagctataatatcaataagaacaccggtcaaacgccttctctaggtagtgttatggaaagcaataattcagcaaggaatagaagagattcaagggcctccttttccacaaatagatcatcagtagtgtcaaattccagccataatggtgttagtaaaaaaataggtggatttttcagaagaccattttcaatcggtggattcaacacatccagttctaattattcactcaacagtatattatcgcaagaagtttcaagtaacaaatccattctaccaagtatacttccagaggttgattccatgcaactacacgacttaaaacctagttatagtttgaagacctttgaaatcaagtcaataatggaaataatcaatcacagaaacattccggcttactactatgcgttcaagatagttatgcaaaatggccatgaatatctgattcaaacggctagttctagtgacctcacagaatggataaaaatgatcaaggcttccaagagattttcattccattcgaaaaaatataaaggtaaaactcataataagatatttggggtaccattagaagacgtttgtgaaagagagaataccttgatacctacaattgttgtgaaattgctggaagagattgagctgcgtgggctagatgaagtgggattgtacagaattcctggttccatcggcagtataaatgcactaaagaacgcatttgacgaagaaggtgcaacagataattcctttacattagaggacgatagatggtttgaagtgaatgcgatcgcaggctgttttaagatgtatttaagagagttaccagattctttattttctcatgctatggtgaacgactttaccgatttggcgattaagtataaagcacatgcaatggtaaatgaagaatacaagagaatgatgaatgagttactccaaaagttacctacatgctattaccaaactttgaaaagaattgtatttcatttgaataaagtacatcagcatgttgtaaataataaaatggacgcatcaaacttggctattgtattttccatgagttttataaaccaagaagacttagccaacagcatggggtccagattaggtgcagttcagacaatcctgcaagattttattaagaatccaaatgattatttcaagcaataa

SEQ ID NO: 25461 - DNA, 1722 bp, Saccharomyces cerevisiae
atgttacagcagggttcttcctcgaggaggagtttgcatggtaatgattttcacacgctcacttctccttcaaggagagactctttgagtattcctagggctgtggacgctagatctgcgtctacgattgatctgttctacataccggatgctaccgtctcaaggaggcactctactctggtggctaatagatcagacaataatggtaatggcgcaccgatgcgccagtacaataaacctaactttgcttcctcctcgacttcatctctgccttcaactagaaatcgcccctctcgctacgataacatgaatatgaatatgaatatgaatatgaacatgaacatgaacatgaacatgaacatgaacaaccatactaccagtgatcacaatgcgcacccgcaatatcgttgtagaccaaacccgtccagacgccactccttaatgaccattcccgaaaagtactctggtagtcgctacagtctccgatcatccccgcctacctattctaatccacgtgttaggaaggaacttactcctttccaattacaaagaaagcagatgaaaagcgcttttcaattccccaacggtgaaaatttcacgccaagaaaccagatagcaaggcttccgccatcttcgacttttcccgactctccttctagttcatcgttgcctttgacccagactggaggcccatcttccgcagataacgattccattgccactggcacgaacaatcgttctcctcaacaaacgaaagctgctgatgctaatcagaaatctgaatccgagtctccaaaggcaattagatcaaattctaaaaagatatctcgtttcttcaggaaaatctggtcgtccaagtcatcaaattctgcagattccgtagaagagaatagcaaaacaaagcagaaaaggaaaaatccggagagagttgtaccagaaccgataacgtcccttgaccaaccggttgaaattataaaacagagtttttcaaccgttaacaatcacgaaacggctgtaccttcaattaaggactctggcatagtacaagaattgacagcactcggagataataacaggataccagttcttccaccccctaggtcaccaaacagacctacactgtctgataaacgaactacaaagttatactactgtagtcaagattcgtctaatgaagatattgctccagaggaaaagagcaccgttttcttaaagcgtttgcaggatgaatggtctaccgtgtatttaaacaaattgcctttgactgcttctgtgccatcttctctctctaccactactgatgctgcgaactcttcgttcataaactcttcaatatcatcgccggctccttcttcttcgtcctcgtcatcgttggtttcccgtggaccaatgcaatccatatcttcttcgccaacacctgccccttcttcagggtcatcgaaatctaaaaatgccgtcaaatccttacgctttgcggatgagatttatgtaaacgatacgtggtccgccgcggactattgcaggtgtgataatacctttttgaataatttctttaaaggaaagagccaagacattaccaatccttctacttttgtcggtaataatctctcatccacaaaaaatatatccaatattgaaatcaaaatggaggtgaatgagttcaaaagaaaggaaatgcgcgttcaccaggatagcgctaagtatacacattactacttataa

SEQ ID NO: 25462 - DNA, 4407 bp, Saccharomyces cerevisiae
atggcagccaaggatatttctactgaagtgctgcaaaatcctgaactatatgggctgaggcggtcacatagagctgctgcgcatcaacaaaactacttcaacgatagcgatgatgaggacgatgaagataatattaaacagtcgaggaggaagagaatgaccacgattgaagacgacgaagacgaatttgaagatgaagaaggcgaagaagattctggagaggacgaagatgaggaagattttgaagaagatgatgattattatggctctcctataaaacaaaatcgatcaaaaccgaaatcaagaacaaaatcaaagtctaaatctaagccaaaatctcaatctgaaaagcaatctacagtgaaaataccaacaaggttttctaatcgtcaaaacaaaacggtaaattataacatcgattatagcgatgatgacctcttagaatctgaagatgactatggttccgaggaggctttatcagaggaaaatgtgcatgaagcatctgccaatcctcaaccagaggacttccacggtattgatattgttatcaatcacagactaaagacatctttggaagaaggaaaggtcttggaaaagactgttcctgacctcaataactgcaaggaaaattatgaattcttaatcaaatggacagatgaatctcatctccacaatacctgggaaacttatgaatccattggccaagtccgtggattgaagaggttggacaactattgtaagcaattcatcatcgaagatcaacaagtaagattagatccatacgttaccgccgaagatatagagatcatggacatggaacgtgaacgtaggcttgatgaatttgaggagttccacgtgccagaaaggattattgatagccaacgtgcttcgttggaagacggcacctcacaattacagtatttagttaaatggcgtcgtctaaattacgacgaggctacttgggagaatgccacagatatcgtgaaattggcacctgaacaagtgaaacattttcaaaacagagaaaactctaagatcctcccacaatattccagtaattatacttcacagagaccgcgttttgagaagttaagcgtgcaacctccgttcattaaaggtggggaattaagagattttcaactaactggtattaattggatggcatttttgtggtccaaaggtgataatggtatactggcagatgagatgggcctgggaaaaacggtccagactgtcgcctttatcagttggctgatatttgctcgtagacaaaacggacctcacatcattgtcgttcctttatcgacaatgcctgcctggttggatacttttgagaaatgggcgcctgatttgaattgtatatgctatatgggcaaccaaaaatcaagagataccattcgagaatatgaattttacaccaatccaagggcaaaagggaaaaaaacaatgaaatttaatgttttattaacaacatacgagtacatcttaaaggatcgtgctgaattaggaagtataaaatggcaatttatggccgttgacgaagctcatagactaaaaaatgctgaatcatccctttatgaatcattaaacagtttcaaggtcgccaaccgtatgttaatcacaggcacacctcttcagaataatattaaagagttagctgcgttggttaatttcctaatgcccggaaggtttacgattgatcaggagattgattttgaaaaccaagatgaagagcaagaagaatatattcatgatttacaccgaagaatacagccttttattcttcgtcggttgaagaaagacgtagaaaaatcacttccatcaaagacagagcgtattttaagagttgaattgtccgacgtacagactgagtactataaaaatattctgactaaaaactactctgctttaactgctggagctaaagggggtcatttctctttactgaatattatgaacgagttgaaaaaggcatcgaaccatccatatctcttcgataatgctgaagagcgcgtcttacagaaatttggggatggtaaaatgactcgagaaaacgtactaagaggtttgatcatgtcttcgggtaagatggttcttttagaccaattattgaccagattgaagaaagatgggcaccgcgtgttgattttttcacaaatggtcagaatgcttgacattttaggcgactatttatccattaaaggtattaacttccaaaggttagatggtacagtaccatctgctcaaagaaggatatctattgatcatttcaactctccggattcaaacgacttcgtatttttactttctactcgtgctggtggtttgggtatcaacttaatgaccgccgataccgttgtgatttttgattccgattggaatccgcaagccgatttacaagcaatggctagagctcatcgtattggccaaaaaaatcacgttatggtgtataggttggtttcaaaagacacagtagaggaagaggtattagaaagagcacggaagaaaatgattctggaatatgctattatttctcttggagtgacagatggtaacaaatacactaagaagaatgaaccaaatgccggtgaattatcggcaatcctgaagttcggtgcaggcaatatgttcactgccacagacaaccagaaaaaattggaggatcttaacttggatgatgttttgaatcatgcagaggatcacgttactactccagacttaggagagtcgcatcttggcggtgaagagtttttgaagcaattcgaagtgactgattataaagctgatatagattgggatgatatcattccagaagaagaactaaaaaaactccaagatgaagagcagaaacgcaaggatgaagaatatgttaaagaacaacttgaaatgatgaatagaagggataacgccctaaaaaaaataaaaaacagtgttaatggtgatgggaccgccgcaaactcagattctgacgacgatagtacttccagatcttctagaagaagagcaagagctaatgacatggactctattggtgaatcggaggtgagagctttgtataaagctattttaaaatttggcaacctaaaggagattttggacgagttgattgcagatggaaccctgccggtcaaatcatttgaaaaatacggtgaaacttacgatgaaatgatggaagcagctaaagactgtgtacacgaggaagagaaaaatagaaaagaaatcttggagaaacttgagaagcatgctaccgcctatagagcaaagctaaaaagcggtgaaataaaagcagagaaccaaccaaaggataatccgttgactagattatctttaaaaaaaagagaaaagaaagccgtccttttcaactttaaaggtgttaaatctttaaacgccgaatctttactaagtagagtggaggatttaaagtacttgaagaacttgataaattcaaactacaaagatgatccattaaagtttagcctaggcaacaacacacctaagcctgtacagaattggtcatctaattggacgaaagaggaagatgagaagctattgattggtgttttcaaatatggatatggttcctggacacaaataagagacgatccatttctaggcattactgataaaatattcttgaatgaagttcacaatccggtagcaaaaaagtcggcaagctcctctgatacaacaccaacaccctcaaagaaaggaaagggaataacgggttcttcaaaaaaagtacctggtgccattcacttgggcagaagagttgattatctattatccttcttaagaggaggcctaaatacaaagagtcccagtgctgacataggctcgaaaaaactccctactggtccttccaaaaagagacaaagaaaacctgctaatcacagcaaatccatgactccagaaattacaagttctgagcctgcaaatggcccgccaagcaaacgtatgaaagccctcccaaaaggtcctgccgccttaataaataacacgagattgtctccaaacagccccacgcccccattaaagtccaaggtttccagagataatggtacaaggcaatcaagcaaccccagtagcggcagcgctcacgaaaaagaatatgacagcatggatgaagaagactgtcgacacacaatgagtgcaatacgtacttctttgaagcgacttagaagaggcggcaaaagtcttgatcgtaaggaatgggccaaaattttgaagaccgaattaactacgattggtaatcatatcgaatcgcaaaagggctcatcgagaaaggcaagcccagaaaaatatcgcaagcacctttggtcttacagtgccaacttttggcctgccgacgttaagagtacaaagctgatggcaatgtacgacaagataacagagtctcaaaagaagtga

SEQ ID NO: 25463 - DNA, 4716 bp, Saccharomyces cerevisiae
atgtctggaacttttcatggcgatgggcatgctcccatgtcgccctttgaagatacatttcaatttgaagataatagcagtaatgaagatacacatattgcacctacccattttgatgatggtgcaacaagcaacaaatacagccggccacaggtcagcttcaatgatgaaacacccaaaaataaacgtgaagatgcagaagaattcacatttaacgatgacacagaatatgacaatcattcctttcagccaacaccgaaacttaataatggatctgggacgtttgatgatgtggaattagacaatgatagtggtgaaccgcacactaactacgatggtatgaaaagattccggatgggtacaaaaaggaataaaaaaggaaacccaataatgggaagatctaagaccttgaaatgggctaggaagaacattccaaacccatttgaagactttacgaaggatgatattgaccctggtgccataaatcgtgcgcaagaactaaggactgtgtattacaatatgcccttaccaaaagatatgatagatgaagaaggcaaccccattatgcagtatcctcgtaataaaatcagaactaccaaatataccccgttaacattcttaccaaaaaacattctatttcagtttcataatttcgccaacgtttatttcttagttttaataattttaggtgcatttcaaatttttggtgtcacgaaccctggtttaagtgcggttccgttagttgtcattgttataatcactgcgatcaaggatgctattgaagactcaagaagaaccgtcctagatttagaggtgaataataccaagacacatattttagaaggtgttgagaacgaaaatgtctcaaccgataatatttcattgtggagaaggtttaagaaagcaaactctagactccttttcaagtttatacaatattgtaaagaacatttaactgaagagggcaaaaagaagagaatgcagagaaagcgtcatgaactaagagtacaaaaaactgttggaacgagtggacccagatcctctctagactccattgacagttacagagtatctgcagattatggccgtccttcattggattatgataatttggaacaaggggccggtgaagccaatatagttgatagatccctaccacccagaactgattgtaaatttgccaagaattattggaaaggtgtcaaggttggtgatattgttcgtatccataacaatgatgaaatccctgctgacattatcttactttcaacgtcggatacagatggtgcctgctacgtagaaactaaaaatttggatggtgaaacaaacttaaaggtacgccaatccttgaagtgtaccaatactataagaacgtcaaaagatattgctagaacaaaattctggatcgaaagtgaagggccccactcaaatttgtacacttatcaaggtaatatgaaatggagaaatcttgcagatggcgagatacgaaatgagccaattactattaataacgttctgcttcgtggttgcactcttagaaatactaagtgggcaatgggtgttgtaatgtttaccggtggtgacacaaaaatcatgttaaactctggcattacacccaccaagaagtccaggatttcaagagaactaaacttctctgtggtgataaatttcgtgctacttttcatcttatgttttgtttctggtattgcaaatggtgtatattacgacaaaaaaggcagatcacggttttcctatgaatttggaacaattgctgggtcagcggcgacaaacggtttcgtctcattttgggttgctgttattctttaccaatctttagtcccaatctctttgtacatttctgtggagatcatcaaaactgcacaagcggccttcatttacggagacgttttactctacaatgccaaattggattatccttgtacaccaaaatcctggaatatttctgacgatttaggtcaagtggaatatatattttctgataaaacaggtacattaactcaaaatgtaatggagtttaaaaaatgtactatcaatggtgtttcatatggaagagcttacaccgaagcgttagcgggattaagaaaaagacaaggtatcgacgtcgaaaccgaaggtaggcgtgagaaggccgaaattgccaaggatagggatacaatgatcgatgaactgagagctttatcaggaaattcacaattttatcccgaagaagttacctttgtatcaaaggagttcgttcgcgatttgaaaggggctagtggtgaagtacaacaaagatgctgtgagcactttatgttagcattagctttatgtcactccgtccttgtagaagcaaacccggacaatccaaaaaaactggatttaaaagctcaatctccagacgaagcagcgttagtagccacagctagagatgtaggattcagttttgttggaaaaaccaaaaaagggttgataattgaaatgcaaggtattcaaaaagaatttgagattctaaatattttggagtttaattcatcgagaaaaagaatgtcctgtattgtcaaaattccgggtctgaacccaggggacgagcctagagcacttttaatttgtaaaggtgcagattccattatatactcaagattaagtcgccagagtggtagcaatagtgaagctattttggaaaaaactgctttgcatttagagcagtacgctactgaaggtttaagaacgttatgcatagctcaaagggagttaagttggtctgaatacgaaaaatggaacgaaaagtacgatattgctgctgcatcattagcaaacagagaggatgaattagaagttgttgcagattccattgaacgcgaattgatattattgggcggtacagctatcgaagatcgtttacaagatggtgttccggattgtatagagttgcttgcagaggcaggaattaaattatgggttcttacgggtgataaagttgaaacagctataaacattggattttcttgcaaccttttgaataatgaaatggaattgttagttattaaaacaactggtgatgacgtgaaagaattcggatcagaaccaagtgaaattgtggatgctttactctccaaatacttgaaggagtatttcaacttaaccggttcagaagaagagatttttgaagctaaaaaggatcacgaatttccgaagggtaattacgccatcgttatcgatggtgatgctttgaaattggcgctatatggtgaagatataagaagaaagtttcttttactctgcaagaattgtagagctgtcttatgctgtagagtatctccatctcaaaaagcagccgttgttaagttagtcaaggattctctagatgtcatgacactagccatcggcgatggttccaacgacgtcgccatgattcaatctgcggatgttggtattggtattgccggtgaagaaggtcgacaagctgttatgtgctcagactacgccattggacaattcagatatttggctagattggtcctcgttcacggtaggtggtcttataagagactggcagaaatgattcctgagtttttttacaaaaacatgatttttgctttggcattgttctggtatggtatctataatgattttgatgggtcttacctgtatgaatacacatacatgatgttctataatttggcatttacatccctaccagtcatcttcttaggtattctggaccaggacgtgaatgacacaatatcattagtggtccctcagttataccgtgttggaattttaaggaaagaatggaaccaaagaaagttcttatggtatatgttggacggattatatcagtctattatctgtttttttttcccttacttggtttatcacaaaaatatgatagttacgagcaatgggttaggattggatcatcgttattttgtcggtgtttatgtgaccactattgctgtaatttcgtgtaacacatatgttttattacaccaatatagatgggattggtttagtggattattcattgcactgtcttgcctcgtagtttttgcatggacgggaatatggtcttctgcgatagctagtagagaatttttcaaagctgcagcgcgtatctatggagcaccttcattttgggctgttttctttgttgccgtgctgttctgcttactgccccgtttcacatatgacagttttcaaaaatttttctacccaactgatgtggaaatagtaagagagatgtggcaacatggccatttcgatcattatcctcctggttacgatccaacagatcccaacagacccaaggtcacaaaagctgggcaacacggagagaagattatagaaggcatagcactttccgacaacttaggaggatcgaactattcaagggatagtgttgtcacagaggagattccaatgactttcatgcacggtgaagatggaagtcctagcggatatcagaagcaagaaacctggatgacttcacccaaggaaacacaagatcttcttcaatcgccccaatttcagcaggcccaaacgttcggaagaggcccatcaaccaacgtcaggtcatccttggaccgcacaagagaacagatgatcgccactaaccaactagataaccgctactctgtggaaagagcgagaacatctctagatctaccaggcgtaactaacgcagcctccttaatcggaacacaacagaacaattaa

SEQ ID NO: 25464 - DNA, 2556 bp, Saccharomyces cerevisiae
atgccgaagaatagtcaccaccatcgttccagttcggttaattccacaaagagtcgttctacggaatctacgaataaatggaaaattccgcactattatcgcagatccgctagcggcagcacacaagcttcgccggacaggaactcctcaacaggctcatgtagcactccagtattacctactatgaatgttatgtctagcccgaaaaaagttttgctagaggatcccagagacaaccatactaaggcgaagaagagtagtagaaagaaatcaggtgaaatggtcttcgtcaattatactgtacaggacacggctaacgaaaatgatactgacttgcaaacccagccggtttctgtgccagcaccaaaggcgaaattaaagaagaaatcctccaaaaggagaatgctgaagatatttggatcgtcaaagaacgaacacatagaggacatcgttgaagagcaaccaatggtgcttcaaatggattcagaatctaaacccctttcgggaacccctatctcagaaagcggaatcgacgcctcgtcactaacaaccaaaagatcttataactcgttcttaaaacacaataggctaaacggtaaaactccgttctctggaaacttgtcctttccatcattaaacatgatgggtaacactactgatctgcctattgacaataacgatttttgttccgagaaagaagtcgttccgaaatcaactcatgatccttcactagcaaaaccgccatcaaggttcactgaaagcgaaacaaattctactcccaacttatcaagtatacctctcatgaacacaaaaaatacaagattgaagtacaataaagtggcgcctcagagttcagaccgacaaaagtcacaggaaagtgggctatatcattctaccgaatcattcaacttcaaagatcaaaactacagtaacaataaatcctctttaagtctgaactccgatttaagtacaccccactttgcaaagcattcacctgattcaccaagaacttcaagatctttcaactgcggagactcacaaagtaaagttaaattaccggaagaaaatgacgcttctattgcatttagtaagatgtttactagaaaacgagccaacactggcgggtccacgtgttcgctagcctcacccactattgcacaaactattcagcaatcaaatataaaagttaataaattgccaactcagcgaaccacttcagttggctcattatcatccatgtcaaatcgttattcaccaataagagttgcatcgccaggaagagcaagatccgcaactcgtgggtcttccctttatagattatccagagaccttaattctttaccaagcgtcactgatctaccagaaatggatagtacaaccccagttaacgaaatattcttggatggccaaccacagcataaaagtggcagtgtcaaaggagggcataggaagaaacaagaatctatctctgatgctcaaagaattcaacattctaattcgtacattacaacaccttcatcttctctggtgactcctccttactacatgacaggttacacattaccaagttctgcatctgcttcttcaactccaaatgtgcttgaaacacacaatatgaactttgttccaagtaccagtactgttacaagttatcgcccatctagcaatttttcctcatttgacaaagaatacagtaacgaaaacgacgctagtggggaattctctgctttcaatactccaatggagaatataccggcactaaaaggtatacctagatccacgttagaagaaaatgaagaagaggatgtcctagtacaagatattccgaatacggcacacttccaaagaagggatattatggggatggatactcacagaaaggatgacagtttagattttaactctttgatgccacacggtagtacaactagtagcagcatcgtagattctgttatgacgaactcaatatccactacaacaagcaacgcgaccggaaactactttcaagatcaagataagtatacattggtaaatacgggattgggattgagtgatgcaaacctcgatcattttattagatctcaatggaaacacgcttctcgatcagaatccaataataataccggaaatcgcgtttcttacagtggctcaacaccaaacaatgttgatacaacaaagactaatttgcaagtgtataccgagttcgattttgaaaacccagagtcgtttttccatgagcaatcgaagctactaggtgagatgggccacagcaataacaacagcaacagcgccatcaacatgaatgaacccaagtctgcggatacatacattggaaatatatctccggatacttcagcaactgtttcattaggcgacctgatgggctcaaacgtttcaaacaacagtgaaagaaatttttacgatggtcatactttcgttccacagtatcaggcgaactcatctgtggaaaactcaaataatcaaaatgcagcaccaattgcaaataacgacattgataataatttacagtctttttattttgataatagcaactaa

SEQ ID NO: 25465 - DNA, 1641 bp, Saccharomyces cerevisiae
atgctacggtctactatatctctactgatgaatagtgctgctcagaaaacgatgacgaattctaattttgttctaaatgcacccaaaatcaccttaaccaaagtggaacagaacatctgtaacttgctgaacgattatacagacttgtacaatcaaaagtaccacaataagcctgagccattgactcttcggatcacgggcggatgggtgcgtgacaagcttctgggacaaggttctcacgacttggatattgccatcaatgtgatgtcaggtgagcaatttgctactggtttgaacgagtatttgcaacaacattacgccaaatatggagccaagcctcataatatccacaagattgacaagaatcccgagaaatccaagcatctggaaactgccactactaagctctttggcgttgaagtggattttgtcaatttaagatctgaaaagtatactgaactttccaggatacctaaagtgtgctttggcacacccgaggaagacgctttaagaagggatgctacattgaacgctcttttctataacattcataaaggtgaagtggaagatttcaccaagagaggtctgcaagatctaaaagatggcgttctccgtactccgcttcctgcaaaacaaacatttttggatgatcccttgagggttttgaggttgatccgttttgcttctagattcaactttaccatagatccggaagtgatggctgaaatgggcgatcctcagattaatgttgcattcaattcaaaaatttctagagagcgagttggtgtggagatggagaaaatattagtaggaccaacccctttattggctttgcagctgattcaaagggctcatcttgaaaatgttatctttttttggcataatgatagctccgtcgtaaaattcaacgaagagaattgtcaagatatggacaaaattaatcatgtatacaatgataacatactaaactcacacttgaaaagttttattgaattatatccaatgtttttagagaagcttcctatcttaagggaaaaaattggtcgttcgccaggatttcagcaaaattttatattgagtgcgatcctgtcccccatggctaatttacaaataatcgggaacccaaagaagaaaattaacaacctggtttcggtgacagaaagcattgtgaaggaaggattgaagctgagtaaaaatgatgcagcagttattgccaagaccgtagattcaatatgttcatatgaggaaatacttgctaagtttgcagatcgttcccagctaaaaaaatccgaaatcggtatatttctacggaactttaatggcgaatgggaaacagcacattttgcatctctatcagatgcatttttaaagattcccaagcttgaaactaaaaaaattgaattacttttccaaaattacaatgaattttattcttacatatttgacaataatttgaataattgtcatgaactaaaaccaatagtggacggaaaacaaatggcaaaactacttcaaatgaagccaggtccatggctgggtaaaattaataacgaagcgattaggtggcagtttgataatcctacagggactgatcaagaattaataactcatttaaaagccatactaccaaaatacctgtag

SEQ ID NO: 25466 - DNA, 2337 bp, Saccharomyces cerevisiae
atgaagttttatatagatgatttaccagtgctttttccataccccaagatatatccagagcagtataattatatgtgcgatattaaaaagactctggatgtaggtggaaatagtatcttggagatgccttcaggaacaggtaaaacggtctcattactatccctcacaattgcctaccagatgcactacccagaacatagaaagatcatatattgttctcgtactatgtctgaaattgaaaaagctttagtagagttagagaaccttatggattacagaactaaagaactaggctatcaagaggattttcgaggtcttggcttgacatcaagaaaaaatttgtgtttgcatcccgaagtgagtaaggaacgaaaaggtacagtagtcgatgaaaagtgccgtagaatgacaaatgggcaggcgaagagaaaattagaagaggatccagaggcaaatgtagaattgtgtgaataccatgagaatttgtacaatattgaagtagaggattatcttccaaaaggcgtattttcttttgaaaaacttttgaaatactgcgaagaaaaaacactttgtccatattttattgttcgtcgtatgatttctctttgtaacattattatttattcttaccattatctattagatcctaaaattgctgaaagagtttccaacgaggtttctaaagatagcattgtcatttttgatgaagcgcacaatattgataatgtgtgtatcgaatcgctgtcattagacttgacaacggatgcattgagaagagccacacgaggtgctaatgcgttagatgaacgtatttctgaggtcagaaaggttgactcacagaaattacaggatgaatacgaaaaactagttcaaggtctccattctgcagatattcttaccgaccaggaagagccatttgtggaaacacctgtattgccccaagatcttctaacagaagcaatcccgggaaatatacgaagagccgagcattttgtttcatttttgaaaagattgatagaatatctgaagaccagaatgaaagttcttcacgttatttcagaaacgccaaaatcatttctacagcatttaaaacagttaactttcatagaaaggaaacctcttcggttttgctcagaaaggctatcattacttgtaagaactttagaagttacagaggtagaagattttactgcattgaaagacatagcaacttttgctactcttatatcaacatatgaggaagggtttttactaattattgaaccgtatgaaatcgaaaatgctgcagttccgaatccgattatgagatttacttgcttagatgcatcgattgccatcaaaccagtctttgagagattttcttccgttattatcacttcagggaccatatcaccattagacatgtatccaagaatgttaaactttaaaactgttttacaaaaatcatatgccatgaccttagccaaaaaatcatttctaccaatgattattaccaagggttctgatcaagttgcaatttcttcaagatttgaaatcagaaacgatcctagtattgttcgtaattacggttctatgctagtagagtttgccaagatcacacctgatggaatggttgtttttttcccctcatatctatatatggaaagtattgtttcaatgtggcaaacaatgggtattcttgacgaagtttggaaacataaattaattttagttgagactcctgatgctcaagaaacttctttagccttagaaacctatagaaaggcttgctcaaatgggcgtggggcaattttgctttctgttgctagaggaaaggtatctgaaggtatcgattttgatcatcaatatggcagaactgtgctgatgataggtatcccgtttcaatacacagaatcgcgtattttgaaagctcgcctagaattcatgagggagaactatcgcatcagagaaaacgacttcttatctttcgatgcgatgagacatgcagctcaatgtctggggagagtactgagagggaaggacgactatggtgtaatggtactagcagaccgtaggttttcaagaaaaagaagccagttaccaaaatggattgctcaaggtttgtctgacgccgatttgaacctttcgactgacatggccatatccaataccaaacaattcttgagaacaatggcacaacccacagaccctaaagaccaagagggtgtatctgtttggagttatgaagatttaataaagcaccagaatagcagaaaagatcaaggtggatttattgaaaacgaaaacaaagaaggagaacaggatgaagatgaagatgaagatatagaaatgcagtga

SEQ ID NO: 25467 - DNA, 804 bp, Saccharomyces cerevisiae
atgtcaaccagtcgtgaagattctgtgtacctagccaagttggctgaacaggccgaacgttatgaagaaatggtcgaaaacatgaagactgttgcctcctctggccaagagttgtcggtcgaagagcgtaatttgttgtctgttgcttataagaacgttattggtgctcgtcgtgcctcttggagaattgtttcttctattgagcaaaaggaggagtccaaggagaagtccgaacaccaggtcgagttgatttgttcgtaccgttcgaagattgagaccgaactaactaagatctccgacgatattttgtccgtgctagactcccacttaattccatcagccaccactggcgagtccaaggttttctactataagatgaagggtgactaccaccgttatttggctgaattttctagtggcgatgctagagaaaaggccacaaacgcctctttagaagcatacaagaccgcttctgaaattgccaccacagagttacccccaactcacccaatccgtctaggtttggctcttaacttctctgtcttctattatgaaattcaaaactctccagacaaagcctgccatttggccaagcaagcttttgacgacgctattgctgagttggacactctgtctgaagaatcatacaaagatagcacacttatcatgcaactgctaagggacaatttaaccttatggacttcagacatgtccgagtccggtcaagctgaagaccaacaacaacaacaacaacatcagcaacagcagccacctgctgccgccgaaggtgaagcaccaaagtaa

SEQ ID NO: 25468 - DNA, 1332 bp, Saccharomyces cerevisiae
atgtttgtcgcacctgtatcttcacaaaagttggatacagcaataagaaaggaaaccacatttgtgccaatgcttgctgcttcattcaaacgccaaccatcacaattggtccgcgggttaggagctgttcttcgcactcccaccaggataggtcatgttcgtaccatggcaactttaaaaacaactgataagaaggcccctgaggacatcgagggctcggacacagtgcaaattgagttgcctgaatcttccttcgagtcgtatatgctagagcctccagacttgtcttatgagacttcgaaagccaccttgttacagatgtataaagatatggtcatcatcagaagaatggagatggcttgtgacgccttgtacaaggccaagaaaatcagaggtttttgccatctatctgttggtcaggaggccattgctgtcggtatcgagaatgccatcacaaaattggattccatcatcacatcttacagatgtcacggtttcacttttatgagaggtgcctcagtgaaagccgttctggctgaattgatgggtagaagagccggtgtctcttatggtaagggtggttccatgcacctttacgctccaggcttctatggtggtaatggtatcgtgggtgcccaggttcctttaggtgcaggtttagcttttgctcaccaatacaagaacgaggacgcctgctctttcactttgtatggtgatggtgcctctaatcaaggtcaagtttttgaatctttcaacatggccaaattatggaatttgcccgtcgtgttttgctgtgagaacaacaagtacggtatgggtaccgccgcttcaagatcctccgcgatgactgaatatttcaagcgtggtcaatatattccaggtttaaaagttaacggtatggatattctagctgtctaccaagcatccaagtttgctaaggactggtgtctatccggcaaaggtcctctcgttctagaatatgaaacctataggtacggtggccattctatgtctgatcccggtactacctacagaactagagacgagattcagcatatgagatccaagaacgatccaattgctggtcttaagatgcatttgattgatctaggtattgccactgaagctgaagtcaaagcttacgacaagtccgctagaaaatacgttgacgaacaagttgaattagctgatgctgctcctcctccagaagccaaattatccatcttgtttgaagacgtctacgtgaaaggtacagaaactccaaccctaagaggtaggatccctgaagatacttgggacttcaaaaagcaaggttttgcctctagggattaa

SEQ ID NO: 25469 - DNA, 1097 bp, Saccharomyces cerevisiae
atgtctgttacaggaactgagatcgatagtgatacagcaaaaaatattcttagtgtagatgaattacagaactatggtattaatgcctcagatcttcaaaaattgaagtctggtgggatatacacagtcaatgtatgttataataacatttttaaaacctctgctgtagaggttctttccccctttcttttactaactaataatttggaaaggaacttttatagaccgttttgtcaacaacaagaagacatctatgtaaaattaaagggttaagtgaggtgaaagtggaaaaaattaaagaagctgctggaaaaatcatacaggtgggatttatccccgctactgtacaattagatataagacagcgtgtgtactccttatcaactggatctaagcaactagattcaatcctaggtggtggaataatgacaatgagtatcactgaagtatttggtgaatttaggtgtggtaagacacagatgtctcatactttgtgtgttaccacgcagcttccgagggaaatgggtggtggtgaagggaaagtagcatatattgatacagaaggcactttcaggcccgagaggattaagcaaattgcagaaggttatgaattggatcccgagtcatgtttggcaaacgtttcatatgctagagccttgaatagtgaacatcaaatggaacttgttgaacaattgggtgaagaacttagttctggagattatcgccttatcgtggtagattctataatggcaaacttcagagtagactactgcggtagaggtgaactaagcgaaagacagcaaaagctaaatcaacatcttttcaaattgaatagattggcagaggaatttaatgttgcagtatttctgacaaaccaagttcaatcagacccaggtgcttctgcattatttgcctcggcagatggtaggaaaccaattggagggcacgttctggcacatgcgtcagcaacaaggattttgttgagaaaagggcgtggtgacgaaagagttgccaagttacaagattccccagatatgcctgaaaaagaatgtgtctacgtaattggtgaaaaaggtattaccgattcaagtgactag

SEQ ID NO: 25470 - DNA, 1677 bp, Saccharomyces cerevisiae
atggcagtccttaacttgaaacgtgaaactgtcgacattgaagagacagcgaagaaagatatcaaaccttattttgcttcgaatgttgaagcggttgatattgatgaagatcccgatgtttcaagatacgatccccagacaggagtgaaaagggcgctcaaaaataggcatatctcattgctagctttgggtggtgttattggcccaggttgtcttgttggtgcaggaaacgcactcaacaaaggtgggccacttgctttacttttaggctttagtattattgggatcattgctttctcagtgatggaatctataggtgaaatgatcactttatatccctcgggcggtggatttaccactttggctcgaagatttcatagcgatgcactgcctgcagtttgcggttatgcttacgttgttgtgttcttcgcagttttggcaaatgagtacaacactctctcctccatactacagttttggggcccacaagtccctctatatggttacatcttgatattctggtttgcatttgaaatttttcaactagttggcgttggtctttttggtgaaacggagtactggcttgcttggttgaaaatagtaggattagtagcctattatattttctcgattgtttacatatctggggatattaggaatagaccagctttcggctttcattattggaatagtccaggtgcattatcacatgggtttaagggaattgcgatagtgtttgtgttttgttcgaccttctattctggaacggaatcagttgccttggctgcaacggaatcaaaaaaccctgggaaggctgtgccacttgctgttcgacaaactctgtggagaattttagttgtttatattggaattgctgttttctatggagcaactgttccgtttgacgacccaaacctctctgcttctaccaaagtcctaaaatctcccattgctatcgccatatctcgtgctggttgggccggcggagctcatctggttaatgccttcattttgataacttgcatctccgccattaatgggtcactttatatagggagcagaaccttgacgcatttagcacatgaaggcctagctccaaaaattctggcttggaccgatcgaagaggcgttcccatccccgccatcactgttttcaacgccttgggcctaatatcattgatgaatgtgagcgttggagctgcaaatgcgtactcttatatcgttaatctttctggtgttggcgtctttattgtctggggtgtaataagttatacgcacctgagaataaggaaggcgtgggttgctcaaggaagatccatagaagagctaccttatgaagcgctattttatccgtggacgccagtacttagtctggccgctaacatttttctagcactcatccaaggatggagctatttcgtaccttttgatgcgggcaattttgttgatgcttatatccttctgcctgttggaattttattgtatattggcatatgtgtttttaagagcaatcattttagaactgttgatttgcggtcaatcaacctagacgaaggacgaagaaaagacatggaggctgatctttctgatcaagagagtagcttagcatcttcggaaacgatgaaggattataaaagtgcaacttttttcagatacctcagcaacattttcacctga

SEQ ID NO: 25471 - DNA, 1776 bp, Saccharomyces cerevisiae
atgtctcacaaacaattcaaatcagatggaaacatcgttactccctacctacttggccttgctcgaagcaatcccggccttacagtgattaagcacgacagagtggttttccggactgcgtcagctcctaattcagggaaccctcctaaagtttcattggtttctggaggtggcagtggtcatgagccaacgcatgccggttttgttggtgaaggtgccttagatgcgattgcagcaggtgccatttttgcttctccttcaactaaacagatctattctgctattaaagctgttgaatctcctaagggtaccttgatcattgtaaaaaattacaccggtgatattatacattttggtctcgctgctgaaagagctaaagctgctggaatgaaagtcgaactggttgctgtaggagatgatgtctctgtcggtaagaagaaaggttctttagtcgggcgtcgaggtctcggagccaccgtattggtgcataaaattgctggggcagccgcttctcatggactggagttggcagaagttgccgaagttgctcagtcagtagttgacaatagtgtcacaattgcggcatctcttgatcactgcacggttcctggccacaaacctgaagccattttgggcgagaatgagtatgaaatcggtatgggtattcataacgagtctggtacctataagtcttctccgctgccatcgatttctgagctcgtttcccagatgcttcctcttcttctcgatgaggatgaagaccgttcttatgtgaagtttgagcccaaagaggacgtagttcttatggttaacaacatgggtggtatgtctaatctagaattgggttatgctgcagaggtcatttctgaacaattgattgataagtatcaaattgtgcccaagagaacgattactggagcattcattactgcattgaatggtcctgggtttggtatcactcttatgaacgcttcaaaagctggtggcgatatccttaagtatttcgattatcctaccacagcgagtggatggaatcaaatgtaccattctgccaaagattgggaggtacttgccaaagggcaggttcccaccgccccctctttaaagacattgaggaatgaaaaaggttcgggtgtgaaagctgattatgacacttttgctaaaattttgcttgctgggattgcaaaaattaacgaggttgaaccaaaggttacttggtacgataccattgcaggagatggtgattgcggaactactcttgtgtccggtggtgaagcattggaagaagctattaaaaaccatacgttgcgcctcgaggatgctgctcttggtatcgaagatattgcgtatatggttgaggattctatgggtggtacgtccggtggtctgtactctatctatctttctgctctcgcacaaggagttagggattctggggacaaggaacttactgcggaaactttcaaaaaggcatcaaacgttgcactagatgctttgtataagtatacgagagcccgtcctggttacaggactctgatcgatgctctgcaaccttttgtcgaagcgctgaaagccgggaagggtcccagagccgccgcccaagctgcttatgatggtgccgaaaagacaaggaagatggatgcccttgttgggcgtgcttcttacgtggctaaggaggagctgagaaaactcgacagcgaaggtggattaccagatccaggagcagttggtcttgctgcactactcgatggatttgttacagctgctgggtactag

SEQ ID NO: 25472 - DNA, 1623 bp, Saccharomyces cerevisiae
atgacagcaatgaaagctattgtctggagacttcccaagatgccgaaaatcaaaattacaaaaacttatgaagttacgaaaattacggcgatattgacactagtaggatttataatgggccttgaggtgccgtcattggcaacttttctcacaaacaaaacgtttaatgagtacttcaagtatccaactcctttacaacaaggtttactcatggggtccacccccctgggtggtatcatgggatgttttatttgctgcataatgaatgatagattcagtagaatatatcaatttcaatcgggaataataatatggaatattgttacgttattgaacttttgtatttgggatatattaggtttactaatttgccggatgatcaagggtatgatccttgggaacttttcaattttagtagcatcctacgcaaatgaagttatcccccgcggcaagcgtggaagtacgatgagctatattcaattgtgtttaaccattggaattcttgttatgcattatttgtgcattgcattaagtctatgggattctcattttgcgttccgtatagcgtggtgcataggaatcattcctggattactgttctggatggctagctacgctctacctgaatcttatcactggctagtactacatgggaagatgagtgaagctcaggaaattcagcacaatttagccaaaaagtttaatgaaagccagccaagggatgcagtccctgagatgagtaagatcgaattagcaggagatttttggattggagttaatgatttggacttctccaaaaaattacctcggggttcgtttaagcctttgattcttggaatgactttacagttattggttcaatttagcggtataaacattatccttggttatattacatacatttgcgagattgtagggcttgaaggcaatgtaaaactattcaccagttccattccatatttcatcaacatggttttgagcttgttaccgattacattcattgattacactagcagaaagctaattaccttgttgggtggctttcccattagtgggttgctcattacaatcggcgcattatttgtgaagtatggtcaagacaccaagcccatcgacggcaataggagtttagtttggtcaattggagaaaacccgtttgtgggaggatggattctaactttatgctttctaattgttggaatatttgccatgagcctttccagtataccttgggtttacacgaatgaaatgttgccctcacgagtgaaagttaagggatttgccatttgcgtaacgtttggatggttgggcaattttattttaacgtttctatgccctgtgatgattgaaagattaaaaggcacaacatttataatatttggatctttgacattcttgatatcactttcagttttgatttggttcccagaaacaaagggtatgagcatagaagatattgataaattcttcgaatttgagagtaaagagggcaccaatttacatggggaaaagggtatcaaaacgccggactcaaattctaatggcggttctacaagatcctcccaagaagggcaattgcataaacctataaaactgaaaagcgatgaagagatgatcatatga

SEQ ID NO: 25473 - DNA, 1436 bp, Saccharomyces cerevisiae
atggattctggtatgttctagcgcttgcaccatcccatttaactgtaagaagaattgcacggtcccaattgctcgagagatttctcttttacctttttttactatttttcactctcccataacctcctatattgactgatctgtaataaccacgatattattggaataaataggggcttgaaatttggaaaaaaaaaaaaactgaaatattttcgtgataagtgatagtgatattcttcttttatttgctactgttactaagtctcatgtactaacatcgattgcttcattctttttgttgctatattatatgtttagaggttgctgctttggttattgataacggttctggtatgtgtaaagccggttttgccggtgacgacgctcctcgtgctgtcttcccatctatcgtcggtagaccaagacaccaaggtatcatggtcggtatgggtcaaaaagactcctacgttggtgatgaagctcaatccaagagaggtatcttgactttacgttacccaattgaacacggtattgtcaccaactgggacgatatggaaaagatctggcatcataccttctacaacgaattgagagttgccccagaagaacaccctgttcttttgactgaagctccaatgaaccctaaatcaaacagagaaaagatgactcaaattatgtttgaaactttcaacgttccagccttctacgtttccatccaagccgttttgtccttgtactcttccggtagaactactggtattgttttggattccggtgatggtgttactcacgtcgttccaatttacgctggtttctctctacctcacgccattttgagaatcgatttggccggtagagatttgactgactacttgatgaagatcttgagtgaacgtggttactctttctccaccactgctgaaagagaaattgtccgtgacatcaaggaaaaactatgttacgtcgccttggacttcgaacaagaaatgcaaaccgctgctcaatcttcttcaattgaaaaatcctacgaacttccagatggtcaagtcatcactattggtaacgaaagattcagagccccagaagctttgttccatccttctgttttgggtttggaatctgccggtattgaccaaactacttacaactccatcatgaagtgtgatgtcgatgtccgtaaggaattatacggtaacatcgttatgtccggtggtaccaccatgttcccaggtattgccgaaagaatgcaaaaggaaatcaccgctttggctccatcttccatgaaggtcaagatcattgctcctccagaaagaaagtactccgtctggattggtggttctatcttggcttctttgactaccttccaacaaatgtggatctcaaaacaagaatacgacgaaagtggtccatctatcgttcaccacaagtgtttctaa

SEQ ID NO: 25474 - DNA, 621 bp, Saccharomyces cerevisiae
atgaatagcgagtacgattacctgttcaaactgctgttgatcgggaattccggtgtcgggaagtcctgtttacttttgaggttttcggacgacacatataccaacgactacatctccacaattggagtggacttcaagattaagactgtagaactggacggcaagactgtaaagctacagatttgggacactgcaggtcaagaacgtttccgtactatcacttcatcttactaccgtggttcgcatgggatcattatcgtgtatgatgtcactgaccaagaatccttcaacggcgtgaagatgtggctgcaagagattgatcggtatgcaacctcaacagtgttgaagctattggtaggtaacaagtgtgatttaaaggacaagcgtgtcgtggaatatgacgtggcaaaggaatttgcggacgcgaataagatgccgttcttagagactagtgctttggactccaccaacgtcgaggatgcgtttttaaccatggctagacaaatcaaggaaagtatgtcccaacaaaacctgaacgaaaccactcagaagaaggaagacaaagggaacgtcaacctgaagggacagagtttaaccaacaccggtgggggctgctgttga

SEQ ID NO: 25475 - DNA, 1374 bp, Saccharomyces cerevisiae
atgagagaaatcattcatatctcgacaggtcagtgtggtaaccaaattggtgctgcattctgggaaactatctgtggtgagcacggtttggatttcaatgggacatatcacggccatgacgatatccagaaggagagactgaacgtgtacttcaacgaggcatcttctgggaagtgggttccaagatctattaacgtcgatctagaacctgggacgattgacgcagtacgcaattctgccatcgggaatttgtttagacctgacaattatatctttgggcaaagttctgcgggcaacgtgtgggccaagggtcactacacagaaggtgctgagcttgtagacagcgtcatggatgttattagacgagaggccgaaggatgcgactcccttcaaggtttccagatcacacattctcttggtggtggtaccggttccggtatgggtacgcttttgatctcgaagattagggaagagtttcctgatcgtatgatggccaccttctccgtcttgccctctccgaagacttctgacaccgttgtcgaaccatacaatgccacgttgtctgtgcaccaattggtagaacactctgatgaaacattctgtatcgataacgaagcactttatgacatctgtcaaaggaccttaaagttgaatcaaccttcttatggagatttgaacaacttggtctcgagcgtcatgtctggtgtgacaacttcattgcgttatcccggccaattgaactctgatttgagaaagttggctgttaatcttgtcccattcccacgtttacatttcttcatggtcggctacgctccattgacggcaattggctctcaatcatttagatctttgactgtccctgaattaacacagcaaatgtttgatgccaagaacatgatggctgctgccgatccaagaaacggtagataccttaccgttgcagccttctttagaggtaaagtttccgttaaggaggtggaagatgaaatgcataaagtgcaatctaaaaactcagactatttcgtggaatggatccccaacaatgtgcaaactgctgtgtgttctgtcgctcctcaaggtttggacatggctgctactttcattgctaactccacatctattcaagagctattcaagagagttggtgaccaattttccgctatgttcaaaagaaaagctttcttgcactggtatactagtgaaggtatggacgaattggaattctctgaggctgaatctaatatgaatgatctggttagcgaataccaacaataccaagaggctactgtagaagatgatgaagaagtcgacgaaaatggcgattttggtgctccacaaaaccaagatgaaccaatcactgagaattttgaataa

SEQ ID NO: 25476 - DNA, 1368 bp, Saccharomyces cerevisiae
atgtcagaagaggataaagcgaaaaaattagagaatttattgaagttattacagttgaataatgacgatacttcaaaattcactcaagaacagaaaaaagctatgaaagaccacaaattctggagaacgcaaccggtcaaagatttcgatgaaaaggtggtggaagaaggccccattgataagccaaagacaccggaagatatatctgacaagccactacctttattgtctagcttcgaatggtgtagtattgatgtggacaacaaaaaacagcttgaagatgttttcgttctactaaatgaaaactacgtggaagaccgcgatgcaggcttcagatttaactataccaaagaattcttcaattgggctttaaagagtccaggttggaagaaggattggcatattggtgttcgcgttaaagaaacacagaaattagttgcctttatctcagccataccagtaacacttggtgttagaggtaaacaagtgcctagtgtagaaatcaatttcttgtgcgttcacaaacagctaagatcgaagagattaacacctgttctaattaaagaaattacgagacgagtgaacaaatgtgacatctggcatgcattgtacacggcaggtattgttttgccagcacctgtgagtacgtgtcgttatactcatcgtcccttgaattggaagaaactttatgaagtagatttcacagggttaccagatgggcacacagaggaggatatgattgctgagaatgcgttaccggccaaaacaaagacagcgggattgagaaaattaaagaaggaagatattgaccaagtttttgagttgttcaaaagatatcaatccaggttcgaactaattcaaattttcacaaaagaagaattcgaacataatttcattggtgaagaatcgttaccattggataaacaagtaattttctcatatgtagtcgaacagcccgatggaaaaattacagacttcttctcattttactcattgccattcacaatcctaaataacacaaaatataaggacctaggcatcgggtacttgtattattatgccaccgatgcagatttccaattcaaagacaggtttgatccaaaagctactaaggctttgaaaacaagattgtgtgaattgatttatgacgcttgtattttggccaaaaacgctaatatggatgtttttaacgcgttgacttcgcaagataatacattgttcttggatgatttgaagttcgggcccggtgacgggttcttgaacttctatttatttaattatagagcaaagccgattaccggtggcttgaatcccgacaatagtaacgacattaaaaggcgtagcaatgtcggtgttgttatgttgtag

SEQ ID NO: 25477 - DNA, 1383 bp, Saccharomyces cerevisiae
atgatgcttgaagggtatacggtacaacctccacagtctactttgataggtgacattgaaattcaggacgaaaatgcaaaccaagaagttaagaacgtactttaccaaggagttcaaaagggtataaaaaggctagaaaaaagacaaaggagggttgcattaggtgatgtaacctctcaaaaggcaaacaaaatacacaatgctatacataataaattccatcagacgaagaacaattttgaaatagagaacatacgctcatcggccttggtaaaagaacaacaacgagacgtaaggcatgaagatagcgactattttttaattgatagttctgaaggctcttctactgatgacgaacaagttaatgaagatgctattgatgatttgttaagtcgaagagtaaatgatcagcagattcaagccgatgaagtgtatgaagatttcgatggagaaatgcaagatgtcattgaagaggatgttgatagtcaaattgaaccactatcaccaataaacaacgatgaaattcagactgagctggacagggcgtttgaaaaatattttcggtcggttcccaatccgctggatgatgatacccatgatgttgtgatggttgtggagtacgcttccgacatattctattacttgagagaacttgaagtgaaatataggcctaatccctactatatgcaaaatcaagtagagcttacatggccgttcagacgaactatgatagattggctagttcaactgcattttagatttcaacttttaccagaaacgctatacctgacgattaatatagtggatagatttctgtcaaagaagaccgttactttgaacaggtttcaattggttggtgtatcggctttatttattgctgccaagtttgaagagattaactgccccactttggatgatctagtttacatgctggaaaatacatacactagagatgacattattagagcggaacagtatatgatagatactctggaatttgaaataggttggccaggacccatgccatttttaagaaggataagtaaagcagatgactatgacttcgaaccaagaacattagcaaagtacttattggaaactacaatagtagaacccaaactagtggctgcggcaccaagctggttagctgctggcgcgtattttctgagcagaacaattcttggttcaaatgattggtctttaaaacatgtattctactctggctatacatccagccaaataattcctttagcatcactgatattggagaattgcaagaacgcatctcgacgccatcattcaatttggaaaaaatactttgaccaaaagcattaccgctgttctcaaattgtagaagaatggattgtttcgacagaagcctaa

SEQ ID NO: 25478 - DNA, 1422 bp, Saccharomyces cerevisiae
atgggtggagaaattattactttgcaagcaggtcaatgcgggaaccacgttggtaagtttctctggtctcaattggcgaaagaacacgctataggcaccgatgggctatctcagcttcctgattccagtacggaaagagatgatgacacaaagcctttcttccgcgaaaacagtaggaataagtttacgccaagggctattatgatggattccgagcctagtgtcatcgccgacgtggagaacacatttcgtgggtttttcgacccaagaaatacctgggtagcttctgatggcgctagcgctggtaattcttgggccaatgggtatgatataggaactcgtaaccaggatgatattcttaacaagatcgacaaggagattgattctaccgacaatttcgaaggtttccagttgctgcactcagtagccggagggaccggttcagggctcggatccaacctcttagaagcgctgtgtgatcgatatcctaaaaaaatactcacgacatattctgtgttccctgcaagatcttctgaggttgttgttcaatcttataacactattctggctttgagaagactgatagaagatagcgatgcaacggtggtgtttgataacgcttcgttgctgaatatttccggtaaagtgtttagaaatccgaacatcgatttacaacacacgaatcaattgatatcgaccataatatcttcagtaacgaacagtatacggtttccgagttacatgtattcatccatgtccagtatttactctaccttgattccttctcctgaacttcatttcctaagccctagtttcactccatttacatcagattatattcacgatgatatagcgcataaaggccattccagttatgacgtcatgttagatttattagacccttccaattctcttgtctctaccgcgatgaacaatccaacatattttaacgtttataatacaatcattggtaatgtagaacctcgtcagatatcgcgtgctatgaccaaattacaacaacgcatcaaattcccctcatggtcctcttctgcgatgcacgttaacattggaagaagatcgccatacttgcctttacaaccaaatgaaaacgaagttagcggcatgatgttaagcaatatgtctaccgtggtgaacgtctttgagaatgcgtgcaatacttttgacaaagtatttgccaagggcgcatttttaaataattataatgtaggcgacttgttccaatcaatgcagaacgttcaagatgaattcgccgagtcaagagaagtagtacaaagcctgatggaggattatgtagctgcagaacaagattcgtacttggacgatgtacttgttgatgatgaaaatatggttggcgagttggaagaggacctggatgccgacggtgatcataaattagtataa

SEQ ID NO: 25479 - DNA, 2454 bp, Saccharomyces cerevisiae
atggatctgaaaacctcatataaaggtatatcgttaaaccctatttatgcaggaagcagtgctgttgccactgtttcagaaaatggtaaaatactagctactccggtgcttgacgaaatcaacataatcgatttaaccccaggctccagaaaaattttgcacaagatttctaatgaagacgagcaagaaattactgcactgaaattaactcctgatggtcaatatctcacgtatgtttcacaagctcagcttttaaaaatctttcaccttaagaccgggaaagttgtcagatcaatgaaaatctcttctccatcgtacattctcgacgcagattccacttcaacgcttctcgcagtcggagggacagatggtagtataattgttgtggatattgaaaatggttacattactcattcgttcaaaggtcatggtggtacaatttccagtttgaagttttatggacaattgaatagtaaaatatggttattagcatccggtgacaccaatggtatggtaaaggtttgggatcttgttaaaaggaagtgcttgcacacattacaagagcacacatctgctgtgagagggttggatatcattgaggtaccagataatgatgagccaagcctaaatttactttccggtggtagagacgatatcatcaatctctgggatttcaatatgaaaaagaaatgtaaattgttgaaaacacttccagtaaatcaacaggtagagtcatgcggattcctaaaggatggtgacggtaaacgcataatttatacagccggcggtgatgctatctttcagttaattgactctgaatctggtagcgtgcttaaaagaaccaataaacctatagaagagttattcattattggtgtacttccaatattgagcaattcacagatgtttttagtattgtctgaccagacattacaactaattaacgttgaagaagacttaaagaatgatgaagacacaatacaggtcacttcgagcattgctggtaatcatggtattattgctgacatgaggtatgttggcccagagctgaataaattagctttagctaccaattctccatcgcttaggataatacccgtccccgatttatcaggcccagaagcttcgctgcctttggatgtcgaaatttatgaaggtcatgaagatttgctaaattcattggatgctactgaggatggcctgtggatcgcaaccgcctctaaagataatacggctattgtttggagatacaatgagaacagctgcaagtttgatatttatgccaagtatattggtcattcagctgccgtaactgctgttggattgccaaatatagtttcaaagggatatcctgaatttttattgacagcatcgaatgatttaacaattaagaaatggataattccaaagccaactgctagtatggatgttcaaatcatcaaggtatccgaatatactcgtcatgcccatgaaaaggatatcaatgctttgtcagtttctcctaacgattctatttttgcaacagcatcatacgacaagacctgtaagatctggaacctagaaaatggtgaattggaagccacgttggccaaccacaagcgtggactatgggatgtatcattttgccaatatgataaattattggcaacttcttcaggtgataaaacagtcaagatatggtcattggatacattcagcgttatgaaaacattggaaggtcataccaatgcggttcaaagatgttcgtttattaataagcaaaaacaactgatcagttgtggtgctgatggcttgatcaaaatatgggattgttctagcggtgaatgtctgaagactttggatggtcataataatagattatgggctttaagtactatgaatgatggtgatatgatcgtaagtgctgatgcagatggtgtttttcagttttggaaagattgtacggaacaagaaatagaagaagaacaagaaaaagctaaattacaagtcgaacaagaacaatcgcttcaaaattatatgagcaaaggtgattggacaaatgcatttttgttagcaatgactttagatcacccaatgaggttgtttaatgttttgaaaagagctttgggcgaatcaaggtctagacaagataccgaagagggcaaaattgaagtcattttcaatgaagaattggaccaagccatctctatcctaaatgatgaacagttaattttgttaatgaaacgatgcagagattggaatacaaatgcaaaaacacataccatagcgcaaagaacaataagatgtattttgatgcatcataacatagcaaaattgagtgagatacccggaatggtaaagatagttgatgcaataattccatacacgcaaaggcatttcacaagggttgataacttagttgaacaaagttacatattagactacgcgctagtggaaatggataagctattctag

SEQ ID NO: 25480 - DNA, 576 bp, Saccharomyces cerevisiae
atgcaaacgctaaagtgtgttgttgtcggtgatggtgctgttgggaaaacgtgccttctaatctcctatacaacgaatcaatttccagccgactatgttccaacagtgttcgataactatgcggtgactgtgatgattggtgatgaaccatatacgttaggtttgtttgatacggccggtcaagaagattacgatcgattgagacccttgtcatatccttctactgatgtatttttggtttgtttcagtgttatttccccaccctcttttgaaaacgttaaagaaaaatggttccctgaagtacatcaccattgtccaggtgtaccatgcctggtcgtcggtacgcagattgatctaagggatgacaaggtaatcatcgagaagttgcaaagacaaagattacgtccgattacatcagaacaaggttccaggttagcaagagaactgaaagcagtaaaatatgtcgagtgttcggcactaacacaacgcggtttgaagaatgtattcgatgaagctatcgtggccgccttggagcctcctgttatcaagaaaagtaaaaaatgtgcaattttgtag

SEQ ID NO: 25481 - DNA, 1971 bp, Saccharomyces cerevisiae
atgaaagtgctatgtgtcgcagagaaaaattctatagcgaaggcagtttcacagatcctaggaggaggcagatcaacttcaagggattccggctacatgtatgtaaagaactatgatttcatgtttagtgggttcccgtttgccagaaatggggctaactgcgaagttaccatgactagtgttgcagggcacctaacaggcattgatttcagccatgattcgcatgggtggggaaaatgcgccatccaagagttatttgatgcgccactgaacgagattatgaataacaaccaaaaaaagatagcaagcaacatcaagcgagaagcgaggaatgcagactatctgatgatatggacagattgcgaccgggaaggagagtacatcggttgggagatatggcaggaggccaagagaggcaacaggctcatacaaaatgatcaagtataccgggcagtcttttcgcatctcgaaagacaacacatattaaatgcagcacgaaacccaagtcgattggatatgaagagtgtgcacgctgtaggcacgcggattgaaatcgatcttcgagcaggtgttacattcaccagactcttaacagaaacgctacgaaataaactgagaaaccaagccaccatgaccaaggatggtgcaaaacaccgcggtggtaacaagaacgactcacaagtcgtatcgtatggtacatgccagtttccaacgctcggctttgtagtagacaggtttgaaagaatacgaaattttgttcccgaagagttctggtatatccaattggtagtcgaaaacaaagacaacggcggaacaacaacgttccagtgggacaggggccacttgttcgaccggctgagcgtgttaacgttttacgagacatgcatcgaaaccgccggcaatgttgctcaagtagtagacttgaaatcaaagccaacaacgaaatacagacctttacctctgaccacagtggagctacaaaaaaactgcgcccggtacctgcgtctgaacgccaaacaatcactagacgcagcagaaaagctataccaaaaggggttcatatcgtatccaagaacagagactgatactttcccacacgcaatggacctaaaatccttggtcgaaaagcaagctcaattggaccaactcgctgcaggcggcagaaccgcctgggcatcgtacgcggcatcgctgctccaacccgaaaacacaagtaacaataacaagttcaagtttccacgaagcggctcccatgacgacaaagcgcatccaccaatccaccccatcgtaagtctggggcctgaagcaaatgtttcgccagtggaaagaagagtatacgagtacgtggccaggcactttttggcatgctgctcagaggacgccaagggccaatcgatgacccttgtgttggactgggccgttgaacgtttctcagcttcaggtctcgtagtcctagagagaaatttcctcgatgtttacccttgggcccgatgggaaaccaccaagcagttaccgcggcttgaaatgaatgccctcgtagacatcgcgaaggccgaaatgaaggcgggcactacggcgccgcccaagccgatgactgagagtgaactcattctcctcatggatacaaacggcattggcacagacgccaccattgcggagcacatagacaagatccaagtacgtaattacgttaggagcgagaaagtaggcaaggaaacctacttacaacccacgaccctgggtgtctcactagtgcacggcttcgaggccatcggcctcgaagactcctttgcaaagcccttccagcgcagagaaatggagcaagacctcaagaaaatctgcgaaggtcatgcctccaagactgatgttgtaaaggacatagtcgagaagtataggaagtactggcacaagacgaatgcctgcaagaatactctcttgcaagtttatgaccgtgtcaaggcatccatgtaa

SEQ ID NO: 25482 - DNA, 2462 bp, Saccharomyces cerevisiae
taattgtatccttacaggtatttgataaagagagaaacagaaatttaactcttccgatatacacgccgtatattcctttcagaaactctagaacctgggattattggttgactttgcccatacgtatcaaacagcttacctttagcagtcatttacgcattattttgtgggaatacaatggatccaagcaaattccctttttcaatctagaaacgagcatctttaacttaaaagactgtactttaaaaagagggtttgaatccttaaaatttcgttatgatgtgattgaccactgtgaagtggtcactgataacaaagatcaagaaaatttgaataaatattttcagggtgaattcacgagactcccttggcttgacgaaatcactataagcaaattaaggaaacaacgggaaaataggacttggcctcagggcacctttgtcttaaacttagaatttccaatgttagagcttcctgttgtgttcatcgaaagggaaattatgaatactcaaatgaatattccaactttgaagaacaatcctggactaagcacagacttacgagaaccgaataggaatgatcctcaaatcaaaatttctttgggggacaaatatcactccacattgaagttttacgatcctgaccaaccaaacaatgatccaatagaggaaaagtataggagattggaaagagcatctaaaaatgcaaacttggacaagcaagtgaagccggacattaaaaagagggactacttgaataaaatcatcaactacccccctggcactaaattaacagcacatgaaaagggttcaatatggaaatataggtattatttgatgaacaataaaaaagctcttacaaagttattacagagtacaaatttgagagaagaatcggaaagagtagaggttttagaactaatggactcatgggcagaaattgatatagacgacgcattagaactattaggctcaacttttaaaaacctttcagtgagatcgtacgccgtaaataggctgaagaaggcatcagacaaggagctggaattgtacttattacagttggtagaagctgtctgttttgagaacctgtccactttttccgacaaatctaacagtgaattcactattgtggatgccgtatcttcgcaaaagctttcgggtgattctatgttactatctacatcgcatgccaaccaaaaattattaaagtccatctcgagtgaatcggaaacttccgggacagaatcgctaccaatcgtcatttctcccttggctgagtttttgattaggagagcactggtcaacccaaggttaggaagttttttctattggtatttaaagtccgagtctgaggacaagccatatttagaccagattttaagttccttttggagtagactggataaaaaatctcggaatatactgaacgatcaagtcaggctaataaatgtgctcagggaatgttgtgaaacaattaagaggctgaaagatactacagccaaaaagatggaattactagtgcatttattggagacgaaagtcaggcctcttgtcaaagtacgaccaattgctttaccactagaccctgatgtgttgatatgcgacgtttgtcctgaaacttcgaaggtatttaaaagctctttatcgccactaaaaataacattcaaaacgaccttaaaccaaccatatcacttaatgtttaaggttggcgatgatttgagacaagatcaactggtagtacagatcataagtttaatgaatgagttattaaaaaatgaaaacgtggacttgaaattgacaccatacaaaattttggcaacaggaccacaagaaggtgccattgaatttatccctaatgacacattagctagcatactaagcaaatatcacggtattcttggctaccttaaactccactatcctgatgagaacgcgacattaggcgtacaaggctgggttttagataattttgtcaaatcttgtgctggctattgtgttattacatacatcttaggtgtcggcgataggcatttagacaacttactagtcacgccagatgggcacttttttcacgcagactttggttatatcttgggtcaggaccccaaaccttttccgccattaatgaaattgccccctcaaattatagaggcgtttgggggtgcagaatcatcaaattatgataaatttcgcagctactgttttgtggcatattcgattttaagaaggaatgcaggcttaatcttaaacctgtttgaattaatgaagacttcgaacatacctgatatcagaatagatcccaatggtgctatattacgtgtaagagagagatttaatttgaatatgtccgaagaagatgccacagtgcattttcagaatctaatcaatgatagtgtaaatgctttgctgcctatcgtgattgatcatttacataatctggcacaatactggcggacctga

SEQ ID NO: 25483 - DNA, 4671 bp, Saccharomyces cerevisiae
atgtctgcagtaggtgcgctattagcaagggagtacaacgtgactgccgaaaaatgcgactttttcctagaaaatggttcttttgattcagtgatagcagcattgccagcgctaaatcaggaacaagagactgtaactcaaaaagttagcaagaacggaaaagaattaatcaacgttgcctcggtaaatatcgaaataccagagcgaataagtctttccaacaacggtaggcagttatttaaatttattgttgatatagagatcttaccttgtgaaaatgataacgaggcaacacttgttgtgtcgtcagattccgtatccttatttcaaattggatttaaaatggagaacaattcaaaaatcgctgttgacaaacaacttccgctgatcttggatatatgtgctcataaaaaccaagaaagggccctacgaaatcagttagaaaatcgtaaatctttagaacgcaaaccatcaagaaagagaagaaaaaaaaattcaaatgttaacgatcctgaaaaattactaaaaagtcgtatacacgaattatctttgtcctacaaagattttgaatgctctccagtcgtattccgatacaatgattcctctttaacatgggttttatcttttaatttgaagttgaagtttttaaataataaattcaaccggttttccgtggaggctaaccaaatactggacttgacgttctctaatagggacgagaacgaatttgagcgatatcacaagcacagccatatccattcaaacttcattcaaaaacaatttatttctcaaatcttggaatatagtaaagataggctatcaaagatcaaaccgttcttaccccaatctataccagacctaaaagttaacctcttaccatttcaaagagagagcgttgagtggatgctaattaaagaagggcatggtaattctcttagtgatacacctacagtcatcgacgaagtagggcttatagattttatgaacgagtactatgcatacggttacgagctcattgcacgcagccctgacgaggtagggccatcattgttatggaacaaattaacaggatatattctaactacagaagatgctgcacatttgtacaaccaatataggaaggaaaggttaagcggcgactacccagtttgtgcaaagggggtgttagcagaagagatggggttgggcaaaactattgaaattttatcactaatactcttaaatagaaggaaattgaaggactcagaggcaacatttattgacgatgaaaatagaacaatcacgaagacaaagacgactttgattatctgtcccaatgctatcttaaaacaatggctcgaagaaatcgaattacacgcaaattccttaaaatggtatacctatagaggatataatgagataatgaaagattgcaaaactgtggacgaagctgttcaacaattgtgccaatacgatattatagttacatcatataacattattgccacggaggtccatcatgctgagtttaaccgtagtatcagatcgagaaggttgaaaagcccaaagtatgactattcttcaccgttagctttgatgcagttttatagaatcattctggatgaagttcaaatgctacgtagttcatcaacatattctgcaaaatgcacgagtttacttcatagaatacacacttggggtgtttccgggactccaatacagaacatttacaactttaggatgatcatgtcttatttaaagctgcatccattttgtgatgaggtagactttattcggacacttcaagaagaaattaaactaagaaatgaggctaaagattacactagtaatgattttgtatgccaattaaagggcgttcggttttctatcaaggattgtatgaacattttttacaggtatgatctttgcataaggcattcgaaagccaatgttgcgtctcagattcatattccgcggcaacacaacttcatcattcccctggagtttgcgcctatcgagtgggacaactatttaaatctttggaacaattttttagagttgagtggctataattcggatggcagtggatcaccccgtgtaagcaatgcctttttaaacgaatggttgtctaggctgcgatatatatgttgccatgcattatttccagaaattttaagtacccgacagaagcgccttcacgggcacttgtcaagaatttcaaatatagacgatatcttaatatccatgcgaatggatgcatttgacagtttaattggctattacagagagagattccatttatcgatcaagcaggcacagtatgaacttgaaatttccaatactccggccaaagcccttgaatcatttatcaaaatcagagatgatttgatgatacacatacgccaaaaattcaacgttgaggatccgtttgataagtcgttaaacctcagtgaagatgaggacgaacatatggacgagaggtttggtgagaaggaaacatcttcaggcgacgaaagcgatagagaaataaatggtgctaaaaaccatgataatcacaacaatgacggaatgttatccaaccacctgaagaagaaaggattacgtgctatgatgaatttactgcatgattgctacttcttcctcggttctgtttactataacttgggcactcgtaagctagaagaggcggacgacaagcatcgaaaagagaagactgaagaagtggtgtattctgatgtttttccaaaaaatgagttagaggaaattgaagagaatagacttttagaacaagaaaattatgcgaatgcagaaattttgaggaagtcaatcctctcctctgaggctagaaaagttgatatgactattaaaatggccagaactaagtttgctcctatgacgagcaatatacctttgcgattaatcaatattgaatttgaccacaaaaatgactactcatctaatttagcagtatctcgttgtttcaagtctttgagtaagttgatagaagggttgaatgaacaaactaaaaacttcaacgagttattggatgagttactcattattatctatgaacctgtccacaggacagaggacgatgatagcactaataaaattatcggtaatgaagaatattcaacatcgattgacagtcaagataagatattcagtcttcttggttgcttggagataattttacagaatagggacaatattttaacttcagaatcagaagttaaaattccgaagcatttggtaccggaaggttcaataatttcaaaatatcaaaagcagttattgaacagcttgcgcttgatttcaggaacacctctacgaactgtttttgatgaactgaagaacagcaggatagtaagacggatatcctcaagcaatgaaagtgaatctaccattcaaaattttgaggactacttacttcagtacgaagttgaaagtaaaagcctgtttaagtacaataaacaggtaagagaatctttgaaaatcctgggatcgatttataatgccaagacggaatattatagtcaattacagaggatttccgattcattggtgtccttgcactctttgagtgctccacaactcagccatctaataagaactatcaataagtcattgggcggtacactagatgcaaaaatcaataacattgaatcacggctgatatatttaaaaaatttgtccagattgaaagacacattaaacgataatcaaatattgagctgctctatctgtttgggagaagttgaaataggtgctatcattaagtgtggacattatttttgcaagagttgtatccttacgtggctacgagcccatagtaaatgccctatatgcaaaggtttctgtagtatatcggaagtctataactttaagttcaagaactcaacggagaagagggaaaaagaaattcaagagccacgaagagagggcgccgattcgtctcaagataattcaaatgaaaactcgattatatccaatatgagtgaagtagaaaaattattcggaaataaatacgagcaattccatcaaattaatgaagtccatcaaattcacataaaggaaagttttggtgctaagattgatttcgtcatcaagttaatatcttacctgaggctaaaaagtgagcaggaaaacgctgatccgccacaagttattctatactctcaaaagacagaatatttaaaggtcattggtaaggtattaaagttgtatcacattgaacacttggcatgtctatctaatacagccaatgttggcgaaactataaataacttcaaacgccagccttccgtcacttgcctacttttgaatgtgaaaactttaggtgccggcctgaatttgataaatgcaaaacatattttcctactagatcctatccttaataatagtgatgaattacaagctatgggaaggaataatcgtataggacaagatgaagaaacttttgtgtggaatttcatgatcagaaataccgttgaagaaaacatcctcagatataaatgtatactcgaagagcgcaaaagaaaggagaagtcaaaaaaaggcgataaatacgacgaagcacaagatgaaacggataatgaggaaagcgatgatgcgaagtttgagataagcgtggtagaccaagaagtcagtaatgaacacttatggaactgcttttttcacggtagtgattag

SEQ ID NO: 25484 - DNA, 2118 bp, Saccharomyces cerevisiae
atgtcccgtgacctacaaaaccatttgttattcgagactgcgactgaggttgctaatagggttggtggtatttactccgtgctaaaatcgaaggctcccattacggttgcccagtataaagaccattaccacttgatagggcccttaaataaagccacttatcaaaatgaagttgatatactagattggaagaagcctgaagccttttccgatgaaatgaggccagtgcagcatgccctgcaaacaatggaatctagaggagttcattttgtttatgggaggtggctgattgaaggtgctccaaaagtaatactttttgacttggattctgtgagaggttattcgaatgaatggaagggtgatttatggtcattagtaggaattccctctcctgagaatgatttcgagacgaatgatgctatcctattggggtatacagtcgcttggtttctaggcgaagtggctcatctcgattcacaacacgcaattgttgcgcactttcacgaatggttggccggtgttgcgttaccattatgccgtaaaaggcgtatcgatgtagttaccattttcaccactcatgctactttattgggacggtatttatgcgcctccggcagtttcgatttttacaattgtttagaatctgttgatgttgatcacgaagctggcagatttggcatataccatcgttattgtatagagagagcggcggctcattctgcagacgtgttcactacggtgtcacaaataactgcttttgaagcggaacatcttttgaaaagaaaaccagatgggattttgcctaatggactgaacgtcatcaaatttcaagcatttcatgagttccaaaatttgcatgctttgaaaaaagaaaaaatcaatgactttgtaagaggccattttcatggttgcttcgatttcgatctagacaacaccttgtacttttttattgctggtagatatgagtataaaaataagggtgctgacatgtttattgaggctctagcgcgtttgaactacagattaaaagtatccggatccaaaaaaactgtggtagcgtttattgtcatgcccgccaaaaataattccttcactgttgaagcattgaagggccaggctgaggtgagggcgttagaaaatactgtacatgaagtgactacttcaattggtaaaagaatattcgatcatgctatcaggtacccccacaatggactgacgacggaattaccaaccgatttgggtgaattactaaagagttcggataaagttatgttaaagagacgtattttggctttgagaaggccggagggacagttacccccaatagttacacacaatatggtcgatgacgctaatgacctgattttaaataaaatcagacaagttcaattgttcaatagcccaagtgatcgtgttaaaatgatcttccatccagaatttttgaacgctaataatccgatccttggtttagattatgatgagttcgttcgtggttgccatttgggtgttttcccttcatactacgagccttggggttacacacctgcagaatgtacagtaatgggtgttccctccatcacgacaaatgtctctggtttcggtgcctatatggaagacttgatcgaaaccaaccaagcgaaagattacggtatttatattgtggatcgtcgtttcaaggcacctgatgaatctgtggaacaattagttgactacatggaagaatttgtaaaaaagacaagaaggcaaagaattaatcaaagaaatagaactgaaagactctccgacttactggactggaagagaatgggtctcgaatacgtcaaggcaaggcagttagcattaagaagaggctatcctgatcagttcagagagctcgttggtgaagaactaaatgattccaacatggatgctttagcaggcggaaagaaattgaaagttgcaagaccgcttagtgtacctggctcaccaagagatttgagatcaaacagcacagtctacatgacccctggtgatttgggtactctgcaggaggttaataacgcggacgattatttttcattgggagtgaatcctgcagctgacgatgacgacgatggcccatatgctgatgacagttaa

SEQ ID NO: 25485 - DNA, 1719 bp, Saccharomyces cerevisiae
atgttgagatcatccgttgttcgtagtcgcgctactttaaggcctttattgcgtcgtgcttactcctctcataaagaattgaaattcggtgtagaaggaagagcctcccttcttaagggtgtcgaaactttagctgaagcggttgctgctactttgggtccaaagggtagaaacgttttaatcgaacagcctttcggtcctccaaagattactaaggatggtgttacagttgccaaatctattgtgttgaaggacaagtttgaaaatatgggtgccaagttactacaagaagttgcctccaaaaccaatgaggctgctggtgacggtactacttctgctactgtcttaggtagagccatcttcacagaatccgtcaaaaatgtcgccgctggttgtaaccctatggatttgagaaggggttctcaagttgcagttgaaaaagtgattgaatttttgagcgccaacaagaaagaaattaccacatctgaggaaattgctcaagtagcaaccatttctgccaatggggactctcatgttggtaagttactagcttcagctatggaaaaggttggaaaagaaggtgtcatcactatcagagaaggtagaacattggaagatgaacttgaggttactgaaggtatgaggtttgatcgtggttttatttctccatacttcatcactgatccaaagtcgagcaaggtggaatttgaaaagccattgctattgttgagtgaaaagaaaatttcttccattcaagatatcttgccagctttggaaatttccaatcaaagcagaagacctttgttgatcattgctgaagatgttgacggtgaagctcttgcggcttgtattttgaacaagttgaggggtcaagttaaggtttgtgctgtgaaggcgcctggtttcggtgataatagaaagaatacaattggtgatattgcagtcttgacgggcggtactgtttttactgaggagttggatttgaaaccagaacaatgtaccatagaaaacttgggttcttgtgactctattaccgttactaaggaagacaccgttatcctgaacggtagtggtccaaaggaagctattcaagagagaattgaacaaatcaaaggctccatcgacattaccaccacaaattcatatgagaaggagaaactgcaagagcgtttggccaaattgtccgggggtgttgctgtcatcagggtcggtggtgcatctgaagttgaagttggtgaaaagaaggaccgttacgatgatgctttgaacgctaccagagctgcagttgaggaaggtatcttgccaggtggtggtactgccttagtgaaggcatctagagttttggatgaagttgttgtcgacaatttcgatcaaaaattgggtgtcgatatcataagaaaggccattacaagaccagccaagcagatcattgaaaacgctggtgaagaaggttcagttatcatcggcaaattgattgatgaatatggtgatgattttgccaagggttacgatgcctctaagtcagaatacaccgacatgttagccactggtatcatcgatccatttaaagtggttagatccggtttagttgatgcttctggtgttgcctcactattagctactaccgaagttgctattgttgatgccccagaaccaccagcagctgctggcgctggtggtatgccaggtggtatgccaggaatgccaggtatgatgtaa

SEQ ID NO: 25486 - DNA, 648 bp, Saccharomyces cerevisiae
atgagcagatccgggaaatcattgacaaagtacaaaattgtttttttgggagaacagggtgttggaaaaacatcgctgatcactagatttatgtatgatacgttcgatgatcattaccaagccacgattggtatagattttctttccaagaccatgtatttggatgataagacaattagattacagttatgggatacagcaggtcaggaaagatttagatcattaataccttcatatatcagagattcgagagttgctattatcgtttacgacattacgaagagaaaatcatttgaatatattgataaatggatagaagacgttaaaaatgaaagaggtgacgaaaatgttatattgtgcattgttggtaacaaaagtgatttatcagatgaaaggcaaatctcaaccgaagagggagagaaaaaagcaaaactattgggtgctaaaatctttatggaaacgtccacaaaggcaggctataatgtcaaagctttattcaaaaagattgccaaatcgctgcctgaatttcaaaacagcgagtcaactcctttggatagcgaaaatgcaaatagtgcaaaccaaaataaaccgggagtcattgatatttctacagcagaggagcaggaacaaagcgcttgtcagtgttag

SEQ ID NO: 25487 - DNA, 2328 bp, Saccharomyces cerevisiae
atgtcatttgatagaccggaaatatacagtgctcctgttttacaaggagaatctcctaacgacgatgataatactgaaatcataaagtcctttaagaatttcattttggagttcagacttgactcgcaatttatttacagagatcagttaaggaacaacatccttgtgaagaattattctttaacggttaacatggagcatttgatcggatataacgaagacatatataagaaactatcagacgaaccttcagatatcattccattattcgaaaccgcgatcacacaagtggctaaaaggataagtattctaagcagagctcaatctgctaataacaatgacaaagatccagaaaatactagtatggatactgattctctcttattgaactctttaccaacatttcaattaattttaaactccaatgcaaatcagattccattgagagatttggattctgaacacgtctccaagattgtccgtttatcaggtattataatatccacgtcagttttatcttcccgtgccacgtacctttctataatgtgcagaaattgcagacacacaacatcaataacaatcaacaatttcaattctatcacaggcaataccgtcagtttaccacgttcttgcttatctacgattgagagtgaatcttctatggcaaacgagtcgaatattggtgatgaatcgaccaagaaaaattgtggacctgatccatatattattatccatgagtcttcaaagtttattgatcaacagtttttaaaattacaggaaatcccagaactggttccagtaggtgagatgcctagaaacttaacaatgacttgtgaccgatacctaacaaacaaagttattcctggtacgagagtcactatagtaggtatttattccatctataattctaaaaatggtgccggatccggaaggagcgggggtggaaatggaggaagtggtgttgctattagaacaccttatatcaaaatattaggtattcagtccgatgtagaaacctcctctatttggaattcagtaactatgtttactgaggaggaagaagaggaatttctacagctaagtagaaacccgaagctttatgaaattttgaccaactctattgccccctctatttttggtaatgaagatataaaaaaagccattgtatgtttattgatgggtggttccaagaagatattacccgatggtatgaggttaagaggtgatatcaatgtactattattaggtgatccaggtaccgccaaatctcaactattgaaatttgtggagaaagtgtcacctattgcggtatatacatctggtaagggatcttctgcagctgggttaactgccagtgtacaaagagatccgatgacaagagaattttatttggaaggtggtgctatggtgcttgccgatggtggtgttgtatgcatcgatgaattcgataaaatgagagatgaagatagagtggccattcatgaagctatggagcagcaaacaatctccatcgcaaaagctggtatcactacagtgctaaattctagaactagtgttttagcggctgctaatccgatatacggccggtatgatgatttgaagtctcctggtgacaacattgatttccaaactactattttatcccgttttgatatgatttttattgttaaggatgaccataatgaagaacgtgatatttcaatagctaaccacgttattaatattcatacaggaaatgctaatgctatgcaaaaccaacaagaggaaaatggcagtgaaattagtattgaaaagatgaaacgttacattacgtattgtagattgaaatgtgcaccaagactttcaccgcaggccgctgaaaaactgtcatcgaacttcgtcaccattaggaagcaattattaatcaacgaattagagtcaacggaaaggtcgtctattccaattaccattcgtcaattagaagctattattagaataacagaatcattagccaagttagaattaagtcctattgcacaggagagacatgttgacgaagctattagattgtttcaagcttccacaatggacgcagcgtctcaggatccaattggcggcttaaatcaagcaagcggaacatctttgtcagaaatccgtcgttttgaacaagaactaaaaagaagattacctataggctggtctacttcttatcaaactttgaggagagaatttgtagatacacatagattttctcaattagcactggataaggccttatatgccctagagaagcatgaaacaattcaattgagacaccagggacagaatatttacagaagtggtgtatga

SEQ ID NO: 25488 - DNA, 1785 bp, Saccharomyces cerevisiae
atgagctatgagaaaaagtctgtggaaggcgcttatattgacgattctacaacgttcgaagcatttcatctcgactctcgtttattacaagctattaagaatataggatttcagtacccaacattaattcaatcacatgctattcctttggctttacaacagaagagagatattatagcaaaggccgctacaggttccggaaaaactttggcatacctcattcctgtaattgaaactatcctagaatataaaaaaacaattgataacggagaggaaaatggtacactaggtattatacttgttccaacaagagaactggctcaacaagtatataatgttttagaaaaactagtcttatattgttcaaaagatataagaactctgaacatatcatccgatatgtctgactcagttttgagcactctacttatggatcaaccagaaatcatagttggtacacctggtaaattattggatttgttgcaaacaaagattaattctatctcattgaacgaactaaaatttttagtagttgatgaggtggatttagtgttaacatttggttatcaagatgatttaaacaaaattggagagtacttaccattgaaaaaaaatttacaaacatttttgatgagtgcaaccctaaatgacgatatacaggctttgaaacaaaaattttgtcgttctccagctattcttaaattcaatgacgaggaaataaataagaaccaaaacaaattacttcaatattacgttaaagtcagtgaatttgacaaattcttactatgctatgtcatttttaaacttaacttaatcaagggtaaaacattaatttttgtaaataatattgacagaggatataggctcaagctagttatggaacaatttggtatcaagtcctgtattttaaacagcgagctacccgttaattcgaggcaacatattgttgaccaattcaataaaaacgtttaccaactattgattgccacagatgacaccgagtacataaaagaggaagatgacgaaatagaagaagggcacaatacagaaaatcaagaagaaaaaagcttggaaggcgagcctgagaacgataagaaaccaagcaagaaaaagaaggtccaagtgaagaaagataaggaatatggtgtttctcgtggtgttgatttcaaaaatgttgcatgtgtcctcaatttcgatttacctacgacggctaagtcctacgtgcatagagtaggtagaactgctcgtggcggaaagaccggtactgcaatttcattcgtagtcccactgaaagaatttggtaagcataagccatcaatgctacagacagcaaagaaggatgaaaggattctttcacgaatcatcaaacaacagagcaaacttggattagaattacagccttacaaattcgatcaaaagcaggtcgaggcgttccgttacagaatggaagacggtttccgtgctgttactcaagttgccattagagaagctagggtcaaagagttgaaacaagaactattggcaagtgagaagttgaaaagacattttgaggagaatccaaaagagctacaaagtttaagacacgataaagaattacatccagcaagagtgcaacagcatttaaagcgtgttccagattacttgcttcctgaatcagccagaggaaatggaaccaaagtcaagtttgttcctttccacaatgctaagaagcgccattcacataaaaagggaagagtcagtaagccaaagaatggtaaagtagacccgttgaagaacttcaaatga

SEQ ID NO: 25489 - DNA, 1689 bp, Saccharomyces cerevisiae
atgtcactcctttacatcattcttctattcacacaattcttactactgccaaccgatgcctttgataggtctgctaacacaaatattgctgtttattggggtcaaaactcagcaggaacgcaagaatccttagctacttactgtgaatcttctgatgctgatattttcctattatctttcttgaaccaatttccaacccttggtttgaactttgccaacgcatgctctgatactttttctgatggcttacttcactgcacccagattgctgaagatattgaaacttgccagtccctaggaaagaaagttctattatcattaggtggtgcatctggtagctacctcttttcagatgattctcaagcggaaacttttgcacaaactttatgggatactttcggtgaaggtacaggtgccagtgagagaccatttgactcagcagtcgttgatggttttgattttgatattgaaaacaacaacgaagtaggctatagtgcgttagctaccaagttaagaactttgtttgccgaaggtacaaagcaatattacctttctgccgcaccacaatgtccatacccggatgcttctgttggtgacttgttggaaaatgcagacattgattttgcgttcatccaattttacaataattactgcagtgtgagtggtcaattcaattgggatacttggttaacctatgctcaaactgtatccccaaataaaaatatcaaactgttcttaggtttacctggttctgcttctgctgctggctctggttatatttctgacacttctttattggaatcaactattgcagatattgcctcttcaagttcttttggtggtattgcgttatgggatgcatctcaagccttttccaacgagctaaatggtgaaccatatgttgagattttgaagaatttgctaacaagtgctagccagaccgccactactacagttgccacctcaaaaacctcagcagcctcaacttcatctgcttcaacttcatctgcttcaacttctcagaaaaagaccacacaatctacgacatctacacaaagtaaaagcaaagttactttatctccaactgcaagcagcgctatcaaaacatcaattactcaaactacaaaaacattgacgagtagcaccaagacaaaatctagtctaggtaccaccacaacagagagcactttaaattcagttgctatcacaagtatgaaaactactctatcttcccaaataaccagtgctgccttggtgacccctcaaacaactactactagcatagtttcttcggccccaattcaaacagctatcactagtactctttcgccagcaacgaagagttcttctgtcgtttccctacagacagctactactagtacgctttccccaacaacgaccagtacaagctcaggtagtacaagctcaggtagtacaagctcagacagtacagctcgtacattggctaaagaattgaatgctcaatatgcggctggtaaattgaacggtaaatctacctgtactgaaggtgaaattgcatgctctgctgatgggaagttcgccgtttgtgatcatagcgcttgggtttacatggaatgtgcttctggaaccacatgttatgcttatgactccggcgactcagtctatacccaatgtaatttctcttatttggaaagcaattacttttaa

SEQ ID NO: 25490 - DNA, 582 bp, Saccharomyces cerevisiae
atggttacccttgaatacaatgcaaacagtaaactgatcactgcgagtgatgctgttgttgcactatctaccgaaactaatatcgatcaaataaatgttctcactacatctttgattggagaaaccaacccaaattttacaccacaaccgaatgaagctctaagcaaaatgatcaagggtttatttgaaagtggtatgaagaatttacaacaaaaaaaattgaatgaggcattgaagaatgtttctttagcaatcgaaatggcacaaagaaaaagagcgccttgggaagcttttgctattcagctaccagagctacactttatgcttcgtagtaaaatagatttatgtttaatactcggaaagcatttagaggcgttgcaagacttggatttcttacttggtacgggacttatccaaccagacgtatttgtcaggaaggcggactgtttgctaaaattgagacagtgggaagaggctagggcaacatgcgagagaggtttagctttagccccagaggatatgaaacttagagcccttttaatagaaactgcaagaaatctggccgaatataacggtgaataa

SEQ ID NO: 25491 - DNA, 660 bp, Saccharomyces cerevisiae
atgtctgccccagctgctaacggtgaagttccaacattcaaactagttcttgtcggtgatggtggtactggtaagaccacttttgtcaagagacatttgaccggtgaattcgaaaagaagtacatcgccaccattggtgtcgaagtgcatcctttatccttttacaccaacttcggtgaaattaaatttgatgtctgggatactgccggccaagaaaaattcggtggtttaagagacggttactacattaacgcccaatgtgccatcatcatgttcgatgttacttccagaattacttacaagaacgttccaaactggcacagggatttagtccgtgtttgtgaaaacatcccaattgtcttgtgtggtaacaaggtcgatgtcaaagaaagaaaggtcaaggccaagactatcactttccacagaaagaaaaacttgcaatactacgatatttctgccaagtccaactacaactttgaaaagcctttcttatggttggccagaaaattggctggtaacccacaattagaatttgttgcttctccagctttagccccaccagaagtccaagtcgatgaacaattgatgcaacaataccaacaagaaatggaacaagctactgctttgccattgcctgatgaagatgatgctgatttataa

SEQ ID NO: 25492 - DNA, 1335 bp, Saccharomyces cerevisiae
atgccatctcatttcgatactgttcaactacacgccggccaagagaaccctggtgacaatgctcacagatccagagctgtaccaatttacgccaccacttcttatgttttcgaaaactctaagcatggttcgcaattgtttggtctagaagttccaggttacgtctattcccgtttccaaaacccaaccagtaatgttttggaagaaagaattgctgctttagaaggtggtgctgctgctttggctgtttcctccggtcaagccgctcaaacccttgccatccaaggtttggcacacactggtgacaacatcgtttccacttcttacttatacggtggtacttataaccagttcaaaatctcgttcaaaagatttggtatcgaggctagatttgttgaaggtgacaatccagaagaattcgaaaaggtctttgatgaaagaaccaaggctgtttatttggaaaccattggtaatccaaagtacaatgttccggattttgaaaaaattgttgcaattgctcacaaacacggtattccagttgtcgttgacaacacatttggtgccggtggttacttctgtcagccaattaaatacggtgctgatattgtaacacattctgctaccaaatggattggtggtcatggtactactatcggtggtattattgttgactctggtaagttcccatggaaggactacccagaaaagttccctcaattctctcaacctgccgaaggatatcacggtactatctacaatgaagcctacggtaacttggcatacatcgttcatgttagaactgaactattaagagatttgggtccattgatgaacccatttgcctctttcttgctactacaaggtgttgaaacattatctttgagagctgaaagacacggtgaaaatgcattgaagttagccaaatggttagaacaatccccatacgtatcttgggtttcataccctggtttagcatctcattctcatcatgaaaatgctaagaagtatctatctaacggtttcggtggtgtcttatctttcggtgtaaaagacttaccaaatgccgacaaggaaactgacccattcaaactttctggtgctcaagttgttgacaatttaaagcttgcctctaacttggccaatgttggtgatgccaagaccttagtcattgctccatacttcactacccacaaacaattaaatgacaaagaaaagttggcatctggtgttaccaaggacttaattcgtgtctctgttggtatcgaatttattgatgacattattgcagacttccagcaatcttttgaaactgttttcgctggccaaaaaccatga

SEQ ID NO: 25493 - DNA, 2337 bp, Saccharomyces cerevisiae
atgctgtctgcacgttctgccatcaagagacccattgttcgtggtcttgcgacagtctccaacttgactagagattcaaaagtcaaccaaaacttattagaagatcattcttttattaactacaagcagaatgtggaaacgctggatatcgtaagaaaaagattaaacaggccatttacctacgcggaaaagattttgtacggtcacttggatgaccctcatggtcaagatattcagagaggtgtttcatacctaaaattaagaccagatcgtgttgcctgtcaagatgctactgctcaaatggctattttacaatttatgtccgctggtttaccacaggttgctaagccagtcactgtccactgtgaccatttgattcaagcacaagttggtggtgaaaaagatttgaagagagctatagatctaaacaaggaagtttatgatttcttggcctctgccactgcgaaatataacatgggtttctggaagccaggttccggtatcattcaccaaattgttctggaaaactacgctttcccaggtgctttgatcattggtactgactcccatacaccaaatgctggtggtttaggtcaattggctattggtgttggtggtgctgatgccgttgatgttatggcaggtcgtccatgggaattgaaggctccaaagatcttaggtgttaagttgactggtaagatgaacggttggacttctccaaaggatattattttgaaattggctggtatcacaactgtcaaaggtggtactggtaaaattgttgaatatttcggtgatggtgttgacaccttctccgctactggtatgggtaccatttgtaatatgggtgctgaaatcggtgctaccacatctgttttcccattcaacaaatctatgattgaatatttggaagcaactggtcgtggtaagatcgctgactttgctaaattataccacaaggacctattatctgctgataaggatgctgaatacgatgaggtcgtcgaaattgacttgaacactctggaaccatacatcaatgggccatttacccccgatttggctactccagtttctaagatgaaggaagttgctgttgctaataactggccattggatgtcagagtcggtttgatcggttcttgtaccaattcctcttatgaagatatgtctcgttcagcatccattgtcaaggatgctgctgctcatggtttgaaatccaagaccattttcactgttactccaggttctgaacaaatcagagccactattgaacgtgatggccaattagaaaccttcaaagaatttggtggtatcgttttggcaaacgcctgtggcccatgtattggtcaatgggatcgtagagatatcaagaaaggtgacaagaatactatcgtttcctcttacaacagaaatttcacttctagaaatgatggtaacccacaaactcatgcttttgttgcatctccagaattagtaactgcgttcgccattgcgggtgatttgagattcaaccctctaacagacaaattaaaggacaaggatggtaatgagttcatgttgaaaccaccacatggtgatggtttgcctcaaagaggttatgatgctggtgagaacacttaccaagctccacctgcagaccgtagcaccgttgaagttaaagtttctccaacttcagaccgtctacaactgttgaaaccattcaaaccttgggatggtaaggatgctaaagacatgccaatcttgattaaggccgtcggtaagacaactactgatcatatttctatggctggtccatggttgaaatacagaggtcatttagaaaacatttctaataactatatgattggtgctattaatgctgaaaacaagaaggctaactgtgttaaaaatgtatatactggtgaatacaaaggtgttccagacactgctagagattacagagaccaaggtatcaagtgggttgttattggtgatgaaaactttggtgaaggttcctctcgtgaacacgctgctttggaaccaagattcttgggcggtttcgctatcatcacaaagtctttcgctcgtatccatgaaactaacttgaaaaaacaaggtctattgccattgaacttcaagaacccagctgactatgacaagatcaaccctgatgacagaatcgatattctgggtctagctgaattggctccaggtaagcctgtaacaatgagagttcatccaaagaatggtaagccatgggatgctgtgttgacccatactttcaacgatgagcaaattgaatggttcaaatatggttctgccttaaataaaattaaggccgatgagaagaaataa

SEQ ID NO: 25494 - DNA, 701 bp, Saccharomyces cerevisiae
atggtacgtagatgcaactatatctttccgtttctcattggcggtttttagcgatcgaaaatactaacataatctttttggggggtgagaatgtatatgtgtactggatatgtatattcttggctttattcaaatagttgaaattacgccaattacaaaagaaaaagcaaaaagaaaatgaaaacagcagttctattcagcctaatttatcggcagcaagaattcgtttgaaaagggaccttgattcgctggacctcccaccaacagtgactttgaatgtaataacatcaccagatagtgcggatagatcacaatcgccgaaattggaggtaattgttaggcctgatgaaggatattataattatggatctattaatttcaatttggattttaacgaagtttatccgattgaaccaccaaaagttgtatgtttgaagaagatctttcatccaaatatcgatttaaaggggaacgtttgcctaaatattcttcgagaagactggtcgccagctctagatttgcagagtattataaccgggcttcttttcttgttcttggagcctaatcccaatgacccgttaaacaaggatgcagcaaagttactgtgtgagggtgagaaagaatttgctgaagctgtgagattgaccatgtctggaggttcaattgaacatgtcaaatatgataacatagtttctccttga

SEQ ID NO: 25495 - DNA, 4770 bp, Saccharomyces cerevisiae
atgtccgatactaacacgtctattcccaatacaagttctgcaagggaggcaggcaatgcttcacaaactccatcgatcagctcttcatctaacacttccactaccactaacacagaatcatcctcagcttctctttcttcttccccctcgacaagtgagttgaccagcattcgtccaattggaatagtagtcgctgcttatgactttaattatcccattaaaaaagacagttcttcgcaacttttgtctgtacaacaaggggaaaccatttatatacttaacaaaaactcatctgggtggtgggatggattagttattgacgacagtaatgggaaagttaacagaggctggtttcctcaaaacttcggtagacctttaagagacagtcatctcagaaagcacagtcatccgatgaaaaaatatagttccagtaagagctcaaggcgcagcagcttaaatagcttgggcaatagtgcatatttacatgtgcctagaaatccgagcaagagcaggagggggagttctactttatcagcgtctttatcaaatgcccacaatgcagaaacaagttccggccacaataacaccgtatcgatgaataattctcccttttcagcgccaaacgatgcttcccacataacccctcaatcttcgaactttaattccaatgctagtctatcccaggatatgacaaagagtgcagatggctcatctgagatgaatacaaacgcaattatgaataacaatgaaacaaatttacaaacttctggtgagaaagcaggtcccccactagtagcagaagaaacaattaagatattaccgttggaagagatagaaatgattattaatggtatacgttcgaacattgcttcgacttggtcccccataccactgataacgaaaacatccgattacaagttggtatactataacaaagaccttgatatatactgttcagaattacccttgatttctaactcaattatggaatccgatgacatttgtgacagcgaaccaaaattcccgcccaatgatcatcttgttaacctatatactagagatctgaggaaaaatgcgaatattgaggacagttctacgagatcgaagcaatcggaaagtgaacaaaatagatcaagccttctaatggaaaaacaggattcaaaagaaactgatggaaataataacagtattaatgatgatgataataataacgaaaataacaaaaacgaattcaatgaggctggtccttcatcattaaattctttatctgctccagatttaacgcagaatattcaatcaagggtagttgccccaagtcgctcttctatactggccaagagtgacatcttttatcactattcaagagatataaaattgtggacagaattacaagacctaacagtttattatactaaaacggctcacaagatgttccttaaagagaatcgtctcaatttcacgaaatactttgatttgatatcagattcaatagtcttcacacagttaggctgcaggctaatgcaacatgaaattaaagccaaaagttgcagcaaggagattaagaagattttcaaaggtctaatctcttcattgtcaaggataagtatcaattctcatttatatttcgattcagcttttcacagaaaaaaaatggatactatgaatgacaaggataacgataatcaggaaaataattgttctaggacggaaggggatgatggtaaaattgaagtagatagtgtacatgatctagtttcagttccattgtccggtaaacgtaatgtaagtaccagtacaacggatacattgactccaatgagatcatcattcagtacagtcaatgagaacgatatggaaaatttctcagtcttaggtccaagaaatagtgttaattctgtcgtaacaccaaggacttcaatacaaaattctactttggaagatttttcaccgtccaacaaaaattttaagtcagctaaatcgatttacgaaatggttgatgtggaattctcgaaatttttaaggcatgttcagttactttattttgtgttacagagctcagtcttctcagatgataatactttaccacagttgctcccaagattttttaaaggttcatttagcggtggttcttggacaaatccattttcgacttttattacggatgaatttggtaatgcgacaaagaacaaagctgtcacatctaatgaagtgaccgcttcgtcgtccaaaaattcctcaatatcaaggattccaccaaagatggcagatgctattgcctctgcgtcaggatatagcgctaattcagaaacaaattcccaaattgatttaaaagcaagcagtgccgcgtctggttcagtttttacacctttcaaccgtccttctcataacagaaccttttcaagagcaagagtttcaaaaaggaagaaaaaatatccattaactgtagacactttgaatacaatgaagaagaaatcctcgcaaatttttgaaaaattaaataatgctacaggtgaacacttaaaaattataagtaaacccaaaagcagaattaggaatttggaaataaattcaagcacatacgaacaaataaatcagaatgttttactattggagatactggagaatttagatctgtcaattttcatcaatttgaaaaacctgattaagacacccagtattttgttggatttggaaagcgaggaatttttagttcacgccatgtcttcggtctcctcagtactaacagagttttttgatataaagcaggcttttcatgacatcgtcatcagattaataatgacaacgcaacaaacgaccttagacgacccgtatttgttttcctcaatgaggtccaatttccctgtcggacatcatgaacctttcaagaatatctctaatacacctttggtcaagggccccttccataaaaaaaatgaacaattggcactctccttatttcacgtattggtgagtcaagatgtggagttcaataaccttgaatttttaaacaactccgacgattttaaagatgcttgtgaaaagtatgtcgagatttctaatcttgcgtgtattattgttgatcaattgattgaagaaagagaaaatttgctgaactacgcagcaagaatgatgaagaataatttgactgcagaactattgaaaggtgagcaagaaaaatggtttgatatttattccgaggactatagtgatgacgattcagaaaatgatgaagctatcatcgatgacgaattaggatctgaggactatattgaacgcaaagctgcgaacatagagaaaaaccttccatggtttttaacttcagattatgaaactagtcttgtctatgactcaagaggaaaaattcgtggcgggacaaaagaggcactgattgaacatttaaccagtcatgaacttgttgatgcggctttcaatgttacaatgttaataactttcagaagtatattaaccacaagagagtttttttatgccctgatttacaggtacaacttgtatcctcctgaagggctgagttacgatgattacaatatttggatagaaaaaaagtcaaacccgattaaatgccgtgtggtcaacattatgagaacatttttgacgcagtattggacaagaaattattatgaacctggcataccactgattctaaattttgccaagatggttgtatcggagaaaataccgggggcagaggatcttttgcaaaagataaatgaaaaactgataaatgagaatgagaaagaaccagtggatcctaagcaacaagattcggtatcggcagtcgtacagacaactaaacgtgacaataaatcaccgatacacatgtcttcgtcttctttaccatcttctgcttcttcagcgttttttagattgaagaaattgaagctcttggatattgacccatacacatatgccacacaattgactgtacttgaacatgacttatacctcaggatcactatgtttgaatgcttggatagggcatggggtaccaagtattgtaatatgggtggttctccgaacattacgaaatttatagctaatgctaatacgctaactaattttgtttctcataccattgtaaaacaggcagatgtcaagacacgttcaaaattaacgcaatattttgttaccgttgcccagcattgtaaagagttgaataatttttcttcaatgactgccatagtgtccgctttgtattcctccccaatctaccgactgaaaaagacatgggatttagtttccactgagtcgaaggaccttctgaagaacctaaacaaccttatggattccaagagaaattttgtgaagtatagagagctgttgcgatccgtgacggacgttgcatgtgttcccttttttggtgtatacctatctgatttaacatttacgtttgtcggaaacccagattttcttcacaattcaaccaacataataaacttcagcaagaggactaaaatcgcaaatatagtggaggaaattataagctttaaaagattccattacaagctgaaacgattggatgatattcagaccgttatagaagcgtctttggaaaatgtcccccacattgaaaagcagtatcaattatcactgcaagtggaaccgagatcaggaaacaccaaaggcagtacgcatgcttcttctgctagcggtacaaaaactgcaaaattcctaagtgaatttacagatgataaaaatggcaattttttgaagctaggtaagaaaaaacctccttctaggttatttcgataa

SEQ ID NO: 25496 - DNA, 1563 bp, Saccharomyces cerevisiae
atgagtttaaaggaggaacaagtgtccattaagcaggacccggaacaagaagagcgtcagcatgatcaattcaatgatgttcagatcaaacaagagtcgcaggatcatgatggagtggactcgcagtacacgaacggtacgcaaaatgacgacagcgagagatttgaggcagctgaatccgatgtaaaggtggaacccggcctcggtatgggcatcacctcctctcagagcgaaaagggtcaagttctgcctgaccaaccggagattaagttcattcgtcgtcaaatcaatggttatgtagggtttgctaatttgcccaagcaatggcacagaaggtccataaagaacggattcagtttcaatctcctatgtgtcggccctgatggtattggtaagacaactttaatgaaaactttatttaataatgatgatattgaggccaatttagtgaaagattacgaggaggaacttgcaaatgatcaggaagaagaggagggtcagggcgagggtcacgagaaccaatcacaagaacaaaggcacaaggtcaaaattaagtcatatgagtcggttattgaagaaaatggtgttaaactgaatttgaacgtgatcgatactgaaggatttggtgattttttaaataatgatcaaaaatcatgggacccgatcattaaggagattgactctcgttttgatcaatacttggatgcggagaacaaaatcaacagacattcaataaacgataaaagaatccatgcatgtctttatttcattgaacctacaggacattacttaaagcccctggacctgaagtttatgcaatctgtatatgaaaaatgtaacttgattcctgtcattgctaaatctgacatcttaactgatgaagagatcttaagtttcaagaagaccattatgaaccagttaatccaatctaatatcgagctgttcaagcctccaatttattccaacgatgatgcagaaaatagccatttatccgaaagactatttagtagtttaccttatgctgttattggttccaacgatattgtagagaactacagtggtaatcaagtgagaggccgttcctatccatggggggtgatcgaagtggacaatgacaaccactctgatttcaaccttttgaaaaatttattgatcaagcaattcatggaggaattaaaggaaaggacaagcaagatactatacgaaaactacaggtcttctaaattggcaaaacttggtattaagcaagataattcagttttcaaagagttcgatccaatatctaaacaactagaagaaaaaactttacatgaggcaaaactagccaaactagaaattgaaatgaaaacagttttccaacaaaaagtttccgaaaaggagaaaaaactacaaaaatcagaaactgaattgtttgctagacataaagaaatgaaggaaaaattaactaaacaattaaaagctttggaggacaagaaaaaacagctagaactttcaataaatagtgcttctcccaatgttaaccactcccccgtccctacaaagaagaagggatttttacgttag

SEQ ID NO: 25497 - DNA, 2367 bp, Saccharomyces cerevisiae
atgaagatggccgtggatgaccctacgtatggcaccccaaagattaaaagaactgcttctagcagtagtagtattgaaacgacagtaacaaagttgctgatgtccaccaagcacctcctccaggtcttaacacaatggtctaaggggacaacctctggaagattagtatctgatgcatacgttcagttgggcaatgacttcaaagtcgtatcgaaattcttcatgcatgcgaaagttgacatgtcagatgttggtgatgtgccaatggctttaagacgtgtattggaagtgacattgagggaaccaccatctgatgaaactttaaataaacatctgccaaaaatcagagagattatagtgacacttttagacaaactaaaggttaaacaagcaattttgaagaatatgcagcaagagcatcggataagtgtaaaatcacatcatcaacaaaacccttcctttactagtaacctttcattgggtagtgaagggacccgtgaggggactccattaagtagcagaaaaagcagtattgtacgtgatcagaggcaaagcgattcagtcgaaaacagctatggggaaaaagtgaattctacttctacgggaacaccctctgctcagtcagcagaggcaacattgacaaaaccaagaactaatattaaacaaaaccttaaatctaacaatgctccaaacgcatctgatgatgatgatgcactttcacaattgaagaagggaactaatttacaaaggagagcctcaaagagatactctgcctaccatatggctaaattgacaaatcagtctacaacagaagctgctgcggctgccggcctcatgacaactccttcaccctcgatgttgcatctagaggaaaccgtaagaaagtcaaagttatacggaaataacaacaatgatgatgatagaaacattaattcagctgaaaataagggtaaaagcattgacgatgtatcaaaggcgagtccattggcgaaaacgccattgcctattgagaatgttcgtgcatctccacgaagattatcaagcgttgttacaacttcgccagataaagccatgaatggaacttgtccagtatttttaaggataggagacaaaacaaagaagtgtcatgtgcaactgcctactacaaaaaacgcattaaggctcctatttattgagcgctttgcgtattctcctggagcaaattccttcccagacatatatattatggatcctcaatatggagtattctatgaattagaggaactaaatcttctcgatattaaagaagggtttgttatcgagctaaagctcgaagagaatccaaataatacgatcaaggaattcattgacacagttaagatggagatatcgaatagtcagaatgatataataagacatttaaaagaaatgagttttggttctgcaattagcggcaagcaaacggaagttttaccacaacctggccttgaagctaacaaacacgatcttgtggggcaaaacaaaaaagatgatgataaaacgatcaaagatattcagtacgaattggggaaaataaaacaagtgcataatattaataggtcaaatattaatgagactattttcaacattttacgaaaggtcgataactttaagtctttatcattttctgccaaaaactcttccaacagaatgtacatggaaaaatcacagaccgaactcggtgatttatccgatactctgctaagtaaagtagatgatttgcaagatgtaatcgaaattatgaggaaagacgttgctgagcgtaggtctcagcccgctaaaaagaagctagaaaccgtatccaaggatttagaaaatgcccaagcagatgtacttaaactacaggagtttattgatactgaaaaaccacattggaaaaaaacttgggaagctgagctcgataaggtctgtgaagaacaacagtttctcacgttgcaggaagagttgattttagatttgaaggaagacttgggtaaggcattagaaactttcgatcttattaagttatgttgtgaagaacaagaaaaaaacccttcgagatcaaaaagtaatcctattttgcctattatgagaccgggcacatttaatcaggtaagggagcaagttatggtggccgtccaatctttaaaccctgaccacgatagtagggtcgaagctattgacaaggctgagaagatgtgggagatggaaagaaaacttaaagctagtaatgaatttgatgatgaactggaaaattttgtgggtaattcaaacctgaaaaaatcgggaggctttgaagaagtagaaaggataagaaagcagaaggatgaagcaaatttgagagcatattttgggccggggtttacttaa

SEQ ID NO: 25498 - DNA, 603 bp, Saccharomyces cerevisiae
atgaacgatcgattagttacggaagagcaagagttgtttacaaaattgcgcgagattgtaggttcaagtattcgcttttgggaggaacaactgttttatcaagttcaagatgtaagcaccatagaaaaccacgtcattctcagtttaaaatgtacaattttaacggatgctcagataagtacgttcataagcaaacccagagagcttcatacgcatgccaaaggatatcctgaaatctattacctttccgagttatcaacaactgtcaattttttttctaaagagggaaactatgtcgaaataagccaggttattcctcattttaatgaatatttttcctctttaatagtgtctcaattggaatttgaatacccgatggtcttctccatgatttcaaggctccgattgaagtggcaacaaagttcgctcgctccgatatcctacgccctaacgagcaattcagtacttcttccaataatgcttaacatgattgcccaagacaaatcttcaacaaccgcgtatcaaattctgtgtcgaagaagaggtcctccaattcagaattttcaaattttttccttaccggctgtaacgtacaataagtag

SEQ ID NO: 25499 - DNA, 2016 bp, Saccharomyces cerevisiae
atgtcttcagttgatgtactgttaacagtaggtaagttggatgcctcattggcgttactgactactcaggatcatcatgttattgagtttcctacagtattattaccagaaaatgttaaagctggatctatcataaaaatgcaagtttcacaaaatttagaggaggaaaaaaaacaaaggaatcattttaagagtatacaagccaaaattttggagaagtatggtacccataaaccggagagcccagttttgaaaattgttaacgttacgcaaacgagctgtgttctagcatgggatccattgaaacttggctcagcaaaattgaaatcactgatcctttataggaagggaatacgttcaatggtaattccaaatccattcaaagtgactaccacgaaaatatccggtctttccgttgatacgccatacgaatttcaattgaaactgataaccacgtcaggaacattatggtctgaaaaggttatattgcgtacacataagatgactgacatgtctggtatcactgtatgtttgggtccattggatccattgaaagaaatttcagacttacagatatcccaatgtttgtctcacatcggggcgagacctttacaacgtcatgttgcgatagatactacgcattttgtctgtaacgatctagacaatgaagaaagcaatgaagagcttataagggcaaaacataacaacataccaattgtcagaccggaatgggtgagagcttgtgaggttgagaaaagaatcgttggtgttagaggattttacttagatgcagatcaaagtatactgaaaaactacacattcccaccagttaatgaggaagaactttcgtactcaaaggagaatgagccggtagccgaagtagcggatgaaaataagatgcccgaggacacaacagatgtcgaacaggttgcatcacctaatgacaatgagagtaatccttcagaagctaaggaacaaggagaaaagagtggacatgaaactgccccagtaagtcctgtagaagatccattgcatgcttcgacggctttggagaatgaaaccaccatcgaaaccgtcaacccctccgtaagaagtttgaaaagcgaacctgttggtactcccaatatagaggaaaacaaagcggactcttccgcagaagccgtggtagaagaaccgaatgaagctgtggctgaaagttctccaaatgaagaagcaacgggacagaaaagtgaggataccgatacacattctaacgaacaagctgataatggatttgtacagactgaagaagtagctgaaaacaacataaccacagaaagtgcaggggaaaataacgaacctgcagatgatgcagcaatggaatttggacgtccagaagctgaaattgaaactccagaagtaaatgagtctatagaagatgccaatgaacctgcggaggattccaatgaacctgtggaggattccaacaaacctgtgaaggattccaacaaacctgtggaggattccaacaaacctgtggaggattccaacaaacctgtggaggattccaacaaacctgtggaggatgccaatgaacctgtggaagataccagtgaacctgtggaggatgccggtgaacccgtacaagaaaccaacgagtttactaccgacattgcctctccaagacatcaagaagaagatatagaacttgaagccgaacctaaagatgctaccgaaagtgttgcagtcgagccatccaatgaagatgtaaaaccagaagaaaaaggttcagaggcagaagacgatatcaacaacgtttccaaggaggctgcctctggtgagagtactacccaccaaaaaactgaggcctctgcttctcttgaaagcagtgccgtcacggaagaacaagagacaacggaagccgaagtaaatacagatgacgttttgtccactaaagaagctaaaaaaaatactggcaacagcaacagtaataagaagaagaataagaagaataagaagaaagggaaaaagaaatga

SEQ ID NO: 25500 - DNA, 2454 bp, Saccharomyces cerevisiae
atggcaggtgctccagctcctcctcctccaccgcctccaccagcattaggtggtagtgctcctaaaccggcaaaatctgtgatgcagggccgtgacgccctgttaggtgacattagaaagggaatgaaactaaagaaagctgagaccaatgatagaagtgccccaatcgtgggaggtggtgtcgtttcatcggcctcaggaagttctggtaccgtcagtagtaaaggaccctctatgtcagctcctccaatccctgggatgggcgctccgcagttgggcgatattttagctggaggtataccgaagttaaaacatatcaataacaatgcaagcactaaaccctctccatcggcgagcgcaccgccaattccgggcgcggtgccatctgttgcggctccccccattcctaatgcaccattatcaccagcacccgctgttcctagtattccctcgtcttctgcacctccaattcctgatattccatcttctgcggcccctcctattcccattgtaccatcatctccagcaccaccgcttccattatcaggtgcctctgctccaaaggtaccgcaaaatagaccgcatatgccttcagtaaggccagcacacagaagccaccaaagaaaaagctctaatatttctcttcctagtgtgtcagcaccccctttgccttcagcgtctctgccaacacatgttagcaaccctccacaagctccaccccctcccccaactccaacaattggcctggactcaaaaaacattaaacctacagataacgcagtctcaccaccatcttctgaagttcctgcaggcgggttgccatttttggcagaaattaatgccaggaggtctgaacgaggagccgtcgagggcgtttcttccacaaagattcaaaccgaaaatcataaatctccttcacaaccaccacttccatcatctgctccgcccattcctacatcacatgctccgccattaccgcctactgcaccacctccaccatcgttaccaaatgtgacctctgcacctaaaaaagcaacttcagctccagctccgcctccaccaccactaccagcagccatgagctctgcgtcgactaacagcgtaaaagcaaccccggttcccccaactttagcaccaccgttaccaaatactacatcagttcctcctaacaaagcatcgtcaatgcccgcgccaccacctcctcctcccccaccacctggtgctttttcaacatcctctgccttgtcagcatcatctattcctttagcaccactaccacctcctcctcctccttcggttgcaacgtcagtaccatcggctcctcctcctcctccaacactcacgacaaacaaaccctcagcgtccagtaagcaatccaaaatatcttcatccagttcttcctcggccgtaacacctgggggacccttaccatttcttgctgagatccaaaagaagagagatgatagattcgtggttggtggtgatactggatacactacccaagataaacaagaggatgtaataggttcatctaaggatgataacgtaagaccttctcctatttctccatctataaacccgcctaaacagagtagccaaaatggtatgtcgtttctggatgaaattgaatccaaattacataagcaaacatcatcgaatgcttttaacgcaccacccccccatacggatgctatggcgcctcctttgcctcctagtgcacctcctcctcctataacatcgctaccgactccaactgcatcaggtgatgaccacaccaatgataagagtgagactgtgttagggatgaaaaaagcaaaggcccctgcactgcctggacacgttccacctccaccagttccaccagttttatcagatgatagcaagaataatgtccccgccgcttctttattacacgatgttcttccctcctcgaatctcgaaaaacctccttctcctcctgttgcagctgctccgccattgccaacatttagtgcaccaagtctgcctcagcaatccgtgtctacatcaataccatcacctcctcctgttgcgcctacactttccgttcgtaccgaaactgaatcaatttcgaagaaccccactaagtcgccacccccaccaccaagtccatctacgatggataccggtacctctaatagccccagtaaaaaccttaaacaacggttattttctacaggtggatcgacgctgcaacacaagcataatacgcatacaaatcaaccagatgttgatgtaggtaggtatacgatagggggatcgaattctatcgttggggccaaatctggaaatgaaagaattgttatagatgattcaagatttaaatggactaatgtgtcacaaatgcctaagccacgtccctttcaaaataaaacaaaactgtatccaagtggaaagggtagtagtgtgccattggacttaacattatttacgtga

SEQ ID NO: 25501 - DNA, 5631 bp, Saccharomyces cerevisiae
atgaacactgatcaacaaccttatcagggccaaacggactatacccagggaccaggtaacgggcaaagtcaggaacaagactatgaccaatatggccagcctttgtatccttcacaagctgatggttactacgatccaaatgtcgctgctggtactgaagctgatatgtatggtcaacaaccaccaaacgagtcttacgaccaagactacacaaacggtgaatactatggtcaaccgccaaatatggctgctcaagacggtgaaaacttctcggattttagcagttacggccctcctggaacacctggatatgatagctatggtggtcagtataccgcttctcaaatgagttatggagaaccaaattcgtcgggtacctcgactccaatttacggtaattatgacccaaatgctatcgctatggctttgccaaatgaaccttatcccgcttggactgctgactctcaatctcccgtttcgatcgagcaaatcgaagatatctttattgatttgaccaacagactcgggttccaaagagactccatgagaaatatgtttgatcattttatggttctcttggactctaggtcctcgagaatgtctcctgatcaagctttactatctttacatgccgactacattggtggcgatactgctaactataaaaaatggtattttgctgctcagttagatatggatgatgaaattggttttagaaatatgagtcttggaaaactctcaaggaaggcaagaaaagctaagaagaaaaacaagaaagcaatggaagaggccaatcccgaagacactgaagaaactttaaacaaaattgaaggcgacaactccctagaggctgctgattttagatggaaggccaagatgaaccagttgtctcccctggaaagagttcgtcatatcgccttatatctgttatgttggggtgaagctaatcaagtcagattcactgctgaatgtttatgttttatctacaagtgtgctcttgactacttggattcccctctttgccaacaacgccaagaacctatgccagaaggtgatttcttgaatagagtcattacgccaatttatcatttcatcagaaatcaagtttatgaaattgttgatggtcgttttgtcaagcgtgaaagagatcataacaaaattgtcggttatgatgatttaaaccaattgttctggtatccagaaggtattgcaaagattgttcttgaagatggaacaaaattgatagaactcccattggaagaacgttatttaagattaggcgatgtcgtctgggatgatgtattcttcaaaacatataaagagacccgtacttggttacatttggtcaccaacttcaaccgtatttgggttatgcatatctccattttttggatgtactttgcatataattcaccaacattttacactcataactatcaacaattggtcgacaaccaacctttggctgcttacaagtgggcatcttgcgcattaggtggtactgtcgcaagtttgattcaaattgtcgctactttgtgtgaatggtcattcgttccaagaaaatgggctggtgctcaacatctatctcgtagattctggtttttatgcatcatctttggtattaatttgggtcctattatttttgtttttgcttacgacaaagatacagtctactccactgctgcacacgttgttgctgctgttatgttctttgttgcggttgctaccatcatattcttctccattatgccattgggggggttgtttacgtcatatatgaaaaaatctacaaggcgttatgttgcatctcaaacattcactgctgcatttgcccctctacatgggttagatagatggatgtcctatttagtttgggttactgtttttgctgccaaatattcagaatcgtactactttttagttttatctttgagagatccaattagaattttgtccaccactgcaatgaggtgtacaggtgaatactggtggggtgcggtactttgtaaagtgcaacccaagattgtcttaggtttggttatcgctaccgacttcattcttttcttcttggatacctacttatggtacattattgtgaataccattttctctgttgggaaatctttctatttaggtatttctatcttaacaccatggagaaatatcttcacaagattgccaaaaagaatatactccaagattttggctactactgatatggaaattaaatacaaaccaaaggttttgatttctcaagtatggaatgccatcattatttcaatgtacagagaacatctcttagccatcgaccatgtacaaaaattactatatcatcaagttccatctgaaatcgaaggtaaaagaactttgagagctcctaccttctttgtttctcaagatgacaataattttgagactgaatttttccctagggattcagaggctgagcgtcgtatttctttctttgctcaatctttgtctactccaattcccgaaccacttccagttgataacatgccaacgttcacagtattgactcctcactacgcggaaagaattctgctgtcattaagagaaattattcgtgaagatgaccaattttctagagttactcttttagaatatctaaaacaattacatcccgttgaatgggaatgttttgttaaggatactaagattttggctgaagaaaccgctgcctatgaaggaaatgaaaatgaagctgaaaaggaagatgctttgaaatctcaaatcgatgatttgccattttattgtattggttttaaatctgctgctccagaatatacacttcgtacgagaatttgggcttctttgaggtcgcagactctatatcgtaccatttcagggttcatgaattattcaagagctatcaaattactgtatcgtgtggaaaatcctgaaattgttcaaatgtttggtggtaatgctgaaggcttagaaagagagctagaaaagatggcaagaagaaagtttaaatttttggtctctatgcagagattggctaaattcaaaccacatgaactggaaaatgctgagtttttgttgagagcttacccagacttacaaattgcctacttggatgaagagccacctttgactgaaggtgaggagccaagaatctattccgctttgattgatggacattgtgaaattctagataatggtcgtagacgtcccaagtttagagttcaattatctggtaacccaattcttggtgacggtaaatctgataaccaaaaccatgctttgattttttacagaggtgaatacattcaattaattgatgccaaccaagataactacttggaagaatgtctgaagattagatctgtattggctgaatttgaggaattgaacgttgaacaagttaatccatatgctcccggtttaaggtatgaggagcaaacaactaatcatcctgttgctattgttggtgccagagaatacattttctctgaaaactctggtgtgctgggtgatgtggccgctggtaaagaacaaacttttggtacattatttgcgcgtactttatctcaaattggtggtaaattgcattatggtcatccggatttcattaatgctacgtttatgaccactagaggtggtgtttccaaagcacaaaagggtttgcatttaaacgaagatatttatgctggtatgaatgctatgcttcgtggtggtcgtatcaagcattgtgagtattatcaatgtggtaaaggtagagatttgggtttcggtacaattctaaatttcactactaagattggtgctggtatgggtgaacaaatgttatctcgtgaatattattatctgggtacccaattaccagtggaccgtttcctaacattctattatgcccatcctggtttccatttgaacaacttgttcattcaattatctttgcaaatgtttatgttgactttggtgaatttatcttccttggcccatgaatctattatgtgtatttacgataggaacaaaccaaaaacagatgttttggttccaattgggtgttacaacttccaacctgcggttgattgggtgagacgttatacattgtctattttcattgttttctggattgccttcgttcctattgttgttcaagaactaattgaacgtggtctatggaaagccacccaaagatttttctgccacctattatcattatcccctatgttcgaagtgtttgcgggccaaatctactcttctgcgttattaagtgatttagcaattggtggtgctcgttatatatccaccggtcgtggttttgcaacttctcgtataccattttcaattttgtattcaagatttgcaggatctgctatctacatgggtgcaagatcaatgttaatgttgctgttcggtactgtcgcacattggcaagctccactactgtggttttgggcctctctatcttcattaatttttgcgcctttcgttttcaatccacatcagtttgcttgggaagatttctttttggattacagggattatatcagatggttatcaagaggtaataatcaatatcatagaaactcgtggattggttacgtgaggatgtctagggcacgtattactgggtttaaacgtaaactggttggcgatgaatctgagaaagctgctggtgacgcaagcagggctcatagaaccaatttgatcatggctgaaatcataccctgtgcaatttatgcagctggttgttttattgccttcacgtttattaatgctcaaaccggtgtcaagactactgatgatgatagggtgaattctgttttacgtatcatcatttgtaccttggcgccaatcgccgttaacctcggtgttctattcttctgtatgggtatgtcatgctgctctggtcccttatttggtatgtgttgtaagaagacaggttctgtaatggctggaattgcccacggtgttgctgttattgtccacattgcctttttcattgtcatgtgggttttggagagcttcaactttgttagaatgttaatcggagtcgttacttgtatccaatgtcaaagactcatttttcattgcatgacagcgttaatgttgactcgtgaatttaaaaacgatcatgccaatacagccttctggactggtaagtggtatggtaaaggtatgggttacatggcttggacccagccaagtagagaattaaccgccaaggtaattgagctttcagaatttgcagctgattttgttctaggtcatgtgattttaatctgtcaactgccactcattataatcccaaaaatagataaattccactcgattatgctattctggctaaagccctctcgtcaaattcgtcccccaatttactctctgaagcaaactcgtttgcgtaagcgtatggtcaagaagtactgctctttgtactttttagtattggctatttttgcaggatgcattattggtcctgctgtagcctctgctaagatccacaaacacattggagattcattggatggcgttgttcacaatctattccaaccaataaatacaaccaataatgacactggttcccaaatgtcaacttatcaaagtcactactatactcatacgccatcattaaagacctggtcaactataaaataa

SEQ ID NO: 25502 - DNA, 2586 bp, Saccharomyces cerevisiae
atgtccaccgctgaatttgctcaactattggagaacagtatcttaagtcccgaccaaaacattcggttgactagtgaaacgcaattaaagaaattatctaatgacaacttcttacaatttgcaggtctttcttcgcaagtgcttatcgatgaaaatacaaagctagaagggcgtattctagcggcgctaactttgaagaacgagctggtgtccaaggactcagtcaagacgcagcaatttgcacaacgttggattacacaggttagtccagaagctaaaaaccaaattaaaactaacgcgctgaccgcattggtctccatagaaccgcgtatagcaaatgcagcagctcaattgattgcggctatagcagatattgagttgccccatggcgcatggccagagttgatgaaaattatggttgacaatacaggtgcggaacaaccagaaaatgtcaagagagcctctttattggccttgggttatatgtgtgaaagtgcagaccctcaaagtcaagccttagtttcttcatcaaacaatatcttaatcgctattgtccagggtgcgcaatctacggaaacttccaaagcagtcagactggcagctctgaatgctcttgcagactctttaattttcatcaaaaataacatggaacgcgaaggtgaaagaaactaccttatgcaagtcgtctgtgaagccactcaagctgaagatatagaagttcaagcagctgcctttggttgtttgtgtaaaatcatgtcactatactatacatttatgaaaccttacatggagcaagccctatatgcattgaccatagctacaatgaaatctccaaatgataaagtagcttccatgactgtggaattctggtccactatttgtgaagaagaaatcgatattgcctatgagctcgctcaatttcctcaatctcctttacagagttataatttcgctctctcttctattaaagatgttgtccccaatttgttgaaccttctaacgagacaaaatgaagatccagaagatgacgattggaatgtttccatgtccgcaggtgcatgcttgcagttgtttgcccaaaactgtggcaatcatatcttagaacctgtattggaatttgttgaacaaaatattaccgctgacaactggaggaatcgtgaagctgctgtaatggcctttggttccattatggatggccctgataaggtccaaagaacctattacgttcaccaagccttaccatctattttgaatttaatgaacgatcaatccctacaagttaaggaaaccactgcttggtgtattggtagaattgctgattctgttgctgaatctatcgacccacaacagcatcttccaggtgtcgttcaagcttgtttaattgggttgcaagatcacccaaaagtggccacaaactgttcttggaccattatcaacttagtcgaacaattagcagaagccacaccatctccaatctataacttctatcccgctcttgtagatggtttgatcggtgctgcaaatagaattgataatgagttcaatgcccgtgcatccgccttttcagccttgacaacaatggttgaatacgccacggacacggtagctgaaacttccgcctccatttctacgtttgttatggacaaattagggcagacaatgagtgttgatgaaaatcaattaacgttagaagatgcgcaaagtttgcaagaattgcagtcaaatatattgactgttctagcagccgttattagaaaaagtccaagtagtgtagaaccggttgcagatatgcttatgggactgttcttcaggttgttggaaaaaaaggactctgcgtttattgaagacgatgtgttttatgctatttcagctctagctgcttctttgggtaaaggatttgagaaatacctggaaacattttctccctatttattaaaggctttaaatcaagtagattcgccagtttcaatcaccgcagtgggcttcatcgctgatatttcaaattcgttagaagaagatttcagaagatattccgatgctatgatgaatgtcttggctcaaatgatctctaatccaaatgcaaggagagagttgaaaccagccgtcttgagcgtgttcggtgatattgcttccaatataggtgctgattttattccctacttgaatgacatcatggcgttgtgtgttgctgcccaaaacacgaagccggaaaacggcacattagaagcccttgattatcaaataaaagtactagaagcagtactagatgcttatgtgggtatagtagcgggtcttcatgataaacctgaagctctgttcccttatgttggtactatattccagttcattgcacaagttgcagaagatcctcagctgtacagtgaggatgctacctcaagagcagcagtcggattgattggtgatatagcagcgatgtttccagacggctcaatcaaacaattttatggacaagactgggttattgattacattaaaagaactaggagtggccaattgttcagtcaagccacaaaagatacagcaagatgggctagagagcaacagaagcgtcaattatccttataa

SEQ ID NO: 25503 - DNA, 897 bp, Saccharomyces cerevisiae
atgtcaaccaacgcaaaagagtctgccggtaagaatatcaagtatccatggtggtacggaggtgcagcgggtatctttgctaccatggtgacacatcctcttgacttggccaaagtcagactgcaggcggctcctatgcccaagcccacactcttcaggatgttggagagtatcttggcgaatgaaggtgtggtggggttatattccggcctgagcgctgctgtgttgaggcaatgtacatacacgacggtgagattcggtgcatacgacttgttgaaagagaatgtgatcccacgcgagcaattgactaacatggcgtatcttttaccttgctccatgttcagtggtgccattggggggcttgcagggaattttgcagatgttgtaaatatcagaatgcaaaacgactctgctttggaggcagcgaagaggagaaactacaaaaacgctatcgatggtgtgtacaagatatatcgctacgagggtggactgaaaaccttgtttaccggttggaagcctaacatggttaggggcatactgatgacggcaagtcaggtcgttacgtatgacgtgtttaagaactacttggtcacaaaattagatttcgacgcatccaagaactatacacacttgacagcgtccctgttggctggcctggtggccaccactgtgtgctctccagcagacgtcatgaagacacgtatcatgaacggcagcggagaccatcaaccggctttgaagatccttgccgacgctgtccgcaaagagggcccatctttcatgttccgggggtggttgccaagtttcactagactgggtccattcacaatgttaattttctttgcaattgagcaattgaaaaaacatagggttggcatgccaaaggaagacaagtag

SEQ ID NO: 25504 - DNA, 1812 bp, Saccharomyces cerevisiae
atgatacaatcagacgaagataatttggactcttctgaaacgacagcatcaacttcatatagtggtacttcctctgtatcatccagactacaactaagaacatccttgttttttgaaaatcttaatggagcacatgggaaccccgatgcggagacagagatggctactgttgcctatgaaaccacaagtagaggtcaaggatttgctgtatacatcaacaatgaaaggttttctcaaataatgggagcatccacaagctctagctctagtagcaactcgtcctctattacacaatttcacgatacccaagataataatataccaagcaacactactgtaaggccaacttcacttcgacgagacaacgaggataccgtaccgttaaggaacgtaactccttcacaaaacgcggcggtacggccagaaagagcagtgaattcaccatcttcgcagagattaagttgcgcactgacaatatcaacttcagttcttatgggagaagatgttgaaggaagccctatagagcaagagcatagtagggtcgtatcttcattatactcatctttggcgaatcgcgggaacgacgagtcaaagaatggaacacctccacgtcctacctcaattgaacctaatgaaacaacggaacactcatttttctcataccattacgatgacaccttagaaccagatgttgaagaggcagtgaggctaacgaagaataaaacttctaatgttaattttataagctcaactggcagtaaaggtgaaggcgagaccgaggatgaagtcatagatcaatacgaacctgtgaatgaatcaaaatttataccgcacaaactaaaaattccagagaaggctggatcaataaagtcgtcgacaagtgatgattcgcattcgccaggtgcgccaggtacgtcggcaaggaagattaaaattcctcagagtccatcgttaattggtaacatattgattccttcacacaatagtgacagtagtaacgaaagttctcctaaagaccatatagggcataataatgaagaaaaattcagttcaaaatctacgcgcaagccctccacatccctagaagaagaaggtccaccaattggactaccttcaattcccgtattaagaagtgtgtccggaccaagcaaatggacgaagacacctttacgcttagaatctggaaattcaactaagtctgatccattttcacgctatgaaggacacaagacgccctctccattgaccaagatgaacaagaagaaaaataaaacgttgccagaacatggacaacccctcgtgctagctccaattaaatctcaaagctcggagtcagacacgggacagaactccattatagaaaagccagctcgaagcatacgacgaaagcaacaagaaaaaactgataataggaaagaagacaggcacgatgctgaaaatatagacctggaggcgagaatgccaattcaacatatcgataccgcttccattcattcgtttgattcaggtcaaaatggattcagggacgtttacagcatcgaaaacatcattgtgatcctcctatgttgtagtatagtgccgccattattttttattattggctgcagctcaagaaggaaattagtttcagactatagattaatgaggttgcttatgaataaagaacaccgagcggctttgctgcaaggattcatatgggacgttgatttaaggtggttccggatgttttgtctgatcttaggggctgccgaaacagtgattgtgatggccggtattgctattggatttggtgtgggtataacacgtgaataa

SEQ ID NO: 25505 - DNA, 1008 bp, Saccharomyces cerevisiae
atgtctgaaccagctcaaaagaaacaaaaggttgctaacaactctctagaacaattgaaagcctccggcactgtcgttgttgccgacactggtgatttcggctctattgccaagtttcaacctcaagactccacaactaacccatcattgatcttggctgctgccaagcaaccaacttacgccaagttgatcgatgttgccgtggaatacggtaagaagcatggtaagaccaccgaagaacaagtcgaaaatgctgtggacagattgttagtcgaattcggtaaggagatcttaaagattgttccaggcagagtctccaccgaagttgatgctagattgtcttttgacactcaagctaccattgaaaaggctagacatatcattaaattgtttgaacaagaaggtgtctccaaggaaagagtccttattaaaattgcttccacttgggaaggtattcaagctgccaaagaattggaagaaaaggacggtatccactgtaatttgactctattattctccttcgttcaagcagttgcctgtgccgaggcccaagttactttgatttccccatttgttggtagaattctagactggtacaaatccagcactggtaaagattacaagggtgaagccgacccaggtgttatttccgtcaagaaaatctacaactactacaagaagtacggttacaagactattgttatgggtgcttctttcagaagcactgacgaaatcaaaaacttggctggtgttgactatctaacaatttctccagctttattggacaagttgatgaacagtactgaacctttcccaagagttttggaccctgtctccgctaagaaggaagccggcgacaagatttcttacatcagcgacgaatctaaattcagattcgacttgaatgaagacgctatggccactgaaaaattgtccgaaggtatcagaaaattctctgccgatattgttactctattcgacttgattgaaaagaaagttaccgcttaa

SEQ ID NO: 25506 - DNA, 1097 bp, Saccharomyces cerevisiae
taatctttattagggacgcctacgatattattattccaaaacttgttaacgtcatcaacagattggctaagtttgctatggaatacaaggatttgcctgtattgggttggactcactttcaaccagcacaattaacgaccttgggtaagagagctactttatggatacaagagctattgtgggatttgagaaactttgaaagagctagaaacgatatcggtctacgtggtgttaagggtactactggtactcaggcatcattcttggccttattccatggtaatcatgataaagttgaagcccttgacgaaagagtaactgaattattaggtttcgataaggtatatccagtcactggtcaaacctactcaagaaaaattgacattgacgtgttggctcctttgtcttcttttgctgctactgcacacaaaatggctactgacataagattattagccaacctgaaggaagttgaggaaccttttgagaaatcacaaatcggatcctctgctatggcttacaagagaaacccaatgcgttgtgagagagtgtgctccttggctagacacttaggttccttgtttagtgacgccgttcaaactgcatccgttcaatggttcgaaagaactctggatgattctgctattagaagaatttctttaccaagtgcatttttaaccgcagatattctattatctactttgttgaacatctcatccggtttagttgtgtatccaaaggttatcgaaaggagaattaagggtgaactaccttttatggctactgaaaatatcatcatggctatggtagaaaagaatgcctccagacaagaagtacatgagcgtattagagtgctctctcatcaagccgcagcagtagtcaaggaagaaggtggggaaaatgatttaattgaacgagtaaagagggatgaatttttcaagcctatctgggaagaattagattctttactggaaccatccacttttgttggtagagctccacaacaagttgagaaatttgttcaaaaagacgttaacaatgctttacaacctttccaaaagtacctaaacgatgaacaagtcaagttaaatgtttag

SEQ ID NO: 25507 - DNA, 2217 bp, Saccharomyces cerevisiae
atgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttga

SEQ ID NO: 25508 - DNA, 1974 bp, Saccharomyces cerevisiae
atgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaaccacaccatctatagttgcctttgatgtcaaaagctcgccacagaataaagatcaaatgaaaactcttgtagggatggcagctaaaaggcaaaatgctattaattctgaaaacactttctttgctacaaagagacttattggccgtgcattcaacgacaaggaagttcagcgagatatggctgttatgccatataagattgtcaaatgtgagtcaaatgggcaagcctatctcagcacgtctaatggtctcattcaatcaccaagccagatagcatctatattactgaaatacctgaaacaaacttcagaagaatacttaggcgaaaaggttaatttggcagttattacagttccagcatattttaatgattctcaaaggcaagccacaaaagatgccggcaagttagctggcctaaatgttttgagagttattaacgaaccaactgcggccgccttaagctttggaattgatgataagaggaataatggattaattgcagtttacgatttgggtggtggtacatttgacatatccatcttggacattgaagatggcgtgtttgaggttcgtgctactaatggtgacacgcatttaggtggagaagattttgacaacgtcattgtaaactatattatagataccttcattcatgaaaaccctgaaattacacgggaagaaattacgaagaacagggagacaatgcaaaggttaaaagatgtttctgaaagagctaagatagatttatcccatgtgaagaaaacttttatcgaacttccatttgtatacaaaagcaaacatctacgagtgccaatgacagaggaagagctggataatatgactttgtcattaatcaacaggactatcccacctgtgaagcaagcattgaaagatgccgatatcgaaccggaggatatagatgaagtaatccttgttggtggtatgacccgtatgccaaagattagatctgttgtaaaagatctttttggtaagtctccaaattctagtgttaacccagatgaaacagttgctttaggagcagctattcaaggtggtattctatccggtgaaataaagaatgtcttacttttggatgtgacaccattgacattagggattgaaacatttggaggagcgttctcacccttgatacctagaaatacgacagttccagtaaaaaaaacagagatatttagtactggtgttgatgggcaagcgggtgttgatatcaaagtttttcagggtgaaagagggttagtgcgtaacaacaagttgattggtgatttgaaacttacaggaatcacccctttgcctaaaggcattccccaaatatatgttacttttgatatcgatgcggatggtatcatcaacgtatctgccgctgagaaaagtagtgggaaacaacaatccattactgtaataccaaattctgggttaagcgaagaggaaattgcaaaacttattgaagaagcaaatgcaaatagggcacaagataacttgatcaggcaaaggttagagcttatctctaaggctgacattatgataagtgatactgagaatttatttaaaagatatgaaaaactgatttctagcgaaaaagagtattctaatatcgtagaggacatcaaagctctgagacaagctataaagaattttaaggctaacgaaaatgacatgtcaattgatgtaaacggaataaaaaaagctacggatgcgctacagggtagggcattaaaattattccaaagcgcaacaaaaaaccagcagaatcaaggtaaataa

SEQ ID NO: 25509 - DNA, 4071 bp, Saccharomyces cerevisiae
atgagcgaaaccaacgttgacagcttaggggacagaaatgacatatactcccaaatatttggtgtagaaaggaggccagattccttcgctacttttgatagtgactcgcacggagacataagttctcagctgctgcctaatagaatcgaaaatatccagaatctaaatgttctgctttctgaagacattgctaatgacatcattattgccaagcagaggagacgttctggagttgaagccgccatcgatgattctgatataccaaataacgaaatgaaggggaaaagctcaaattacattttatcgcagcagactaatattaaggaagttccagatacacaaagtttgtctagtgctgataatacacctgtgagcagtccaaagaaggcaagagatgccacatcttcccatcccattgttcatgctaaatcgatgtcccatatatattcaacgagtaatagtgctagtagacaagccaagcactataatgaccaccctttgcctccaatgtctccaagaaatgaagtttaccagaagaataaaagtactacagcttttgtgcctaagaggaaaccttcgctcccgcaactagcacttgctggtcttaagaagcagagcagtttttccaccggcagtgcatcaaccactcctacacaggctagaaaatcgcctttgcaagggtttggtttcttttcgagaccaagttccaaagacttgcacgaacagcaccaacatcaccagcatattcagcataataatattaacaatcataataataataatactaataataatggcgcacattatcaagtgggtagtagtaacagtaattaccctcaacattcacattctatatcatctagatcgatgtcgttgaactcatctactctaaaaaatattgcatcatcttttcaatcgaagacttctaacagcaggaaagctacgcaaaaatatgatataacttccaacccattctcagatcctcatcatcatcatcatcatcatcactcttcaaacagtcacagtagcctaaataatgtccacgggtctggaaactcctcaagtgttatgggaagctcgtctaatattgggttgggtcttaaaacgagagtttcttccacctcattagctttaaaaagatacacttcggtttcaggaacttctctatcttctccacgtagaagtagtatgacacctttgtcggcatctagacctgttatgagcgcttcatcaaaaaaacctcaggtatatccagctttgttgtcaagagtcgccacaaaatttaaaagttcgatacaactcggggaacataagaaggatggattagtttaccgtgacgcatttacagggcagcaggcagtcgatgtcatctgtgctatcattagaacttctgatagaaacttagccttgttatttggtagatcactagatgcacaaaagctgttccatgatgtggtatacgagcacaggttaagagattcaccacatgaagtttacgaatttacagataactcaagatttacaggaacaggttccacaaacgcccatgatccactgatgctactcccaaactcatcatcttttaattccgggaaccactcttatccgaattccggaatggttccatcaagttcaacttcatctttgaatagtgatcaggcaactttgacagggtcgaggctacatatgagtagttcattgtcccagcaaaagaaccctgcagccattcataacgtcaatggtgtgtttacattactggcggaatgctattcccctacgtgcacaagagacgctttgtgttactctatttcgtgtccaagacgtcttgagcaacaagcaaggttaaatctgaaaccaaatggcggcctgaaacgtaatatatcaatggcattggatgatgatgacgaagaaaagccatcttggacaagttccgtatctaaagaggattgggaaaacttaccaaaaaaggaaataaaaagacaagaggctatttatgaagtttatatcacggagaagaactttgtaaaatcattagaaattacaagagacacattcatgaagactttggctgaaacaaatattatttcagcagatattagaaaaaatttcatcaagcatgtttttgcacatataaacgatatctattcagtgaatagacgttttttgaaggctttaactgataggcaaagaagttcaccagttgtgagaggaattggggacattgttttaagattcattccattttttgaaccatttgtttcatatgtcgcttcaagaccatatgcgaagtacttgattgaaacccaaagatcagtcaatccctattttgctagatttgatgacgatatgatgagctcctccttacgtcatggtattgattcgtttttatctcaaggtgtttcaagaccaggtcgatatatgctattggtcaaagaaatcatgaaatctactgaccccgagaaggacaaaagtgattatgaagatttaagcaaagccatggatgcattaagggattttatgaaaaggattgatcaagcaagtggtgctgcacaagatagacatgatgtaaaattgttgaaacaaaagattcttttcaaaaacgaatacgttaatttaggattaaatgacgaaaggagaaaaattaaacatgaaggtatactatcacggaaggagttgtcaaaatcggacggaacagttgttggtgacatacaattttatcttctagataatatgctcttatttttaaaggccaaagcagttaataaatggcaccagcataaggtattccaaaggcccattccattgccattgttatttgcatgtccaggtgaagatatgcctgcgttgaggaaatatattggagaccacccagattgttcaggaactgtaattcaaccagaatacaacacgagtaatcctaaaaacgcaataactttcttatactacggtgccaagcagagatatcaagttacattatatgctgcgcaatacgctggattgcaaacgcttttggaaaaaataaagcaaggacaagcagctattataagcaaaacggagatgttcaatgtaacgaaaatgagcgataggttcttcgattacaccaacaaaattaacagtgttacttcctgtgatgggggtagaaaacttctgattgcaacgaactctggattgtatatgagcaacattaaaagacagcagaataaagatcatagacataaaagctctgcttttttttcaactccaatccaactagtacaaagaaataatatcactcaaattgctgtattagaagaattcaaatcaatcatacttttaattgataaaaaattatacagttgtccgctgtcattaatcgaagcagaaggtaatgggacatctttcttcaaaaagcatcacaaggaactgatcaatcatgtgagtttcttcgcagaaggagattgcaatggtaagagattaatcgtgactgcacacagttcatcgcattcaattaagtacttcgagcatgaacatccattattggccgaaaaaaatggtagtggtagcggtaacaaaaaaagtctcaagaaaaaaatcaccgaggttatttttgattctgaacctgtctctatttcatttctcaaggccaacctatgcattggctgtaaaaagggttttcagatcgttagcatttcacagaatgctcatgaatccttgttagatccggccgatacatcattagagtttgcactaagggatactttgaaaccaatggcaatctatcgtgtgggaaatatgtttttgctgtgttacacagaatttgccttctttgtcaataatcagggttggagaaagaaagaatcgcatattattcattgggagggagagccccaaaaatttgcaatttggtacccgtacatcttggcattcgacagcaacttcattgagatcagaaagattgaaactggcgaattaattcgttgcgtccttgctgataagattcgacttctacaaacaagtactcaagaaatcctgtactgctacgaggattatcgcgggtatgatacagttgcgtcgttagatttctggggttaa

SEQ ID NO: 25510 - DNA, 1038 bp, Saccharomyces cerevisiae
atgaacactaccacatctactgttatagcagcagttgccgaccagttccagtctttgaactcttcttcttcatgtttcttgaaggttcatgttccttccattgagaacccattcggtattgaattatggccaattttctccaaagtgtttgaatactttagtggctatccagctgagcaattcgagtttattcacaataagactttcttggctaacgggtatcatgctgttagtattattatcgtttattacattattatctttggtggccaagctatcttacgcgccttgaacgcctctccattaaagtttaaattgcttttcgagatacacaacttgtttttgacttctatttctctagttttatggttgctgatgttagaacagttggttcctatggtttatcacaacggtctattctggtctatctgctctaaggaagccttcgcaccaaaattagttactctttactatttgaactatttgaccaaattcgtagaattgattgacactgtgtttttagttttgagaagaaagaagttattgtttttgcacacttaccatcacggtgccaccgctttgttgtgctacactcaattaattggtcgtacttctgttgaatgggtagttatcctactaaacttgggtgttcacgttatcatgtactggtactacttcttgagttcatgtggtattagagtttggtggaagcaatgggtcactagattccaaattattcaatttttgattgacttggtatttgtttactttgctacctatacattctatgctcacaaatacttggacggtattttaccaaacaagggtacttgttatggtactcaggctgctgctgcttatgggtatttgattctaacatcttatttgcttttgtttatttccttctacatccaatcttacaagaaaggtggtaaaaagacagtcaagaaggaatctgaagtttccggctccgttgcatccggttcttctactggtgtcaagacctctaacaccaaggtctcttccaggaaagcttaa

SEQ ID NO: 25511 - DNA, 1047 bp, Saccharomyces cerevisiae
atgccaactctagtaaatggaccaagaagagactctaccgaagggtttgataccgatatcatcactcttcctagattcataatcgagcaccagaagcaatttaagaacgctactggtgatttcacattagtactgaatgccttgcaattcgcgttcaaatttgtatctcacaccatcagacgtgctgaattggttaacttggttgggttagcaggcgcttccaacttcactggtgaccagcaaaagaagttggacgttctaggtgatgaaatatttatcaatgccatgagggctagtgggatcatcaaggtccttgtatctgaagaacaggaagacttgatcgtttttcccacaaacacgggctcatacgcagtgtgttgtgatcctattgatggctcctcaaatttggacgccggtgtctccgttggaactatcgcgtctatattcagactgctaccagactcatcaggtactataaacgacgtactgagatgtggtaaagaaatggtagccgcttgctatgccatgtacggatcctctacgcatctagtattgacattgggtgatggagttgatgggtttaccttagacacaaacttgggcgaattcatcttgactcatcctaacttaagaattccgcctcaaaaggccatctactcaattaatgaaggtaacaccctctactggaacgagactataagaacatttattgagaaagtcaaacaaccccaagcagacaacaacaacaagcctttctcggctaggtatgttggatccatggttgctgatgttcacaggacgtttctttacggtggccttttcgcatacccttgcgacaagaagagccccaacggaaaactgaggttgctttatgaggccttcccaatggctttcttaatggaacaagcagggggaaaagcggtcaacgatcgcggagagagaatcttggatttggtgccaagtcatatccatgacaaatcttctatttggttgggttcttcaggtgaaattgacaaatttttagaccatattggcaagtcacagtag

SEQ ID NO: 25512 - DNA, 3345 bp, Saccharomyces cerevisiae
atgatttcgactacgattagtggtaaaagacctatagagcaggttgatgatgagctactttcactgactgcgcagcaggaaaacgaagagcagcagcagcagagaaaacgcagacgtcatcaatttgcccccatgacacagtttaacagcaatacactagatgaagacagcgggtttaggagctcctctgacgtggccacggcggatcaagataactttttggaagagtcaccttcaggatatattaagaaagtgatcttgcgaaactttatgtgccatgaacattttgaacttgagcttggttctaggctgaattttattgttggtaataatggtagtggtaaaagtgcaattttgaccgccattactattggtttgggagccaaggctagcgagactaacagaggttcctctttgaaggatttgattcgtgaaggttgttattctgctaaaatcatccttcatctggataatagcaagtatggtgcttatcagcaaggtatttttggtaacgaaattatagtagaaaggataattaagagagatgggcccgcttcttttagtttaaggtcggaaaacggcaaggaaattagcaataagaaaaaggatattcagacggtagtggactatttttctgttcctgtaagcaaccccatgtgtttcctgtcacaagacgctgctaggtctttcttaactgctagtacctcacaggataagtatagccattttatgaagggtactttacttcaagaaattaccgagaatttgctttacgccagtgctattcacgatagtgcacaagaaaatatggctctgcacctggagaatttgaagtctttgaaagctgaatacgaagatgccaaaaaactgttaagggaattaaatcagacttcagacttgaacgaaaggaaaatgcttttgcaagcgaaatcgttatggatcgatgttgcccataatacagatgcttgtaaaaatttagagaatgaaatcagtggcattcaacagaaagttgatgaagttactgagaaaattaggaataggcaagaaaagattgaaagatatacatctgatggtactactattgaagcgcaaattgatgcaaaggtcatttatgttaatgaaaaagatagtgagcatcaaaatgcaagggaactgttaagagatgtcaaaagcaggtttgaaaaggagaaaagcaaccaagcagaagcacaaagcaatatcgatcaaggtagaaaaaaagtagatgctttgaataaaacaattgcgcatttagaagaagaactcacgaaggaaatgggcggtgataaagatcagatgagacaggagcttgaacagttagaaaaagctaatgaaaaattgagagaggtaaacaattctttagttgtaagtttgcaagatgtgaagaatgaggaaagagacatccaacatgaacgtgagtctgaattgaggacaatttcacgcagcattcaaaacaaaaaagtggaattgcagaatattgctaagggtaatgatactttcttaatgaattttgatcgtaacatggatcggctcttaaggacaatagagcaaagaaaaaacgagttcgaaactccggcaattggacctctgggttcccttgtaacaattagaaaaggttttgagaagtggacacgttctattcaaagggctatttcatcttcgctaaatgcatttgttgtgtcgaatccaaaggataacaggttatttagagacattatgaggtcgtgtggcataagaagtaatatacccattgttacttattgcttgagtcaatttgattattcgaaaggtagagcgcatggaaattatccaactattgtggatgcactagaattttcaaagcctgaaattgaatgcttattcgttgatttaagtagaattgaaagaatagtgttaattgaagataaaaacgaagccagaaatttcttgcaacgaaatcccgtgaacgtgaatatggctttatcgctaagagatagacgtagtgggttccagctctctggcggatatcgactagatacggttacttatcaagataaaattagattaaaggtcaactcttcatccgacaatgggactcaatatttaaaggacttgattgaacaagagaccaaagaattacaaaatatacgggaccgttacgaggaaaagctaagtgaagtgaggtcaagattaaaggaaatagatggcagactcaagagtaccaaaaatgaaatgagaaaaactaattttaggatgacagaattaaaaatgaatgttggcaaagtagttgatactggtatattaaattcgaaaataaatgagaggaaaaatcaagaacaagccatcgccagttacgaagccgctaaagaagaattagggctgaaaattgagcaaattgcacaggaagctcagccaattaaagagcaatacgattctacgaaattagcattggtggaagcacaagatgaactgcaacaattaaaagaggacatcaacagtcgtcaatctaaaattcaaaaatacaaagatgataccatttactacgaggataaaaaaaaagtctacttagaaaatataaagaaaattgaagttaacgtagcagctttaaaagaaggtatacagaggcaaattcaaaatgcttgtgcattttgttcaaaagagcgaattgagaatgttgatttaccagatacacaagaggagattaagcgtgaattggataaagtctcgagaatgattcaaaaagctgaaaaaagcctaggattatcgcaagaggaagtcatcgcattatttgagaagtgtaggaataaatataaagaaggtcaaaagaagtacatggagatagacgaagcactgaacaggttacataattccctcaaagctcgtgatcaaaactataaaaatgcggaaaaagggacttgttttgatgcagatatggattttcgcgcatcattgaaagtaaggaagttctcgggaaacctttcctttattaaggataccaaaagtttagaaatatacatcttgactactaacgatgagaaggcaagaaacgttgacaccttgtctggtggtgaaaaatcgttttcccaaatggcgctgttattggctacatggaagccgatgcggtcaaggattattgcgttggacgaattcgacgttttcatggaccaggttaacaggaagattggtactactctcatagtgaaaaaactaaaggatattgccagaactcaaactattatcattactcctcaagatatcgggaaaattgcagatatcgatagttctggtgttagtatccacagaatgagagaccctgagagacagaataattccaatttttataattaa

SEQ ID NO: 25513 - DNA, 2967 bp, Saccharomyces cerevisiae
atgggcgtatctcttttagcttcttcttctgcatttgtaactaaaccactcctcactcaattggttcacctctcacctatcagtctcaatttcaccgtaagacgcttcaagccattcacgtgcttatcacgctattacacaacaaatccttataatatgacatccaattttaagacattcaatctggactttttaaagccggatttagacgaaagatcgtatcggtttattgagctacctaataagctgaaggctctgttgatccaggacccaaaagcagataaagcagcagcgtcgctagacgtcaatattggcgcctttgaagatccaaagaacctacctggattggcgcatttctgcgagcatcttttattcatgggctctgagaaatttccagacgaaaacgaatactcgagctatttaagcaagcacggtggttcatccaatgcctacacagcatcgcaaaacacaaattatttttttgaggttaatcaccaacatttatttggtgcgctagacaggttttcagggtttttctcttgtcctcttttcaacaaggactctactgataaagagatcaacgccgttaacagcgaaaacaaaaagaacttacagaatgatatttggagaatttaccaattagacaagtctttgaccaatacaaaacatccatatcacaaattttctacaggaaacatcgaaactttgggcacattgccaaaggaaaatggactaaatgttagagatgaactgttaaaattccataagaatttttactccgctaacctaatgaagctatgtattcttggtagagaagaccttgatactctctctgattggacttatgatctcttcaaggatgtagccaataacggtcgtgaagtacccctttatgcggaacctattatgcagcctgagcatttgcaaaaaataattcaagtccgtcctgtgaaagatttgaaaaaactagaaatctctttcactgtccctgatatggaggaacattgggagtccaagccaccgaggatattaagtcatttaatcggccatgaagggtccggttcattactagcacatttgaaaaaattgggctgggccaatgagctatctgctggtgggcatactgtgtccaaaggaaatgctttttttgctgtcgatatagatttaacagacaacgggttgacacactatcgcgatgttattgtcttgatcttccagtatattgaaatgttgaaaaactcactacctcaaaaatggatattcaatgaactgcaagatatctctaatgctaccttcaagtttaagcaagctggtagcccatcttccacagtttcatcattggcaaaatgcttggaaaaggattacattcctgttagcagaattttagccatgggtttgttaacgaaatatgaacctgatttgcttacccaatatacggacgctctggtcccggaaaattctcgtgttactctgatctcaaggagtttagaaacagattctgctgaaaaatggtatggtactgcgtataaagtggtagattatccggcagatttaataaaaaacatgaaatcgccaggtttgaaccctgctctgactttgccacgtccaaatgaattcgtttcaacaaatttcaaggttgataaaattgacggtataaaaccattagatgaacctgttttgttattatccgatgacgtcagcaaattatggtacaagaaggacgaccgattctggcaaccacgaggctacatttacttgtcttttaaacttccacatacgcatgcaagcatcattaatagtatgctttctacgctatacactcagctggccaacgatgccttgaaagatgtacaatatgatgctgcttgtgccgatcttcgtatatcattcaataaaactaatcaaggcctcgccattaccgcgtctgggttcaacgaaaaattgatcattctattaacaaggtttttacaaggcgttaattcattcgaacctaagaaggatcgttttgagattttgaaagataagaccatacgtcacttgaaaaaccttttatatgaagttccttattcacaaatgtcgaattactacaatgctataataaatgaacgttcttggtcaactgcagaaaaattacaagtctttgaaaaattgacctttgaacaattgatcaacttcatacccaccatttacgaaggcgtttattttgaaactttaatccacggaaacataaaacatgaagaagcattggaggtggattctctgatcaagtctttgattccaaacaacattcataatctgcaggtttctaacaaccggttgagatcctacttacttcctaaaggcaaaactttcagatatgaaactgctttgaaagactcccagaatgttaactcatgtattcaacatgtcacccagctagatgtctattcagaagacctatctgccctcagcggattatttgcgcaattgattcacgagccatgttttgataccttaagaacaaaagagcaattgggctacgttgtttttagttcgagtttgaacaatcacggtacagcgaacattaggatcttgattcagtcagaacataccacgccatatctagaatggagaataaacaatttttatgaaacttttggccaggttttgagggatatgccagaagaggactttgaaaaacacaaagaggcgttatgcaacagtctattgcaaaaattcaagaatatggccgaggaaagcgccagatacacagcagcaatttacttaggtgattacaatttcacacatcgtcaaaaaaaggctaagctcgttgctaacattacaaagcagcaaatgatagatttttatgagaattatataatgagcgagaacgcatcgaagttgattctacatttgaaatctcaagtggaaacaaagagctcaatgaaaatgaattggacaccgctaagtatccaactggccagttga

SEQ ID NO: 25514 - DNA, 2343 bp, Saccharomyces cerevisiae
atggctcctaaatctagttcttccggttccaaaaagaaatcatcggcaagttctaatagtgctgatgcaaaagcatccaaatttaaattgcctgctgaatttattaccagaccacatccttctaaagatcatggcaaggaaacatgcacagcatatattcatcctaacgtattatcctcgcttgagataaatccgggatcattttgtactgtcggtaagataggcgaaaatggtattttagtaatagctagagcgggtgatgaagaagtacatcctgttaatgttatcaccctttccacaactatacgatctgttgggaaccttatccttggtgatcgtctagaattaaagaaagcccaggtgcaaccaccttatgccactaaggttaccgtggggtccttacaaggatataatattttggaatgtatggaggaaaaagtaattcaaaagctactggatgatagtggcgttataatgcctggaatgatttttcaaaacttaaaaacaaaagcaggtgatgaaagcattgatgtcgtaattacagatgcgagcgatgattcgcttcccgacgtcagccaactagatcttaacatggacgatatgtacggtggattagataacctgttttatctatctccaccttttatattcagaaaaggctccacacatataactttttcgaaagaaacccaggcaaatcgtaaatacaatcttccggagcccttatcctatgcagcagtgggcggcttagacaaggagattgaatcactgaaaagtgctattgaaatacctcttcatcaaccgacgctatttagtagctttggtgtttctccccctcgaggtatacttcttcacggacccccaggtactggtaaaactatgcttttgagagttgtagcaaatacgtccaacgcacacgtcctaaccattaatggcccctcaatcgtctccaaatatcttggtgaaacggaagcggcattaagagatatttttaatgaagcaaggaagtaccagccttccattattttcattgacgaaattgattcaatagcaccaaatagagcaaacgatgactccggtgaagttgagagcagagtcgtggctacattgcttaccctaatggatggcatgggcgctgcaggtaaagtggtggtaattgctgctacaaacaggcctaattctgtcgaccctgctctcaggagacctggcaggtttgaccaagaagtagaaattggtataccagacgttgatgccagatttgacattttaactaagcaattctcaagaatgtcctcggatcgtcacgtattagattctgaagcgatcaagtacattgcttctaaaacgcatggctatgttggtgctgatttaactgctctctgcagagaatcagttatgaagacgatacaacgaggactaggaacagacgccaatattgacaagttttccctaaaagttacattgaaagatgtggagagcgccatggttgatatcagacccagcgcaatgagagaaatcttcttagaaatgccaaaagtttattggtctgacattggcggccaagaagagcttaaaacaaagatgaaagaaatgatacagttgcctttggaggcttcggagacttttgccaggctgggaatttctgcaccaaaaggtgtattactttacgggccgccaggttgctccaagacattaaccgcaaaagctctcgctacagaatcgggtatcaacttcttagctgtgaaagggcctgaaatttttaacaagtatgtaggggaatccgaaagagctataagagaaattttccgcaaagcacgctctgcagctccaagtattatcttctttgatgaaatcgatgcattatctcctgatagagacgggagttccacctctgcagctaatcacgtgctcacatctttactcaatgagattgatggtgttgaagagttaaagggtgtagttattgtagcggcgacgaatagacctgatgaaatagatgctgctcttctaaggcctggtaggttagatagacacatttacgttggccctccagacgtaaacgcccgcttggaaatcttaaagaagtgcacaaagaaatttaatacagaagagtctggagtcgatcttcatgaattggcagaccgtacagaaggttattccggagctgaagttgtgctgctttgtcaagaagcgggcttggctgccataatggaagatttagatgtcgcaaaagtggaattacgtcattttgagaaagcttttaaaggaattgctaggggcattactccagaaatgctctcttattatgaagagtttgctctaagaagcggttcatcttcgtaa

SEQ ID NO: 25515 - DNA, 3864 bp, Saccharomyces cerevisiae
atgtctgagggattcagtagcagttccatacaggaattatatcaatcgttaaaagaaatcactaacaacgcagacgtagagcttttcgaagatcgcattactaaattagattttgagagcaccgatgaaccaaagcatgcaaatgatatcataaaggatagatttttgagaccttctaatgctcttccttggagcttgttggacatggtccaagacgttccacatacgtcttctccagaagattgctctggtaaactagattacaaggaattgctgaaagtcccggacccaattaatagaacatcataccagtttaaaagaactgggttagaaggtaaaatttcaggctacaaagaagaggttgatttgaaggaagttgcaaatgccaatgcatcaaattcactgtcgattacgagaagtatcaaccataaccaaaactcagtaaggggttctacagcgcaattgcctttcacaccaggcggaattcccatgaaatctgtcaagacagattcagaacaaaatggatcttctacaatggccaacgctactaaattgttacacaaggatggtcaaggtttattcgatattccagagggtatgaatagaggcattaagccgatggattctccagctgaaaatgaggatcaaaacggacagttcaaagaattgaaacagctaaatgagatagataatgaattagacataaggattgaggcgaacgaggcaaagttaaaagaggaggaaaaatctgccaagtcaatttctgaagaaattatggaggaagccactgaagaaacgactgccgataatgctgatgatgccgaaatcgatgaactattaccaattggaatagactttggcagaactaaaccagtttcgaaaagtgttcctgttaaaaaggaatgggcccatgttgttgatttgaaccataagatcgaaaatttcgatgagttgattccaaaccccgctagatcgtggccttttgaattggatacatttcaaaaggaagccgtctatcatctcgaacaaggtgattccgtatttgttgccgcccacacatctgctggtaaaactgttgttgcagaatacgcaattgccatggcacatagaaacatgactaaaactatatatacatcacccattaaagccttatccaatcaaaaattccgagactttaaagaaacttttgacgatgttaatattgggttgattactggtgatgtgcaaattaatccggatgctaactgtttgattatgacgaccgaaattttaagatcaatgctttatagaggtgccgatttgatcagagatgtagagtttgtcattttcgatgaagttcactacgttaatgatcaagaccgtggtgttgtctgggaagaagttattattatgcttccacagcatgtcaagtttatcttattatctgccaccgttcctaacacttatgagtttgctaattggattggaagaactaagcaaaaaaatatttatgtcatttccacaccaaaaagacccgttccattggaaataaatatatgggctaaaaaggaactgataccggttattaatcaaaattcagaatttttagaagctaatttcaggaaacataaagagattctaaatggggagagtgcaaaaggggctccttcaaaaactgacaacgggagaggtggatccacagcaagagggggccgtggtggatccaatactcgagatggaagaggaggccgtggtaattcaacacgtggaggtgccaaccgtggaggttcaagaggtgctggcgcaattggctccaacaagcgtaagtttttcactcaagatggtccttcgaaaaaaacatggcccgaaattgtcaattacctaaggaaaagagagcttctaccaatggttgttttcgtatttagtaaaaagaggtgcgaggaatatgctgactggttggagggaattaacttctgcaacaataaggaaaaatcacaaatccacatgtttattgagaagtcgattactcgtttgaaaaaagaggatagagatttgcctcaaattcttaaaaccagatcattacttgaacgtggtatagctgttcatcatggggggctattgcccattgtcaaggagttgatcgaaatattattttccaagggttttatcaaagttttatttgcaacagaaacttttgccatgggtttgaaccttcccacaagaacagttatctttagcagcatccgtaaacatgatggtaatggattaagagaactgactccaggtgagtttacccaaatggctggtagagctggtagaaggggcttggattccactggtacagtcattgtgatggcatataatagtcctttatctattgctacgttcaaagaagtaacgatgggtgttccgacgaggttgcagtctcagtttagattaacatacaatatgatattaaatcttttaagaattgaggcgttgagagttgaagaaatgatcaagtattcttttagtgagaatgccaaagaaactttacaacctgaacatgaaaaacaaatcaaagtattacaagaggaattacaaaccatagagtacaaaagttgtgaaatctgtgataatgatatcgaaaagtttttggaattgatgctggcatataaggaggcaacagtcaacctaatgcaagaaatggttaaatcgccttcgatattgcatatcttgaaagagggcagactcgttgcttttagggaccccaatgattgcttgaaattaggatttgtatttaaagtttctctgaaggatgctgtttgtgtcattatgacgttcacaaaaccatacaaactcccaaatggtgagccaaatcatttaatatactttccaaaagcggatggatacagaagaaggaacttccctaaattccagaagactgatttttatatggaagaagttcctgtgacggctattgaagtgatcactaaacgcaagtttgccgcacccttgggaaaagtgattaaaaaggatgttgccgctttgaacgagtttaacgctgaaacaaataacattttggacggcaaaacgctaaaagaagcaattaacattgaaaagcaaggtttaaaaattcaccaaatattgttagaccgtacaaatataagggatgagatattcaaactaaaaagcattaaatgtcccaacctaagccaacacattgttcccaagtttaaggcgcatgtaattaaaaagaaaattgaagaattgtaccatttgatgtctgaccaaaatctgagcttactacccgattatgaaaagagattggctgttctgaaagacactgaatttatcgaccaaaaccacaacgtgctgttaaaaggtagagtggcatgtgaaattaattctggttatgagttagttttaactgaattaattttagacaactttttaggaagctttgaacctgaagagattgtagccttattatcagtatttgtttatgaggggaaaaccagggaagaggagcctcctattgtcacaccaaggctagcaaagggtaaacaaagaattgaggaaatttacaagaaaatgctttgtgttttcaatacgcatcagattccattaactcaggatgaagctgagtttttggacagaaaaaggtttgccatgatgaatgtggtgtatgagtgggcccgtggtttatcattcaaagaaatcatggaaatgagccccgaggctgaaggtactgtagtcagagttatcacttggctagacgaaatttgccgcgaagttaagactgcctctattattattggtaattccacattacatatgaagatgagcagggctcaagagttgattaagagagatattgttttcgccgcaagtttgtatttatag

SEQ ID NO: 25516 - DNA, 2061 bp, Saccharomyces cerevisiae
atgaccgatatcacacccgtacagaacgatgtggatgtcaatggtaataatgtcaatgacgacgtttccagtaatctaaagaggcctatagatcaaggggatccttcgaatggactcgcagaagaagaaaaccccgccaataaccagttgcatctcaaaaaggctagactggatggagatgctctaacatcatcgcctgctggacttgcagagaacggtattgaaggcgccaccctggcggctaacggggaaaatgggtataacgccaccggaagtggcgcagaagacgaacagcaggggttgaagaaggaagaaggaggacaaggtaccaaacaagaggatttagatgaaaactcaaaacaagaacttccgatggaggttccaaaggaacctgcccctgctcctcctccagagcccgatatgaataatctccctcagaatccaataccaaagcaccagcagaaacatgcattgcttgcgattaaagctgtcaaacgcttgaaggatgcgagaccctttctacaacctgttgacccagtgaaattggatattcccttttactttaactacataaagaggccaatggacttgtctactatagagaggaagttgaacgtaggcgcttatgaagttccggagcaaatcacggaggatttcaatctcatggttaacaacagtattaaattcaacggtccaaatgcgggcatatcacaaatggcaagaaacatacaagcttctttcgagaaacatatgctaaatatgcctgctaaggatgctccacctgtaatagccaagggacggcggtctagtgcccaagaggatgccccaattgtaattagacgagcccaaactcataatgggaggccgaaaaggactatacatccgccgaaatcaaaggatatttatccttatgaatcgaagaaaccgaaatccaaaagactacaacaagcaatgaaattttgtcagagtgtgctaaaggaattgatggccaagaagcacgcctcttataactacccatttttggaaccagtagacccagtttctatgaatttgccgacttatttcgattatgttaaagagccaatggatttaggcacaatcgccaagaaattaaatgactggcagtatcaaacaatggaggattttgagagagacgtgaggttggtctttaaaaactgctacacgttcaatccggatggcacgatcgttaatatgatgggtcatcgtctagaggaagttttcaattccaaatgggcggataggcctaatttggatgactacgattccgatgaagattcgaggacccaaggcgactacgacgattatgaatctgagtattcagagtctgacatcgatgaaactataattacaaatccagccatccagtatttggaagaacaacttgctcggatgaaagtggagttgcaacaattaaaaaagcaagaactggaaaaaataagaaaagagaggcgcttagcacgtggatcaaagaaacgcggcaaaagatcgaagggaaggagtgggtctaagaacgcttcttcgaaaggaaggcgagataaaaagaataaattgaaaacagtagtgacatatgatatgaaacgtatcattacagagaggatcaatgatttaccaacttccaaattagaaagagcaatcgacataataaaaaaatccatgcccaatatttctgaagacgatgaagtagaacttgacctcgacactttagataatcacaccatcttaacattgtacaacactttctttagacaatatgaaagctcatccggtgcttctaacggtttggacggtacttcaggtgttacgcgagatgcttcgtccttgtcgcctacaagtgcgggaagcagaaagagaagatctaaggcattaagccaagaggagcagagtaggcagatagaaaagataaaaaataaactagctatcttagacagtgcttcacctctgagccaaaacggctccccaggccaaattcaaagcgctgcacacaacgggttttcctcatcttcagatgacgatgttagcagcgaaagtgaagaagagtga

SEQ ID NO: 25517 - DNA, 6696 bp, Saccharomyces cerevisiae
atgaattccaacaatcctgataataataatagcaacaacattaataataataataaggataaggatattgcccccaatagcgatgttcagctagctaccgtctataccaaggcaaagtcttacattcctcagattgaacaagtttatcaaggcacaaatccaaatattcaagaggcaaaattattaggggagttattacaagttctagcagaagttcccaagggtacgcatttattttgcgaccccatacttgaaccaatatcaattttttccctaaccattttctcattcaatgaagaagctacggccacatggctgaagaatcattttaatccaattctctctgtttgtgataaatgcattctaaattttgcgagagggaagtgcaaaatgttacaacattttgccattcaaagacatgtgccgcatgaacatgtagccaagtttaatgacatcgtatgccaatggagggtggaggctgtttttcctattcttagaaatatttccgttaacgataatacgggaattaacattacaaatgaaattgaaactgcaatgtacgagtgtctctgtaatccgcatatgttgaggcttaacaagcaacttaaggctactttcgaagcaatcttcaaatttttctacgacacaaagcatcgtttgttggacgttacgaatccattaagcataaaaacctttatatcaggtgtcatattttgctggtgtgaaggttcaaaagaggaaaatgagtggtcacgagcttttctaaaggatttatactcaagaaatttccatataaatctttctaacctgacaccggatattattgaggaagtttatatccatattttattcttacagaatccggcaaactggacagagattgtggtatctcaattctggtcgagattactaccggttttcaatttatttgataaagacgtcttcatagagtactttcaggtcccaaaaaatgtggaatctttaaaaaaaacattcaaatttccgttagagccaatttttaaaatgtggtacaatcacttaagcaaatcatatcatgataagccactagactttttgttaagaggattaacaatgttcttgaataaatttggctccgagttttggtccaaaattgaacccttcacattccatagcattttggatataattttcaatagagattcattcccaatcaaactaatcaaaattcaagacaatccaattgttgagcatcaaacagaagtttactttcaacttaccggttctgtaaccgatttactttcttggaccttaccattttatcatgcactgtcaccatccaaaagaattcaaatggttagaaaggtctcaatggcgttcctgcgtataatagccaattatccatccctaaaatccattcccaaagcttgtttaatgaattcagcaactgccttgttgagggctgtgttgactattaaggaaaatgaaagggcaatgctttataagaatgatgaatttgaaacagtactgttgactaaaacagattctagagctttgctcaacaatcctttgatccaagacataataattagatcagcttcgaatcctaacgacttttatcctgggctaggtgctgcttctgcatcggtggccacatccacgatgatggtattggcagaatgtatcgattttgatatactgttattatgtcatcgaacgtttaagctttattcaggtaaaccaattagcgaaattccaatttcaaccaacgtcttggaaaatgttacaaataaaattgacctgagatcttttcatgacggtccattgctggccaaacagctgctagtatctttaaaaaatattaatggtcttttgatagtaccgtcaaatactgccgtagctgaggcacacaacgcattgaatcagaagtttttgctgctatcaacgagattaatggaaaaatttgcggatattttgcccggtcaactgtctaaaatccttgcggatgaagatgcatcgcagggtttttggtcctgcatattctcctctgataaacacttgtatcaagcagctactaatattttatacaatacatttgacgttgagggtagactggaaggtatcttagcgattctgaatagtaatttgaccgttaacttgaagaatataaacgtgatgctacaaagattaatcaattgtgaattctatgagccttgcccccgtgctgttcgtgttttgatggacgtagtgagtgcatttgtagacccgatttctggtgtgtttgctaatttccaaactttgaagagccaaaataccgaaaaggaatttttaaaattctgggaatcatgttggttattcttggatacgatttataagtttactttgaaatgggcttctaaatatgactattctgaactggaaaatttcaccaaagatactttagatctaagtcgctctttggtggactcctttagagaattttcagatattcttcatgaccaaacgaaaaatttacttctcaacgttttagaaacctttaagaatatgttgtattggctgagattgagcgacgaagtacttttggaatcttgtgttagattaattataagcacgtctgatttagcacatgaaaagcatgtgaaagtggatgattccttggtagaaatgatggccaagtacgcctcgaaggcaaagagattttcaaataagttgacggagcaacaggcgagtgagattctacaaaaggctaaaatattcaataaagcactcacggaagaggtcgctacagaagctgaaaactacagaaaagaaaaggaattatcaagacttgggaaggtgatcgacttaacggattctgtgccggcgtcaccatccctctcgccctctctgtcttcaaccattgctagttcttctgctgaatccagggcagactatttacaaagaaaagctttatcttcttcaataactgggagaccaagagtagctcagcctaaaataacatcttttggtacgttccaatcatcagctaatgctaaactgcatcgtacaaaacctgttaagcctttatccaaaatggaattagctaggatgcaattattaaacaacagagttgttcatccacctagtgcgccagctttccatacaaagagtaggggtttgtctaacaaaaacgacgatagcagtagtgaggagagtgacaacgatatagaaagcgctcgggagctttttgctattgctaaggcaaaaggcaaaggaatacaaactgtcgatattaatggtaaggttgtcaagagacaaactgcggctgaattggctaaacaggagttagaacatatgagaaagagattaaatgttgatatgaaccctctatatgaaatcatattgcaatgggattacaccagaaatagtgaatatcctgatgatgagcctattggtaattattctgacgtaaaggatttcttcaactctcctgctgactaccaaaaagtcatgaagcctttactacttctagaatcttggcaaggtctatgttcttcacgtgatagagaggactataaacctttcagtattattgtaggaaatcgaactgctgtgtcagatttctatgatgtgtatgcctctgtcgctaaacaagtcatacaggattgtggtatttctgaatctgacttaattgtaatggcttatttacccgattttcgaccagacaaaaggttgtccagtgatgatttcaagaaagcacaacatacatgtttagcaaaggtgagaacattgaaaaataccaaaggtggtaatgttgatgtcacattacgaattcatagaaatcattctttcagtaaatttttgacactaagatcagagatatattgtgtgaaggttatgcaaatgacgactattgaaagagagtattcaacactggaagggctggaatactatgacttagttggccaaattctacaggctaaaccatcgcctcccgtaaatgtggatgcggcagaaattgaaacagttaagaaaagctataagctcaatacgtcgcaggctgaggccatcgttaattcggtatctaaagaaggtttttctttaattcagggtccacctggtacgggtaaaacaaagactatactgggtattattggttactttttgtctacaaagaatgcctcatcttcaaatgtcatcaaagtgccactagaaaagaactcatcgaatactgaacaactgttaaaaaagcaaaaaattctaatctgtgcccccagtaatgccgctgtggacgaaatctgcctcagactgaagagtggagtgtatgacaagcaggggcatcaatttaaacctcaattggtccgtgtaggtaggtcagacgttgtaaacgttgcaattaaggaccttactttagaagaacttgtggataaaaggataggtgaaaggaattacgaaatcagaacagatccggaactagaacgtaaatttaataatgctgtgactaaaagaagagaattgagaggaaaattagactctgagagtggtaatccagaaagtccaatgtcaaccgaagatatcagtaaattacaacttaagattagggagctaagtaaaataatcaatgaacttggccgtgatagggacgaaatgcgtgagaagaattccgtaaattataggaatagggatttggatagaaggaatgcacaggcccatatcttggcggttagtgacatcatatgttcgactttatctggttcagcccatgatgtactcgcaacaatgggtattaaatttgatacggtcattatagatgaagcatgtcaatgtaccgaactttcttcaattattcctctcaggtatggagggaagcgttgtattatggttggtgatcctaaccaactaccaccaactgttctttcaggtgcagcaagcaattttaaatacaatcagtcactgttcgttagaatggagaaaaatagctccccatacttgctggatgttcaataccgtatgcatccttccatcagtaaattcccctcttctgaattttatcagggacgactaaaagacggccctggtatggatatcttgaacaaaagaccctggcaccagcttgagccattagctccctacaaattttttgacatcattagtggtaggcaagaacaaaatgcgaagactatgtcttatacaaatatggaggaaatacgtgttgccattgagttagttgactaccttttcagaaaattcgataataaaattgatttcacgggaaaaatcggtataatttcaccttatagagagcaaatgcaaaaaatgcgtaaagagtttgcccgctattttggaggcatgatcaacaaatcaatcgatttcaatacaatcgacggtttccaaggtcaagaaaaagaaatcatcttgatatcgtgtgtccgtgccgatgatacgaaatctagtgtcggttttttaaaggactttcgtcgtatgaatgtggctctgactagagccaagacaagtatttgggttttgggacatcaaaggtctctggctaaaagcaagttatggagagatttgattgaagatgcaaaagatagaagttgtcttgcatatgcttgctcgggtttcctggatcccagaaataatagagctcaaagtattttaagaaagttcaatgtacccgtaccatcagagcaagaagatgattataagctacccatggaatatattacgcaaggccccgatgaggtaaaatccaataaggacacaaagaagagaagagttgtcgatgaaggtgaagaggcagataaagctgtaaagaaaaagaagaaagagaagaagaaggaaaagaaaaagtccaaggcagatgataagaaaaagaataacaagaaggcagaatcgcccagcacctcatctggtacaaagaaaaagtcatccatttttggtggaatgagtgtaccgagtgccgtagttcctaaaacttttcctgatgtggacagcaacaaaaaggcagcagcagttgttggtaaaaagaaaaataacaaacacgtttgtttttcggatgatgttagtttcataccaagaaatgacgaacctgaaattaaagtgaccagaagtttatcctctgtattgaaggaaaagcagttaggtttgaaggagacgagaacaatttctccgcctgaaatcagtaataatgaggatgatgatgacgaagatgattatacgccgtcaatctccgattcttcattaatgaaaagtgaagcaaatggtcgtaacaacagggtggcttctcataaccaaaatttcagcgctagtatatacgacgatccacaagtttcgcaagcaaagcagacgcaggtacctgctgctattacaaaacacagaagttcaaatagtgttttatccggtggttcttcgaggatcctgactgcttccgattacggtgaacccaatcaaaatggacagaatggagcaaataggaccctctctcaacatgtgggtaatgcgaatcaatactcaacggctcctgtgggtacaggcgaactgcatgaaactctgcccgcccatccgcaagacagctatcctgctgaggcagaagatccatatgatttaaacccccatccgcaaccacaatcttcagcattcaaaggacctggtagtgggcccacaggcacacgcaacagttcgagacggaatgcttcatctagcccatttatcccaaaaaaaagaaagcctagatcatga

SEQ ID NO: 25518 - DNA, 1662 bp, Saccharomyces cerevisiae
atgtcgaaagacttgaattcttcacgcatcaaaatcattaaacctaatgactcttacataaaggttgaccggaaaaaagatttaacaaaatacgaattagaaaacggtaaagtaatttctactaaggaccgacctatcgcttctgtacctgccataacaggaaagataccaagtgatgaggaagtattcgactccaagacgggattacctaatcattcctttttaagagagcatttctttcatgagggtcgactttctaaggaacaggccataaaaatcttaaatatgtcaactgtagcattgagtaaagaacccaatctactaaaactcaaagcgccaattactatatgtggtgatattcacgggcagtattatgatttattgaaactgtttgaagttggcggtgaccccgccgaaatcgactatttattcttgggggattatgttgatagaggtgcattctcttttgagtgtctgatttatttgtactccttgaagttgaataatttagggagattttggatgctaagaggtaaccatgagtgtaagcacttgacctcttattttacttttaagaatgagatgttgcacaaatacgatatggaagtttacgatgcttgctgcagatcattcaatgtcttaccattagcagctttaatgaacggacaatatttttgtgtgcatggtggtatctctccagagttaaaatcagtagaggatgttaataaaattaatagatttcgagaaatcccatctcgtggtctcatgtgtgacctactatgggccgatcctgtcgaaaattatgatgatgcaagagatggtagcgaatttgatcagagcgaggatgaattcgtacctaacagtttgaggggttgctctttcgccttcacttttaaagcatcatgcaagtttttgaaggcaaatggtttgttatctattattagagcacacgaagcacaggatgctgggtacagaatgtataaaaacaataaagtaacaggcttcccgagcttaataaccatgttcagtgcgccaaactacctggacacatatcataataaagctgctgtgttaaaatatgaagaaaacgtcatgaacatcaggcagtttcacatgtctccgcacccttactggttgcctgattttatggatgttttcacctggtcactaccttttgttggcgaaaaagttactagcatgttagtgtctatattaaacatatgtagtgagcaggaacttgacccagaatcggaacccaaagctgcggaggagactgtaaaggcaagagcaaacgcaactaaggagaccggcaccccatctgatgaaaaggcgtcatcagcgatattagaagatgaaacccgaagaaaggctttgagaaataagatattagctattgctaaagtttcaagaatgttttcggtgctaagagaagagagcgaaaaagtggaatatttgaaaactatgaatgccggtgtcttacctcgtggtgctctagctcgtgggactgaaggtttgaatgaaacgctaagcacttttgaaaaggctagaaaggaagaccttattaatgaaaaattaccaccatctttatcggaggttgaacaagagaagattaaatactacgaaaaaatattaaagggagcggagaaaaagccacaactgtga

SEQ ID NO: 25519 - DNA, 1275 bp, Saccharomyces cerevisiae
atgtccgaagctaccctctcctccaagcaaaccattgaatgggaaaacaaatactccgcccacaactaccaccccttgcccgtcgtttttcacaaggctaagggcgcacatgtgtgggacccggagggtaagctgtacctcgacttcctgagcgcttattctgccgtcaaccagggccattgccatcctcacatcatcaaggctttgacggagcaagcacaaacactaacattgtcctccagagcgttccacaacgatgtttacgcgcaattcgccaagttcgtgaccgaattcttcgggttcgaaaccgttttgcccatgaacaccggtgcagaagccgtggaaactgctttgaagttggccagaagatgggggtacatgaagaagaacatccctcaagataaagccatcattctgggtgccgagggtaacttccacgggagaaccttcggtgctatcagtttgagtaccgactacgaggactccaagttgcatttcgggcctttcgtgcctaacgttgccagtggtcactccgtgcacaagatcagatacggccacgcagaagatttcgtccctatcttggaatctcctgaaggtaagaacgttgccgccatcattctagagccaattcagggtgaagccggtatcgtcgtgccccccgcagactacttcccaaaggtctccgcattatgccgtaagcacaacgtcctattgatcgttgacgaaattcaaaccggtatcggtagaaccggtgagttgctttgctacgaccactacaaggcagaggccaagcctgatattgttttgttaggtaaggctctctcaggtggtgttcttcccgtctcatgtgttctgtcttctcacgacatcatgtcttgctttaccccaggatctcacggttctactttcggcggtaatcctttggcttcccgcgttgccatcgccgccctcgaggtcatccgcgacgagaagctgtgccaaagagccgcccaactgggtagctctttcatcgcccaattgaaagctctccaagccaaatctaacggtataatctctgaggtgcgtggtatgggactgcttaccgccatcgtaatcgacccatccaaggccaatggtaagaccgcttgggacttgtgtctattgatgaaggatcacggcctcttggctaagcccacccacgaccacatcatcagattggctcctcctttggtcatctccgaagaggacttgcaaaccggtgtcgaaaccattgccaagtgtatcgatctgttataa

SEQ ID NO: 25520 - DNA, 2937 bp, Saccharomyces cerevisiae
atggctaaaacattgaaagatttggacggttggcaagttatcattacagatgatcaggggagggttattgacgacaacaatagaagaagatcaagaaaaagaggaggagaaaacgtatttctgaaaagaatttctgatggattgagttttgggaagggtgagagcgtgatatttaatgataatgtgacggaaacatattctgtctacttgatccatgagatcagactcaatacacttaataatgttgtggagatttgggttttttcttacttgagatggtttgaactcaaaccaaaactgtactacgaacaattcaggccagatctaataaaggaagatcatcctttagaattttacaaagataaatttttcaacgaagtaaataagagcgagttatatttaactgctgagctatcagagatttggcttaaggatttcattgcagttggacagatactgccagagtcacaatggaatgatagtagtatcgataaaatagaggatagagattttctagtacgttatgcatgcgaacctactgcggaaaagtttgtaccaattgatatttttcaaatcataagaagagtaaaggaaatggaacccaaacaatctgatgaatacttgaaaagagtatctgtaccagtgagtgggcagaagacaaatagacaggtgatgcataagatgggagttgaaagatcttcaaaaagactagcaaagaaaccttcaatgaaaaaaattaaaatcgagccctctgcagatgatgacgtaaataatggaaatataccgtctcagcgaggaacgtcaacaactcatggttcaatttctccccaagaagagtctgtttcccctaacatctcatcggcgtccccttctgcgctcacatcacctacagattcttcgaaaattttacaaaaaagatctatatcaaaggaactaattgtttcagaggaaataccaataaactcttcagaacaggaatccgattatgagccaaacaatgaaacatctgtgctttcaagtaaacctgggtcaaagccagagaagacatctacagaactcgttgacggccgagagaattttgtatatgcaaataatccagaagtgagtgatgatggtgggcttgaagaggaaacagatgaagttagttcagaaagttctgatgaagcaataataccagtaaataaaagacgtggcgctcacggaagcgaattgagcagtaaaattagaaaaatccacattcaagaaacacaagaattttctaaaaattacactacagaaacagataacgaaatgaacggaaatggaaaacctggaattcccaggggcaacaccaaaattcatagtatgaacgaaaatcctacaccagaaaaaggtaatgcaaagatgattgatttcgctactttgtcaaagttgaaaaaaaaatatcagataattttagaccggtttgcaccagataatcaagtaacagattcctcccaattgaacaaattaacagacgaacagtcaagcttggacgttgcaggccttgaggataagtttagaaaagcatgctcttcatctggaagagaaaccattctgtcaaattttaacgctgatataaatttagaggaatcaattagagaatctttacaaaagagagaactactaaaatcacaagtggaggattttacaagaatattccttccgatttacgacagtttgatgtcttcccaaaataaactattttatattaccaatgcagatgattctactaaattccagcttgtgaatgatgtaatggatgagttgatcacctcttcggcccgaaaggaactacctattttcgattacattcatattgatgccttggaactggcaggaatggatgcattatatgagaaaatatggttcgccatttctaaagaaaatctatgcggtgatatatcactagaggccttaaacttctatattacaaatgtcccgaaagcaaaaaagagaaagacactaatattaatacaaaatccggaaaatctattgagtgagaagattttacaatatttcgagaaatggatttcttcgaaaaattcaaaattgtctatcatttgcgttggcggacataatgtgacgattagagagcaaataaatataatgccctccctcaaagcacactttaccgaaatcaaacttaataaggtggacaagaatgaattgcaacaaatgatcatcacgcgactcaaatctttattgaaaccttttcatgtcaaagtaaatgataagaaggaaatgactatttacaataatattcgcgaaggacagaaccagaaaataccagataatgtgatagtaatcaatcataagatcaacaacaaaatcactcaacttattgcaaagaacgtagccaacgtaagtggtagtactgaaaaagcattcaaaatatgtgaagctgccgtagaaatttctaaaaaagacttcgtacggaaaggtggtctacaaaagggtaaattggtagtgtcacaggagatggtaccacgctatttctcagaagctattaacggattcaaggatgaaactatttcaaagaagattataggaatgtctctgttgatgagaacatttttatataccctggcgcaagaaaccgaaggcacgaatcgtcatacgcttgctctggagaccgtcctgattaagatggtgaagatgttgcgggacaacccagggtacaaggcgtcaaaagaaattaagaaggtcatatgcggtgcctgggagcccgcaataactatagagaaactaaagcaattttcttggataagtgtagtgaatgatttagtgggagaaaaattagttgttgtggtgctcgaggagcccagtgcaagcattatggtagaactaaaacttcctttagaaataaattacgccttttcgatggatgaagaattcaaaaatatggactgcatttga

SEQ ID NO: 25521 - DNA, 1302 bp, Saccharomyces cerevisiae
atgacaattgaaagcactctagctcgggaattagaaagcttgattttacccgctgattccatagtgaatgtagttgaccaattccaagaggagttgttatcacggcttcagacaaatacgatttctatgctcccgcagtgtttagtcccagataaacgatcgcgatggaaccctgaagacaaaattctgaccattgatttcggcgggacaagactgaaatttgcaattatctctctgccccaaatcgttatcgaatacaatgatgccttcgaacttacctacaacatcgttgattcgaatttctttaatcaaatcatctatacaatatgtaccaggctggctgcaaatggttatataaaaaaaaagaacgagtcatctgaggcgtctaaattttttgtttccgtgacattcagttttcctctaaatccagaaggggaggtagttgcaatgggaaaaggatttgtgatgactgacacccttcaaggatccacggtgaaacagctcatccaatcttcctttcaccggattatatcagaaaatatcgaagaatttttctgtaccatgaacgtgtgtcatgtaataaacgatgcaattgcagtttcactaacaagcaaatttatatgcgaaaacgattccatctcattaataataggaactggtacaaatgcatgttttgaggttccatacggatatttaccacctttcaagagagatgccctgagagaaacattaccgtcaagctataataaggagacattaaatttcaaacatgttctcattaattctgaaattggctttattggtaaaaatgtcattgcattgcaaccgtttgacattcatggagcaatctcatacgaaatgccactagagtgcgttacttctggtaaatggcttcccctatcattaaaaaatattctattgcaatataacataatccccaaaaacttcccagtagagttcaatggggaactggtatgccagctggcagaagactgtactaatgcttggttcgaaaacgaacattatgcactaatttgtcagatcgcacgactattaatcaagagagccgcattttatgttgctgcaattgtacaagctattgatatcatcacaggctgcaaaaactataactttattcatattggctacgttggatcctttctccacaattcaaatttttatcgagagcagataaaatattactccagcatacatattaagttgcaattcttaaatcacagtaatcttctaggcgctgcaatagccacctacttgaacaaatcagacaaccaagttcaataa

SEQ ID NO: 25522 - DNA, 1038 bp, Saccharomyces cerevisiae
atggaaggcgtgtatttcaatattgacaatgggtttattgaaggtgtagtgagaggctacagaaatgggttgttatctaataaccaatacatcaacttaacacaatgtgacacgttggaagatctaaaattacaattatcatcaactgattatggtaattttctttcctctgtttcctcagagtctttgaccacgtcattgattcaagaatatgcttctagcaagttgtaccacgaattcaactacataagagaccaatccagtggatccacgagaaagttcatggactatatcacttatggttacatgatcgacaatgtagcattgatgattacaggtactattcatgatcgtgataagggtgaaattttacaacgttgtcatccgctaggttggtttgatactttgcctacgttgagtgttgctactgatcttgaatccctatacgaaaccgtattggtggataccccactggcaccttacttcaaaaactgttttgacacggcagaggagctagacgatatgaacattgaaattattagaaataagctgtacaaggcttatttagaagacttttacaattttgtcactgaagaaattccggaacctgctaaagaatgtatgcaaacattactagggtttgaagctgacagaagaagtatcaatattgcactcaactctttgcaaagttcagatattgacccagatttgaaaagtgacttgttacctaacataggtaagttgtaccctcttgcaacgtttcacttggcgcaagcccaagatttcgaaggagttagagctgctttagctaacgtctatgagtataggggatttttggagactggtaacttagaagatcacttttaccaattggaaatggaactatgtagagatgctttcacgcaacaatttgccatcagcactgtttgggcctggatgaaatccaaggaacaagaagttaggaatattacctggattgcagaatgtatcgcacaaaaccaaagagaaagaatcaacaattatatttccgtttattga

SEQ ID NO: 25523 - DNA, 3138 bp, Saccharomyces cerevisiae
atgtcacttcccttaaaaacgatagtacatttggtaaagccctttgcttgcactgctaggtttagtgcgagatacccaatccacgtcattgttgttgctgttttattgagtgccgctgcttatctatccgtgacacaatcttaccttaacgaatggaagctggactctaatcagtattctacatacttaagcataaagccggatgagttgtttgaaaaatgcacacactactataggtctcctgtgtctgatacatggaagttactcagctctaaagaagccgccgatatttataccccttttcattattatttgtctaccataagttttcaaagtaaggacaattcaacgactttgccttcccttgatgacgttatttacagtgttgaccataccaggtacttattaagtgaagagccaaagataccaactgaactagtgtctgaaaacggaacgaaatggagattgagaaacaacagcaattttattttggacctgcataatatttaccgaaatatggtgaagcaattttctaacaaaacgagcgaatttgatcagttcgatttgtttatcatcctagctgcttaccttactcttttttatactctctgttgcctgtttaatgacatgaggaaaatcggatcaaagttttggttaagcttttctgctctttcaaactctgcatgcgcattatatttatcgctgtacacaactcacagtttattgaagaaaccggcttccttattaagtttggtcattggactaccatttatcgtagtaattattggctttaagcataaagttcgacttgcggcattctcgctacaaaaattccacagaattagtattgacaagaaaataacggtaagcaacattatttatgaggctatgtttcaagaaggtgcctacttaatccgcgactacttattttatattagctccttcattggatgtgctatttatgctagacatcttcccggattggtcaatttctgtattttgtctacatttatgctagttttcgacttgcttttgtctgctactttttattctgccattttatcaatgaagctggaaattaacatcattcacagatcaaccgtcatcagacagactttggaagaggacggagttgtcccaactacagcagatattatatataaggatgaaactgcctcagaaccacattttttgagatctaacgtggctatcattctgggaaaagcatcagttattggtcttttgcttctgatcaacctttatgttttcacagataagttaaatgctacaatactaaacacggtatattttgactctacaatttactcgttaccaaattttatcaattataaagatattggcaatctcagcaatcaagtgatcatttccgtgttgccaaagcaatattatactccgctgaaaaaataccatcagatcgaagattctgttctacttatcattgattccgttagcaatgctattcgggaccaatttatcagcaagttacttttttttgcatttgcagttagtatttccatcaatgtctacttactgaatgctgcaaaaattcacacaggatacatgaacttccaaccacaatcaaataagatcgatgatcttgttgttcagcaaaaatcggcaacgattgagttttcagaaactcgaagtatgcctgcttcttctggcctagaaactccagtgaccgcgaaagatataattatctctgaagaaatccagaataacgaatgcgtctatgctttgagttcccaggacgagcctatccgtcctttatcgaatttagtggaacttatggagaaagaacaattaaagaacatgaataatactgaggtttcgaatcttgtcgtcaacggtaaactgccattatattccttagagaaaaaattagaggacacaactcgtgcggttttagttaggagaaaggcactttcaactttggctgaatcgccaattttagtttccgaaaaattgcccttcagaaattatgattatgatcgcgtttttggagcttgctgtgaaaatgtcatcggctatatgccaataccagttggtgtaattggtccattaattattgatggaacatcttatcacataccaatggcaaccacggaaggttgtttagtggcttcagctatgcgtggttgcaaagccatcaatgctggtggtggtgcaacaactgttttaaccaaagatggtatgactagaggcccagtcgttcgtttccctactttaataagatctggtgcctgcaagatatggttagactcggaagagggacaaaattcaattaaaaaagcttttaattctacatcaaggtttgcacgtttgcaacatattcaaacctgtctagcaggcgatttgctttttatgagatttcggacaactaccggtgacgcaatgggtatgaacatgatatcgaaaggtgtcgaatactctttgaaacaaatggtagaagaatatggttgggaagatatggaagttgtctccgtatctggtaactattgtactgataagaaacctgccgcaatcaattggattgaaggtcgtggtaaaagtgtcgtagctgaagctactattcctggtgatgtcgtaaaaagtgttttaaagagcgatgtttccgctttagttgaattaaatatatccaagaacttggttggatccgcaatggctggatctgttggtggtttcaacgcgcacgcagctaatttggtcactgcacttttcttggcattaggccaagatcctgcgcagaacgtcgaaagttccaactgtataactttgatgaaggaagttgatggtgatttaaggatctctgtttccatgccatctattgaagttggtacgattggcgggggtactgttctggagcctcagggcgccatgcttgatcttctcggcgttcgtggtcctcaccccactgaacctggagcaaatgctaggcaattagctagaataatcgcgtgtgctgtcttggctggtgaactgtctctgtgctccgcacttgctgccggtcacctggtacaaagccatatgactcacaaccgtaaaacaaacaaagccaatgaactgccacaaccaagtaacaaagggcccccctgtaaaacctcagcattattataa

SEQ ID NO: 25524 - DNA, 1476 bp, Saccharomyces cerevisiae
atgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataa

SEQ ID NO: 25525 - DNA, 569 bp, Saccharomyces cerevisiae
ataatccgatcagttctaaactagaaagtggatacttggatttggtggtgaaagcatacgttgatggtaaagtctccaaatatttcgctggcttaaattctggtgacaccgtggatttcaaggggccaataggtactttgaactacgaaccaaattcctccaagcatttaggtatcgtagccggtggttctggtatcacgccagtcctacagatcttgaatgaaatcatcaccgttcctgaagatttgacgaaagtctccctgctatatgccaatgagactgaaaatgacattctattgaaggacgaactggatgagatggccgaaaaatacccacatttccaggtccattacgtggtacactatccatccgacagatggaccggagatgtcggctacatcaccaaggaccagatgaacaggtatctgccggaatattcggaggataacagactcttgatctgtggacctgatggaatgaacaacttggcccttcaatacgctaaagaactgggctggaaggtcaattcaacgagaagttctggcgacgatcaagtcttcgtcttttaa

SEQ ID NO: 25526 - DNA, 370 bp, Saccharomyces cerevisiae
atgtcaaaagaagacatagaaggaactaacattctagacgaacctgtccacgggatctatattcctgccgcgctattcgttgttggtgttgcaatcaccacgtatatgtctggtgaattgaaaatcctgtggagtttacccattctcttcatgatcatcttcgtcagagcatactctgcctacaaaagaagaagatcactgtatccagataggtggacttcgttagaattggaagatcaaaccataatttccaagaataccgccctgtatcgttttaagttgaagacaagactggaaagcttggacattcccgctggtcatcatgttgctgtacgcgttccaattgacggcaaacaagaggtcagatact

SEQ ID NO: 25527 - DNA, 1636 bp, Saccharomyces cerevisiae
atgagagaggtcattagtattaatggtatgtatgcgttcctttttttgttcaatattcgcaaccaatggcacctgtgggacagggaaagaagtttgatctgatctggtttgattcattcccaattggtcaccatctggttgatttacggcaaataatttgacttgtaccagcacagtttactaacagtttctttttctccattttttctgggcatactcggacgaaaaagctcataattgacctcattacatggggagtgatttttgtgtcttcttcttcggaggattgctggaacttttgttatttttcttttttacaacagttggtcaagcaggttgtcaaataggtaatgcatgctgggaattgtactccctagagcatggcatcaaggaagacggccatttggaggatggcttgtcaaaacctaagggaggtgaagaaggattttctacattcttccatgaaacggggtacggaaaattcgtcccaagagcaatctacgtggatttagagcccaatgttatcgatgaagtacgtacaggacgtttcaaggagcttttccatccagaacaattgattaacggtaaggaagatgccgccaataactacgcaagaggccattatacagtgggtagagaaatagtggatgaagttgaagaaagaattagaaagatggccgaccaatgtgacggtttacaagggttcttgttcacccactccctcggtggtggaactggttccggtttaggttccctgttattagaaaacttatcgtatgaatacgggaagaaatccaaattggaattcgccgtttatcctgcgcctcaattgtctacttccgtcgtggaaccttacaacacggttttaaccacgcataccaccctggaacacgcagactgtacgtttatggtcgataacgaagccatttacgatatatgcaagaggaacttgggaatttctagaccaagcttcagcaacttgaacgggttgattgcccaagtgatatcatctgttacagcctctttgaggttcgatggttcattaaacgtggatttgaacgaatttcagaccaacttggtaccatatccaagaattcatttccctttggtttcctacgcacccatcttgtccaagaagagggccacccatgaatccaactccgtgtcagaaatcacaaacgcttgtttcgaaccgggcaatcaaatggttaagtgtgacccaacaaaggggaagtacatggctaactgtttgttatacagaggtgacgtggtgaccagagatgtccaaagagccgtcgaacaggtgaagaataaaaaaacagtacaaatggtggattggtgtccaacaggatttaagattggtatttgttatgagccaccaagtgtgataccaagttccgaattagccaatgtggatagagctgtctgcatgctatccaacaccactgccatcgcggacgcttggaagagaatcgatcagaaattcgacctgatgtatgccaaacgtgctttcgtccattggtatgtcggtgaaggtatggaagaaggtgagttcaccgaagctagagaagatttagctgccttagaaagagattatattgaagtgggtgccgattcttacgctgaggagttctaa

SEQ ID NO: 25528 - DNA, 1764 bp, Saccharomyces cerevisiae
atgagttccgtcaataaagatactattcatgttgctgaaagaagtcttcataaagaacaccttaccgaaggtggtaacatggccttccacaaccatttgaatgattttgctcatattgaagatcctctggaaagaagaagattggctttggagtccatcgatgacgaaggtttcggttggcaacaagttaagaccatctccattgctggtgttggtttcttgacagattcttatgatatttttgccattaatttgggtatcactatgatgtcctacgtttactggcacggtagtatgccaggtccaagtcaaaccttgttgaaggtttccacttctgttggtactgttattggtcaatttggttttggtactttagctgatattgttggtcgtaagagaatttatggtatggaacttattatcatgattgtctgtaccattctgcaaaccactgttgctcattctcctgctattaacttcgttgctgttttaacattctaccgtattgtcatgggtattggtatcggtggtgactacccactatcttctattattacttctgaatttgccactaccaaatggagaggtgccatcatgggtgctgtctttgctaaccaagcttggggtcaaatctccggtggtatcatcgctcttatcttggttgctgcttacaagggcgaactagaatacgcaaactctggtgctgaatgtgatgctagatgtcaaaaggcttgtgaccaaatgtggagaatccttattgggttgggtaccgttctagggttggcatgtttgtatttcagattaactattccagaatctcctagatatcaattggatgttaacgctaagttggaacttgctgctgccgcacaagaacaagatggcgaaaagaaaattcacgacaccagtgatgaagacatggcaattaacggtttggaaagagcttctactgccgtcgaatctcttgacaatcatcctccaaaggcttcgttcaaagatttctgcagacattttggtcaatggaagtacggtaagattttgctaggtactgctggttcatggtttaccttagatgttgctttctacgggttgagtttaaacagtgctgttattctgcaaaccatcggttatgccggttccaaaaacgtttacaagaaactgtatgatactgctgtcggtaatctgattttgatttgtgctggttcattacctggttactgggtatccgtcttcactgtcgatataatcggtagaaaaccaattcaattagccggtttcatcatcttgaccgctttgttctgtgtcatcggtttcgcataccataaacttggtgaccatggtctgttggctctttacgtcatttgtcaattcttccaaaacttcggtccaaacacaaccacctttattgttcctggtgagtgtttcccaactcgttacagatctactgctcatggtatttctgctgcatctggtaaggtcggtgccattattgcacaaaccgctttgggtactctaatcgaccataactgtgctagagacggtaagccaaccaactgttggttacctcacgtcatggaaattttcgccttattcatgttgttgggtatcttcacaaccttgttgatcccagaaactaagagaaagactctagaagaaattaacgagctataccacgatgaaatcgatcctgctacgctaaacttcagaaacaagaataatgacattgaatcttccagcccatctcaacttcaacatgaagcataa

SEQ ID NO: 25529 - DNA, 891 bp, Saccharomyces cerevisiae
atggactctcttgaagctagattacaattcattcaggtcctgaagaacctgcaaaagacgctgcacaagaccagagactctatcacatcatcgtcgaccaccacaccaccgtcatcgcaacaaaagctgaacaatgaccctatacagttctacttgagaaactacagacatcactacgaggacttccaccaatgtttgttcgatacaaccatgaagatggacccactagatagactggacgtagtgatatactatgttagaataataagaaacttatatccgcatagccattccaataccaatgttacaaaagtgttaaacgaagtgctactcatggacatagacttggtttttgagctttgtctgccctgccaggactggaaatccctcacgaatcaagccacctgtaaagagctattccttgacttatccaaactaatccattacgacgccaccagcgtcacgcacacaccatcagacaccacactcatagacgctactacctggtacagtgtcaagacagagaggactacaaaggactataaagaatcattgcaacgaacggagtctctgcttaaggacagagacttgaagaaattggctttctttcagcagttcaattccgatacaactgcgatcaacccggacttacagacgcagccaaccaatgcaaacattttgttgcacaggatggaagcagacagggaactgcacaagaggtcgaaagagacaagttggtacatcgaaaggccctccaacgatatactggatgaatccgaatttaaaagcttgtggacgcattttgaaactactgattccggatttgataaggacgattacaaaaatatcaaggctttaaatgacattgcgaaggcatcttacatatattag

SEQ ID NO: 25530 - DNA, 1332 bp, Saccharomyces cerevisiae
atggagaaagtaagtgtttccagcgggaattcaggcctaaatcctagccaattttatgggtcaaacaactttagggataatatagcatccttgactatttcaattgatcagattgagaaagagcttgaacttttaaggcatttgattttgaaggcagatctgaccaacaatcaaatgcagttgaaaattttaaaaaagtcacaaagaaccctattaaaggaactagaaatgaaggaactgttgaaacagcaatatatggtacaagaaaatggtaatagtttgttcagaaaaactaagatatacattaggtcgtacttcagtgagaattctagtaatggcctaaaagaaataacttattatatcatcaatatccatcattttaacaatgggcaggtaagttcttgggatatggcaaggagatataatgaattttttgaattaaatacatatttgaaaaagaattttagggatctgatgaggcagttgcaagatttgttcccgtcaaaagtgaaaatgtcattgaaatatcatgttacaaaaacattgctttatgaggaacgaaagcaaaaacttgaaaagtacttgcgagaactattatctatttctgaaatatgcgaagataacattttcagaagatttttgacagatcctaccccattcaaactgaacaaggaatatatgcatgatgatattctggaggagccacttcatgaacctattggtagtagtaatagcacaagtaatagcagttctgttgttgatttacaaagctctgaagacggcggtgaattgaatttctatgaagatgaaagacattttttcaccgattctggctatcctttttattcgcaaaataaatcttttgttaaacagatatgtgacttatttatttcgctctttgctttaaataaggccaacgcgggttggttaagaggaagggctataattaccgttttacaacagcttcttgggagcactattgaaaagtatataaaggtcagcattcaaaaattgagatcagaggatcaagtatttgaagcaatagttacattcaagaatatgctatggggtgataacggtctgttcgaaagaaaaagaaatgaaacggcagaggcaacaagaagcgaaggtgaaaggttacggacggaacaactcgctttaaccagtttgcaaagactcttcgcagacacttgtggtcgtgtagttggtctaagagattctcatgaagctgctggccgggtccatgccatgctacagaatccgtatttaaatgccagcttactgttggaagctcttgatgcaattttattggacataatatgtaatgactga

SEQ ID NO: 25531 - DNA, 3297 bp, Saccharomyces cerevisiae
atggctctcatcgtggcatctttgtttttgccctaccaaccacaattcgagcttgacacctctctccctgagaactcgcaggtggactcatctctcgtgaacatccaggctatggccaatgaccaacagcaacaacgtgcgctttctaacaacatctcacaggaatcattggtcgcgccagcaccagaacaaggtgtccccccagcaatctcaaggagtgccaccaggtcacccagtgctttcaaccgcgcctcgtctacgacaaatactgccactttagatgatcttgtctcttcggacatattcatggaaaacttgactgcgaatgcaactacctcacatacgccaacaagcaagactatgcttaaaccccggaaaaatggttccgtggaacgattcttctccccttcttccaatattcccacggatcgcatcgcatcgccaatccagcatgagcatgactccggttcgagaattgcttcgccaatccaacagcaacagcaggaccccacgaccaacttattaaagaacgtcaacaagtcattgttagtgcactcactgttgaacaacacctcacaaactagcctagaaggacccaacaaccacattgttaccccgaaatcgagggcgggcaacaggcctacttcggcggctacttctttagttaataggaccaaacaaggttcggcctcctctggatcttctgggtcttctgcgccaccttccattaaaaggattacgccccacttgactgcgtctgctgcaaaacagcgtcccttattggctaaacagccttctaatctgaaatattcggagttagcagatatttcgtcgagtgagacgtcttcgcagcataatgagtcggacccggatgatctaactactgcccctgacgaggaatatgtttctgatttggaaatggatgacgcgaagcaggactacaaggttccaaagttcggcggctattccaataaatctaaacttaagaaatatgcgctgttaaggtcatctcaggagctgtttagccgtcttccatggtcgatcgttccctctatcaaaggtaatggcgccatgaagaacgccataaacactgcagtcttggagaatatcattccgcaccgtcatgttaagtgggtcggtaccgtcggaatcccaacggatgagattccggaaaatatccttgcgaacatctctgactctttaaaagacaagtacgactcctatcctgtccttacggacgacgacaccttcaaagccgcatacaaaaactactgtaaacaaatcttgtggcctacgctgcattaccagattccagacaatccgaactcgaaggcttttgaagatcactcttggaagttctatagaaacttaaaccaaaggtttgcggacgcgatcgttaaaatctataagaaaggtgacaccatctggattcatgattaccatttaatgctggttccgcagatggtgagagacgtcttgccttttgccaaaataggatttaccttacatgtctcgttccccagtagtgaagtgtttaggtgtctggctcagcgtgagaagatcttagaaggcttgaccggtgcagactttgtcggcttccagacgagggagtatgcaagacatttcttacagacgtctaaccgtctgctaatggcggacgtggtacatgatgaagagctaaagtataacggcagagtcgtttctgtgaggttcaccccagttggtatcgacgcctttgatttgcaatcgcaattgaaggatggaagtgtcatgcaatggcgtcaattgattcgtgaaagatggcaagggaaaaaactaattgtgtgtcgtgatcaattcgatagaattagaggtattcacaagaaattgttggcttatgaaaaattcttggtcgaaaatccggaatacgtggaaaaatcgactttaattcaaatctgtattggaagcagtaaggatgtagaactggagcgccagatcatgattgtcgtggatagaatcaactcgctatccaccaatattagtatttctcaacctgtggtgtttttgcatcaagatctagatttttctcagtatttagctttgagttcagaggcagatttgttcgtagtcagctctctaagggaaggtatgaacttgacatgtcacgaatttatcgtttgttctgaggacaaaaatgctcccctactgttgtcagaatttactggtagtgcatctttattgaatgatggcgctataataattaacccatgggataccaagaacttctcacaagccattctcaaggggttggagatgccattcgataagagaaggccacagtggaagaaattgatgaaagacattatcaacaacgactctacaaactggatcaagacttctttacaagatattcatatttcgtggcaattcaatcaagaaggttccaagatcttcaaattgaatacaaaaacactgatggaagattaccagtcatctaaaaagcgtatgtttgttttcaacattgctgaaccaccttcatcgagaatgatttccatactgaatgacatgacttctaagggcaatatcgtttacatcatgaactcatttccaaagcccattctggaaaatctttacagtcgtgtgcaaaacattgggttgattgccgagaatggtgcatacgttagtctgaacggtgtatggtacaacattgttgatcaagtcgattggcgtaacgatgtagccaaaattctcgaggacaaagtggagagattacctggctcgtactacaagataaatgagtccatgatcaagttccacactgaaaatgcggaagatcaagatcgtgtagctagtgttatcggtgatgccatcacacatatcaatactgtttttgaccacagaggtattcatgcctacgtttacaaaaacgttgtttccgtacaacaagtgggactttccttatcggcagctcaatttcttttcagattctataattctgcttcggatccactggatacgagttccggccaaatcacaaatattcagacaccatctcaacaaaatccttcagatcaagaacaacaacctccagcctctcccactgtgtcgatgaaccatattgatttcgcatgtgtctctggttcatcgtctcctgtgcttgaaccattgttcaaattggtcaatgatgaagcaagtgaagggcaagtaaaagccggacacgccattgtttatggtgatgctacttctacttatgccaaagaacatgtaaatgggttaaacgaacttttcacgatcatttcaagaatcattgaagattaa

SEQ ID NO: 25532 - DNA, 504 bp, Saccharomyces cerevisiae
atgtctaggaagctgaaaaaaacgaatctgtttaacaaggatgtaagttccttgctttacgcttacggcgatgtgccgcagccactacaagctactgtgcagtgtttggatgaattggtatctggatatttggtggatgtttgtactaacgcattccatacagcccagaattctcagcgcaataagctccgattggaagatttcaagtttgccctccgtaaagacccgataaagcttgggagagcagaagaactgatagctactaataagttgattacggaagctaagaagcagttcaatgagacagacaatcaaaattcattaaagaggtacagagaagaggatgaagagggtgacgagatggaagaggatgaggatgagcagcaggtgacggatgatgatgaggaagcagcgggccgtaatagcgctaaacaatcaacagattcgaaggcaacaaagattaggaagcaggggcctaaaaacctcaagaaaacaaaaaaatga

SEQ ID NO: 25533 - DNA, 753 bp, Saccharomyces cerevisiae
atgaccgacagatattctttttcgttgaccactttttctcccagcggtaaattgggtcaaattgattacgccttgacggcagtaaaacaaggtgtcacctcattgggtataaaagctacgaatggtgtagtaattgccacagaaaagaagtcgtcctcgccactggccatgtcagaaacactttcgaaggtatccttactaacaccggacattggtgcagtatattccggtatggggcctgattatagagttttagtggataaatcaagaaaggtagcacatactagttataaacgaatttatggtgaataccctcccaccaaattactggtttctgaagtagccaaaataatgcaagaggctacacagtccggtggtgtcagaccctttggtgtttcactgttgattgctggccacgacgaatttaatgggtttagtttatatcaagtggatccttccggttcctacttcccttggaaagccaccgctataggaaaaggttctgtggcggcaaaaacgtttttagagaaaagatggaatgatgaactggaactagaagacgccattcatattgccttactaacgctgaaggagtcggtagagggcgaattcaatggtgacaccattgaactggctattattggcgatgagaaccctgacttgctaggctacactggtattccaaccgataaaggccctagatttagaaaattaacttctcaagaaataaatgatagattagaagcattatga

SEQ ID NO: 25534 - DNA, 939 bp, Saccharomyces cerevisiae
atgtcgatagtagagacatgcatatcttttgtttcgacaaatccgttttatccattttgtactggattgcttctgaattgtgtggttacacctctttacttttggaaaacgcaaaatggtagaatcgtggtcgtttcattgctgcaattcgtagtactttatgccacagcgtttatttcgattggaactgataaatctctttacagaaataaatgggtcgcgctaccgctatccaagaagacccgcatttctcgtaatactagtctgtactgcttcaagttaaagtacccatttgaaagattgcatattcccatgggataccacctggcagtaagggttacaataaatggtgagcgattagtgaggtactatacgccagtaaatgttcctaatacggagggtcacttggaattagtagtcaagacgtataaacatggtgtcgtttctaagtattttgataaattaaaaattcgccagtatgttgaatttaaagggccgttaggtgagctggaatatgatcaggacaccgcaacagagttgggtataatcgcaggggggtctggtataacccctgtattgcaagtgctgcaagaaatcataccctctccagaagacctaacacacatttctttgatatacgcaaacgaaacagaggatgacattctcatgaaatcgcaactagaccacatggctaaggagtacccgcattttaaagttcattatgtaattcataagccaaacggtaaatggaacggtgatgttgggtacgtaactctagaggaaatgaaaagatacctacctaaacaagcggaggaccatcgtttattgatttgcggaccacctaaaatgaatgaaatggttttgaattatgcaaaggagttggggtggagtaatgggtttcacaaaggtaatggaaccgataaagtttttgttttttaa

SEQ ID NO: 25535 - DNA, 1460 bp, Saccharomyces cerevisiae
atgagagaagttattagtattaatggtatgttcgatttgcccgtccaggctagatcttttttttgttagttcattttggcgtttcatctttcattactaacttcaacgcaaaatttttttttttttgatttctctttacagtcggtcaagctggttgtcagattggtaatgcctgttgggaattatattcccttgagcacggtattaagccggatggacatctagaagatggcctttcaaagccgaagggaggagaagagggtttctccacgtttttccatgaaaccggctacggtaagttcgttccaagggctatttacgtggatttagagcccaacgttattgacgaagtccgtaacggtccttacaaggacttgttccatccagaacagttgatcagtggtaaggaggacgcggctaataattatgcaagaggccattacaccgttggtagagaaattttgggcgatgttctggataggattagaaaactggcagaccaatgtgatgggttacaagggttcttgtttacccattctcttggtggtggtactggttccggtctagggtccttactgttggaagaactatccgctgaatacggtaagaaatccaagctggaatttgccgtataccctgctccacaagtgtctacttctgtggttgagccttacaacacagttttaactacacatactacattggaacatgcagattgtactttcatggtcgataatgaggctatttacgacatgtgcaaaagaaacttggatatcccaagaccaagctttgcaaacttaaacaacctaattgctcaagtggtatcatctgttacagcatcattgagattcgacggttcattaaatgtagatttgaacgaatttcaaaccaatttggttccatatccaagaattcatttccccttagtttcatattctccagtcttatccaaatcaaaggcattccatgagtccaactctgtgtcagaaattacaaacgcttgttttgaacctggtaaccagatggtcaagtgtgatccaagagatggtaaatacatggctacttgtctgttatacaggggtgatgtggtaacaagagatgttcaaagagctgtcgagcaggtgaaaaacaagaagaccgtccaattggttgattggtgtccaactggtttcaagatcggtatttgctacgaacctccaactgccacaccaaactcacaattggccactgtggatagggccgtctgtatgttgtcaaataccacatccattgctgaggcttggaagagaatcgatagaaaattcgatttaatgtatgccaaacgtgctttcgtccactggtatgtcggtgaaggtatggaagaaggtgaattcaccgaagctagagaagatttggctgctttagaaagagattacatcgaagtgggtgccgactcatacgctgaggaagaggaattttaa

SEQ ID NO: 25536 - DNA, 3165 bp, Saccharomyces cerevisiae
atgccgccgctattcaagggactgaaacagatggcaaagccaattgcctatgtttcaagattttcggcgaaacgaccaattcatataatacttttttctctaatcatatccgcattcgcttatctatccgtcattcagtattacttcaatggttggcaactagattcaaatagtgtttttgaaactgctccaaataaagactccaacactctatttcaagaatgttcccattactacagagattcctctctagatggttgggtatcaatcaccgcgcatgaagctagtgagttaccagccccacaccattactatctattaaacctgaacttcaatagtcctaatgaaactgactccattccagaactagctaacacggtttttgagaaagataatacaaaatatattctgcaagaagatctcagtgtttccaaagaaatttcttctactgatggaacgaaatggaggttaagaagtgacagaaaaagtcttttcgacgtaaagacgttagcatattctctctacgatgtattttcagaaaatgtaacccaagcagacccgtttgacgtccttattatggttactgcctacctaatgatgttctacaccatattcggcctcttcaatgacatgaggaagaccgggtcaaatttttggttgagcgcctctacagtggtcaattctgcatcatcacttttcttagcattgtatgtcacccaatgtattctaggcaaagaagtttccgcattaactctttttgaaggtttgcctttcattgtagttgttgttggtttcaagcacaaaatcaagattgcccagtatgccctggagaaatttgaaagagtcggtttatctaaaaggattactaccgatgaaatcgtttttgaatccgtgagcgaagagggtggtcgtttgattcaagaccatttgctttgtatttttgcctttatcggatgctctatgtatgctcaccaattgaagactttgacaaacttctgcatattatcagcatttatcctaatttttgaattgattttaactcctacattttattctgctatcttagcgcttagactggaaatgaatgttatccacagatctactattatcaagcaaacattagaagaagacggtgttgttccatctacagcaagaatcatttctaaagcagaaaagaaatccgtatcttctttcttaaatctcagtgtggttgtcattatcatgaaactctctgtcatactgttgtttgtcttcatcaacttttataactttggtgcaaattgggtcaatgatgccttcaattcattgtacttcgataaggaacgtgtttctctaccagattttattacctcgaatgcctctgaaaactttaaagagcaagctattgttagtgtcaccccattattatattacaaacccattaagtcctaccaacgcattgaggatatggttcttctattgcttcgtaatgtcagtgttgccattcgtgataggttcgtcagtaaattagttctttccgccttagtatgcagtgctgtcatcaatgtgtatttattgaatgctgctagaattcataccagttatactgcagaccaattggtgaaaactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaaaggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgttgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccgcatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 25537 - DNA, 1755 bp, Saccharomyces cerevisiae
atgtccgctaaatcgtttgaagtcacagatccagtcaattcaagtctcaaagggtttgcccttgctaacccctccattacgctggtccctgaagaaaaaattctcttcagaaagaccgattccgacaagatcgcattaatttctggtggtggtagtggacatgaacctacacacgccggtttcattggtaagggtatgttgagtggcgccgtggttggcgaaatttttgcatccccttcaacaaaacagattttaaatgcaatccgtttagtcaatgaaaatgcgtctggcgttttattgattgtgaagaactacacaggtgatgttttgcattttggtctgtccgctgagagagcaagagccttgggtattaactgccgcgttgctgtcataggtgatgatgttgcagttggcagagaaaagggtggtatggttggtagaagagcattggcaggtaccgttttggttcataagattgtaggtgccttcgcagaagaatattctagtaagtatggcttagacggtacagctaaagtggctaaaattatcaacgacaatttggtgaccattggatcttctttagaccattgtaaagttcctggcaggaaattcgaaagtgaattaaacgaaaaacaaatggaattgggtatgggtattcataacgaacctggtgtgaaagttttagaccctattccttctaccgaagacttgatctccaagtatatgctaccaaaactattggatccaaacgataaggatagagcttttgtaaagtttgatgaagatgatgaagttgtcttgttagttaacaatctcggcggtgtttctaattttgttattagttctatcacttccaaaactacggatttcttaaaggaaaattacaacataaccccggttcaaacaattgctggcacattgatgacctccttcaatggtaatgggttcagtatcacattactaaacgccactaaggctacaaaggctttgcaatctgattttgaggagatcaaatcagtactagacttgttgaacgcatttacgaacgcaccgggctggccaattgcagattttgaaaagacttctgccccatctgttaacgatgacttgttacataatgaagtaacagcaaaggccgtcggtacctatgactttgacaagtttgctgagtggatgaagagtggtgctgaacaagttatcaagagcgaaccgcacattacggaactagacaatcaagttggtgatggtgattgtggttacactttagtggcaggagttaaaggcatcaccgaaaaccttgacaagctgtcgaaggactcattatctcaggcggttgcccaaatttcagatttcattgaaggctcaatgggaggtacttctggtggtttatattctattcttttgtcgggtttttcacacggattaattcaggtttgtaaatcaaaggatgaacccgtcactaaggaaattgtggctaagtcactcggaattgcattggatactttatacaaatatacaaaggcaaggaagggatcatccaccatgattgatgctttagaaccattcgttaaagaatttactgcatctaaggatttcaataaggcggtaaaagctgcagaggaaggtgctaaatccactgctacattcgaggccaaatttggcagagcttcgtatgtcggcgattcatctcaagtagaagatcctggtgcagtaggcctatgtgagtttttgaagggggttcaaagcgccttgtaa

SEQ ID NO: 25538 - DNA, 2745 bp, Saccharomyces cerevisiae
atggcaaaaacgttgaaggatttacagggttgggagataataacaactgatgagcagggaaatataatcgatggaggtcagaagagattacgccgaagaggtgcaaaaactgaacattacttaaagagaagttctgatggaattaaactaggtcgtggtgatagtgtagtcatgcacaacgaagccgctgggacttactccgtttatatgatccaggagttgagacttaatacattaaataatgttgtcgaactctgggctctcacctatttacgatggtttgaagtcaatcctttagctcattataggcagtttaatcctgacgctaacattttgaatcgtcctttaaattattacaataaactgttttctgaaactgcaaataaaaatgaactgtatctcactgcagaattagccgaattgcagctatttaactttatcagggttgccaacgtaatggatggaagcaaatgggaagtattgaaaggaaatgtcgatccagaaagagactttacagttcgttatatttgtgagccgactggggagaaatttgtggacattaatattgaggatgtcaaagcttacataaagaaagtggagccaagggaagcccaggaatatttgaaagatttaacacttccatcaaagaagaaagagatcaaaagaggtcctcaaaagaaagataaggctactcaaacggcacaaatttcagacgcagaaacaagagctacagatataacggataatgaggacggtaatgaagatgaatcatctgattatgaaagtccgtcagatatcgacgttagcgaggatatggacagcggtgaaatatccgcagatgagcttgaggaagaagaagacgaagaagaagacgaagacgaagaagagaaagaagctaggcatacaaattcaccaaggaaaagaggccgtaagataaaactaggtaaagatgatattgacgcttctgtacaacctccccccaaaaaaagaggtcgtaaacctaaagatcctagtaaaccgcgtcagatgctattgatatcttcatgccgtgcaaataatactcctgtgattaggaaatttacaaaaaagaatgttgctagggcgaaaaagaaatataccccgttttcgaaaagatttaaatctatagctgcaataccagatttaacttcattacctgaattttacggaaattcttcggaattgatggcatcaaggtttgaaaacaaattaaaaacaacccaaaagcatcagattgtagaaacaattttttctaaagtcaaaaaacagttgaactcttcgtatgtcaaagaagaaatattgaagtctgcaaatttccaagattatttaccggctagggagaatgaattcgcctcaatttatttaagtgcatatagtgccattgagtccgactccgctactactatatacgtggctggtacgcctggtgtagggaaaactttaaccgtaagggaagtcgtaaaggaactactatcgtcttctgcacaacgagaaataccagactttctttatgtggaaataaatggattgaaaatggtaaaacccacagactgttacgaaactttatggaacaaagtgtcaggagaaaggttaacatgggcagcttcaatggagtcactagagttttactttaaaagagttccaaaaaataagaagaaaaccattgtagtcttgttggacgaactcgatgccatggtaacgaaatctcaagatattatgtacaattttttcaattggactacttacgaaaatgccaaacttattgtcattgcagtagccaatacaatggacttaccagaacgtcagctaggcaataagattacttcaagaattgggtttaccagaattatgttcactgggtatacgcacgaagagctaaaaaatatcattgatttaagactgaaggggttgaacgactcatttttctatgttgatacaaaaactggcaatgctattttgattgatgcggctggaaacgacactacagttaagcaaacgttgcctgaagacgtgaggaaagttcgcttaagaatgagtgctgatgccattgaaatagcttcgagaaaagtagcaagtgttagtggtgatgcaagaagagcattgaaggtttgtaaaagagcagctgaaattgctgaaaaacactatatggctaagcatggttatggatatgatggaaagacggttattgaagatgaaaatgaggagcaaatatacgatgatgaagacaaggatcttattgaaagtaacaaagccaaagacgataatgatgacgatgatgacaatgatggggtacaaacagttcacatcacgcacgttatgaaagccttaaacgaaactttaaattctcatgtaattacgtttatgacgcgactttcatttacagcaaaactgtttatttatgcattattaaacttgatgaaaaagaacggatctcaagagcaagaactgggcgatattgtcgatgaaatcaagttacttattgaagtaaatggcagtaataagtttgtcatggagatagccaaaacattgttccaacagggaagtgataatatttctgaacaattgagaattatatcatgggatttcgttctcaatcagttacttgacgcgggaatattgtttaaacaaactatgaagaacgatagaatatgttgtgtcaagctaaatatatcagtagaagaagccaaaagagccatgaatgaggatgagacattgagaaatttatag

SEQ ID NO: 25539 - DNA, 738 bp, Saccharomyces cerevisiae
atggctacaccaagcacgggagcaaacaattctatacctgcggtacgaaatcaggttgaagttcaggttggattagtaggggatgcacaagtagggaaaacatcgctgatggtgaagtacgtacagaacatatacgataaggaatacacacagacgctgggagtgaactttttgaaaagaaaagtaagcatacgctccacggatattatattttctataatggatttaggcggacaaagagaattcatcaacatgctcccaattgcgacggtagggtcttcagtgatcatatttctgtttgacctgacacgtccagagacgttgagttcaataaaggagtggtataggcaggcgtacgggctaaatgattcggcaattcctattttggtgggcacaaagtacgatttactaatagacttagacccggaatatcaggaacaaatctcgagaacgagtatgaagtatgcacaggtcatgaatgctcctcttatattctgctctactgccaaatctataaacattcaaaaaattttcaaaattgcactggcaaagatctttaatttgacattaaccatcccagaaatcaatgaaatcggcgatcctcttttgatatataagcacctaggtggccagcaacatcgacatcataacaaaagtcaggatagaaagagccataatatcaggaagccctcctcgtcgccctcatctaaggcaccatcgccgggcgttaatacatga

SEQ ID NO: 25540 - DNA, 2255 bp, Saccharomyces cerevisiae
ataaaaatgtcatgaattttatcaataaagacagtcctttatcctggaacgatatgtttaaacccagtataatacaaccaccgcagttaatttctgaaaactcatttgaccagagcagtcaaaaaaaatcgagatcgacaggattcaagaatccattaagaccagcgttgaaaaaggaaagttcttttgatgaacttcaaaataattctatatctcaagagagaagtttggaaatgataaatgaaaacgaaaagaagaaaatgcaatttggagaaaagattgctgttttgacgcaaagacctagcttcactgaattgcagaatgaccaagatgacagtaacttgaatccccataatggtgtgaaagtcaagataccgatttgcttaagcaaagaacaagaaagtatcatcaagttggcagaaaatggccacaacattttttatacagggagtgccggtaccggtaaatccattcttttacgtgaaatgataaaagttttaaaaggcatatatggtagggagaatgttgcagtcactgcttccacgggtttagctgcttgtaatatcggtggtataaccatacactcgttcgctggtataggattaggaaaaggtgatgcggataaactctataaaaaagttcgtaggtctcgaaagcacctaaggcgctgggaaaatattggtgctttggttgtcgatgaaatatcaatgttagacgcagaactgcttgataaactcgatttcatagctagaaaaatacggaaaaatcatcaacccttcggtggaattcaactcatcttctgtggcgattttttccagttaccgccagtatcaaaagatcctaatagaccaactaagtttgctttcgaatccaaggcttggaaagaaggtgtaaagatgacgattatgctacaaaaggtttttagacagcgaggcgatgttaagttcattgacatgttgaatcggatgagactaggcaatattgatgatgaaacagaaagagagttcaagaagctttctagaccattgccagacgatgaaattattcccgcggaactttatagtaccagaatggaagtagaaagggccaataattcaaggctaagtaaattgccaggccaggtgcatatttttaatgcaatcgatggcggtgctttggaagacgaagagttaaaggaaaggctgttacaaaattttttagctccaaaggaattacatttgaaagttggcgctcaggttatgatggtaaaaaatctagacgcaacattagttaatggatcccttggtaaagtcatcgaattcatggatccagaaacatatttttgctatgaggcgctaacaaacgatccatctatgcctccagaaaaactcgagacttgggcagaaaacccttcaaaactaaaagctgcaatggagagggagcaaagtgatggggaagaaagtgcggtagctagtcgcaaatcttcagtgaaggagggatttgctaagagtgatataggtgagccggtctctcccctagattcctcagtttttgacttcatgaagagagtcaagacagatgacgaagttgtgctggaaaatataaaacgcaaggaacaactgatgcagaccatacatcaaaactctgcaggaaaacgaaggttacctctcgtgagattcaaagcttctgatatgagtacgaggatggtgcttgtcgagccggaggattgggcgatagaagacgaaaatgaaaagccactggtatcaagggttcaattaccgctaatgcttgcctggtcactatccattcacaaatctcagggtcagacacttccaaaagttaaagtggatttacgtagagtattcgaaaagggtcaggcgtacgttgccctttctagagctgtttcaagagaaggactacaggtgttaaattttgacagaactaggatcaaagcacatcaaaaggtaattgatttttatcttactttatcttcagccgaaagtgcctataagcaacttgaggcagatgagcaagtgaaaaaaaggaagttagactacgcaccaggccctaaatataaggctaaatccaagtcaaagtcaaattctccagcacccatatcagcgaccacacaatctaataatggtatcgcagcgatgttgcaaagacacagtaggaagagatttcagttgaaaaaagagtctaatagtaatcaagttcattcattggtttccgacgaacctcgtggtcaggataccgaagaccacatcttagaataa

SEQ ID NO: 25541 - DNA, 1131 bp, Saccharomyces cerevisiae
atgtcttataaattcggcaaacttgccattaataaaagtgagctatgtctagcaaatgtgctacaggctggccaatcctttcgatggatttgggatgaaaagttaaaccagtacagcactacaatgaagataggccagcaagaaaagtattcagtagtgattttgaggcaagatgaagagaatgagatcctggaatttgttgctgtcggcgactgtggcaatcaggacgccttaaaaactcatctaatgaaatattttagattggacgtgtcactgaagcacttattcgataatgtttggattccaagcgataaagcatttgcgaaactttctccacaaggcatccgtatcttggcccaggaaccatgggagacattgatttcctttatttgctcgagtaataataacatttcaagaattacgagaatgtgcaatagcctttgctctaatttcgggaacttaatcacaacaatagatggggtcgcctaccattcgtttcctacaagtgaggagctaacttctcgagccactgaagccaagttgcgtgagctgggctttggatatagagctaagtatattatcgaaaccgcgagaaaactggtgaatgataaagctgaagctaatattacttctgacaccacataccttcaaagtatctgtaaagatgctcaatatgaagacgttagagagcacctcatgtcctacaatggtgtaggccccaaagttgctgattgcgtttgtctaatgggacttcacatggatggcatcgtccccgtagatgtccatgttagtagaattgcgaagagggactaccaaatatctgcgaacaagaaccatctcaaagaattgaggacaaaatacaacgccttacctatctcaagaaaaaaaatcaacctagagctcgaccatattagattaatgctttttaaaaaatggggatcatacgctggttgggcccaaggtgtcctattctctaaagaaatcggagggactagtggtagcactacaactggtactataaagaagagaaaatgggatatgataaaggaaacggaagcaattgttacgaaacaaatgaaactgaaagttgaattgtctgatcttcacatcaaagaagcaaaaatagattag

SEQ ID NO: 25542 - DNA, 1815 bp, Saccharomyces cerevisiae
atgtcttcagacgctataagaaatactgagcagataaacgccgctattaaaattatagaaaacaaaacagagcgtccgcaatcgtccacaacccctatagattcgaaggctagtacagttgctgctgctaattccacggccacagaaacttccagagaccttacacaatataccctagatgacggaagagtcgtatcgacaaaccgcagaataatgaataaagtgcccgccatcacgtcacatgttcctacagatgaagagctgttccagcccaatgggatacctcgtcacgaattcctaagagatcatttcaagcgcgagggcaaattgtcggctgcgcaggcggccaggatcgttacacttgcaacggaactcttcagcaaagaacccaaccttatatctgttcccgccccaatcacagtttgcggtgatatccatggccagtactttgaccttttgaagctattcgaagttggcggagatccggccactacatcgtatttgttcttgggagactatgtcgacagagggtccttttcgtttgagtgtcttatttatttatattctttgaagctgaattttaacgaccatttctggctactgaggggtaaccacgaatgtaagcatctaacgtcatatttcactttcaaaaatgaaatgctgcacaagtacaatctagatatttacgagaaatgctgcgaatcgtttaacaacttgcccctggctgcgttaatgaacggacagtatctttgtgttcatggtggtatatctcccgagttaaactctttacaggacattaacaacctaaatagattcagggagattccctctcatggcctgatgtgtgatctgttgtgggctgacccgattgaagagtacgacgaagtcttggataaagacttgactgaggaagacatagtgaactccaaaaccatggttcctcatcatggcaagatggcaccttcaagggatatgtttgtcccaaactcagtaaggggctgttcatatgccttcacgtatcgtgctgcgtgccattttctgcaagagactggcctgttgtccatcatcagggcacacgaggctcaagacgctggttatagaatgtacaaaaataccaagactttgggctttccctctcttttgacccttttcagtgcgcctaactacttggacacctacaataataaggctgccatattgaaatacgaaaataatgttatgaatatcagacaattcaacatgactccacacccctattggttaccagatttcatggacgttttcacgtggtccttgccatttgttggtgaaaaagttacagagatgcttgtcgcaattctaaacatctgtactgaagatgagctggaaaacgacacccccgtcattgaagaattagttggtaccgataaaaaattgccacaagctggtaagtcggaagcaactccacaaccagccacttcggcgtcgcctaaacatgcttccattttagatgacgaacatcgaaggaaagccttacgaaataagattctggccgtcgccaaagtttccagaatgtattctgttctcagagaagaaaccaataaagttcagtttttaaaagatcacaattcaggcgtgttgccacgtggcgctttatctaatggtgtaaagggtttagatgaagccctgtctacctttgaaagggcaagaaagcacgatttaattaatgaaaaattaccgccttcactagacgaactgaaaaacgaaaataagaagtactacgaaaaagtttggcagaaagtacatgaacatgatgcaaagaatgatagcaaatag

SEQ ID NO: 25543 - DNA, 925 bp, Saccharomyces cerevisiae
actagatcaagccgaatccatttataaggctgctgctgaacgtggggttcaaaccatcatctctttacaaggtcgtaaatcaccatatattttgagagcaaaagaattaatatctcaaggctatatcggcgacattaattcgatcgagattgctggaaatggcggttggtacggctacgaaaggcctgttaaatcaccaaaatacatctatgaaatcgggaacggtgtagatctggtaaccacaacatttggtcacacaatcgatattttacaatacatgacaagttcgtacttttccaggataaatgcaatggttttcaataatattccagagcaagagctgatagatgagcgtggtaaccgattgggccagcgagtcccaaagacagtaccggatcatcttttattccaaggcacattgttaaatggcaatgttccagtgtcatgcagtttcaaaggtggcaaacctaccaaaaaatttaccaaaaatttggtcattgacattcacggtaccaagggagatttgaaacttgaaggcgatgccggcttcgcagaaatttcaaatctggtcctttactacagtggaactagagcaaacgacttcccgctagccaatggacaacaagctcctttagacccggggtatgatgcaggtaaagaaatcatggaagtatatcatttacgaaattataatgccattgtgggtaatattcatcgactgtatcaatctatctctgacttccacttcaatacaaagaaaattcctgaattaccctcacaatttgtaatgcaaggtttcgatttcgaaggctttcccaccttgatggatgctctgatattacacaggttaatcgagagcgtttataaaagtaacatgatgggctccacattaaacgttagcaatatctcgcattatagtttataa

SEQ ID NO: 25544 - DNA, 2013 bp, Saccharomyces cerevisiae
atgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatctggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctggtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatacggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattctacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtctcaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatga

SEQ ID NO: 25545 - DNA, 1968 bp, Saccharomyces cerevisiae
atgatacagacgccaagggagttgttgaatccacggtacacgtaccataccatctttagcgacgtgtgcaagacccgattcaaccatttagttacgaggttgtttttcatatgttctattatccaaactgtggtgatttcactgctggcgttgccacactcaccgttatgggaactggcattggcatttattcccaatattttagctcttaacctagtttcccttttgatcattgtgacaagaaaaaattacatgcatgtaaagaattttgggttcgctaattcacttactttcattctaggccaattgttatcagtaaagtttcttgtataccagggagtctatagcatgggcagcatccttttatcattcgtactgggtgtggttttcggacgtggcggatctggatggaagccatactataagctgtttatttggctagtcgttcccacgatttacaacctacaacatcatgtcactgacgctgacaaattgtcgttcaactgcgaaaactttttccaggccccacaagactacgtattagagcgtgtcaagaggattatggagaagtcagtcattctaagtgtaatcagcatgttcgtattaccaatctttaccacagtatttttttccaggcaaaaatcgggattatttgattcatttacgaatggcgtgctagctgtcacaaatttactaataatctcctgcattatcttcatcactttcgaattcataaatatagcatttgacgcacatatgtccataggttgtctgcacaagggcaagctaatttcgaatttgtcgtcgacgccgatggaaaccctgcttagtgggctttctgcagacaagccatttactaggttgactgcctaccaggaactagcgtatagggccacttcactggatccatcattgcgagcaccaatatatcactccaagttcagaagcagtagtggtaatacttggtcattaatcctcaatgaatgcttgaagaccattcagataaacaatgaaaaggttgtgcagtacctaagatcagtacaagatcttgggggctctgcaactgctagacataaaaaaaaagtagaaaatctagattatatgtatgagaacgggaaactaacaagcgccaacgaaagactctttgggaaccgaccctctatgatggcgccattacgggataacggcttattagatgaatcaccaaacaggctgagggtaagaactgacgatagtgtattgcttaaccgcggaaacaagaaaaggcataggtcctcgtattacgacaacgatttagatgaaacgacacaaacttttaacggctctattttcacccacgaaacaacatttatgaccgctatgcgtctgatgttaaaaaaactgaaaaattctataatgtcgtttattttcccttcctacgcagaaagacaatcatctgatgaaagcgacaattacagactattaccaaatggctccaacaaagcccaaatctcgataattgacatatggtccatttccaagaaaaggcaagctgagaagctggttccattgcccatatgccacgcaaatagtgtggtagcactgacaggactgctgatccgatcaaagacagaagatccaaaaggcggtatcattgcatccgttggggatattcttaagactttggagaggtccatctgtgcactgggtgaatttgccgattgggatccggaatcgatggcatacactgccttccaaacacaaaggacagcccaagatagagtacaacaagacagtgaagacgaagatagcatgaaagacactactgacatgatcagtgttctttatcagctgtccaccagtgcttttatggagattgtacttgaatacaatgttgctctgaacgacgtatatttggatgcagacgtggccaagttggcgaactggtttctagaagtgtacgcctcaggcaaccctaatgctacgtaa

SEQ ID NO: 25546 - DNA, 564 bp, Saccharomyces cerevisiae
atgtctatagcaagttatgcccaagagttgaagttggctttacatcaatatccaaacttccctagtgaaggcattctcttcgaagatttcttacccattttcaggaacccaggtcttttccagaagttgatcgatgctttcaaactgcatttagaagaagcttttccagaagttaaaattgattatatcgtcgggttggaatcccgtgggttcttgttcggaccaactttagctttggccctaggtgttggtttcgttccagtcaggaaggcaggtaagctacctggcgaatgttttaaggctacgtacgaaaaggagtacggttctgatctttttgagatacagaaaaacgctattccagcaggttccaacgttatcattgttgatgacattattgccactggtggttctgctgctgcagccggcgaattagttgaacaactcgaagccaaccttttggaatataactttgttatggagttggatttcttgaaaggcaggagtaagttgaatgctccagtgttcactttactgaacgctcaaaaggaagcgttgaaaaaatga

SEQ ID NO: 25547 - DNA, 1080 bp, Saccharomyces cerevisiae
atgtggtgcatgagaagattgccaacaaattcagttatgacggtggctcgaaagagaaagcaaactacgatcgaagacttctttggtacaaagaaaagcactaatgaggcgcccaataagaaaggtaaatcgggcgctactttcatgaccataacaaatggcgcagctatcaagacagagacaaaggcggtcgcaaaggaggcaaacacggacaaatatcctgctaattcaaatgcaaaagatgtatattcgaagaacttgagcagcaatttacgtacactactgtcgctggagctagaaacgattgatgattcgtggtttccacatttaatggatgaatttaaaaagccatattttgtaaagttgaaacagtttgtcactaaagagcaagctgatcatacagtatttccgcctgcaaaggatatttactcatggaccaggctaacgccttttaataaagttaaagtcgtgattatcggtcaagatccctaccacaactttaatcaggcgcatggcttggcttttagcgtcaaaccccctacaccagcaccaccgtcattaaagaacatatataaggaactgaagcaagagtatcctgattttgttgaagataataaagtgggagatttaactcactgggcttcacaaggggttttattgcttaatacctcgttaactgtaagagcacataatgcaaactcgcattctaagcatggttgggaaacttttacaaaaagggtagttcagttgttgatccaggacagagaggccgacggtaagagtttagtattcctcttatgggggaacaatgctatcaaattagtagagtctctgttgggatctacttccgttggaagcggtagtaagtaccctaatatcatggtgatgaagtcagtgcatccgtctccattaagtgcaagtagaggattttttggtaccaaccatttcaaaatgataaacgattggctatacaatacccgcggagagaaaatgatagactggagtgttgttcctggaacgtcattaagagaagttcaggaggcaaatgctcgcttagagtcagaatcaaaggacccttga

SEQ ID NO: 25548 - DNA, 1041 bp, Saccharomyces cerevisiae
atgaccgaacctcaaggtcctttggacaccatcccgaaagtgaactatccgccaatactgacaatagcaaactatttttccacaaaacaaatgattgaccaagtcatcagtgaggaccaggactacgttacgtggaaattgcaaaacctgcgaacgggtggtacatcaatcaacaaccaattaaataaatatccaaaatacaaataccagaaaaccaggataaatcagcaagacccggactctatcaacaaagtcccagaaaacctgatctttccacaagacattttacaacagcaaacacaaaatagcaattacgaagacaccaataccaacgaagatgaaaatgaaaaacttgcgcaggacgaacaattcaagctcttggtaaccaacttggataaagatcaaactaatcggtttgaagttttccatagaacatccctaaacaaaacccaggtcaaaaaactggctagcacagtagctaatcaaactataagtgaaaatattcgtgtttttctgcaagcggtgggaaaaatatacgctggtgagataatcgaattggccatgattgtgaagaataagtggttgacaagtcaaatgtgcatagagtttgataagaggaccaaaataggctataaattgaaaaaatatctaaaaaaattgactttctccatcatagaaaaccagcaatacaagcaagattatcaatccgatagcgttcccgaagacgaacctgatttctacttcgacgatgaagaagtagacaagcgcgaaactacgctgggcaactcgttgctacagtccaaatccttacagcaatcagaccataattcacaggacttgaagctacaactcatcgagcagtacaataagctcgtcctccaattcaacaaactagatgtaagcatcgagaaatataacaacagtcccttattgcccgaacacatccgtgaggcgtggagactctaccgtctgcagtcggacactttgcctaacgcttactggagaactcaaggagaagggcagggatccatgttcagatag

SEQ ID NO: 25549 - DNA, 1152 bp, Saccharomyces cerevisiae
atgagtgaaacagaattgagaaaaagacaggcccaattcactagggagttacatggtgatgatattggtaaaaagacaggtttgagtgcattgatgtcgaagaacaactctgcccaaaaggaagccgttcagaagtacttgagaaattgggatggtagaaccgataaagatgccgaagaacgtcgtcttgaggattataatgaagccacacattcctactataacgtcgttacagatttctatgaatatggttggggttcctctttccatttcagcagattttataaaggtgagagtttcgctgcctcgatagcaagacatgaacattatttagcttacaaggctggtattcaaagaggcgatttagttctcgacgttggttgtggtgttgggggcccagcaagagagattgcaagatttaccggttgtaacgtcatcggtctaaacaataacgattaccaaattgccaaggcaaaatattacgctaaaaaatacaatttgagtgaccaaatggactttgtaaagggtgatttcatgaaaatggatttcgaagaaaacactttcgacaaagtttatgcaattgaggccacatgtcacgctccaaaattagaaggtgtatacagcgaaatctacaaggttttgaaaccgggtggtacctttgctgtttacgaatgggtaatgactgataaatatgacgaaaacaatcctgaacatagaaagatcgcttatgaaattgaactaggtgatggtatcccaaagatgttccatgtcgacgtggctaggaaagcattgaagaactgtggtttcgaagtcctcgttagcgaagacctggcggacaatgatgatgaaatcccttggtattacccattaactggtgagtggaagtacgttcaaaacttagctaatttggccacatttttcagaacttcttacttgggtagacaatttactacagcaatggttactgtaatggaaaaattaggtctagccccagaaggttccaaggaagttactgctgctctagaaaatgctgcggttggtttagttgccggtggtaagtccaagttattcactccaatgatgcttttcgtcgctaggaagccagaaaacgccgaaaccccctcccaaacttcccaagaagcaactcaataa

SEQ ID NO: 25550 - DNA, 627 bp, Saccharomyces cerevisiae
atgtcttctagaaaaaaaaatattttgaaagtaatcatcctaggtgactctggtgttgggaagacctccttgatgcaccgttatgtcaatgataagtattctcaacagtataaagcaacaattggggctgactttttaacaaaagaggtgacagttgacggtgataaagttgccaccatgcaagtttgggatactgctggacaggaacgtttccaatcactgggtgttgctttctatagaggtgcagattgttgcgttttggtctacgatgtgaccaatgccagttcctttgagaatattaagtcttggcgagatgaatttctagtgcatgcgaacgtaaactcaccagaaacatttccatttgttatactgggaaataaaattgatgccgaagaatctaaaaaaattgtatcagaaaagtccgctcaggagcttgctaaatcattaggcgatattcctttgtttttaacaagtgccaaaaacgccataaacgttgataccgcatttgaagaaattgcaaggagtgctttacaacagaatcaagctgatacagaagcctttgaagatgactataatgatgccatcaatattcgcctagatggagaaaataattcttgtagctgttga

SEQ ID NO: 25551 - DNA, 2118 bp, Saccharomyces cerevisiae
atgtcgttgggtcctcttaaagctatcaatgataagcaattgaatacccgttccaagttagttcacaccccaataaagggaaataccgcagacctcgtaggaaaagaaaatcactttaaacaaacaaagagactagatccgaataatgatcatcaccaccagccagctcaaaaaaagaaaagggaaaagttatcagctttgtgtaaaacaccaccttcattaatcaaaacaagaggaaaagactatcaccgaggtcattttttaggtgaaggtggatttgctcgctgtttccaaattaaggacgattcaggcgaaatttttgctgccaaaacagttgctaaagcctcaattaaatcagagaagacaagaaaaaagttgttgtcggagattcaaattcataaaagtatgtcccatccaaatatcgttcagtttattgattgttttgaggatgatagcaatgtctatatcttattggagatatgccccaacggttcattaatggaattactaaaaagaagaaaagttttaacagaaccagaagttagatttttcaccactcaaatatgtggtgcaattaagtatatgcattcaagaagagttatacatagagatttaaaacttggtaacatcttcttcgattcaaactataacttaaagattggtgacttcggtctggcagctgtgttggcgaatgaaagtgaacgtaaatacaccatatgcggaacacctaattacatcgcacctgaagtgttgatgggtaagcattctggacattcatttgaagtagatatttggtcattaggtgttatgctttatgctttgttgattggtaagccacccttccaagcaagagatgtaaacactatttatgaaagaatcaaatgtcgtgatttttcgtttccaagagataaaccaatctcagatgaaggtaagattttaataagagacattctatccttagatccaatagaaaggccctctttgactgaaattatggattatgtatggtttaggggaactttcccaccatctattccttcgacggtcatgtcagaagcaccaaattttgaggatattcctgaagagcagtcactggttaacttcaaagattgcatggaaaaatctctactattagaaagcatgagcagcgataaaattcagcgtcaaaagagggattatatttcttcaattaaatctagtatcgataaactagaagagtaccaccaaaacagaccatttttaccacattctttatcccctggcgggacgaaacagaaatataaggaggttgttgatatagaggcacaaagaagattaaacgatttggctcgtgaagcaaggatacgtagagcacaacaggccgttttgagaaaagaattaatagctacatcgaccaatgtcattaaatcagaaatctccttgagaatattagccagtgagtgtcatcttactttgaatggcattgtagaagcagaagctcagtataaaatgggaggtcttccgaaatcaagattgcctaaaattaaacacccaatgatagttaccaagtgggtcgactactccaacaaacacggattctcctatcagttatcaacagaggatattggtgtcttatttaataatggcaccacagttctccgattggcagatgcagaagagttttggtatattagttatgacgatcgggaaggttgggtagcaagtcattatttattgagcgaaaaaccacgagagctaagtagacatttagaagtagttgatttttttgccaagtacatgaaggcaaatttgagccgagtatctacgtttggcagagaagaatatcataaagatgatgtatttttgagaagatacacaaggtataaaccatttgttatgtttgaactaagtgatggtactttccagttcaatttcaaagatcatcataaaatggcaatatccgacggaggtaaattggtgacctacatttctccctcccatgaaagcaccacatatcccttagttgaagtactaaaatatggcgagatcccaggatatccagaaagtaactttagagagaaactaactttgataaaggaaggtttgaagcagaagtccacaattgttaccgtagattaa

SEQ ID NO: 25552 - DNA, 2121 bp, Saccharomyces cerevisiae
atgcaattacggaacatattacaggctagctcgctaatttctggactttcgctcgctgcagattcgtcgtccactactggtgatggttatgctccatcaataattccttgtcccagtgatgatacctctttagttagaaacgcgtctggcttatctaccgctgaaactgattggttaaagaaaagagatgcgtacactaaagaagctttacattccttcttaagcagagctacttctaacttcagtgacacttctttgctatccactcttttcagtagtaactcttccaatgtacccaaaattggtattgcatgctctggtggtggttatcgtgccatgttgggtggtgctggtatgattgctgctatggacaatcgtactgatggtgctaacgagcatggtcttggtggtttactacaaagttccacgtatctatcgggtttgtccggtggtaactggttgactggtactttggcatggaacaattggacctctgtacaggaaattgtagaccatatgagtgagagcgattccatctggaatatcacgaaatccattgtgaaccctggtggctctaatttgacctacacaattgaaagatgggagtccattgtacaagaagtgcaggctaagtctgatgcaggcttcaatatatctttgtcggatttgtgggcccgtgcactttcttacaacttctttccaagcttgccagatgctggctccgctttgacttggtcctctttgagagatgttgatgtgttcaaaaacggtgaaatgcctttaccaattactgttgcagatggtagatacccaggtaccaccgtgataaacttgaatgccactcttttcgagttcactccatttgaaatgggttcttgggatccttctttgaacgcttttacggatgtgaaatatctaggtaccaacgttacaaatggtaaaccggtcaacaaggatcaatgcgtttctggttacgataatgctggatttgtaattgccacatccgccagtttattcaacgaattttccctggaagcttccacttcgacctattataaaatgattaatagttttgccaacaagtacgttaacaacctatcccaagatgacgatgatattgcaatttacgctgcaaatccattcaaggatacagaatttgttgaccgcaattacacttccagtattgttgatgccgatgatttgtttttagttgatggtggtgaggacggccaaaatttgccgttggttccactaatcaagaaggaacgtgacttggatgtggtgttcgcattggatatatccgacaatactgatgaatcatggccaagtggtgtgtgcatgacgaacacttatgagcgccagtattctaagcaaggtaaaggaatggctttcccatatgttccagacgttaacaccttccttaacttgggcttaactaataagccaacgttttttggttgtgatgcaaaaaatttgacggacttggagtatattccacctttagttgtatatatcccaaacacaaaacattcattcaatggtaaccaaagtactttgaagatgaactacaatgttacagaacgtcttggaatgatcagaaatggttttgaagctgctacaatgggcaactttacggatgactctaactttttaggttgcataggttgtgccatcattagacgtaagcaagaaagcctaaatgccaccttgccccctgaatgtaccaaatgttttgcggattactgctggaacggcacactaagtacctcagctaatcctgaactatcgggaaatagtacgtatcaaagcggtgctattgcctctgcaatctctgaggctactgacggtattccaataacggctctcttaggttcatcaacctccggaaatactacatcaaactcaacaacctcgacttcatcaaatgtcacttctaactcaaactcttcgtcaaatacaactttaaactcaaattcttcatcctcttcaatttcttcctctacagctcgttcttcttcctctacggcaaacaaagcgaatgctgcggctatttcctatgcgaacactaatactctaatgagtttgttaggtgccataacagcattatttggactaatttag

SEQ ID NO: 25553 - DNA, 1995 bp, Saccharomyces cerevisiae
atgaagttgcagagtttgttggtttctgctgcagttttgacttctctaacagagaacgttaacgcttggtcaccaaataacagttacgtccctgcgaacgtaacctgtgatgatgatattaacttagtcagagaagcatctggtttgtcagataacgaaacagaatggctgaaaaaaagagatgcatacaccaaggaggctttgcattcttttttgaatagggccacttcgaatttcagtgacacttccttgctatccactctttttggtagcaactcttccaatatgcctaagattgccgtcgcctgttctggtggtggttaccgtgccatgttgtctggtgctggtatgcttgctgctatggacaatcgtactgatggcgcaaatgagcatggtcttggtgggctgctgcaaggtgcaacttacttggcaggtctgtcgggtggtaactggttaacaagtactttggcttggaacaactggacgtctgtgcaagctatcgtggataatacaacagaatctaactcaatttgggacatctctcattcaattcttaccccagacggcattaacatctttaagactgggagtagatgggacgacatatcagatgacgttcaggataaaaaagacgccggtttcaacatctctttggcggatgtttggggccgtgctcttgcgtacaatttttggccaagcttacaccgtggtggtgtagggtacacatggtcaactttaagggaagctgatgtcttcaagaatggagaaatgcccttccctatcactgttgcagacggtagatacccaggtaccaccgtgataaacttgaatgccactcttttcgaatttaatccctttgaaatgggttcatgggaccccactttgaacgcatttacggatgtgaagtatttaggtaccaacgttacaaacggtaaaccagttaataaaggccaatgcattgccgggtttgataacactggtttcataacagccacttcatctacgttgtttaaccaatttttactaagattgaattctaccgatttaccttcatttattgctaacttagccaccgatttcctggaagatttatccgacaatagtgacgatattgcaatttacgccccaaatccattcaaggaagctaattttcttcaaaagaacgcaacctccagtattatcgaatcagaatatctatttttggttgatggtggtgaagataaccaaaatattcctttagttccattgttgcaaaaggaacgtgaactagatgttatttttgcattagacaattctgctgatactgacgactattggccagatggtgcttcattagttaacacttatcagcgtcaatttggcagccaaggtctcaatttgtctttcccatatgttccagatgtgaacacatttgtcaacttggggttgaacaaaaagccaaccttttttggttgtgatgcaagaaatttgacagacttggagtacattccaccattaattgtttacattccaaattcaagacattcatttaatggtaaccaaagtacttttaagatgtcatactccgattcagaacgtcttggtatgattaagaatgggtttgaagctgccacaatgggtaattttactgatgattctgatttcttgggctgtgttggttgcgccattatcagacgtaagcaacaaaacttgaatgctacattgccctctgaatgcagccagtgttttaccaactactgctggaacggtactattgacagcaggtcagtctcaggtgtaggaaatgatgattattcttcttctgcttccttgtctgcctccgccgctgctgcctctgcctctgcctctgcctctgcttccgcctctgcctctgcttctgggtcttccactcataagaaaaatgcgggcaatgctttggtgaattattctaacttaaacactaacacttttattggtgtcttaagtgtcattagtgccgtcttcggtctaatttag

SEQ ID NO: 25554 - DNA, 1626 bp, Saccharomyces cerevisiae
atgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataa

SEQ ID NO: 25555 - DNA, 1617 bp, Saccharomyces cerevisiae
atgagttctgtcgcagaaaatataatacaacatgccactcataattctacgctacaccaattggctaaagaccagccctctgtaggcgtcactactgccttcagtatcctggatacacttaagtctatgtcatatttgaaaatatttgctactttaatctgtattcttttggtttgggaccaagttgcatatcaaatcaagaaaggttccatcgcaggtccaaagtttaagttctggcccatcatcggtccatttttggaatccttagatccaaagtttgaagaatataaggctaagtgggcatccggtccactttcatgtgtttctattttccataaatttgttgttatcgcatctactagagacttggcaagaaagatcttgcaatcttccaaattcgtcaaaccttgcgttgtcgatgttgctgtgaagatcttaagaccttgcaattgggtttttttggacggtaaagctcatactgattacagaaaatcattaaacggtcttttcactaaacaagctttggctcaatacttaccttcattggaacaaatcatggataagtacatggataagtttgttcgtttatctaaggagaataactacgagccccaggtctttttccatgaaatgagagaaattctttgcgccttatcattgaactctttctgtggtaactatattaccgaagatcaagtcagaaagattgctgatgattactatttggttacagcagcattggaattagtcaacttcccaattattatcccttacactaaaacatggtatggtaagaaaactgcagacatggccatgaagattttcgaaaactgtgctcaaatggctaaggatcatattgctgcaggtggtaagccagtttgtgttatggatgcttggtgtaagttgatgcacgatgcaaagaatagtaacgatgatgattctagaatctaccacagagagtttactaacaaggaaatctccgaagctgttttcactttcttatttgcttctcaagatgcctcttcttctttagcttgttggttgttccaaattgttgctgaccgtccagatgtcttagctaagatcagagaagaacaattggctgttcgtaacaatgacatgtctaccgaattgaacttggatttgattgagaaaatgaagtacaccaatatggtcataaaagaaactttgcgttacagacctcctgtcttgatggttccatatgttgttaagaagaatttcccagtttcccctaactataccgcaccaaagggcgctatgttaattccaaccttatacccagctttacatgatcctgaagtttacgaaaatcctgatgagttcatccctgaaagatgggtagaaggctctaaggctagtgaagcaaagaagaattggttggtttttggttgtggtccacacgtttgcttaggtcaaacatatgtcatgattaccttcgccgctttgttgggtaaatttgcactatatactgatttccatcatacagtgactccattaagtgaaaaaatcaaggttttcgctacaattttcccaaaagatgatttgttactgactttcaaaaagagagacccaattactggagaagtcttcgaataa

SEQ ID NO: 25556 - DNA, 1527 bp, Saccharomyces cerevisiae
atgaatacagtttcaccagccaaaaaaaaggttattataattggtgccggtattgctgggcttaaagctgcatctacgctacaccaaaacggtattcaagattgtcttgttcttgaggccagagatcgggtcggtggtaggttgcaaactgtcacaggctatcaaggtcggaaatatgatataggtgctagctggcaccatgatacgttgacaaaccctttatttttggaagaggctcaactgagtttgaatgatgggagaacgaggtttgtttttgatgacgataattttatttatatcgacgaagaacgtggaagggtagaccatgacaaggaactgcttcttgaaattgtggacaatgaaatgagcaaattcgcagagttagaattccatcaacacttaggagtttcagattgctccttttttcaattagtaatgaaatacttactacaaagacgccaatttctcacaaatgaccaaataagatatttgccacaactctgtcgatatctggaattgtggcacggcttagattggaagcttttgagtgccaaggatacatacttcggtcaccaaggaaggaacgcctttgctttgaactatgattctgtggttcaaagaattgctcaaagctttcctcaaaattggttaaagctaagttgtgaagtgaaatcaattacacgagaaccttcaaaaaatgtgacagtgaactgtgaagatggtactgtgtacaatgctgattatgttattattacagtacctcaaagtgtattgaatttgtctgtacaacctgaaaaaaatttacggggaagaatagaatttcaaccacccttgaaaccagtgattcaagatgcttttgacaagatccattttggagcgctaggtaaagtaatttttgagtttgaagaatgttgttggtcgaacgaaagttcaaaaattgtaactttggctaactctaccaatgaatttgtcgaaatagtacgtaatgcggaaaatttagatgaattagactctatgctagaaagggaagattctcaaaagcatacgagtgttacttgttggagccagcctttatttttcgtaaatttgtcaaaaagcacaggagtagcaagctttatgatgttgatgcaggcaccgcttacaaatcacatagaatccattagagaagataaagagcgtctttttagttttttccaacctgtgctgaacaagattatgaagtgtctagattctgaggatgtcatcgacggaatgaggccgatagaaaacattgcaaacgctaataaaccagtcttaagaaacatcatcgttagcaactggacacgcgatccttactcacgcggtgcttattcggcctgttttccaggagatgatccagttgatatggttgttgcaatgtctaatggtcaagactcccgcataagatttgcaggcgaacatactatcatggacggcgccggctgtgcctatggtgcttgggaaagcggaagacgggaggcgactcgaatctctgacttactgaaatag

SEQ ID NO: 25557 - DNA, 498 bp, Saccharomyces cerevisiae
atgtcgaaaaccgctcagaaacgtctcctcaaggagcttcaacagttaattaaagattctccacctggtatagtggctggtcccaaatcggagaataacatattcatttgggactgcctaattcaagggcctccagatacgccatacgctgatggtgtttttaatgctaagctagagtttcctaaagactatccgttatctccacctaaacttactttcacacccagcatactacatccaaatatttatccaaatggggaagtgtgcatatccattctacactcccctggtgatgatcctaacatgtacgaattagcggaagaaagatggtcgccagtgcaaagtgtagaaaaaattctattaagtgttatgagcatgttgagtgagcccaatatcgaaagtggtgccaacattgatgcttgcatcttgtggagagataatagacctgaatttgagagacaggtaaagttatccattttgaaatcattaggattctga

SEQ ID NO: 25558 - DNA, 2010 bp, Saccharomyces cerevisiae
atgagctacagttatgaagcttgtttttgggacccaaacgacaatggtgtgaacatccttctgggtcacatttctcagggaataagatcttgcgactcaatgatacttttctttaagcagcgtagtgagcttgagaaggactatgccaggcggcttggagccatcacgggaaaactagacaaagacattggaacaaacatggattatggaaagttgaatgaaacatttaatgtggtgctcagtgttgagaaagctcgagcacaatcgcattccaagcaaagtgagattcttttcagacagatttacacggatactaaggcatttgccgctaacttgcaagcaagatatactacattgagtggaaagattgaaaggttgcggatggacaagttcaacaagaaaaaggggtgtgaggtgttgcaaaagaaattacaggatgcccagattagattcagagacttgcaattgaacgagaataatatgattggggccaagagagtagaacacaacaagagagaactattgaaatgggaatcgaactctcaggaatataaggttcaactagacgttcttaagcaagaatataaggcatcgcagaaattctggatacacgagtgggcgcaattatcctgcgaactgcaagaaatggagaacgctagaatatcctttttacaatcgaaattacaacagttcgcaacctcatcgatggaaacatatattttagagcaaacaaaaatggacatgttaacaaatcatctgaactcattcacggcagcggatgaaatatcgacgttttcaaaagaaaatggaactggtagactgaaacataagacttccaaaggtgacatgaattctagcgccaactgggctcaaatgagcagtatctccacgacaagtaaaaaaaccgaatcgtatatggacaatataaggaaactatcttctcagctgaaggaaaccgaaaataaaaggaaactagcttcaatagacaaatatgagaaaccattgccatctccagaagtcaccatggctacacaatttagaaattccacacccgtcatacgtaatgagacaaaagtggttgctaacccaacattatctttgaggtcttcacccgtccagttacagagcaatgtggatgactccgtgttaaggcagaaacctgataaaccaaggccgattgttggggaagaacaacttaaacctgatgaagattcgaaaaatcctgatgaaaaaggtctaatggtgcataaaagaaatcaatctctcagctcaccatcagaatcaagttcttctaatccaacggattttagccacatcaaaaagagacaaagtatggaatctatgactacatccgtaagttcaatggccaatagtatagacgactcacagagatttgccaaatcatggaactcgtcaaataggaaaagaaaatctatgagccatttgcaagtaccctcatccgcttcttcgaggtcggatgatgggggaagaacgcctaactctgcgcacaacctcaatgaagatgattataacacgaggagagataccagtacaagcacaattttgttcaaacctcctgtggcagtaagaggaacgtctagggggcacacgcatagacaatccatgataatgcaagattcaagtaatccaattgaagatgccttgtacgaaatggaaagaatccaaagtagttctaaaccaggtacaaaaacaggaaacatcatggatgagagaggtgtggtcagggatagaggtattactgttaccttgcctattgtcaccagtgaaggttttccagtcattgaatatgccaaggccatgtatccattgattggaaatgaggcacctggattagcgaatttccataagggcgactatctgctaattactgagattgttaataaagattggtataaaggtgaagtttatgataatgaccgtatagatagaaatcataggataggattaattccctataatttcattcagctactgcatcaaggtctttga

SEQ ID NO: 25559 - DNA, 534 bp, Saccharomyces cerevisiae
atgtttcgagccggatcatcaaaaagattcttacgaaacacactaatagcaatttcatgggttccggtacttctaacaatcaataataatgtggtccatattgcgcaagttaaaggtacctctatgcagcctacgctgaacccgcaaacggaaacgctggcaacagattgggtgctgctttggaagtttggagtcaagaacccaagtaatttatctagagatgacattatccttttcaaagctcctacaaaccctcggaaagtttactgcaaaagggttaaaggtttaccgtttgataccattgacacgaagtttccataccctaaacctcaagtgaacctgcccaggggacacatatgggtcgaaggggacaattattttcattcgattgatagcaatacttttggccccatttccagtgggttggtcatagggaaagctataacaattgtttggccaccctccaggtggggaacggatctcaaactgagtaccggtagagactgcattagcaaaagagccattttagaatga

SEQ ID NO: 25560 - DNA, 615 bp, Saccharomyces cerevisiae
atgaatagcggtggtagtgatagtttcgattatcttcttcaattaacaaaagctttaagtgcagagtgtcgggctaacagacaagagaccgatcgaatagaactattgttaaagcgccttgccaaacagtcaggaatatcttatgataatttgagcaaaaacataattccagattcatggaaagataatgcatctcaaaaagcatctccccccactgaggcacagaagcttatcagcgaaaattttaaactcatatacgagattgaaaaacaagagtacttcaatacaaaggctgttgcgctaattaacaacataaatgagcatttctcatatattaaaaattttatcgacgaacagaatgcaataagagaacgaaatattgccacattttcatcagagaagcttgatgaaaggaacaaaagtcttcaacaaaattacgagtcattgaagacagaaaatgaagaaacaaaaaaaaaattgcattcaattatcaaacagtttgaaaaacttttgaaggaagtggattgggatcgtatatctaaagattccagagattacagccgctttaaaaaacagttggaatacctgcaagacacgtaccaggtactgaaatag

SEQ ID NO: 25561 - DNA, 2673 bp, Saccharomyces cerevisiae
atgaatcaagaagaggctatattccggtcagcagacatgacgtacgtccaactgtacataccgttggaagtcataagagaggtaactttcttattagggaaaatgagtgtctttatggtgatggatctcaataaagatttaactgcctttcaaagaggttatgttaaccagttgaggcgtttcgatgaagtggaaaggatggtaggcttcttgaatgaggtagttgaaaagcacgccgcagagacctggaagtatattttacatatcgatgatgaaggaaacgacattgcccaacccgatatggcggatctcatcaataccatggaaccactatcgttggaaaatgttaatgacatggtgaaggaaattactgattgcgaatcccgtgcaaggcaattagatgaatctttagatagccttagaagtaaactgaacgatcttttagagcaaaggcaggtaatattcgaatgctcaaaatttattgaagtcaatcctgggattgctggaagagctacaaaccccgagattgaacaagaagaaagggatgttgacgagtttagaatgacccctgatgatatcagtgaaacattaagcgatgctttttcttttgacgacgaaacaccacaggaccggggcgctctagggaatgacctcactagaaaccaatcagtcgaagatctaagctttttagagcagggataccagcatagatacatgataacaggctctatcagaagaacaaaagtagatatattgaacagaatcctgtggaggttattgcgtggtaatttgatctttcagaattttccaatagaggagccattgttggaaggtaaagaaaaggttgaaaaggactgctttattatttttactcatggtgaaacattgctcaagaaggttaagcgtgtcatagattccttaaatggtaaaatagtctccctgaatactcgttctagtgaattagttgacaccttaaaccgtcaaatagacgacttgcaaagaatcctggatactaccgaacaaactttacacacagaactgctcgttatacatgaccagctgccagtatggtccgccatgacgaaaagggaaaaatatgtttataccacattgaacaagttccaacaagaatcacagggtctaatagccgaaggttgggtgccttccacagaattgatccatttacaagactcattgaaggattacattgaaacgttgggttctgaatacagtaccgtctttaatgtgatcctaaccaataaattaccacctacataccatagaaccaacaagttcactcaggccttccaatcgattgtggatgcatacggtatcgcaacatataaagaaatcaatgctggtttagccacggttgtcaccttcccatttatgtttgccattatgtttggtgacatgggccatggtttcattttatttttgatggcactattcttggtgctaaatgaacgtaagtttggtgctatgcacagggacgaaatttttgacatggcatttacaggtagatatgttttattgttgatgggtgcattttctgtatatactgggctgttgtacaatgatatcttttccaaatctatgacaatattcaaatcaggctggcaatggccttccactttcagaaagggcgaatcgattgaggcgaagaaaactggggtttatccgtttggattggattttgcttggcatggtactgataacggactactattttccaactcttataagatgaagctgtccattctaatgggatacgcacatatgacttattccttcatgttttcttatatcaattacagagctaaaaactctaaagtggacataattggtaactttatccccggtttagtgtttatgcaatcaatatttggttatttgtcgtgggctatcgtgtacaagtggtcgaaggattggattaaagatgataagcctgctccagggttactgaatatgctaataaacatgtttttagcaccgggtactattgatgatcaattatattccggacaagccaagttgcaagttgtactactgcttgcggcactagtttgtgtcccgtggttattgctgtataaacctttaacactgagaaggttaaataagaacggtggtggtggcaggcctcacggataccaaagtgtgggcaatattgagcatgaggaacaaatagcacaacagagacattcagcggaaggtttccaagggatgatcatcagtgatgttgccagtgttgcagacagtatcaatgaaagcgttggtggaggtgaacaggggccatttaatttcggcgatgtcatgattcatcaggtaatccatactattgaattctgtttaaattgtatctctcatacagcatcatatctacgtctttgggcactatcgttggcgcatgcgcaattatctagtgttttatgggatatgacaatttcaaacgctttcagttctaaaaactcagggtcgcctttggctgtcatgaaggtggttttcttatttgctatgtggtttgttttaaccgtttgtatcctagttttcatggaaggtacttccgcaatgttgcatgcgctacgtttgcattgggtggaggcaatgtccaaattttttgaaggtgaaggatatgcgtacgagccattttcatttcgtgcaataatagaataa

SEQ ID NO: 25562 - DNA, 921 bp, Saccharomyces cerevisiae
atgacctcaattgaagatctgatatcaaatcctcccctgctactgcattcctcactctctcaacttcgctacctcatactcagtgaagggcttcccatatctgaagataaacagcagcagcgcacgcgatgttacgtgtggacggtgctctctcaaacttctatggaggcgtctacacaacggtaccttgcgctcttgaaactgggcccaccttccacaaccatttaccaaaaaatcaagaacgacacatccagaacttttcagacggatccaaactttagaaatagagtctcagaggatgccctcatccggtgtctgtcgtgctttgcttggcaaacacaacaaagaagacaaaagactcgttttggtcgcattcctgtgagcacatatgtgcagggcatgaacgtgttattagctcctctgctttactcatgtccttctgaacctatggcgtatcaacttttcactaagctttgttatgaaatgataccgacgtatctaactaagaacctaaacggcgcccagaacggcgccaaactactagatatttctctcagaatcattgatccaaagctgagtaaatttctatcggacaatttacttacagcagagatttatggtatgccttccatactcacgttatccagctgcaataaaccgcttgatcaggtcattaaactgtgggatttcatgtttgcatatggattccatatgaatattctctttgtggtggcattcctagttaaaatgagatccaaggttttcaaatcggattcccctgttaatttactacgacagtttccggattttgatgctgacgagatcattcggctgggcgtcgggttcatcgctaagatccctgctcaaatttatgacctattggtagaccacttgaccgacccagacatatatataccgtaa

SEQ ID NO: 25563 - DNA, 930 bp, Saccharomyces cerevisiae
atgtctcacacagaaacacagactcagcagtcacacttcggtgtggacttccttatgggcggcgtttctgctgccattgcgaagacgggtgccgctcccattgaacgggtgaaactgttgatgcagaatcaagaagagatgcttaaacagggctcgttggatacacggtacaagggaattttagattgcttcaagaggactgcgactcatgaaggtattgtgtcgttctggaggggtaacaccgccaatgttctccggtatttccccacgcaggcgctgaattttgccttcaaagacaaaattaagtcgttgttgagttacgacagagagcgcgatgggtatgccaagtggtttgctggaaatcttttctctggtggagcggctggtggtttgtcgcttctatttgtatattccttggactacgcaaggacgcggcttgcagcggatgctaggggttctaagtcaacctcgcaaagacagtttaatggattgctagacgtgtataagaagacactgaaaacggacgggttgttgggtctgtaccgtgggtttgtgccctcagttctgggtatcattgtctacagaggtctgtactttggcttgtacgattctttcaagcctgtgctgttgacgggggctctagaggggtcctttgttgcctctttcctattaggttgggtcattaccatgggtgcttccactgcgtcgtatcccttggatacggtaagaagaaggatgatgatgacttcgggccagaccatcaagtacgacggtgctctggactgtttgagaaagattgttcagaaagagggcgcgtattccttgttcaagggctgtggtgccaacatatttagaggagtcgctgcagctggtgtcatctcattgtacgatcagttgcaactcataatgtttggcaaaaaattcaagtga

SEQ ID NO: 25564 - DNA, 1287 bp, Saccharomyces cerevisiae
cttatagataagtatgcattatacgtgcccaagacgggctcttttcctaaaggatttgaagtaggctacactgcatctggagtcaaaaaaaacgggagcctggacctgggtgtaatcttgaataccaataaatctcgtccttcaaccgcagcagctgttttcacgaccaataaattcaaagctgcgccagttttgacatcgaaaaaagtccttgaaactgctcgtggtaaaaacatcaacgctattgtagtcaattccggttgtgctaactcggtcacaggtgatcttggtatgaaagatgcccaagtaatgattgatttggttaacgataaaattggtcaaaaaaattctaccctagtcatgtctacaggcgttattggacaacgactacagatggacaagatcagcactggtatcaataaaatttttggagaagaaaagttcggcagtgattttaactcttggttgaacgtagccaaatcaatctgtactactgatactttcccaaaattagttacatctagattcaaattacctagtggtactgagtatactttgacaggtatggcaaagggcgcgggtatgatttgtccgaatatggctaccttattaggtttcatagttacagatcttcctattgaaagcaaggcgttgcagaagatgctgactttcgctactacccgttcatttaattgtatatcggtggacggtgatatgagcaccaatgacacaatttgcatgttggccaacggtgctattgacaccaaagaaattaacgaagactctaaagattttgaacaagtaaaattgcaggtcacagaatttgctcagcgcttggcccagttagtcgttcgcgatggtgaaggttcgacaaagtttgttactgttaacgttaaaaatgctttgcattttgaagacgccaaaataattgctgaatcaatctcaaactctatgttggtcaaaaccgcactatatgggcaagatgccaattggggaagaatattgtgcgcgatcgggtatgcaaagctgaatgacttaaaatctctagatgtcaacaaaattaatgttagctttattgctaccgacaattcagaacctcgtgagctgaagcttgtcgctaatggtgtgccacaattggagatcgatgaaacaagggcttctgaaatattggctttgaatgatttggaagtgtctgtcgacttgggaaccggtgatcaggcagcacaattttggacttgtgatttatcacatgaatatgtaacaattaacggtgattaccgttcataa

SEQ ID NO: 25565 - DNA, 1128 bp, Saccharomyces cerevisiae
atgttgagaacgtcaacattgttcaccaggcgtgtccaaccaagcctattttctagaaacattcttagattgcaatccacagctgcaatccctaagactcaaaaaggtgtcatcttttatgagaataaggggaagctgcattacaaagatatccctgtccccgagcctaagccaaatgaaattttaatcaacgttaaatattctggtgtatgtcacaccgatttacatgcttggcacggcgattggccattacctgttaaactaccattagtaggtggtcatgaaggtgctggtgtagttgtcaaactaggttccaatgtcaagggctggaaagtcggtgatttagcaggtatcaaatggctgaacggttcttgtatgacatgcgaattctgtgaatcaggtcatgaatcaaattgtccagatgctgatttatctggttacactcatgatggttctttccaacaatttgcgaccgctgatgctattcaagccgccaaaattcaacagggtaccgacttggccgaagtagccccaatattatgtgctggtgttactgtatataaagcactaaaagaggcagacttgaaagctggtgactgggttgccatctctggtgctgcaggtggcttgggttccttggccgttcaatatgcaactgcgatgggttacagagttctaggtattgatgcaggtgaggaaaaggaaaaacttttcaagaaattggggggtgaagtattcatcgactttactaaaacaaagaatatggtttctgacattcaagaagctaccaaaggtggccctcatggtgtcattaacgtttccgtttctgaagccgctatttctctatctacggaatatgttagaccatgtggtaccgtcgttttggttggtttgcccgctaacgcctacgttaaatcagaggtattctctcatgtggtgaagtccatcaatatcaagggttcttatgttggtaacagagctgatacgagagaagccttagacttctttagcagaggtttgatcaaatcaccaatcaaaattgttggattatctgaattaccaaaggtttatgacttgatggaaaagggcaagattttgggtagatacgtcgtcgatactagtaaataa

SEQ ID NO: 25566 - DNA, 1416 bp, Saccharomyces cerevisiae
cacttgtttaaggaagtcaccccccttcgttcacaatacctgagaaactctacaacttctacattcaatcatggctcatccacagaaacgccagccgagaacggcttgccgcgacccatggaattctatttgtcatccgattgtgcatcactagcgcggtatgtgagtaaagtagtatatttggaggataatgatattgcccatatctatgatggggagcttcatatccattgttctaaaattggttccgaggacttttcatttagaacagttcaaaaattagaattggagttgtccaaaatcaaaaaaggcccttacgataattttatgcaaaaggaaatatacgagcagtgtgaaacaacaaaaaatgtcatgagaggaagagttgacgcctttacaaacagagtagttttgggaggactagaaaattggttgacagaattgagaagagcaaaacgaataataatgattgcatccaaggcctccttccattcatgcctagctgcccgtcccatctttgaggagttaatggaagttccagtaaacgttgaattggccttggattttgttgaccgcaattgttgcattttcaggaacgatgtttgcatatttgtttctcgaagtggggagacaactgatacaattaatgctttgaactactgtatcaaaaaagaggcagtcacaatcggggtagttaattgcagcggttcctctatctcaagatttacacattgcggtgttcatacaaacacaggccccgagaaaggtattgcaacaaccaagtcttatacttctcaatacatcgctttagtcatgattgccctatggatgtcggaagatttggtgtctaaaatagaaaggaggaaagaaataattcaagccttaactatagtcccaagccaaataaaagaagttttggagcttgaaccattgattattgaattgtgtgacaagaaactaaaacagcatgatacatttttgcttttaggaagaggttaccaatttgcctctgctttggaaggcgcctcgaagatgaaagaaatttcttacgtgcattctgaaagtattcttaccaacgagctaggacacagagtcctagctgtggcatctgataatccgccaattatcgcctttgcgacaaaggatgctttttcgcccaaaatcgcgtcttgcattgaccaaataatagaaaggaagggcaatccgattatcatttgtaacaaggggcataagatatgggagcaagacaaacaaaaaggaaacgttgttacactcgaggtaccccaaaccgtagattgtctccaagggatacttaacgttattcctttacaattaatttcttactggttagcgatcaagaaagacatcggagttgatttgccaagggactcggcgatgtcggccccggatatataa

SEQ ID NO: 25567 - DNA, 2478 bp, Saccharomyces cerevisiae
atgttgctactttcttggtcaagaattgctactaaggtagttagaaggcccgttcgcttccggtcctattacggcttgacccatatcaagagtttacatactcaatatcggctactcaataggctgcaagagaataagagcggtaacaagaacgaggacaataacgaagacgctaaacttaacaaagaaattcccacagacgaagaggttgaagcaataagaaaacaagtagaaaaatatatcgaacaaactaaaaataatactataccggctaactggaaagaacagaaacgcaaaattgatgaaagtattaggcgtttagaagatgctgtattgaaacaagaatctaacagaattcaagaagaaagaaaggaaaaagaggaggaaaatggtccttcaaaagccaagtcaaacagaacaaaagagcagggctactttgaaggtaacaatagcagaaatattccaccgccaccaccacctcctcccccaaaaccacctctaaatgatcctagtaatcctgtatcgaaaaatgttaacttattccagataggactaacttttttcctcctttcgtttttattggatctcctcaacagtttggaagagcaaagtgagataacgtggcaggattttagagagaaactattggcaaaaggttatgttgcgaagttgattgttgtcaacaagtccatggtgaaagtgatgttaaatgacaacggaaaaaaccaagccgacaattacggtcgcaacttctattatttcacaattggttcaattgatagcttcgaacacaaacttcagaaagcacaggacgaactggacattgataaggatttcagaatacctgtactatatgttcaagaaggcaattgggctaaagctatgttccaaattttgccaactgttttaatgattgcaggtattatttggttgacaagaagatcggcacaagcagcgggcggtagccgtggaggcatatttggtctgagtcgttctaaggctaaaaaatttaacactgaaacagacgttaagatcaagttcaaggacgttgccggatgcgatgaggctaaggaagaaattatggagtttgttagcttcttgaaagaaccttctcgttatgaaaaaatgggagctaaaattcctagaggtgcgattctatctggtccaccaggtaccggtaaaactttgcttgcaaaggcaacagcaggtgaagccggtgttccgttttattttgtttctggttcagaatttgtagaaatgtttgttggtgttggtgcagcaagagtaagagatttgttcaaaactgcaagagaaaatgcaccctcaattgtgtttattgacgaaattgatgctataggaaaagcaagacaaaagggtaatttttcaggtgccaatgatgagagagagaacacgctaaatcaaatgttagtagaaatggatggtttcactccagctgaccacgttgttgttttagctggtaccaatagacccgatattctcgataaagcattattaaggcctggtagatttgacaggcatatcaatatcgacaagcccgaacttgagggtagaaaagccatttttgctgttcatttacatcatttgaaacttgccggggaaatttttgatttgaaaaatagattagcggctttgacgccaggcttttctggtgctgatattgccaacgtttgtaacgaggccgccttgattgctgctagaagtgatgaagatgcagtaaaattgaatcattttgaacaagctatcgaaagagtcatcggtggagtggaacgcaaatccaagctactctctcccgaagagaagaaagtagtggcttaccacgaggctggtcatgctgtatgtggatggtacttaaaatacgcagatcctcttctgaaagtcagtattattccacgtggccagggcgcccttggttatgcacagtatttgccaggtgatatcttcttactaactgaacagcaacttaaggacagaatgaccatgtctctgggtggaagagtttctgaagaattacatttcccatcagttacaagtggcgcatctgatgacttcaaaaaagttactagcatggccacggcaatggtcacagaattaggcatgagtgataaaattggctgggtcaattaccagaagagagatgatagcgatttgacaaaaccattttcggacgagacaggtgacattattgattccgaagtatacagaatcgtccaagaatgccatgacagatgtacaaagctgcttaaagaaaaagcagaagatgtagagaagattgctcaagtactactgaaaaaagaagttttgacaagagaagatatgattgatttacttggtaagcgccctttcccagaaaggaatgatgcttttgataagtacttgaacgattacgaaacggaaaaaatcaggaaggaagaagaaaaaaacgaaaaacgtaatgagcctaagccatctacaaactga

SEQ ID NO: 25568 - DNA, 1848 bp, Saccharomyces cerevisiae
atgtcatctatctctttgaaggaaattataccacctcagccttcgacacagcgtaactttactacgcatttatcgtatgaccctacaaccaacgcaattgcttacccatgtggaaaatctgcatttgtacgttgtttggacgatggagacagtaaagtacctccagtagtacaatttactggtcatggctcttcggtagtcacaacggtaaagttctctccaattaagggttcccagtacctatgctccggtgacgaatctggaaaagtgattgtttggggatggacatttgacaaagaaagcaattctgttgaagtgaatgttaagtctgaattccaagttttagcaggtccaatcagcgatatctcctgggattttgaagggcgaagactctgcgttgtgggagaaggtcgtgataactttggtgttttcatatcctgggattctggtaattccttaggtgaagtttcaggtcactcacaacgcatcaatgcttgtcatttgaagcaatctagacctatgagatctatgacagttggagatgatggatctgttgtcttttatcaaggacctccatttaagttctctgccagtgacagaacacaccacaaacaaggctcatttgtcagggatgttgaattttcacctgacagcggtgaatttgttattacggtagggtctgacagaaagatttcttgctttgatggcaaatcaggtgagtttcttaaatacatagaggatgatcaagaaccagttcaaggtggtatatttgcactatcgtggcttgattcccaaaagtttgctaccgtaggagcagacgctaccattagggtttgggacgtcacgacttcaaaatgcgttcaaaaatggaccttagacaagcaacaactgggaaatcaacaagttggtgttgttgcaacaggaaacggaaggattatttctctttcactggatgggaccttaaacttctatgaacttggacatgacgaggttttaaaaaccattagtggtcataacaagggtattactgctttgacagtcaacccactaatcagtgggtcatatgatggtaggattatggaatggtctagctcttccatgcaccaagatcactccaacttgattgtatcattggataatagtaaagcgcaagaatactccagtatttcttgggatgatactttgaaagtgaacggtattactaagcatgaatttggatcgcaaccaaaggttgctagtgcgaacaatgatggcttcactgcagtactaacaaatgatgatgatttgttgatattacagtcttttacgggcgatataatcaagagtgtaagactgaactcaccaggctctgccgttagcttgagccaaaattacgttgcagttggtttggaagaaggtaatactattcaggtattcaaattatcagatttggaagtcagttttgatttaaaaacacctcttcgcgcaaaaccctcgtacatatcaatttcgccatctgaaacatacatcgctgctggagatgttatgggcaagatattgctatatgatttacaatcaagagaagtgaaaacttcaagatgggctttccacaccagtaaaatcaacgccatttcatggaaacctgctgaaaagggagcaaacgaagaggaaattgaagaggacttagttgccactggttctttagacaccaatatttttatttactccgtcaaaagacctatgaaaatcattaaggcgttgaatgctcacaaggacggtgttaacaaccttttatgggaaacaccatctaccttggttagttctggtgcggacgcttgcattaaaaggtggaatgttgtcctcgagtga

SEQ ID NO: 25569 - DNA, 2034 bp, Saccharomyces cerevisiae
atgcattcctggcgaatatccaagtttaagttaggaaggtccaaagaagatgatgggagtagtgaagatgaaaatgaaaaatcgtggggtaatggcctgtttcatttccaccatggagaaaaacatcacgatggtagcccgaagaatcataatcatgaacacgaacaccatataagaaagatcaatacaaatgagactctcccaagttccttaagttctccaaaattacgtaatgatgcatccttcaagaatccatcggggataggaaatgacaattctaaggcttccgaaaggaaagctagtcagtcgtctactgagacgcagggaccgagttcggaatccggactaatgacagtgaaggtgtattctggtaaagattttactcttcccttccctatcacctctaactctactattttacaaaaactactaagttccggcatccttacttcatcatccaatgacgcttccgaagttgcagccataatgcggcagctaccacgatacaagagagtggatcaagattcagcaggggaaggcttgatagatagagcttttgccactaaattcattccttcctctatattgttacctgggtcaacaaattcaagcccattactttattttacaattgaatttgataattctattactactattagtccagatatgggaacgatggagcaaccagtgtttaacaaaatatcgacatttgatgtaacaagaaaattacgatttttaaaaatcgatgtctttgcaaggattccatccctacttttaccctctaaaaactggcaacaggagattggcgagcaggacgaagtactgaaggagattttaaaaaaaatcaatacaaatcaggatatccatttggactccttccatttacctttgaatttaaaaatcgattctgcagcccaaataagactatacaatcaccattggatttctttagaaaggggatatggtaaattaaatatcacggtggactacaaaccttctaagaacaagcctctctccattgatgactttgatctattgaaggttatcgggaagggttcgttcggcaaagtgatgcaagtaaggaaaaaagatacccaaaagatttacgctttgaaggctctgagaaaagcatatattgtatcgaaatgtgaagtgacacatactttagcggagaggactgtcctagcaagagttgactgcccctttattgttccgttgaagttctcattccaatctccggagaagttgtacctagtattagctttcattaatggcggtgaactgttctaccatttacaacacgagggacgattcagtctagcacgctcccgtttttatattgcagaactattatgtgctctcgattcattacacaaacttgacgtcatttatcgtgacctaaagcctgaaaacattctattggattaccaaggacatattgcactgtgtgattttgggctttgcaagctgaacatgaaggataatgacaaaacagacactttctgtggtactcccgaatatttggcaccagaaatcttgttggggcagggctatactaaaacagttgactggtggacattaggtatcttactgtatgagatgatgacagggctgccaccatactatgatgagaacgttcctgttatgtacaagaaaattctgcagcaaccgctactatttcctgatggatttgaccctgcggcaaaagacctattaattggcctcttaagcagagacccaagcagaagactcggcgttaacggtacagatgaaattcgtaaccatcctttctttaaagacatctcatggaaaaagctacttttgaagggctatattccgccttacaagccaattgtaaagagtgaaatagatactgcaaattttgatcaagagttcactaaggaaaaaccgatcgatagtgtagtggacgagtacttaagtgcaagtattcaaaagcagtttggtgggtggacgtacattggtgacgaacagttgggtgattctccttcgcaggggagaagcattagttag

SEQ ID NO: 25570 - DNA, 1710 bp, Saccharomyces cerevisiae
atgtcatttcaaattgaaacggttcccaccaaaccatatgaagaccaaaagcctggtacctctggtttgcgtaagaagacaaaggtgtttaaagacgaacctaactacacagaaaatttcattcaatcgatcatggaagctattccagagggttctaaaggtgccactcttgttgtcggtggtgatgggcgttactacaatgatgtcattcttcataagattgccgctatcggtgctgccaacggtattaaaaagttagttattggccagcatggtcttctgtctacgccagccgcttctcacatcatgagaacctacgaggaaaaatgtactggtggtattatcttaaccgcctcacataatccaggtggtccagaaaatgacatgggtattaagtataacttatccaatgggggtcctgctcctgaatccgtcacaaatgctatttgggagatttccaaaaagcttaccagctataagattatcaaagacttcccagaactagacttgggtacgataggcaagaacaagaaatacggtccattactcgttgacattatcgatattacaaaagattatgtcaacttcttgaaggaaatcttcgatttcgacttaatcaagaaattcatcgataatcaacgttctactaagaattggaagttactgtttgacagtatgaacggtgtaactggaccatacggtaaggctattttcgttgatgaatttggtttaccggcggatgaggttttacaaaactggcatccttctccggattttggtggtatgcatccagatccaaacttaacttatgccagttcgttagtgaaaagagtagatcgtgaaaagattgagtttggtgctgcatccgatggtgatggtgatagaaatatgatttacggttacggcccatctttcgtttctccaggtgactccgtcgcaattattgccgaatatgcagctgaaatcccatatttcgccaagcaaggtatatatggtctggcccgttcattccctacctcaggagccatagaccgtgttgccaaggcccatggtctaaactgttatgaggtcccaactggctggaaatttttctgtgctttgttcgacgctaaaaaattatctatttgtggtgaagaatcgtttggtactggttccaaccacgtaagggaaaaggacggtgtttgggccattatggcgtggttgaacatcttggccatttacaacaagcatcatccggagaacgaagcttctattaagacgatacagaatgaattctgggcaaagtacggccgtactttcttcactcgttatgattttgaaaaagttgaaacagaaaaagctaacaagattgtcgatcaattgagagcatatgttaccaaatcgggtgttgttaattccgccttcccagccgatgagtctcttaaggtcaccgattgtggtgatttttcatacacagatttggacggttctgtttctgaccatcaaggtttatatgtcaagctttccaatggtgcaagattcgttctaagattgtcaggtacaggttcttcaggtgctaccattagattgtacattgaaaaatactgcgatgataaatcacaataccaaaagacagctgaagaatacttgaagccaattattaactcggtcatcaagttcttgaactttaaacaagttttaggaactgaagaaccaacggttcgtacttaa

SEQ ID NO: 25571 - DNA, 2064 bp, Saccharomyces cerevisiae
atgatcagacaatctacgctaaaaaacttcgctattaagcgttgctttcaacatatagcataccgcaacacacctgccatgagatcagtagctctcgcgcagcgcttttatagttcgtcttcccgttattacagtgcgtctccattaccagcctctaaaaggccagagcctgctccaagtttcaatgttgatccattagaacagcccgctgaaccttcaaaattggctaagaaactacgcgctgagcctgacatggatacctctttcgtcggtttaactggtggtcaaatatttaacgaaatgatgtccagacaaaacgttgatactgtatttggttatccaggtggtgctatcctacctgtttacgatgccattcataacagtgataaattcaacttcgttcttccaaaacacgaacaaggtgccggtcacatggcagaaggctacgccagagcttctggtaaaccaggtgttgtcttggttacttctgggccaggtgccaccaatgtcgttactccaatggcagatgcctttgcagacgggattccaatggttgtctttacagggcaagtcccaactagtgctatcggtactgatgctttccaagaggctgacgtcgttggtatttctagatcttgtacgaaatggaatgtcatggtcaagtccgtggaagaattgccattgcgtattaacgaggcttttgaaattgccacgagcggtagaccgggaccagtcttggtcgatttaccaaaggatgttacagcagctatcttaagaaatccaattccaacaaaaacaactcttccatcaaacgcactaaaccaattaaccagtcgcgcacaagatgaatttgtcatgcaaagtatcaataaagcagcagatttgatcaacttggcaaagaaacctgtcttatacgtcggtgctggtattttaaaccatgcagatggtccaagattactaaaagaattaagtgaccgtgctcaaatacctgtcaccactactttacaaggtttaggttcattcgaccaagaagatccaaaatcattggatatgcttggtatgcacggttgtgctactgccaacctggcagtgcaaaatgccgacttgataattgcagttggtgctagattcgacgaccgtgtcactggtaatatttctaaattcgctccagaagctcgtcgtgcagctgccgagggtagaggtggtattattcatttcgaggttagtccaaaaaacataaacaaggttgttcaaactcaaatagcagtggaaggtgatgctacgaccaatctgggcaaaatgatgtcaaagattttcccagttaaggagaggtctgaatggtttgctcaaataaataaatggaagaaggaatacccatacgcttatatggaggagactccaggatctaaaattaaaccacagacggttataaagaaactatccaaggttgccaacgacacaggaagacatgtcattgttacaacgggtgtggggcaacatcaaatgtgggctgctcaacactggacatggagaaatccacatactttcatcacatcaggtggtttaggtacgatgggttacggtctccctgccgccatcggtgctcaagttgcaaagccagaatctttggttattgacattgatggtgacgcatcctttaacatgactctaacggaattgagttctgccgttcaagctggtactccagtgaagattttgattttgaacaatgaagagcaaggtatggttactcaatggcaatccctgttctacgaacatcgttattcccacacacatcaattgaaccctgatttcataaaactagcggaggctatgggtttaaaaggtttaagagtcaagaagcaagaggaattggacgctaagttgaaagaattcgtttctaccaagggcccagttttgcttgaagtggaagttgataaaaaagttcctgttttgccaatggtggcaggtggtagcggtctagacgagttcataaattttgacccagaagttgaaagacaacagactgaattacgtcataagcgtacaggcggtaagcactga

SEQ ID NO: 25572 - DNA, 3660 bp, Saccharomyces cerevisiae
atggctatcttaaaaagaggagctagaaaaaaggtacatcaggagccagctaaacgctctgcgaatatcaagaaagctacttttgattcctcgaagaagaaagaagttggtgtgtctgatctgacgcttctttctaaaatctccgacgaagccataaatgaaaacttgaagaagagatttttgaatgctacaatctacacttatataggtcatgtgttaattagtgtcaatccattccgagacctcggaatctatactgatgctgttatgaatgaatacaaaggtaagaatagattggaagttccaccccatgtatttgcaattgcagagtctatgtactacaacatgaaatcatataatgaaaatcagtgtgttattatttcaggtgaatcaggtgccggtaaaactgaagcagctaaaagaattatgcaatatattgcggctgcttctagcacacatacggagtcaattggaaagattaaagacatggttttagccactaatccattgttggaatcttttggctgtgcaaagactctaagaaataacaactcttctagacatgggaaatatctagaaataaaattcaataaccagtttgaaccatgtgctggtaatatcacaaactatttattggagaagcagagagttgtgagtcaaattaagaatgaaagaaatttccatatattctatcagttcacgaaaggtgcttccgatgcttataggcaaacatttggggtccaaaaaccggaacaatatgtgtacacagctgctgcgggttgcatatctgctgagacaattgatgatttgcaagattatcaagagacattaaaagctatgagagttattggtctcggtcaagaagaacaagaccaaattttcaggatgttagctgcaattctttggattggtaatgtttcctttatagaaaatgaggaggggaatgcgcaagttagggacacctcagtaaccgattttgttgcttacttgttacaaatagatagccaattgctgattaaatcacttgtggaaagaattatggaaaccaatcatggtatgaaaagagggtcagtgtatcatgttccattgaatattgtccaagcagatgcggttagagatgctttggcaaaggctatttacaataacttatttgactggattgtgagtagggttaacaaatctctgcaggcttttccaggcgctgaaaaatccattggtattcttgatatttacggctttgaaatttttgaacataactcttttgagcagatttgtatcaattatgttaatgaaaagttacaacaaatctttattcaattgacattgaaatctgagcaagaaacttacgagagagaaaaaatccaatggaccccaattaaatactttgataacaaggttgtgtgtgatttgattgaggcaagaagaccacctggtatatttgcagcaatgaatgattctgttgcaactgcacacgcggattcaaatgctgctgatcaggcttttgctcagcgtttgaacttgttcacaacaaatccacattttgacttgagatctaacaagtttgttattaagcattatgccggtgatgtcacatacgatattgacggtattacagataaaaataaggatcaattacaaaaggatctggtagaattaattggtaccactaccaatacatttttagccaccattttcccggatactgtagacagagaatcaaaaagaaggccacctacagcaggcgacaaaattataaagagtgcaaatgatttggttgaaactttatcaaaagcacaaccttcatatatcagaacaattaaaccaaacgaaaccaaatctcctaacgattatgacgatcggcaagttctacaccagattaagtatctaggtctgcaagaaaacgtgcgtatcagaagagcaggttttgcatatagacaagtgtttgagaagttcgtggaaagattttatttattatctccacactgttcttacgctggtgactatacatggcaaggtgataccttagatgctgttaagtatatattgcaagattcctctatcccacagcaggagtaccaattgggtgtcacaagtgttttcatcaaaacacctgaaacattatttgctttggagcatatgagagatagatactggcacaatatggctgccagaatccaacgtgcttggaggagatttttgcaaagaagaattgatgcggccactaagatccagcgcaccatcagggagaggaaggaaggtaataagtatgagaagctccgggattatggtacgaaggttttgggtggaagaaaagaaagaaggtctatgtccttattaggttacagagccttcatgggtgattatctatcatgcaacgagtccaaatcgaagggcgcttatatcaaaagacaagtgagcattaaagagaaggtcatcttttccatacatggtgaggccttgcatacaaaatttggccgttctgcacaaagattgaaaaaaactttcctattaactccaactacattgtacattgttggtcagactttggtccaaaatgctatgacctatactcaggattataaaatcgatgtgcgaaacattcaagcggttagtttaaccaatttacaggatgattgggtcgccattaagttggctagctcaggtcaacctgaccccttaatcaacacatatttcaaaacagaactcataacgcatctgaaaaggcttaacgacaaaattcaaattaaaataggctcggcgatagagtaccaaaagaaacctggaaagttgcattcagtgaaatgtcaaatcaatgaatctgcaccaaaatatggcgacatatataaatccagtacaatatcagttcgtcgtggtaacccacctaattctcaagtgcacaaaaaaccgagaaaaaagagttcaatctcttcaggatatcatgctagttcctcgcaagcaacgaggaggccagtttcgattgctgcagcccagcatgttcccaccgccccggcttctaggcattctaaaaagcctgcccctccaccaccaggaatgcagaacaaagctgctacaagaagatctgttcctaatcctgcttccactctcactgcatcccaaagtaatgcccgtccttctccccctactgctgccactcgtgctacacccgctgctacacccgctgctgccgcaatgggctctggtagacaggcaaatatccctccaccacctcctccacccccaccctcttcaaagccaaaagaacccatgtttgaagcggcttacgattttcctggttcaggatcaccatctgagttacctttaaagaaaggagacgtaatttacattacaagagaagaaccaagcggttggtctctcgggaaacttctggatggctctaaggaaggttgggtgccaacagcttacatgaaaccacattccggaaataataatatccctactcctcctcaaaacagggatgttcctaaacccgttctgaattctgtacaacatgataacacctctgcaaacgttattccagctgcagcccaagcaagtttgggtgatggtttggcgaatgcgcttgctgctagggccaataaaatgagattagagagtgatgacgaggaggctaacgaagatgaagaggaagatgattggtaa

SEQ ID NO: 25573 - DNA, 1233 bp, Saccharomyces cerevisiae
atggcatctaacgaagttttagttttgagaggtaccttggaaggtcacaacggttgggtcacatctttggctacttctgctggtcaaccaaacctattgttgtccgcttcccgtgataagactttgatctcctggaagttgactggtgacgaccaaaagtttggtgtcccagttagatctttcaagggtcacagtcacattgtccaagactgtactttgactgctgacggtgcttacgctttgtctgcttcttgggacaagaccttgagattatgggatgttgccaccggtgaaacctaccaaagattcgtcggtcacaagtccgatgttatgtccgttgacattgacaagaaggcttccatgattatctctggttcccgtgacaagaccatcaaggtctggaccatcaaaggtcaatgtttggccactttgttgggtcacaatgactgggtttcccaagtcagagttgttccaaacgaaaaagctgatgatgactctgtcaccatcatttctgccggtaacgacaaaatggttaaggtatgtgatatattttctttccatgatagaatatgatgacaatcgagtagaagaagaaaagtggatttgtgtatgccattcaaatgatgtaataacatatttgctacttcagatggaactttgagttccgaatgagacataccaattatcaccaagatctctgatgaatggtttagcattactctgctcttctctttactcgttatgtcaaaatggaaactttttttttaaattaattttgttcccttactaacaaaaatgatataatgacaggcttggaacttaaaccaattccaaattgaagctgacttcatcggtcacaactccaacatcaacactttgactgcttccccagacggaactttgattgcttccgctggtaaggacggtgaaattatgttgtggaacttggctgctaagaaggctatgtacactttgtctgcccaagatgaagttttctctttggctttctctccaaacagatactggttggctgctgccactgctaccggtattaaggtcttttctttggacccacaatacttggtcgatgacttgagaccagaatttgctggttacagcaaggccgctgaaccacatgctgtttctttggcttggtctgctgacggtcaaactttgtttgccggttacaccgacaacgtcattagagtttggcaagttatgactgctaactaa

SEQ ID NO: 25574 - DNA, 591 bp, Saccharomyces cerevisiae
atgaaagcaaccattcaaagagtaacatctgtatttggagttccccgagcatctgtattcgtgccaagaatcagcacaccatttattttgcataattatatctctaatggcagaatggaccttttttccaaagaattccacaatggccgcgtatccaaatctgatctttggtcaagcaacaaggaagaggagctcttagtatctcaaaggaaaaaaagaccgatctctcctcatttaactgtttacgaacctgaaatgagctggtatctttcctctttacatcgtatatctggcgttttactggctcttggattctatgctttcacaattactttgggtgtgacgacaataatgggaatggatacgacttttcaggatctaaacaagtggtatcacgaaaagatgcctaagtggtcccaatgggtggccaaaggctctgcagcatatctgtttgcattccattttggtaacggtataaggcatctcatctgggatatgggctacgaattgaccaaccgtggggttataaaaaccggatcaatcgttttagccggcacactcgtcttaggaacgtatttactggctcagtaa

SEQ ID NO: 25575 - DNA, 1536 bp, Saccharomyces cerevisiae
atgtcgaaaaggtctatcgaggtcaacgaggaacaagatagagtggtctctgctaaaacagaatctcactctgttcctgctattcccgcctctgaagagcaagatgctcccaagaatgacctagaagaacaattgagtgatgaatttgatagtgatggtgaaattattgaaattgatggcgatgatgagattaatgacgaagatgaccttaggaaaaagcaagaagaagctgaaactttagtacaaaaggaccaatccgaaggcaacaaagaaaagatccaggagctttacttaccccatatgtctcgtccattagggccagatgaagtccttgaggctgatcccactgtttatgaaatgctacataatgtcaatatgccatggccatgcttgacattagatgtcattccagatacactaggttctgaacgtagaaactatccacagtctattttgttgaccacggctactcaatcttccaggaaaaaggagaatgaactaatggttctagcactttctaatttagcgaaaacacttttgaaagacgataatgaaggtgaagatgatgaagaggatgatgaagatgatgtggatccagtcattgagaatgaaaatataccattgagagatacaaccaatagattaaaggtttctccttttgccatttctaatcaagaggtgttaaccgctacaatgagcgaaaatggtgatgtttatatatacaatctagctccacaaagcaaagctttttccacaccaggttatcagattccgaagtctgctaagcgtcctattcacactgtaaaaaatcatgggaatgttgaaggctacgggttggattggtcaccattgatcaagactggtgcgttactatcaggtgattgctcaggacaaatatattttacccaaaggcacacatcgagatgggtgactgataaacaaccatttactgtttcaaacaataaatccatagaagatatccagtggtctcgcactgaatccaccgtttttgcaaccgcaggatgtgatggatatataaggatttgggacacaagatcaaaaaaacataaacctgctatctctgttaaagcttctaatactgacgtaaatgtcataagttggagtgataaaattggttacttgctagcaagcggtgacgataacggtacatggggagtatgggatttaagacagtttacgccaagtaatgctgacgccgtccaaccggttgctcaatatgacttccataagggagccattacttccattgcattcaacccattagatgagtctatcgttgcggtaggctcagaagataatactgtgactttgtgggatttgtctgtagaagctgacgatgaggaaattaaacaacaggccgccgaaacaaaagagctacaagaaattccaccacaattattgtttgttcactggcaaaaggaagttaaagatgtcaaatggcataagcaaatcccaggttgtttagtaagtaccggtactgacggtttgaacgtctggaaaacaatcagtgtctaa

SEQ ID NO: 25576 - DNA, 1308 bp, Saccharomyces cerevisiae
atgtacgagtactgctcagttgtaataaagaaatactccaagtatacaattccctccttcgctccaaatggttttcaatcaatgcttgagcctcctcagatagacaagtggcaacacctttccgctaactgcactctccaatttcgggttcttctaatggactctagacaaattctgatcaatgtggttctcaataattcaacacttctcgaaaatattcgcctgccgctgggggataatcaagatttaatacaattttcatgtaaaagccccataatctcttgtaaatatatctccgaagaattcggacccagaatgttaaggaggtttcagatgaatttgccaaatgacgttgagttcaacaggactgtagtttctttaaagaaccttaattttgttttaaggacagctaggacatcaatagcccagagtacaataacaagccaggtgcaaggcaataataacggtacaaaggtctgtttcacagaaggtccaaaagttagtagctacacaaatccgaacacgcaatttcaaactcaaaacatgattatggatttcagtcaacgttatcaggaagaatctgaaagagagtcaaataatcgttcaaatataactttaccacacgacagcattcaaatagctcaacaaatatggccaaacacggatttaaatgtagtacaatcttcacaagacctcaacactccaatggctacgcaaactgttttgggtcgtcctgagtcgctaattgtacagccattggaggtttctcaatctccaccaaacactaccaactgccttcctaatgcagaaaacaaaaagaaaaaagtcgacaccacttctgattttacttcaagaaaggagattgctctgtgtaaaactggtttattagaaactattcatataccaaaggaaagggaaagtcagatgcaaagcgtcactggtttagatgcaacaccaacgattatatggagccccgggaaagacaacacggcgaagaaaaataccagtaataagaaaaatattgatgataaactaacaaacccccaaaaatctggaaatacacatacccctgatagaaataaagaagtgctacctaacggcacacttaatgaaacgaggaaagaagcatcgccaagcgaaggattaacgataagagttaaaaacgttaatcggaatgcgtcaagaaaaatatctaagcggctaatcaaggaaaagttgaaagacgaagaattcatgaaatgggtatgtatgcatttgcaagaaactgagctgtttccccctcttatccactcattttctctgacttga

SEQ ID NO: 25577 - DNA, 576 bp, Saccharomyces cerevisiae
atgggactactaagtattatcaggaaacagaagctcagggacaaagaaattcgctgtctgattctaggactagacaattcggggaagtcaacgatagtaaacaaactattgcccaaggatgagcaaaataacgatggtataatgcctactgtgggttttcaaatacatagtctgatgataaaagatgtgacaatatctctatgggacattggggggcaacgcacattaaggccattttgggataactattttgataagacacaagcgatgatatggtgtatagatgtgagcctttcaatgcggtttgacgaaaccttgcaagaactaaaagaattaatcaatagagacgaaaatcgaataggatacgagtgtgctgttatcgttgtgttgaacaagattgatttagtggaggacaagtccgagcttcatcgaaggtgtttactggtagagagcgagttgaagtgtctgttcaagccggacatccgaatagagctcgtcaaatgtagtggcgttaccggagaaggtattgataacctgcgtgaccgtctggtggaatcctgccattttacccaataa

SEQ ID NO: 25578 - DNA, 1113 bp, Saccharomyces cerevisiae
atgaatattcaaagcaataattctccgaatctcagtaataacatagtgtcaaaacaggtttactacgcccatcctccacctacgatagacccgaatgatccggtgcagatatctttccctaccaccgaagtagttgggcatggttcgtttggtgtggtatttgccactgttattcaagaaactaatgaaaaagttgctattaagaaagtcctgcaagataaacgattcaagaacagagagctggaaataatgaaaatgctgagtcacataaatataatagatctgaagtactttttctatgaaagggactcccaagatgagatttatttaaatttgatactagaatacatgccacaatctttgtaccagaggttacgtcatttcgtccatcaacgtacgccgatgtcaagattggaaataaagtactacatgtttcaattgttcaagtcattgaattacctccatcatttcgcgaacgtctgtcatagagacattaagcctcaaaatttattagtagatcctgagacctggtccttaaaactgtgcgatttcggcagtgcaaagcaattgaaacctactgaacctaacgtttcctatatttgttcacggtactatagagcaccagagctaatcttcggcgcaacaaattataccaaccaaatcgacatatggtcctctggctgcgtaatggcggaactgctattgggccaaccaatgttccctggagaaagtggtattgatcaactagtggaaatcattaaaatcttaggtactccatcaaagcaagaaatttgctctatgaatcccaattatatggagcataagttcccgcaaattaaaccaataccattgtcacgtgttttcaagaaagaagatgatcaaactgtggaatttctagctgacgttttgaaatatgatccactagaaagatttaatgctctacaatgcctgtgtagtccatattttgatgaactaaaacttgatgacggtaaaataaatcaaataacaactgatttaaaattgctagagttcgatgaaaatgtcgaattgggccatctatctcccgatgaactatcatctgtaaaaaaaaagctatatccgaagtctaagtaa

SEQ ID NO: 25579 - DNA, 573 bp, Saccharomyces cerevisiae
atgacggttggtacacttcccatctggtcaaaaaccttttcttatgcaattaggtcattatgcttcttgcatataatacatatgtatgcatacgaatttactgagacgaggggagaatcaatgttgccaacactgtcagcgaccaatgattatgtgcatgtcttgaaaaatttccaaaatggtagaggcataaaaatgggtgactgcatagtagcactgaaacctactgaccctaatcataggatttgcaaaagggttacgggtatgcctggtgatctcgtgctcgtggatcccagtacgatagttaattatgtcggcgatgtgcttgttgatgaggagaggtttggtacctatattaaagtccctgaaggtcatgtttgggtaaccggagataatttgtcacattcattagattcaagaacatacaatgcattacccatggggctgatcatgggcaagattgtagctgctaacaattttgacaagcccttctgggacggttcgatacgcaatatttggggtttcaaatggatcaataatacatttctagatgtgcaggctaagagcaactga

SEQ ID NO: 25580 - DNA, 949 bp, Saccharomyces cerevisiae
atgtcagacgagattgtaaccaacaaatctgttacttatgttaacaatactactccagtcacaattacatcatcggagctggacttgagatcatgttatcaagatgacgaagttgttatagaagtccatgctgctgctttgaatccaattgattttattactcaccagctttgtaactcctacatatttggcaagtatccaaagacttattctagagattacagtggtgtcatcattaaagcgggaaaggatgtcgacaatcgctggaaggttggcgacaaagtgaatggtatgtacagtcatatttatggtgaacgtggtactttaacacactacttgatactcaaccctgccaaagatgtacccatcacacatatggtggaggttccaaaggacgaaaatgacccatatgacgactttgtatatgctgctgcctggcccctaacatttggtacagccttttctacattatacgatttcaagaaagattggacttctgattcgaaagttctggttattggcgcttcaacctctgtgtcatatgcttttgtccatattgcaaaaaactacttcaacatcggcactgttgttggcatttgtagcaagaattccattgaacgcaataagaaattaggatatgactacttggttccctatgacgaaggatccatcgttgagaatgttaagaaattaaagcaaagcgtgttggaaaacgacaaatttgacatgatttttgattcagtgggtaaccatgatttcttccctgtcattgatcaatttctaaaacctaaggcgaaaaattccttttacgttacaattgcaggaaataacaaggccgattataagaatatcagttggagagatttcgtatcattgagttctattttaaaggctataaacccattcaaaaaatacaactggcgctttggacacccttatccccccaaca

SEQ ID NO: 25581 - DNA, 4971 bp, Saccharomyces cerevisiae
atgggcatagctgatgggcaaagaagaagatcttcatcactacgaacgcagatgttcaacaagcatttgtatgataaatatcgcggaagaactgatgatgagatagagttagaagatataaatgagagtaagacgttctccggtagcgataataacgataaagatgacagagatgaaacaagcggcaattatgctgctgaagaggattatgaaatggaagagtatggtagtcctgatgtgtcatatagcattatcactaaaatacttgatactatcctagatcgaaggaggacgttccattcgaaagacggtagacatattccgattatattagatcataatgcaattgaatacaaacaagctgctactaaaagggatggtcatttgatagacgaaaggttcaacaagccttactgcgacaaccgaataacttcatcaagatatacattctattcctttttgcctagacagttgtatgcacaattttcaaagttagccaatacttattttttcattgtcgcagtattacaaatgatacctggatggtctacaactggtacttatacaactattatccccttatgtgtatttatgggtatatccatgacaagagaggcttgggacgatttcaggagacatcgtttagataaggaagagaacaataaaccagtgggagtgttggttaaagatggaaataatgacgcacaagaagtttatacactaccaagtagtgttgtctcatccactgcatatctaactaaatcggccgctgctgaaaataatccacctttaaacgatgatcggaactcctctcaaggacacttcttagacacgcacttcaataactttgaactactcaagaataaatacaatgttcatattcatcaaaagaagtgggaaaaacttcgtgttggagacttcgtacttctcacacaagatgattgggtacctgcagatctgcttttattgacatgtgacggcgaaaatagcgaatgtttcgttgaaacgatggctttagatggcgaaacaaatttgaaaagtaaacaaccccatccagaattaaataagttaaccaaagccgcatcaggtcttgcaaatattaatgctcaagttaccgtggaagatcccaatattgatttatataattttgaaggtaatcttgaattgaaaaaccatcgcaatgataccataatgaaataccctctaggtcctgataatgtcatttatcgtggtagtattttgaggaatactcaaaatgttgttggtatggtcattttcagtggtgaggaaacaaaaatcagaatgaatgctttaaaaaacccaagaacgaaagcccctaagctacaaaggaagataaatatgattatcgtgtttatggtgtttgtcgttgccacaatatctttattttcttatcttggccatgttttgcataagaaaaaatatatcgaccagaacaaagcatggtatctatttcaggcagatgctggcgtagcacccacaataatgtcttttatcatcatgtataacactgtgattcctttgtccctatatgtaacaatggaaattatcaaggtagtccaaagtaaaatgatggaatgggacatagacatgtaccatgcagaaacgaacacgccatgcgaatcgagaactgccaccattctggaggaattggggcaagtatcttatatttttagtgataaaaccggaacgctgacggataataagatgatatttcggaaattttctttatgtggatcatcttggctgcataatgtagatctcggtaattctgaggataactttgaagacaacagagacaatacgaactccttgagactaccaccaaaagctcacaacggctctagtatagacgttgtttccattggagatcaaaatgttcttgatcggttaggattttcggacgcaccaattgaaaaagggcatcgtccatctttggacaactttcctaaatctaggaattctattgaatataagggaaattcatcagcaatttatacaggccgtcccagtatgagatcactttttgggaaagataattcacatctaagtaaacaagcttcggttatttcaccctccgagacattttcggagaacattaaaagttcgtttgatttaattcagtttattcaaagatatccgaccgccctgttttctcaaaaggctaaatttttcttcttatcattagctctttgtcatagctgtcttcccaaaaaaactcataacgaatcaataggagaagactccatagagtatcagtcttcatctccagatgaattagcactagtaaccgctgctagagaccttggttatattgtattgaatagaaatgcacagattttgaccattaaaacttttccagacggttttgacggtgaagcaaaattggaaaattatgaaattttgaactatattgacttcaattctcaaagaaagagaatgtctgttcttgtacgtatgccaaatcaaccaaatcaagttcttttaatttgcaaaggtgctgataacgttattatggagcgtttacatgatcgcgaattggctgccaaaaaaatggcagacatatgcaccagtaccaaagaacgtaaagacgcagaagcagagctggttctccagcaaagaaagtctctggaaagaatggtagatgaagaggctatggccaggacctcattgagaaattctttgtctagcgtaccgagagcaagtttatcattgcaggcagtgagaaaaagtctttcaatgaagaacagcaggacccgtgatccagagaaacaaattgactccattgatcaatttctagaaacggtcaagaaatctgatcaggagattggcagcgttgtaaataaaagcaggaagtcactccataagcaacaaatagaaaaatatgggccgcgaatttcgatagatggaacacattttccgaacaacaatgtcccaatagacacaagaaaagaaggactacagcatgattacgatacagaaattttggagcacattggaagcgatgagttaattttgaatgaagagtatgttattgaaagaactttgcaagccatcgatgagttttcgactgaaggcttaagaactctggtctatgcttacaaatggatcgatattgggcagtatgaaaattggaataaacgctatcaccaagccaaaacctcccttactgatagaaaaatcaaagtcgatgaggcaggtgcagaaatcgaggatggtttaaatctgttaggggtaactgcaatcgaagacaagttacaagacggcgtttcagaagctatagaaaagatcagaagagccggtataaaaatgtggatgctaacaggggataaaagggaaacggctataaatatagggtattcgtgtatgttaatcaaagattattctacggtagtcattttaactactactgatgaaaatattatatcaaagatgaatgcggtttctcaagaagttgattccggaaacatagcacactgcgttgttgtaattgacggtgccacgatggccatgtttgaaggaaatcctacatacatgtctgtatttgttgagctttgcactaaaacagactcggtaatatgttgccgtgcttcaccttctcaaaaagcccttatggtttccaacataagaaataccgatccaaacttagtcacgttggcaataggtgatggtgcgaatgatattgccatgatacaatctgccgatataggtgttggaatagccggtaaggagggattgcaagcatctagagtatctgattattctattggccaatttcggtttctcttgaaattgttatttgttcatgggcgttataactatattcgcacctccaagtttatgctttgcacgttttacaaagaaattacgttttactttacgcagttgatatatcaaagatatacaatgttttcaggctcctctctatatgagccatggtcattgtccatgttcaatactctattcacatcactaccggttctatgtattggtatgtttgagaaagacttgaaaccaatgactctactaacagtccctgaattatattcgtacgggcgcctttcacaaggttttaattggttaatattcatggagtgggttatcttggcaactacgaattctcttatcattacatttttaaatgttgtaatgtggggtatgagttctctttcagataacactatgtatcctctaggtctcatcaatttcacagccattgttgccttaattaacgttaaatcccaatttgttgaaatgcacaataggaattggctggcttttacttctgtagttctatcctgtggaggttggttagtgtggtgttgtgcccttcctattttgaataatactgaccaaatatatgatgtagcatatggcttttacaatcattttggtaaagacattacattctggtgtactagcttggtgttggcactgttacctatcactttagatatagtttacaaaacattcaaagttatgatatggccatcagattctgatatttttgctgagctggaacaaaaaagtgatatcagaaagaagctggaactaggagcctatagcgaaatgaggcaaggatggacgtgggataaagatcccagtactttcacaaggtacacagacaaagttctttcaaggccaagaactaattcacgtgcaagtgcaaaaactcataacagcagcatatattcaatgtcaaatgggaatgtagaccattcctcaaaaaaaaatttctttggaaactcttctaaaaagagctctgaacgatacgaggtattacctagtggcaagttaatcaagcgaccatccttgaaaacacaaagcagtaaagacagtattggcggcaatataactactaaactgacgaagaaactgaagcttccatcgaggaatgtggaagatgaagatgtgaaccagattattcaggcaaggctaaaggatctggagtaa

SEQ ID NO: 25582 - DNA, 1107 bp, Saccharomyces cerevisiae
atgaactcatggaacctgagttcttcaataccgataatacatacgcctcatgaccatcccccgacatcagaaggaactccagatcaaccaaataataaccgaaaagatgataaactgcacaaaaaaagaggcgattcagatgaggacttaagccctatatggcattgtgtcgtctccggtgggattggtggaaaaataggagattctgcgatgcattcattggatactgttaagacaagacaacagggcgcacccaatgtcaaaaaatacaggaacatgatctctgcatatcgtaccatttggctagaagaaggcgtgagaagggggctatacggcggttacatggctgccatgttaggctccttcccgtcagcggcaatcttctttgggacctatgaatatactaagagaacaatgatagaagattggcagattaacgataccatcacacatttgagcgctggatttcttggcgattttatctccagttttgtttatgttccatcagaggtcctaaagacaaggctacaattgcaaggaaggttcaataatcctttctttcaatctggctataattattcgaatttaagaaatgccataaagacagttataaaagaagaagggtttcgctcactattttttggatacaaagccactttagccagagatttgccatttagtgcattgcagtttgccttctacgaaaagtttaggcaattggctttcaagattgaacagaaagatggtagggatggtgagttgtctatacctaatgaaatattgactggtgcctgtgcaggtggactggcgggaatcattaccacaccaatggatgttgttaagactagagtccaaactcaacagccgcccagccaaagcaacaaatcatactcagtaacacatccacatgtaacaaacggcagaccggcagcactttccaactcgatttcgctcagccttcggacggtctaccaatctgaaggtgtgttaggtttctttagtggcgttggccctagattcgtctggacaagtgttcagagcagtataatgttgcttctgtatcaaatgaccctacgcggattaagtaacgcatttccaacggactaa

SEQ ID NO: 25583 - DNA, 1521 bp, Saccharomyces cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggtaagcctttccattccaatgctaaacaagacttagcccagattatagaacttacaagatactatgcgggggcggtcgacaagttcaatatgggtgaaaccattccattgacttttaacaagtttgcatatactctaaaagttccttttggcgttgttgctcaaatcgttccatggaattatcctctagctatggcttgtagaaaaatgcaaggtgccttagcggccggtaacacggttatcatcaaacctgctgaaaatacctctctatctctactttattttgctactttaattaaaaaagcaggttttccacctggtgttgtcaatgtcattcctggttatggttccgttgtggggaaagctttaggaacccacatggatatcgacaaaatatcttttacgggaagtactaaggttggcggctcagtattggaagcttccggccaatcgaaccttaaggatatcacactagaatgcggtggtaagtctcctgctcttgtatttgaagatgcagaccttgataaggctatagaatgggtagcaaatggtattttttttaattcgggacagatctgcactgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaaaggaggaaaagttggacatgttccagacctctgaatttcctattggtggagctaaaggctacttcattcccccaaccatcttcactgatgtaccagaaacatctaagttgctgcgtgatgaaatatttggcccggttgtggttgttagcaagttcacaaattatgatgacgctctgaagctggctaatgatacttgctacgggctcgcctctgcggtcttcaccaaagatgtcaagaaagcgcacatgtttgctcgcgatattaaagcaggaactgtttggatcaatcaaaccaatcaagaagaagctaaagttccttttggcggatttaagatgagtggtattggtagagaatcaggcgacaccggcgttgataactatttacaaataaaatcagtccatgtggatctttcattggataaataa

SEQ ID NO: 25584 - DNA, 1521 bp, Saccharomyces cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggaaagccttaccattcaaatgccaaaggtgatttggcacaaattttacagcttaccagatattttgctgggtccgctgataagtttgacaaaggtgcaaccataccattgacttttaacaagtttgcatatactctaaaagttccttttggcgttgttgctcaaatcgttccatggaattatcctctagctatggcttgttggaaattgcaaggtgccttagcagccggtaacacggttatcatcaaacctgctgagaatacctctctatctctactttattttgctactttaattaaaaaagcaggttttccacctggtgttgtcaatatcgttcctggttatggatcacttgtaggccaagccctagcatctcacatggatatcgacaaaatatcttttacgggaagcaccaaggtcggtggatttgtgttggaagcttccggccaatcgaaccttaaagacgttacactagaatgcggtggtaagtctcctgctctcgtatttgaagatgcagaccttgataaggctatcgattggatagcagctggcattttctacaattcaggacagaattgtaccgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaagggaggaaaagttggacatgttccagacctctgaatttcctattggtggagctaaaggctacttcattcccccaaccatcttcactgatgtcccgcaaacatcgaaactgttacaggatgagatatttggcccggttgtggttgttagcaagttcacaaattatgatgacgctctgaagctggctaatgatacttgctacgggctcgcctctgcggtcttcacaaaagatgtcaagaaagcgcacatgtttgctcgcgatattaaagcaggaactgtttggatcaactcatctaacgatgaagatgttaccgttccttttggcgggtttaaaatgagtggtattggtagagaactggggcaaagtggtgttgatacctatcttcaaacaaaagcagttcacataaatctctctttggacaactaa

SEQ ID NO: 25585 - DNA, 207 bp, Saccharomyces cerevisiae
atgaatacagaccaacaaaaagtgagcgaaatatttcagagctcaaaggaaaaattgcagggcgatgcaaaggtagtgagtgacgcttttaagaaaatggctagtcaagacaaggacggcaagactaccgatgctgatgaaagtgaaaaacacaactatcaagagcaatacaacaagctcaaaggggcggggcataagaaggagtag

SEQ ID NO: 25586 - DNA, 2118 bp, Saccharomyces cerevisiae
atggctggtgaaacttttgaatttcaagctgaaatcactcagttgatgagtttgatcatcaacactgtctattctaacaaggaaattttcttgagagaactgatctctaacgcctccgatgctttagacaaaattagataccaagctttgtctgatccaaagcaattggaaaccgaaccagatttgttcattagaatcaccccaaaaccagaagaaaaagttttggaaatcagagattctggtattggtatgaccaaggctgaattgattaacaatttgggtaccattgctaagtctggtactaaagctttcatggaagctctatctgctggtgccgatgtatccatgattggtcaattcggtgttggtttttactctttattcttagtcgccgacagagttcaagttatttccaagaacaatgaggacgaacaatatatttgggaatctaatgccggtggttctttcaccgttactttggacgaagttaacgaaagaattggtagaggtaccgtcttgagattattcttgaaagatgaccaattggagtacttggaagaaaagagaattaaagaagtcatcaagagacattctgaattcgttgcttaccctatccaacttctagtcaccaaggaagtcgaaaaggaagttccaattccagaagaagaaaagaaagacgaggaaaagaaggatgaagatgacaagaaaccaaaattggaagaagtcgatgaagaagaagaagaaaagaagccaaaaaccaaaaaagttaaagaagaggttcaagaattagaagagttgaacaagactaagccattatggactagaaacccatctgatatcactcaagaggaatacaatgctttctataagtctatttctaacgactgggaagacccattgtacgttaagcatttctctgttgaaggtcaattggaatttagagctatcttgttcattccaaagagagcaccattcgacttatttgagagtaagaagaagaagaacaatatcaagttgtacgttcgtcgtgtcttcatcactgatgaagctgaagacttgattccagagtggttatctttcgtcaagggtgttgttgactctgaagatttaccattgaatttgtccagagaaatgttacaacaaaataagattatgaaggttattagaaagaatattgtcaagaaattgattgaagccttcaacgaaatcgctgaagactccgagcaatttgacaaattttactctgccttcgctaagaacattaagctgggtgtacatgaggacactcaaaacagagctgctttagctaagttgctacgttacaattctactaaatctgtcgatgaattgacttccttgactgattacgttactagaatgccagaacaccaaaagaacatctattacatcaccggtgaatctctaaaggcagtcgaaaagtctccattcttggacgccttgaaggctaagaactttgaagttttgttcttgaccgacccaattgatgaatacgctttcactcaattgaaggaattcgagggtaaaactttggttgacattactaaagatttcgaattggaagaaacagacgaagaaaaagctgaaagagagaaggagatcaaagaatacgaaccattgaccaaggccttgaaggatatcttgggtgaccaagtggagaaggttgttgtttcttacaaattgctagatgctccagctgccatcagaactggtcaattcggctggtctgctaacatggaaagaatcatgaaggctcaagccttgagagactcttccatgtcctcctacatgtcttccaagaagactttcgaaatttctccaaaatctccaattattaaggaattgaaaaagagagttgatgagggtggtgcacaagataagaccgtcaaagatttgactaacttattattcgagaccgctttgttgacttctggtttcagtttggaagaaccaacttcttttgcatcaagaataaatagattgatttctttaggtttgaacattgatgaggatgaagaaacagaaaccgctccagaagcttctaccgaagctccagttgaagaggttccagctgacaccgagatggaagaagttgattaa

SEQ ID NO: 25587 - DNA, 1785 bp, Saccharomyces cerevisiae
atgaataactccaaaattcctaaactttcctttcatagtgatccaaacaacgtcactcgagactttccaaagacaaaacgacagaaggttcagaaaagagaaatggatatgatactaactcctaataacaacaagctaaatatattgcacagctctggatctggtatacggcgctgctacactgatgacacctccgctacgtatactaagaaactaacctttgggggggaccccaagattattgaaagggttaagaacaatgaacgtaaggttagaaaagacatagattcactactgaatgctatttctgaaattgaaaaggaatctgttcgtattcatgccagggaactacctgcaataacattagaattagatgcaaaagtcaaagcgtgcagggagctacaaaatgagattgatggactatcaacggagatggacttgaaggataatcaatgtgatcttcaaagaaagaatgttgagctatcatcaaaaaatatagtgtctatgcatgcagtaaaagtacaagagttcgaaaacgatttagaggaagagctatcgaatgccaaaagggagtggacgtataaattaatggaagtagaaaatttgaaacctgacgaaaggttaactgacgaaatgcgacagcttaaaacagaattcgaggaggtcaataggaaactattcattctacagaatgaaaatgagaacgagtgtaaaaactacaaaaaagaattggacaagaaattcgagatattcaagaaagttaagaacgatgctagaattgaattagatggggagcaagaaagactttcgaaagttttaaaagacctacaagacacccatggtgaactgaaagaaaatattaagacgtgtagagatgagtttaacgattttgaaaaaaggattggagaggcagaagtgaacttccatagcatggaacttgccgttgttcctctcaaaaagaagcttgcttctacatcacaagcattgacgcaagtgcaggaggagaagaagcaagtcgaaggagaagcaaacaattggaagaagaagtacgttaatgaactagaaaaggttcaacaggaattatacacacgacaaaatctggccacttcaattgaagaaatcaaaggatacacccgatgctttgcgtatgccaatgaacgacaaatgcctgatgaattccatatcaactatgtggatcggtgcatttgcgagaatagtggagaaaaacgggtacaagtatttgatagagtagttctcgaagaaatccataaggatcacaaacgcttatataacgaatgcattccgttcctggaaaaatacatcagcaagttaattaactgcagcattatagtggtttcgcagcaacccacagcaccaatgaaaaagactttgctaaaacagttaattgagcagtacggtgagaattataagatgacattgaacattttgcatcttgacggaagtattaaacacagtgacgttggattagataacccaacagaaattagagatctgtcacaagatgaagaatgcatgaacattttaactttagataccaagttgggaaaagatgaagagtcccattcaatgaatatatatatcggtagtatgtccacggtacagctgaatagagagcttgatgatgctccctcagtcctttcgcatattctcactaaaacaaagcagtgctttgtcttcaagattaacgctggtgaaaacatcgagaaggctctagccttagcgggaaagctgaaaagaacaataacattacctcagctagattaa

SEQ ID NO: 25588 - DNA, 1641 bp, Saccharomyces cerevisiae
atgaaccactcagaagtgaaaactgggttaattgtcactgcaaagcagacatattacccaattgaattgtccaatgcagaactactaactcattacgaaaccatacaggaatatcacgaggaaatctctcaaaatgtgctggtccaatcttccaagacaaaaccagacataaaattgatcgatcagcaaccggagatgaatcctcatcaaactagagaagccatagtaacatttttgtatcaactttcagtgatgactagagtaagtaatggtatcttcttccacgctgtcaggttctacgatcgctattgctctaagagagtagtgttaaaggaccaagctaaactagttgtaggcacctgcctttggttagcggccaaaacttggggagggtgcaaccatattataaacaacgtctccatccccacaggtggtaggttttatggtcccaatcctagagctcgtattccacgcctttctgaattggttcattattgcggcgggtccgatttattcgatgaatcaatgttcattcaaatggaaagacatatcttggatactctgaactgggacgtttatgagcccatgattaatgactacattttaaacgttgacgaaaattgtttgatacaatatgaactttacaaaaaccagttacaaaataacaatagcaacggcaaagaatggtcctgtaagagaaagtcacaatcttctgacgacagtgatgccacagtggaagaacatatcagtagttcaccgcaaagtactggactagatggcgatacaactaccatggatgaagatgaagaactaaattccaaaattaaattgataaatttgaaaagattcttaattgatctgagctgttggcaatacaacttgcttaaattcgaattatacgaaatatgcaatggtatgttttctataataaacaaattcactaatcaagatcaaggcccttttctctctatgcccattggtaatgatataaactcaaacactcaaacgcaggtattcagcattatcatcaatggcatagtcaattctcccccatctttagtcgaagtttataaggagcaatatggtatagtacctttcatattacaagtaaaagattataacttggaattacaaaagaaactgcaactggcctctacaatagacctaaccagaaaaattgctgtcaattctcgttactttgaccaaaatgcctcttcatcatcagtttcttctccaagcacatattcttcgggaaccaattatactccaatgcgaaacttcagtgcacaatcagacaacagtgttttcagtactaccaacattgaccattcatcgccgatcacccctcacatgtacacttttaatcagtttaaaaacgaaagtgcttgtgacagtgccataagcgtaagcagtctacctaatcaaacccaaaatggtaacatgccattatcaagcaattatcagaatatgatgctagaagaaaggaataaagagaatagaattcccaactcatcatccgctgaaataccacaacgtgccaaatttatgacgactggtatattccagaacacaggagaacttactaatagagcgtcttcgatatcgctatcgttaaggaaccacaatagctctcaactgtga

SEQ ID NO: 25589 - DNA, 669 bp, Saccharomyces cerevisiae
atgaagtttttcccactccttttgttgattggtgttgtaggctacattatgaacgtattgttcactacctggttgccaaccaattacatgttcgatccaaaaactttgaacgaaatatgtaactcggtgattagcaaacacaacgcagcagaaggtttatccactgaagacctgttacaggatgtcagagacgcacttgcctctcattacggggacgaatacatcaacaggtacgtcaaagaagaatgggtcttcaacaatgctggtggtgcgatgggccaaatgatcatcctacacgcttccgtatccgagtacttaattctattcggaaccgctgttggtactgaagggcacacaggtgttcactttgctgacgactattttaccatcttacatggtacgcaaatcgcagcattgccatatgccactgaagccgaagtttacactcctggtatgactcatcacttgaagaagggatacgccaagcaatacagcatgccaggtggttcctttgcccttgaattggctcaaggctggattccatgtatgttgccattcgggtttttggacactttctccagtactcttgatttatacactctatatagaactgtctacctgactgccagggacatgggtaagaacttgttgcaaaacaaaaagttctaa

SEQ ID NO: 25590 - DNA, 2880 bp, Saccharomyces cerevisiae
atgactgttactactccttttgtgaatggtacttcttattgtaccgtcactgcatattccgttcaatcttataaagctgccatagatttttacaccaagtttttgtcattagaaaaccgctcttctccagatgaaaactccactttattgtctaacgattccatctctttgaagatccttctacgtcctgatgaaaaaatcaataaaaatgttgaggctcatttgaaggaattgaacagtattaccaagactcaagactggagatcacatgccacccaatccttggtatttaacacttccgacatcttggcagtcaaggacactctaaatgctatgaacgctcctcttcaaggctacccaacagaactatttccaatgcagttgtacactttggacccattaggtaacgttgttggtgttacttctactaagaacgcagtttcaaccaagccaactccaccaccagcaccagaagcttctgctgagtctggtctttcctctaaagttcactcttacactgatttggcttaccgtatgaaaaccaccgacacctatccatctctgccaaagccattgaacaggcctcaaaaggcaattgccgtcatgacttccggtggtgatgctccaggtatgaactctaacgttagagccatcgtgcgttccgctatcttcaaaggttgtcgtgcctttgttgtcatggaaggttatgaaggtttggttcgtggtggtccagaatacatcaaggaattccactgggaagacgtccgtggttggtctgctgaaggtggtaccaacattggtactgcccgttgtatggaattcaagaagcgcgaaggtagattattgggtgcccaacatttgattgaggccggtgtcgatgctttgatcgtttgtggtggtgacggttctttgactggtgctgatctgtttagatcagaatggccttctttgatcgaggaattgttgaaaacaaacagaatttccaacgaacaatacgaaagaatgaagcatttgaatatttgcggtactgtcggttctattgataacgatatgtccaccacggatgctactattggtgcttactctgccttggacagaatctgtaaggccatcgattacgttgaagccactgccaactctcactcaagagctttcgttgttgaagttatgggtagaaactgtggttggttagctttattagctggtatcgccacttccgctgactatatctttattccagagaagccagccacttccagcgaatggcaagatcaaatgtgtgacattgtctccaagcacagatcaaggggtaagagaaccaccattgttgttgttgcagaaggtgctatcgctgctgacttgaccccaatttctccaagcgacgtccacaaagttctagttgacagattaggtttggatacaagaattactaccttaggtcacgttcaaagaggtggtactgctgttgcttacgaccgtatcttggctactttacaaggtcttgaggccgttaatgccgttttggaatccactccagacaccccatcaccattgattgctgttaacgaaaacaaaattgttcgtaaaccattaatggaatccgtcaagttgaccaaagcagttgcagaagccattcaagctaaggatttcaagagagctatgtctttaagagacactgagttcattgaacatttaaacaatttcatggctatcaactctgctgaccacaacgaaccaaagctaccaaaggacaagagactgaagattgccattgttaatgtcggtgctccagctggtggtatcaactctgccgtctactcgatggctacttactgtatgtcccaaggtcacagaccatacgctatctacaatggttggtctggtttggcaagacatgaaagtgttcgttctttgaactggaaggatatgttgggttggcaatcccgtggtggttctgaaatcggtactaacagagtcactccagaagaagcagatctaggtatgattgcttactatttccaaaagtacgaatttgatggtttgatcatcgttggtggtttcgaagcttttgaatctttacatcaattagagagagcaagagaaagttatccagctttcagaatcccaatggtcttgataccagctactttgtctaacaatgttccaggtactgaatactctttgggttctgataccgctttgaatgctctaatggaatactgtgatgttgttaaacaatccgcttcttcaaccagaggtagagccttcgttgtcgattgtcaaggtggtaactcaggctatttggccacttacgcttctttggctgttggtgctcaagtctcttatgtcccagaagaaggtatttctttggagcaattgtccgaggatattgaatacttagctcaatcttttgaaaaggcagaaggtagaggtagatttggtaaattgattttgaagagtacaaacgcttctaaggctttatcagccactaaattggctgaagttattactgctgaagccgatggcagatttgacgctaagccagcttatccaggtcatgtacaacaaggtggtttgccatctccaattgatagaacaagagccactagaatggccattaaagctgtcggcttcatcaaagacaaccaagctgccattgctgaagctcgtgctgccgaagaaaacttcaacgctgatgacaagaccatttctgacactgctgctgtcgttggtgttaagggttcacatgtcgtttacaactccattagacaattgtatgactatgaaactgaagtttccatgagaatgccaaaggtcattcactggcaagctaccagactcattgctgaccatttggttggaagaaagagagttgattaa

SEQ ID NO: 25591 - DNA, 3939 bp, Saccharomyces cerevisiae
gtagtttatgttgccttacagccacttcttaaaattagtgaaaggtatagcgaaggtttagctaatcacgaatgtgaaatttttttaaagttgattaaaaagtactatgctgttgagaaaatttttgaaaatcatgatatacatgaagaaagaaacttactaaatctgcggaggaaagaccttacaaacttgaaaaaaattttgtgcataagtttatcgcatgctaacgtagtcgcaaagaacaagttagtaactgcaatattgcatgaatacgagccattgtgccaggattcctctaagatgtctttaaaattcagggctgttatacatgatttggcaagtttggaatctaagtgggctaaagaggttgctgtaaaggcaagatcagtgctactcagagggattttccctcccataaagaaaagaaaagagcatattaaaactctcctgcaattgcacataaaggatactggtgccgaaaacattcacagcaggaacatatattcctgtatgagggattttggtaatttaatacattcaaatctgatacaacttcaggatttgttctttttttttggccatcaagatacggctctttccagtatagcatctgaaatttatgcaaggtatgcctacggcaattatcaattaaaaagtattaagattcataaaggagcgcctgatttactaatgtcatggcaattcagctcattaagaaattatttagtcaattctgatggtgagagtgatgagtttacaaaactttctaaacctccctcaacatcaggtaagagctcagcaaatagttttggtcttcttgtcaacatgcgtgcgcttgaatctctggaaaagacattagacgaggtatacgaacaaattcatattcctgaggaaagactttccagcggagagaactctcttattgttaatattttatctcctattcgttacagaagtgaaaatgatctaattaaaactttaaaaattaaacttcatgaaaatgagagaggtctatccaagctcaaggttaatcgtattacatttgcatttatcgccgcgaatgcgcccgctgttaaattttactcctttgatggaactacgtacgatgaaatctctcaaataagaaatatggatccatcctatgaagcaccgttagagttaggaaaaatgtcgaactataaaatcagatcactacctacatacgatagtagtatacgcatttttgaaggtattagcaaatttacgccgctagataaaaggttctttgtcaggaaaatcataaattccttcatgtataatgatcaaaaaacaaccgaagaaaacttgaaagcggaaatcaatgctcaagtggtttatatgttagaacatctaggagcagttgacatctcaaattcagacttgaatcatatttttttaagtttcaatacagttcttaacataccagtacatcgtctcgaggaaattgtgagtacaattctaaagactcacgaaaccagattgtttcaagaaagaatcacagatgtagaaatttgcatctctgttgagtgcctagaaacaaagaagccagccccgcttagattacttatttctaataaatctgggtatgtggtaaaaattgagacatattacgaaaagatagggaaaaatgggaatctgattttggaaccgtgtagtgagcagagccattatagccagaaatctctctctcttccttactcggtcaaggattggctacaacctaaaaggtacaaagctcaattcatgggtacaacatatgtgtacgatttcccaggtctgtttcatcaagctgcaatccaacagtggaaaaggtattttccaaaacataagctgaatgacagtttttttagttgggttgaattgatagaacaaaacggtaatttaataaaagtaaacagggagccaggccttaataatatagggatggttgcttttgagattatggttcagacacctgaatatcctgaagggcgtaacatgatcgtgatttctaatgatattacctacaatattggatcttttggaccgagagaagatttgttttttgatagggtcacaaattatgcaagagagagagggatcccgaggatatacttggcggcgaattcaggagctaaattgggtatagccgaagagctgatccctctatttcgtgtagcatggaatgacccctctgatccaacaaagggtttccagtacttatacttagctccaaaagacatgcagctactgaaagattctgggaaaggaaattcggttgttgttgaacacaagatggtatacggtgaagagagatatattattaaagcaatagtcggattcgaagagggtttaggtgttgaatgtttacagggctcgggtttaattgctggtgccacttcgaaagcgtatagagacattttcactattactgctgttacttgtcggtccgttggtataggttcctatctggtcagactaggacaacgtactattcaggtggaggataagcctatcatactgacgggtgcatcggcgattaataaagttttgggtaccgatatctatacatctaacctacaaattggcggaacccaaatcatgtataaaaacggaatagcgcatttaacagccagtaatgatatgaaagccatcgaaaaaataatgacatggttatcatatgtcccggcgaaaagagatatgagtcctccacttcttgaaactatggatagatgggatagggatgtagacttcaaacctgccaagcaagtgccatatgaggcaaggtggttgatagagggtaaatgggactcaaataacaacttccagtcaggcctatttgataaggattcgttttttgagacattatctggatgggccaaaggtgtaatagttggaagagcacgtcttggaggtattcccgtgggtgttattgcggtagaaactaagactatcgaagaaataatccccgctgacccagctaatctggattcttcagagttttccgttaaagaagcaggacaggtgtggtatccaaattccgcgttcaaaacagctcaaactataaatgattttaactatggtgagcaattaccattgattatcttagccaattggaggggattttctggcggtcaaagggatatgtacaatgaagtactaaagtacgggtcttttattgttgacgctctggttgactacaaacaacccatactgatatacattccgccctttggtgaattaaggggcggatcatgggttgttatagatccaactattaatcctgaacaaatggaaatgtatgccgatgttgaatctaggggaggtgtgttagaacctgacggagtagttagcataaaataccgtaaggagaaaatgatagagacgatgattcgattagactccacatatggacatttgagaagaacgttgacagaaaaaaagttatctttggaaaaacaaaatgatcttacgaagagattgaaaataagagagagacagttgataccaatttacaatcaaatcagcatacagtttgcagatttacatgatagatcgactaggatgctagttaaaggagtaatccgaaatgagttggaatggaaaaagtcacgcagatttttatattggagactgagaaggaggttgaacgagggacaagtgatcaaaagactgcaaaaaaaaacatgtgataacaaaacgaaaatgaagtacgacgacctgttgaaaatagttcagtcatggtataacgatctggatgttaatgatgacagagcagtagtggagttcatagaaagaaattcgaaaaaaattgacaagaacattgaagagtttgagatctcgctgttgatcgatgagcttaagaaaaaatttgaagacagaaggggaaacattgtccttgaagagctaactaggttggtggacagtaagcgaaagagatag

SEQ ID NO: 25592 - DNA, 2883 bp, Saccharomyces cerevisiae
aaagggaagacaattacacacggccaaagctggggggctcgccggatacattctcacttttacattaccatattcacaattacttgcattcgaataggacagtacaagctcgcgttatatttggatccttatcgattctataatataacgggcagccagatagtacggttgaaaggacagcgccctgaatacagaaaacgcatttttgcccattcgtataggcattcatctcgaataggtttgaattttccatctagaagaaggtattccaattatgtggatcgaggcaatattcataaacatactcgattaccgccccagttcatagggctaaatactgtggaaagtgcccaaccttcaatattaagagattttgttgatttacgtggtggacatactgttatttcaaagatcttaatagcaaacaatggtattgctgcggtgaaagaaatgagatctataagaaaatgggcgtacgagacgttcaatgatgaaaaaatcattcaattcgtggtaatggcgacacctgatgatttacacgcaaattcggagtatattagaatggcagaccaatatgtgcaggtaccagggggtaccaacaacaacaattacgccaacatagacttaatactggacgtggcagagcaaacggatgtggatgcggtctgggctggatggggccatgcttctgaaaatccgtgtcttcctgagctgttagctagttcacaaaggaaaatactattcattggtcctcctggacgcgctatgagatcattgggtgacaagatttcttccactattgtagcacaaagcgctaaaatcccgtgtatcccttggtctggttcacatatagacactatccatatcgataacaagacgaactttgtatctgtgccggatgatgtatatgtaaggggatgttgttcctcacctgaagatgctttagaaaaggctaaattaataggatttcctgtaatgattaaggcatccgaaggtggtggaggtaagggcattaggcgagtagataatgaggatgattttattgcattatatcgccaagcagtgaatgagacacctgggtcgcctatgtttgttatgaaagttgtcactgatgctcgtcacttagaggtacagttattagctgaccaatatggcactaacattacattgtttgggagagactgttccatacaaaggcggcaccaaaagattatagaagaggcaccagtgacaataaccaagcctgaaacgtttcaaaggatggaacgcgcagcaattcgtctaggtgaattggtaggttatgtttctgcgggcactgtcgaatacttatattcaccaaaagatgataaattttactttttagaactgaatccgagactacaagtagagcatccaacgacagaaatgatatctggcgtaaaccttcctgccactcaactgcaaatcgccatgggcattcctatgcacatgataagtgatatcagaaaactttatggtttagatccaacgggaacttcgtatattgattttaaaaatttaaagagaccctcgccaaaaggccattgtatttcatgcaggatcacttcagaagatcctaatgaaggtttcaagccctccactgggaaaatacatgagctcaattttcgttcttcttccaatgtttggggttacttctcagtaggaaataatggtgctattcactcattttcagattcccaatttgggcacatttttgctgtaggaaacgataggcaagatgcaaagcaaaacatggttttagctctaaaagatttttccatccgaggagaattcaaaacccccatagagtacctgatagagctattagaaactcgggactttgagagtaataacatatcgactggttggttagatgatttgattttgaaaaatttatcttccgatagcaaactagatccaacgctcgctattatctgtggtgccgcaatgaaagcatacgttttcacagaaaaggtgaggaataagtatttggaattattgcggaggggccaagttccacctaaagattttcttaaaacgaagtttcctgttgacttcattttcgataataatagatacttgttcaatgttgctcaatcatctgaagaacaatttattctttctatcaataagtctcaatgtgaagttaatgttcaaaaattgtccagtgactgcttgttgatctccgttgacggtaaatgccatacagtttattggaaggacgatatcagaggtacaagactttcgatagactccaataccatatttttagaagctgaactcaatcccactcaagtgatctctccaactccggggaaattggtgaaatatttggtccgaagtggtgatcacgtttttgctggacagcaatatgcagaaatagaaataatgaaaatgcagatgccactagtagcgaaaagtgatggtgtaattgagttactaagacagcccggttccataattgaggctggtgatgtcatcgcaaaattgactttggattcgccgtccaaagctaacgaatcgtctttataccgcggagaattacctgttttaggtccaccgctaatagagggtagccgaccaaaccataagctcagagtcttaataaataggttagaaaatattctcaatggatatcatgaaaactctggaatagaaactactctaaaagagttgataaaaatattgagagatggtaggcttccttattcagaatgggattcccaaatttctacggtacgcaatagactaccaaggcaattgaatgaggggctgggaaatctagtcaagaaatctgtttcttttcctgcaaaggaactgcacaaattaatgaagcgctacttggaagaaaatacaaatgatcat

SEQ ID NO: 25593 - DNA, 1332 bp, Saccharomyces cerevisiae
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 25594 - DNA, 1215 bp, Saccharomyces cerevisiae
atggtaataagatgtagtactgacaaaacatggtggataggccagaagagcgtgcattggctggcgaaaagatcgaggacaatgattccaaaattatatatacatttgatactatctttattgttgttgccgctaattttggcgcaggattattatgcaatactagagatagacaaagatgccactgagaaggaaatcaaatcagcgtacagacaattgtctaagaagtaccatccggataaaaatgctgggagcgaagaagcccatcaaaaattcattgaagtcggcgaggcatacgatgtattgagcgatcctgaaaagaaaaagatttatgaccagtttggtgcagatgctgtaaagaatggcggtggcggtggcggtccaggaggccctggcgcaggtggattccacgatccgtttgacatattcgaacggatgtttcaaggaggtcatggaggtcctggcggcggatttggccagagacagaggcagcgtggtccaatgatcaaggtccaggaaaaactatctttaaagcagttttattccgggtcctcgatagaatttactttaaacctaaacgatgaatgtgatgcatgccatggtagtggctctgcagatggtaagctggcccaatgtcccgattgtcaaggtcgtggggttataatacaagtgctgcgcatgggtattatgacgcagcagattcaacagatgtgtggtaggtgtggtggtacgggacaaattatcaaaaatgaatgcaaaacatgtcacggcaaaaaagttaccaaaaagaacaagttcttccacgttgacgttccaccaggcgcaccaagaaactacatggacacaagagtcggcgaggctgaaaaagggcctgactttgacgccggtgacttggtcatagaattcaaggaaaaggatactgagaacatgggttacagaagaagaggcgacaatctgtacagaacagaagttctttctgctgcggaagcgctatacggcggatggcaaagaacgatagaattccttgatgagaacaagcccgttaagttatctagacccgctcatgtagttgtctccaatggcgaagttgaagtcgtgaagggattcggcatgcccaagggtagcaagggttacggtgatttgtacatagactacgtcgttgtcatgccaaagactttcaaatctgggcaaaatatgctcaaagatgagttgtag

SEQ ID NO: 25595 - DNA, 2229 bp, Saccharomyces cerevisiae
atgggttcatcaattaactatcctgggtttgtgactaaaagcgctcatttggctgacactagtacggatgcgagcatttcatgtgaggaagcaacaagctcgcaggaagcgaagaagaatttctttcaaagggattataacatgatgaagaaggcgcctgctccaacgaagtctaaactgtctttggccttgcagacttccaagtcatcctctagtgccaacggtactgtacaagaggatacttcctcgaagacagaagatttttctacaaagagcattaagaaaaaaccagatagcggcgttgaatcgcatgtgtccatccaatcggattcggggccacaatcagactcagatttggattcagattcctctatctcatcatgtgacgaaaggaacgaagagtctttgaaagattacaggccgggtgggtaccaccctgcctttaagggcgagccctataaggatgcacgctacattttagtaagaaagctgggatggggccacttctccaccgtttggttggcaaaggatatggtaaacaacactcacgttgctatgaagattgttcggggcgacaaagtttacacagaagctgctgaagacgaaattaagcttttgcaaagagtgaatgacgccgataatacaaaggaggattccatgggggctaatcatattttgaaattgctagatcatttcaaccataagggccccaatggcgtccatgtggttatggtatttgaagtcctcggcgagaacttactggctttgataaagaagtatgaacataggggcattccattgatttatgtcaagcaaatatcgaagcagttactgcttggtcttgattacatgcataggcggtgtggtattatacacacagatattaaaccagaaaacgtgttgatggagattggagatgttgagggtatcgttcaaatggtcgaggcactggataaacagaagagagaggcaaaaaggttgcagaggcacgtttcgcggtcttctgatattaccgcgaacgatagcagtgatgagaaatgggcagaatgccaaacaagtatgccctgcggctcaagctcaaattccaaatctcgttctatagagaaggacttgtcaaaaagatgctttagaagacctagacgtcatacaattatcacagggtcgcaaccattaccttccccaattagttcatcaaatttctttgaaatgagggcgcacttttgtggtagtagtcacaatagcttttcctccgtatctgggaataggaacattccatcttccatcaataataacagtattaataatggcataggcattaagaatagcaacaatagtttcttaaattcagtaccacattctgtgaccaggatgttcataaatgaagacagtaatgataacaacaataatgataatagtaaaaataaaaataacaacaataacaacagtaacaacaataataacgaggacataatgaacacacctttgcatgaagagcagctggcagactctttatctacatttgatatttccaatatatcacaaagctccgatacaaatggtccatatatttctaatactatggattcaaattcaaacgtcagtaccgatatcaactccccagaaaatttgattcagatcaagattgctgatttaggtaatgcttgttggtatgacgaacattacacgaattctatacagacaagagaatacagatcaccagaggtgttactaggcgccccttggggttgtggtgcagatatatggtctactgcttgtctaatttttgaattgattaccggagattttcttttcgaaccggacgaaggtcattcctacactaaggatgatgaccatattgcacaaatcatcgagttattgggagaattaccatcataccttttgaggaacggcaaatatacaagaactttcttcaattcaagagggcttttaagaaatatctcgaaattgaaattttggcccttagaagatgttttaactgaaaaatataagttttctaaggacgaagccaaggaaatatctgattttttgtcgcctatgttacagctagacccaaggaaaagagctgatgcaggtggcttggttaaccatccatggctcaaggataccttgggtatggaagagattcgggtacctgatagagagttgtacgggagtggttccgatatccccggatggtttgaagaagtccgcgatcataaaagacattga

SEQ ID NO: 25596 - DNA, 1356 bp, Saccharomyces cerevisiae
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataa

SEQ ID NO: 25597 - DNA, 1416 bp, Saccharomyces cerevisiae
atgagcatttgtccacatatacagcaagtatttcagaatgaaaagtctaaagatggggttctaaaaacgtgcaatgctgccaggtatatattaaatcattccgtacccaaggaaaaattcttaaacaccatgaaatgtggtacatgccacgaaataaactctggtgcaactttcatgtgtctacaatgtggattttgtggatgttggaaccattcgcattttctctctcacagtaaacagattggtcacatatttggtatcaactcaaataatggccttttattttgcttcaaatgtgaggactatatagggaatatcgatctgattaacgatgctatcctagcgaagtattgggacgacgtgtgcacaaagaccatggttcctagcatggaaagaagagatgggctttctggcctgatcaacatgggatccacttgtttcatgagtagtattctccaatgtctaatccataacccttactttattaggcactcaatgagtcaaattcattctaataattgtaaagtgcgttctccagataaatgtttttcatgtgcactcgataaaattgttcatgaactttatggagcgctgaatacaaagcaagcttcttcgtcatctacatctactaatcggcaaaccggattcatatatcttttaacttgtgcctggaaaatcaatcaaaatctagcagggtattcacaacaagatgctcatgaattttggcagtttataattaaccaaatccaccaaagctatgttcttgatttgccaaatgccaaggaagtcagcagagcaaataataagcagtgtgaatgcatagtgcatactgtgtttgagggctccttggaaagttctattgtgtgtccaggctgtcaaaataattcaaagacaaccattgatccattcttggatctttctctggatatcaaggataagaaaaaactttatgaatgtcttgacagtttccataaaaaagaacagttgaaggatttcaactatcattgtggggagtgtaacagcactcaagatgcaataaagcaactaggcatacacaaattaccatcggttttggttttgcaattgaaaagattcgaacacctacttaatggaagtaacagaaaactagacgattttattgaatttccaacttatttaaatatgaaaaattactgttcaacgaaggaaaaagataagcattctgaaaatggcaaggttccagacattatttacgaattaatcggtattgtttcccacaaggggacggttaatgagggacattatattgcattttgtaaaatttctggagggcaatggtttaaattcaatgattccatggtctcctctatatctcaagaagaggttttaaaggaacaggcatatttattattctacaccattcgtcaagtaaattga

SEQ ID NO: 25598 - DNA, 2079 bp, Saccharomyces cerevisiae
atggactatcctgatccagacacaataaggattttaattactacagataatcatgtgggttacaacgaaaatgatcccattactggcgatgattcttggaaaactttccatgaagtcatgatgctggccaaaaataacaacgtagacatggttgtacagtccggtgatctttttcacgtgaataagccttccaagaagtcactctaccaagtactgaagactttgagattatgttgcatgggtgacaagccttgcgagttagaattattgagcgatccctcacaagtttttcactacgatgaatttaccaacgttaactatgaggaccccaactttaatatttctattcccgtattcggcatatcaggtaatcatgatgatgcgtcgggggactcactgttgtgtcctatggatatacttcatgcgactggtctaataaatcatttcgggaaagtcatcgaatctgataaaataaaagtcgtgccattattatttcagaaagggtccactaagttagcattgtacggattagccgctgttcgtgatgaaaggttatttagaacttttaaggatggtggtgtcacttttgaagtaccgactatgcgagaaggtgaatggtttaatttaatgtgcgtccatcaaaatcatacaggtcacacgaatactgcatttttacctgaacagttcttgccagatttcctggatatggtgatatggggtcatgaacatgagtgtattccgaatctcgtacacaatccaattaaaaattttgatgtattacaaccaggttcatctgtagctacttcactttgtgaggctgaggcacaacccaagtatgtctttatccttgacataaagtatggagaagcaccaaaaatgacacctattcctcttgagactatacggacattcaaaatgaaatccatttcgttacaagatgttccccatttgaggcctcacgataaagatgctacgtctaagtatcttattgaacaagttgaagaaatgatccgcgacgctaatgaggaaactaaacaaaaattagcggacgatggtgaaggtgacatggttgcggaattaccgaaaccattgatcagattacgtgttgattatagtgcaccctccaatacacaatccccaatagattaccaagttgaaaacccgcgtagatttagcaatcgatttgtgggacgtgttgctaacggtaataacgttgtgcagttttataaaaaaaggtcacctgtaactagatcaaaaaaatccggtataaatggaacaagcatcagtgatagagatgttgagaaacttttcagcgaaagtggcggtgaactagaagttcaaactttggttaatgatctcttgaacaaaatgcaactatctttattaccagaagttggtttgaatgaagcagtaaagaagtttgtagataaagatgagaaaacagctcttaaagaatttattagccatgaaatatcgaacgaagttggaatattatctacgaatgaagaatttctgagaacagatgatgcagaggaaatgaaagcgcttataaaacaggttaagcgtgctaacagtgttaggccgactccccctaaagaaaatgatgagacaaatttcgcattcaatggtaatgggctagattccttccggtctagtaatagagaagtaagaactggatctccagacattacccaatcacatgttgataatgaatcaagaataacccatattagtcaagcggaaagcagtaagccaacgagcaaacccaaacgagtgcgaactgcaacgaaaaagaaaattcctgctttttcagactcaactgtcatatccgatgcagaaaatgaactcggtgataataacgatgctcaagatgatgttgatattgatgagaatgacataattatggtcagtactgacgaagaggacgctagttatggtttacttaatggtcgaaaaacaaaaacaaagactcgtcctgctgcgagcaccaaaaccgcttccagaaggggaaaaggaagagcatcaaggacgccaaagacggatattcttggaagtctccttgctaagaaaagaaaatag

SEQ ID NO: 25599 - DNA, 804 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 25600 - DNA, 1773 bp, Saccharomyces cerevisiae
atggctgttataagaattaaaaaacccagaggaccaggagagaaggatcaaccattagaaggcgagcctaaactaaagagaattcgcataaagacaaaggtaactgatgaagatatcaaaccaaagcctaaattaaagataaacctaaagaaaaagaaagagagtgctgacggcaaagagaagaagaattcattgaagttaaagttaaacttgaaaaaaaatgaagaaccagttaagaagatacacaaggcgccaaagctacgtctcaaacctattagaattcctggggaagcgtacgactcagaagcctctgatattgaagatgaccctctcatagagagtggtgtgatattaaggatacttccagacatacagttagagtttgtaaaaaattcgttagaatcaggtgattattctgggataagtatcaagtggaaaaacgagagacacgctgtcgtaacaataaacgatgtaatgtatggtgccattctagtagatttgcctacagttatagaagtgaacaagagcgtcgatagaaaaaacctcctgaagacatttgacgtatcacaaatgctactatgcataagacctatacaagaagaggaagaagtatatgccctagaagcccctgatacagaagatctggttgttaagcattttgaaggcatagaggatgaaatttgggagaataaagaaaccttcttaaaaggatacaatggtgcgcctttaagtgatatggaggctaaacatttgaaagaaatagctttgaagggctatgactacaaacatggaatatcaccacctttgtacaatgttcgaaatagacgatttagacggaaaatggaccctaatgaaatagactatgtagaaaaagtggttgatatgcttttgaagcaagataaacaggcagaagaggtcagctatgatctggttgataaaagtgaactgcaagcgaggcaagagcgtgtttctagttgggaaaatttcaaagaggagcctggagagcctttatctagacctgctttaaagaaagaagagatacacacaattgcttcggcagtaggaaaacaaggtgcagaagaagagggagaagaaggaatggaagaagaagaagaggaggatcttgacctaggcgctgcttttgaaagtgaagaggaaggtagcggtgccgagggagacaaggagcaacaacaagaggaagtcggtgatgaggtggatcaagacacaggcggagaagatgatgacgatgatgacgacggtgacattgaagctgctggtggggaaagtgaatctgatgacgaaaaagacgaaaacagacagcacactgaattacttgcggacgaattgaacgaactagagaccaccctggcccataccaagcataaattaagtaaagccacgaatcctcttttgaaaagcaggttcatagatagcattaaaaagctcgagaaggaggctgaactaaaacgtaagcagttacaacaaaccgaagattctgtccagaaacaacatcaacatcgctctgacgcagaaactgcaaataacgtcgaggaagaagaagaggaagaggaagaagaagaggaagaggatgaagtggacgaagacgaggaggatgacgaagaaaacgatgaggacgaggataatgtgcatgaacgggaacacatacaagagaacaaggtggtgcgcgaacttgatgaagcccccgcagaggaaacactcgaccagaacgatctcgatatgatgatgctatttggtgcagagggtgatgagtaa

SEQ ID NO: 25601 - DNA, 1047 bp, Saccharomyces cerevisiae
atggcaaggcaagggaacttctacgcggttagaaagggcagggaaactgggatctataatacatggaatgaatgtaaaaaccaagttgatggttatggtggtgcaatttataaaaaatttaacagctacgagcaagcgaaatctttcctaggtcaaccaaatactacatcaaactatggaagttcaacgcatgctggagggcaagttagtaaacctcataccactcaaaagcgagttcatcgaaggaatcggccacttcattattcctccttgacatcgtcatcagcatgttcatctttaagctctgctaatacaaataccttttattcagtaaagagtaatgttccaaatatcgagagtaaaatctttaacaattggaaagactgtcaagcctatgtcaagcataaaaggggtataaccttcaagaagtttgaagaccaattagctgcggaaaacttcattagtggtatgagtgcgcatgattacaagctcatgaatatatccaaagaaagttttgaatctaagtataagctttctagcaataccatgtacaacaagtctatgaacgtttactgtgatggttcaagttttggaaacggcacgtcatcttcaagggcaggttatggtgcatattttgaaggagcgccagaggaaaatatttcagaacccttattatcgggagctcaaactaataatagagctgaaatcgaagcagtatcagaagctttgaagaaaatctgggaaaagttaactaatgaaaaggaaaaagtaaattatcaaatcaaaactgattcagagtacgtaaccaaattattaaatgacaggtatatgacgtatgataataaaaaacttgaagggctacctaattctgatttaattgttcctttggtgcagaggttcgttaaagttaaaaagtactatgagttgaataaagagtgcttcaaaaataatggtaaatttcagattgaatgggtaaaaggacacgatggtgatccaggaaatgaaatggcagattttctggcgaagaaaggagcatctagacgataa

SEQ ID NO: 25602 - DNA, 474 bp, Saccharomyces cerevisiae
atgaacggcggaggcaagaatgttttgaataaaaactcagtgggctcagtatcagaagttggtccggactcaacacaagaggaaacgccacgagatgtccgtcttttgcatctgctcctcgcatcacagtcgattcatcaatatgaggaccaagtaccgctacaattgatggattttgcacataggtacacacaaggagtccttaaggacgcgttggtttacaacgactacgctggcagtggaaattctgccggcagtggattaggagtagaagacatacggcttgccattgcagcgagaacacaataccaatttaagcctacggcacctaaggagctcatgttacagttagctgcggaaagaaacaagaaggcattacctcaagtgatgggtacgtggggtgtcaggcttcccccagaaaaatattgtctcacagcgaaggagtgggaccttgaggacccaaagtctatgtga

SEQ ID NO: 25603 - DNA, 945 bp, Saccharomyces cerevisiae
atgccatctaccactaatactgctgcagcaaacgtaatagaaaaaaagccagtctcgttttctaatatcctattgggtgcctgtttaaacttgtcagaggtgactacattagggcaacctttggaggttgttaagaccacaatggctgcaaacagaaacttcacatttttagaatctgttaagcatgtctggtcaagaggtggtatcttgggttactaccaaggtttgattccatgggcatggatcgaagcctccactaaaggtgctgtgttgctgttcgtgtcagctgaggctgagtatcgtttcaaaagtttggggttgaacaactttgcctcaggtatattaggtggtgtcacgggtggtgtcactcaagcctacttaaccatggggttctgtacctgtatgaaaacggtggaaattacaagacataaatctgcctccgcaggtggtgtcccacaatcttcttggagtgtgttcaagaatatttataaaaaggaaggtattagaggtattaataagggtgttaatgctgttgctattagacaaatgaccaactggggttctcgttttggtttgtccagactagtggaagatggtatcagaaagatcaccgggaaaaccaataaagacgacaagttgaatccgttcgagaaaattggtgccagtgctttaggtggtggtttaagtgcttggaatcaaccaatcgaagtcattagagttgaaatgcaatctaagaaggaagatccaaacagaccaaaaaatttgactgttggtaagacatttaaatacatctatcaatcaaatggtctaaagggtctttaccgtggtgtcaccccaagaattggtttaggtatctggcaaactgtcttcatggttggttttggtgatatggcgaaggaatttgtcgccagaatgactggtgaaaccccagttgccaaacattag

SEQ ID NO: 25604 - DNA, 2085 bp, Saccharomyces cerevisiae
atgaccgaacaatattccgttgcagttggcgaagccgccaatgagcatgaaaccgctccaagaagaaatatcagggttaaagaccagcctttgattagacccataaactcctcagcatctacactgtacgaattcgccctggaatgttttaccaagggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacttctcacaagtggatgaaaacttttcttggttgcatgtcacaaggtattcctgtggtcaccgcgtacgacactttgggtgagagcggtttgattcactccatggtggaaacagattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaacctttgaattcgaagcgttctactggaatggtatcctagggtacgccaatgtcaagactttaaccccaacttctacacgtaattgccaaggtgacctgatggagtttaaacctaccgtaatggtgggtgtcgccgcagtttgggaaacagtgagaaaaggtatcctggccaagatcaacgaattgcccggttggtctcaaacgcttttctggactgtctatgctttgaaagagagaaatataccatgtagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataatcaaggtgaattgctgtttaagggtgcacccatctgttctgaatactataagaatcctgaagaaactgctgcggcctttaccgatgatggctggttccgtaccggtgatatcgctgaatggacccccaagggacaagttaagatcattgatagaaagaaaaatttggttaagaccttaaatggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaatggccttgttacatccgcccaaaaattaaagagaagagatattctagcggctgtcaagccagatgtggaaagagtttataaagaaaacacttaa

SEQ ID NO: 25605 - DNA, 3165 bp, Saccharomyces cerevisiae
atgactattatcgtcgcttctttattcttaccatatacccctcaattcgaggctgatgtcaccaactcggatactgctaagctggttgaatcaagtatgatcaaggtagactgcaacaaccaggaattgagcaacaacaagcaagaaagaagcagttctgtaacttcggcaagctctcattatattggcttacctcaggaggcgcaaattaacggtgaacccttacaaagggccaatgtgggctctcctgctacgggagttaactatcataatgagatggaaatgctttcctcagagcaattcctggaagagctgactgccaatgccactcatgcagcaaactctggtattccgccagctaataacccagtttcttctggctcaactgcccagcggccttcagtcgaggaattcttttctgctccgtctgctagagtctgttctccctcccaggaagcttctgcttcgtctatttctgctagtcgttcatcggctcaccacaacgatttgagctccagccttatgaaaaatcccaatttgtcatttgattcacatccacccagggtcagaagctcatccaagagtgctgtaatcactcccgtctctaaaagcgttccagatgtcgatcctgctgttgtagatgtcgcaaaagttagagaagagtttcaacagcaagcctccttgccttccatgaaaagagtttccggaagcaccgctggagactcttccattgcttcttcgagttctaatctcaggtactcacagcaatttcaggataactttatcgaagacactgatagtgaggatgacattgattctgatttggagaccgatgctactaagaaatacaacgtcccaaaatttggtggctattccaataacgcaaagttaagagcatctctaatgagaaactcgtatgagctattcaaacatttgccatggacaatagtcgacagtgacaaagggaacggatccttgaaaaatgcagttaatattgcagttgctgaaaagacagtgaaagaacctgtttcctgggtaggtacaatgggaatccctactgacgaacttcctcacgaagtttgccataagatttcaaagaaattagaacaggatttttcttcttttccagtggtcacggacgatattacttttaagggtgcttataagaactacgccaaacagattttatggcccactctacattatcaaattccagataatccaaattcaaaggcttttgaagaccattcttgggactactatcaaaaagtgaatcaaaagttttctgataggatagtttccgtttacaaacctggcgacacaatttggatccatgattatcatttgatgcttgtcccacaaatggtgagagagaaactgcctaaagctaagattggatttttcttacacgtatcatttccaagtagtgaggtcttcagatgccttgctaacagagaaaggattcttgaaggtattattggtgcaaactttgttgggtttcaaactaaagaatacaaaagacatttcctacaaacttgtaacagattgcttgctgcggatgtctctaatgatgaagtcaaataccattgcaatattgtttccgtgatgtatgcgccaattggtattgattattaccatttgacatcgcagttgagaaatggttctgtacttgaatggcgccaattaattaaagaaagatggcgtaataaaaaactgattgtttgtcgcgatcaatttgacagaattagaggtcttcagaaaaaaatgttagcctacgagaggtttttgatagaaaaccctgaatacatcgaaaaagttgttttgatccaaatctgcatcggtaagagttccgatcctgagtacgaacgtcaaattatggttgtcgttgatagaatcaattctttgtcttcgaacatcagtatctctcaaccagtggtctttttgcatcaagatttagattttgctcaatatttggcattgaattgtgaagctgacgttttccttgtggatgcgctgagagaaggtatgaatttaacatgtcatgagttcattgtcagttcattcgaaaaaaatgcgcctctattattatctgaattcactggtagttcttctgtcctaaaggaaggtgccatcttaataaacccatgggatataaatcatgtagcacaaagtatcaagagaagtttagaaatgtctccagaagaaaaaaggcgtaggtggaaaaaattattcaaatctgttattgaacatgattcggataattggattacaaagtgcttcgaatacataaataatgcttgggagtccaaccaagaaacgtctactgttttcaatttggctccagaaaaattctgtgctgattacaaagcctccaaaaagcatttatttatcttcaagatttcagaacctccaacgtccagaatgctatccttgctaagtgaattgagttcaaataatatagtttacgttttgagttcatttacaaagaatacattcgaaagcttatacaatggtgttctaaacatcggattgatagcggagaatggtgcctacgtaagagttaatgggtcgtggtacaacatcgtggaagagcttgattggatgaaagaggtggcaaagatctttgacgagaaagtcgagaggttacctggttcatactacaaaatcgctgattctatgatcagattccatacagaaaacgctgatgatcaagatcgagtcccaactgttattggggaagccattacgcacataaacaccttatttgatgacagggatattcacgcttatgtgcataaggatattgtcttcgttcaacaaacggggctagccttagccgccgctgagtttttgatgaaattttacaacagtggcgtcagtcctactgacaatagcagaatatctctatcaagaacatcctcttcgatgtccgtcggtaataataagaagcatttccaaaaccaggtagatttcgtttgcgtttccggttcgacatcacctattattgaaccattatttaaattagtgaagcaagaggttgaaaagaacaatctaaaatttggttacaccattctttacggtagctcaagatccacttatgccaaggaacatatcaatggtgtcaatgaactttttaccatccttcatgacttgacagccgcctaa

SEQ ID NO: 25606 - DNA, 1122 bp, Saccharomyces cerevisiae
atgtcgttgaatatacatatcaagtcaggacaagacaagtgggaagtaaatgtggcacctgaaagcacagtgttgcaattcaaggaggcgataaacaaagcgaacggtatcccggtggcaaatcagagattgatctactcgggtaagattttaaaggacgaccaaaccgtggagtcataccacattcaagacggtcacagcgtccatctggtcaagtcacaacccaaaccacaaaccgccagtgccgctggcgcaaataacgccaccgccaccggtgcagcagctggcactggcgccaccccgaacatgtcgtcaggtcaaagtgcaggcttcaatccgctggccgacttgaccagtgccagatacgctggatatttgaatatgccatctgcagacatgtttggcccggacggtggtgcattaaacaacgactcgaataaccaagacgagctgttgaggatgatggaaaaccccatcttccaatcgcaaatgaacgagatgttgagtaaccctcagatgttggactttatgatccagtccaacccgcaattgcaggccatgggtccacaagccaggcaaatgctacaaagtcccatgtttagacagatgctcaccaatcctgatatgattagacagagcatgcaattcgcaagaatgatggaccctaatgccggtatgggctctgcaggtggggctgcctctgccttccccgctcctggtggcgatgctccagaggaaggctccaacacgaacactacttcctcatccaacacagggaacaacgcagggactaatgcaggtaccaacgcaggcgctaacacagctgcaaacccatttgcgtctcttctgaaccctgcattaaacccctttgctaacgcgggaaacgctgcatccaccgggatgcccgccttcgatcctgcattgctagcgtctatgttccaaccccctgtacaagcatctcaagcagaagacaccagaccaccggaagaacgctatgaacatcaattaagacaactaaacgacatgggcttcttcgatttcgatagaaacgtcgcagccctcaggagaagcggtggctccgtccaaggcgctcttgattcactactgaacggcgatgtttaa

SEQ ID NO: 25607 - DNA, 1869 bp, Saccharomyces cerevisiae
atgttgcaaggaattttagaaaccgtaccatctgacttgaaagatccgatatcattatggtttaagcaagaccgcaacccaaaaactatagaagaggtcaccgctctctgcaaaaaatccgactggaatgagttacacaaaagatttgattctagaattcagtttggcactgctggtttaagatcgcaaatgcaagctggctttagcaggatgaatactttagtagtcatacaagcgtctcagggattggcaacttatgtaagacaacagtttccagacaatttggtagctgttgtgggacacgatcatagattccattctaaggagttcgctagagctactgctgctgcatttcttttaaaaggatttaaggtacattatttgaatcctgaccacgaatttgttcatacccctttagttccctttgcagtggataagctaaaggcctccgttggcgtaatgataacagcaagtcacaacccaaaaatggataatggatataaagtatactattccaatggatgccaaatcattccacctcacgatcatgccatctctgattccattgacgcaaatttagaaccatgggccaatgtgtgggatttcgacgatgttctaaataaggctctcaaacaagggaaattgatgtattccagagaagaaatgctgaagttatatttagaggaggtttctaaaaatctggtagaaatcaacccattaaagcttgaagtaaaagccaaaccttggttcgtttacactccaatgcatggggttggatttgacattttcagcaccatcgtaaaaaaaacactgtgcctggtagaaggtaaggattacctatgtgttcctgaacaacaaaatccagatccttctttcccaactgttggatttcctaaccctgaagaaaaaggtgctttagacattggtataaacttggctgaaaaacatgacattgacttacttgttgccaacgaccctgacgctgatagattctctgttgctgttaaagatatgcagtcaggcgaatggcgacaactaacaggtaacgaaatcggttttctttttgcattttatgaatatcagaaatataaaagtatggacaaagaatttcagcacgttcatccgttggctatgttaaattcaacagtgtcttcacaaatgataaaaaaaatggcagaaatagaagggttccattatgaggatacattaacaggatttaagtggatcggaaatcgtgccatactcttggaaaagaaaggctattacgttccttttggattcgaggaagcaataggctacatgtttccagcaatggagcatgataaggatggtatcagtgcatccattgtcttcttgcaagcctactgtaagtggaaaatagaccacaatttggacccgctaaatgtcttagaaaatggcttcaaaaaatatggcgtgttcaaagagtacaatggctattatgtcgttccaaatccaactgttacaaaagatatatttgactacatcaggaatgtctacactcctgagggcgcgtcatatccttcatctattggtgaagaaatcgaagtactttactatcgagatttaaccactggttaccaatcggataccataaatcataaacctactctacccgtcgatcctacatcacaaatgataacagtatctgctagaccaagtaacggtagtgagaatgagcatatccgcttcactattcgcgggtccggaacagaaccaaaacttaaagtatatattgaagcttgcgcaaatgaagaacaaagagcctctttcttggcgaaattgacttggaatgtgctgagacgtgaatggtttagaccagatgaaatgaatatagttacaaaattttga

SEQ ID NO: 25608 - DNA, 915 bp, Saccharomyces cerevisiae
atgaagatgttgaggcgtacaaaggtaaatttttcaaaattgctttacaagattactaaactagcaatagtactgacgatcctatatatttattttacgcccaaaatcgtctcccgaaacaatgcatcattgcagcatatttttcctcataaatatggcgattatgaaatcaatttggtcatagcgcaccctgacgacgaagttatgtttttttcccccataatttctcaactgaattcgtactttccgagaaccgtcccatttaacataatctgcttatcaaagggcaacgccgaaggtcttggcgaaaccagggtaagagaattaaatgagtcggccgctttattgctacacaatgaaagagcagtctccgtacaggtgatggatttccaggatggtatggacgaaatatgggatattgattctataacttcttctctttcacaaaagatagatataaagaatcataacttgaaccagattatcgttacctttgattcatatggtgtatcaaatcatatcaaccacaaaagctgttatgctgccgttaaaaagttggtggatgattatgctcaacctaagaccaaaagaaatgaacaaccacctcatgtcactgcgctttatttgagaagctacaagaacaacatcgttttaaagtacaactcctttatttgggaaatcctaaaaatactttacgacctgatttctccattccgtagaataattcaggcgcttccgcctaacacagccgccgaaaaagacaagctttcacttatgaatacacatgcacaatacgtactagcgtttgccactatgctaaatgctcacgaatcccaagttgtgtggtttagatacggatggtggatattttccagatttgtcttcgttaatgaatttgatgtttatacatattag

SEQ ID NO: 25609 - DNA, 1809 bp, Saccharomyces cerevisiae
atgcgctcagtcactaatgcatttggcaatagtggagaacttaacgatcaagtggatgaaacaggttataggaagtttgatatccatgaaggaattttgttttgcattgaactatcagagacaatgtttaaagagtcctctgatctagagtataaatcaccattgttggaaattctggaatcactagatgagctaatgtcacaattggtcataacaagacctgggacagctattggttgctatttttattactgtaacagagaggatgccaaggaaggtatctatgaactttttccattaagggatataaatgctacatttatgaagaaattgaacgatcttttagaagatttatcatcggggagaataagcctatacgactattttatgtttcaacaaactgggagtgaaaagcaagtgcgcttatctgtattattcacattcatgcttgacacttttttggaagagattccgggtcaaaagcaattaagcaacaagagagtgttcttattcactgacattgataaaccacaagaggcgcaagatatcgatgaacgggcaagattgagaaggcttacaattgatttatttgataacaaagtgaattttgcaactttttttattggctatgccgataaaccatttgacaacgagttttattcggacatactgcagttgggttcacatacaaatgagaatactggtttggattctgaatttgatggtccaagtacaaagcctatagatgctaaatacatcaagtccagaatcctaaggaaaaaggaggtaaagaggataatgtttcaatgtccattaatcttggatgagaaaacaaattttatagtcggagtcaagggttacactatgtatacccatgaaaaagctggagtcaggtataaacttgtttatgagcatgaagatatcagacaagaagcatattcaaaaagaaaatttttaaatcctataacaggagaagacgttactggtaaaactgtcaaggtttatccttatggtgacctcgatatcaatctatcagatagtcaagatcagatagtaatggaggcttatactcaaaaagatgcgtttttgaagattattgggttccgttcatcgagcaaatcgatacactatttcaataacatagacaaaagttcgtttatcgtaccagatgaagcaaaatatgaaggttcgataagaaccttggcttctttattaaaaattttgagaaaaaaagataaaattgcaatattatgggggaagcttaaatcaaattcacatccttcactatatacgttatcaccctcaagcgtgaaggactacaacgaaggattttatctctacagggttccattcctagacgaaattcgaaaatttcctagtttactatcctatgatgatggctctgaacataaactagattatgataacatgaaaaaagtaactcaaagtataatgggatactttaacttgagggatggatataacccatccgatttcaaaaacccactattacaaaaacattacaaagttttacatgattacctgttgcaaattgaaaccacttttgacgaaaatgagacacctaatactaaaaaagacagaatgatgcgtgaggacgattctttaaggaaactatattatatacgaaataaaattttagaatctgagaagtcagaagatccaatcatccaaaggctaaataaatatgttaaaatctggaatatgttctacaaaaaatttaacgatgataacatttcgataaaagaagaaaagaagccctttgataaaaagccgaaattcaatatataa

SEQ ID NO: 25610 - DNA, 1518 bp, Saccharomyces cerevisiae
atggctaccccgtcaaataaacgttctagagattctgaatctacagaagaacctgtagtagatgaaaagagcacttcaaaacaaaacaatgccgcacctgagggagaacaaactacttgtgtggaaaagttcgaagaactaaagttatcacagccaactttaaaggccattgaaaagatgggatttaccactatgacttctgttcaggcaaggactatcccacctcttttggccggtagggatgttcttggtgctgccaagacaggttctggtaaaactctagcgtttctcatccctgctattgaactattgcattctttgaaattcaaaccaagaaatggtaccggtataattgtcattacgcctacaagagagttggctttacagatttttggagtggcaagagagttaatggaattccattcacagacatttggtattgtcattggtggtgcaaatagaagacaggaagccgaaaaattgatgaaaggtgttaacatgttgattgctacccctggaagattattggatcacttacaaaatacaaaaggatttgtattcaagaacttgaaggctttgattatcgatgaagcggacagaatcttagaaattgggtttgaagatgaaatgaggcagataattaagatcttgccaaacgaagataggcaatccatgttattttcagctacacaaacgaccaaagttgaggatttggctagaatctcgctgagaccgggccctcttttcattaatgtcgttcctgaaaccgacaactccaccgcagatggattagaacaaggctatgtggtatgtgacagtgataagagatttttgttgttattttctttcttgaaaagaaatcaaaaaaagaaaattattgtatttttatcatcttgtaactctgtgaaatattacgctgaattattgaactatattgatttgccagtcctcgaattacacggtaagcaaaaacaacaaaagagaacaaatacatttttcgaattctgtaatgcggaaagaggtatcttgatttgtacagatgtcgcagctagagggctagatatccctgctgtggactggatcattcaattcgaccctcctgatgatccaagagattatattcatagagtcggaagaaccgcaagaggcactaaaggtaagggtaaatctttaatgtttttaacacctaatgaattagggtttttaagatatctaaaggcttccaaggtcccattaaatgagtacgaattcccggaaaacaaaattgcaaacgttcaatcacaattagaaaaattaattaaatccaactattatctacatcaaacagccaaggatggttatagatcttatttacaagcgtacgcttcccactctttgaaaactgtctatcaaatcgataagctggatttagccaaagtagcaaagtcttacggttttccagtccctccaaaggttaacattacaattggtgccagtggaaaaacgccaaataccaaaagacgtaaaactcataagtaa

SEQ ID NO: 25611 - DNA, 1761 bp, Saccharomyces cerevisiae
atgactacagctagttcttctgcttcccagctacaacagcgcctgccggaagaaaaaccttggccgcaactgagtggcagcaatgcagacgctcaaaccttcaaatgtaaatacgtaaccaaccacaactccttgggcgatgggaattttagcgtcgtgaaagaatgtatgaatatacacacaaaggatttgtacgcgatgaagcttattaagaaacaaactgtcaagaacaaaattcaacttattcaaagagagttcgaccttttgaggtcaataagcgagaaaatcagagatatggaaaaaaagaatgaacattctttggacatttttgaggggcatcaccatattttacaacttttcgactattttgagacggcagataacattgtcctgatcactcagctgtgtcagaagggagatttgtatgaaaaaattgttgaaaatcagtgtttagacctcgaaactcaagttacctcgtactgcgcctgtttggtgagcgttctcgagtttttgcattctcaaggtattgttcatagagacttgaaagcagaaaacgtcttattcagattgagagtgaacgaaaacgaaaaaaacctacagggtgaacaccacggagatttcaaatacgatctcttggcacacgacctagttctcgccgattttggtcttgctgctgaatataacacaagtaaggtaaactcgttaaaggagtttgttggaaccatctcgtatattgctccagaaatcgtcaagtgcaaaggtgtcggtgaaatgactcctgatcaagttggcaaactagacaagtatggttgtccggtggatatatgggcccttggtgtactgacatatttcatggccttcggctatacgccctttgactgtaccacagacgacgaaactctggaatgtatttcaaaatgtgactattacgtcgacgaacaaatgatgcacgaccctaaatacgaacaattttggaattttgttcaatgctgttttactattgacccggccgttaggcgttctgctaagaatttgaaacagcatccctttattaaggattattttgctacttcaaattctttgaatactaaggacacgccgaatttctcctttcatccaacaataagaagggtatcttctacagcgtccatgcacacattgaggtctccttccaaatcaagaaagacaactactctagcgtatttaaatatggatggcgggtcctctgaaacttccaccgccttcagcagcaagatggatttgcctgacctttacgttgatagaaccattaattctcgtgaaagatcattgaatagaattcgagacactctgaagaaaacattatccatgacatctcttaagcctgcaggcacattcgactatcttcacgctaacaaaaacggtacttctttatcatcatccaagtcaggcctcgtgaaaaagaattctacttttgtcttggaccctaagccaccaaagaatagcttgatgaacggttgtttcagcaccactccagaatcgcgctcaaatttcaatacccccaaaaccttatcgaggcaaggttcctctactagcgtgaagaaatatgtcaatgaagttgacttacttttaaccccacgtacggcctcgatgagcagcaatgataccacagccattaacgattatgatactactaacgataagaatcctgcaagaaaacacgcagcttcattccaggtgaatgttgatgattctgatggtgatgaaaccatgcagatatag

SEQ ID NO: 25612 - DNA, 1122 bp, Saccharomyces cerevisiae
atgaacgtcatagatttaagtgatcctgccatcaatgtggattatgatagcttgattggcattgacaatgaggaatctcaagaaatttttgaaaatgaagtgaaggaagatggacaacaagaagagcaggaagaagcatcttcaagaaaagatgggctcatcgttgaaccagggagagatgttgagagtttgagaagggctattcgagatcagttgcttttcaagatacatagacaaaaccaatcagactgtgcagatgcgagaaagttgagtaacgatgaagaagatgaaagtcggcaacagaaattagaaagaataagagaagaattggaggagttgaaaatagaaaatttaacatctgaaatgcaaactgaaatcaaggaattgtgcgaaattcaatcaaaattggcgacggaatcatctagtagattgacaaatttgaggaagaagcttctcgaaacatatgaaggccaagataccgtcatattgccaaacataattcttgatacgagtaatatcaaaagattgcaaaagttagatcagaaaatatccctaatggaacgttttgttggcataccagaagctttggaggcagaagaagataggaaatcggttcatagtaaagtcaatgaactatatagaagtattcaacttttacaaggcgatgataaggcggaaggaaagctgcaaaagttccgggatagactcgtagaactgaacgaggaatttgaaaactcattgttaggcaagaaaatacaacaggacttgaggttgaaagatgacaccgtgagcaagcttgttatgcccgaaaacaaagtaaaggagataaatagtatgtattccatgttcaagcaatatcaagattcactaccactgttggcggagaggatgaaaagtctcaataaaatgaacaacagggtgatcgaggtgtacgaaaccacgaaagggctggattcacaaataaccagcatccaagaacaaggaaaagtttggctaaaggctttaaatgagctggataaaaaattcgatgaacaagaggttaaaattcgcgaaaatatggagcagatcaggcgtaaaattgataccctcgaagacgaagctctacagagaaatagcaaataa

SEQ ID NO: 25613 - DNA, 1599 bp, Saccharomyces cerevisiae
atgaaagcattcaccagtttactatgtggactaggcctgtccactacactcgctaaggccatctcattgcaaagaccgttgggtctagataaggacgttttgctgcaagctgcggaaaaatttggtttggacctcgacctggatcatctcttgaaggagttggactccaatgtattggacgcttgggcccaaatagagcatttgtacccaaaccaggttatgagccttgaaacttccactaagccaaaattccctgaagcaatcaaaacgaagaaagactgggactttgtggtcaagaatgacgcaattgaaaactatcagcttcgtgtcaacaagattaaggaccctaaaatcctgggcattgacccaaatgtcacacagtacacgggttacttggatgtggaagacgaggacaagcatttcttcttttggacttttgaaagtagaaacgatcctgcaaaggatccggtcatcctttggttgaacgggggtccaggttgttcttcactaaccgggctgttctttgaattaggaccctcatccattggacctgatttgaaacccatcgggaacccttactcttggaacagcaatgccaccgtgatcttccttgaccagcctgtcaacgttgggttctcgtattccgggtcctcaggtgtttccaacactgtcgccgctggtaaggatgtctataacttcttggagttgttcttcgatcagttccctgaatacgtcaacaagggccaagatttccacatcgctggggaatcctacgccggccattacatccctgtttttgcctctgaaattttgtctcacaaggacagaaacttcaacttaacctccgtcttgatcggaaatggcctcactgacccattgactcagtataactattacgaaccaatggcctgtggtgaaggtggcgaaccatctgttttgccctcggaggaatgctctgctatggaagactctttggaacgttgtttgggcttgatcgagtcgtgctatgactcgcaatccgtctggtcctgtgttccagctaccatttattgtaataacgcccaattggctccttaccaacgtaccggcagaaacgtttacgatatcaggaaggattgtgaaggtggcaatttgtgctacccaacgttacaagatatcgacgactacttaaaccaggactacgtcaaagaagctgtcggtgcggaggttgaccactacgaatcctgtaacttcgatatcaacagaaatttcctgtttgcgggtgattggatgaagccttaccacaccgccgtaacagatcttttgaatcaagacctacccattctggtatatgcaggcgataaagatttcatctgtaactggttgggtaataaggcgtggacggatgtcttgccatggaagtacgacgaagaatttgcaagccaaaaagtacgtaactggactgcttctatcaccgacgaggtcgctggtgaagtcaaatcctacaagcacttcacctatttgagagtcttcaatggtggccacatggttccatttgacgtccctgaaaacgccttaagtatggttaacgaatggatccacggtggtttctccttataa

SEQ ID NO: 25614 - DNA, 2073 bp, Saccharomyces cerevisiae
atgctgcttcttccaagatgtcctgtaattgggcgaattgtaagatcaaaatttagatctggtctaatccggaaccattcgcccgttatatttactgtgtctaagttatcaacccagcggcctctgttattcaattcagctgtgaatttatggaatcaagcacaaaaggatattacgcacaaaaaatccgtcgagcaattctcgtcggctccaaaagtgaagactcaggtaaaaaagaccagcaaggccccaaccctctcggaactgaaaatcttgaaagatctatttcgctatatttggcccaaaggcaacaataaagtgaggataagggtactgattgcccttggactgttgatatccgccaaaattttaaatgttcaagtacctttttttttcaagcaaactattgattcaatgaatatagcatgggatgatcctacagtcgcccttccggcagcgattggattaaccattctttgctatggtgttgcaaggttcggctctgttttattcggcgaactgaggaacgccgtatttgccaaagtggcacagaatgccattagaactgtgtcgctacaaactttccagcaccttatgaagttagatttgggatggcacttgagtagacaaacgggtggtctgacgagggccatggatagaggtacaaagggtatatctcaagtgttaacggccatggtattccacattatccctataagttttgaaatatctgtcgtttgtgggattttgacgtatcaattcggtgcgtcatttgccgcaataacattcagtacaatgcttttatactccattttcactataaagacgaccgcatggaggacacattttagaagggatgctaacaaggccgataacaaagctgccagtgtggctttagattctttaattaattttgaggcggtaaaatacttcaacaatgaaaaatatcttgcagataagtataatggctccttgatgaactatcgtgactctcaaattaaagtatcgcaatctctagcatttttgaactccggccaaaatctaatttttactactgccctaactgcaatgatgtatatgggttgcaccggcgttattggtggcaacttgacagttggtgacttggttctaattaatcagttggtttttcaactatcagtaccgctaaattttcttggtagtgtttacagagatttaaagcagtctctgattgatatggaaacgctatttaagttaagaaaaaatgaagtcaagattaaaaatgccgaacgtcccttaatgcttccagaaaatgttccctacgatattacttttgagaacgtcacgtttggatatcatcccgataggaaaattttaaagaatgccagctttaccatcccagcaggctggaaaaccgcaatagttgggtcttcgggcagtgggaagtccaccattttaaaattagtctttagattttatgatcctgaaagcggaaggatcctcataaacggtagagatattaaagaatatgacatcgatgccttgaggaaggtgattggtgtggtaccacaggacacaccacttttcaatgacactatctgggaaaatgtaaagttcggtcgtattgacgcaaccgacgaggaagtgataactgtagttgaaaaagcccagctagcacccttaatcaagaaattaccacaaggttttgacaccatcgtcggggagcgagggttgatgatcagcggtggtgaaaagcaaaggctggcaattgcaagggtactattgaagaatgcaaggatcatgttttttgacgaggccacaagcgccttggacacacacacagaacaagctctcttacgaaccattagagataactttacttcgggttcgagaacgagtgtatacatcgcacatagactgaggacaattgcagatgcagacaagatcatagtccttgacaacggaagagtaagagaggaaggtaagcatcttgaactgttggctatgccagggtcattgtaccgcgaactttggaccatacaagaagatctggatcatttagagaatgaactaaaagaccagcaagaactatga

SEQ ID NO: 25615 - DNA, 1047 bp, Saccharomyces cerevisiae
atgtctattccagaaactcaaaaagccattatcttctacgaatccaacggcaagttggagcataaggatatcccagttccaaagccaaagcccaacgaattgttaatcaacgtcaagtactctggtgtctgccacaccgatttgcacgcttggcatggtgactggccattgccaactaagttaccattagttggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaagaatacgctaccgctgacgctgttcaagccgctcacattcctcaaggtactgacttggctgaagtcgcgccaatcttgtgtgctggtatcaccgtatacaaggctttgaagtctgccaacttgagagcaggccactgggcggccatttctggtgctgctggtggtctaggttctttggctgttcaatatgctaaggcgatgggttacagagtcttaggtattgatggtggtccaggaaaggaagaattgtttacctcgctcggtggtgaagtattcatcgacttcaccaaagagaaggacattgttagcgcagtcgttaaggctaccaacggcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataa

SEQ ID NO: 25616 - DNA, 3693 bp, Saccharomyces cerevisiae
atgagctctgaagacgaattgggaagtatcggtactgtgtttcccggaagtcccatagataagagcattgggagtattctcccacaatttgatgaagaagtggagactttgctggaagatagcttcacgtggaacattcctgactggaacgagttaacaaacccgaaatacaattcgcccaggtttagaattggtgatttcgaatgggacattctattattccctcagggaaaccataataaaggtgttgcggtatatctggaacctcatccggaagaaaaattagatgagactacgggagagatggtgccagttgatccggactggtattgttgtgctcagtttgccattggtatatctagacctggtaatggtgacaccatcaatttaattaacaaatcgcatcaccgattcaacgctctagatacagactggggatttgcaaatttgatagatttgaacaacttgaaacatccctcaaaaggaagaccgctttcgttcttaaacgaagggaccttgaacataacagcgtatgtgcgcatattgaaggatcctactggtgtcttgtggcataatttcctgaattatgactcgaagaaagtcacgggctatgttggcttccgaaatcagggtgccacatgctatttgaattcgttattgcaatcttacttctttacaaaatacttcagaaaactggtttacgaaatacccaccgaacatgaaagtccaaacaacagtgtcccattggctttgcaaagagctttctaccaactacaagtatccgatataccattagacactttggaacttaccaggtcattcggttgggacactgcggaatccttcactcaacacgatgtgcaggaattgaataggatattaatggacaggctggaaaataatatgaagggaacacccgtggaggggaagttaaatgaaatatttgtcggaaaaatgaaaagttatattaaatgtatcaatgttgattatgaatctgctagagtggaggacttttgggatctgcaactgaatgtcaaaaatttcaagaatttacaagaatcttttgacaattacattgagatggaactaatgaatggtgaaaatcagtatgctgctcaagactatggtttgcaagatgctcaaaaaggtgttatattcgaatcatttccgccagttttacatctgcagttgaaaagatttgaatacgattttaattatgatcagatggtaaaggttaacgataaatatgaatttcctgaaacaattgacttgtcgcccttcgttgataaagacgtattaaagaaaacgttagactcggagaacaaggataagaatccttatgtttataacttacatggtgtgctagttcattctggtgatatatctaccggccactactatactctgattaaacctggtgttgaagatcaatggtacagatttgatgatgaaagggtttggagggtcacaaagaaacaagttttccaagaaaattttggatgtgataggttgcctgatgaaaaagttcgtacaatgacgagaggtgagtatcagaactatatcattcaacgccatacaagtgcttatatgcttgtttatatacgtcaagaacaagaggaggatttgctgcgtccagttttggaatctgatgttcctaagcatgtaatcacaagagtaagagaagaaatcaaagaacgggaaacaaaagaaaaggaaattagagaagcacacctgtatgtcacgctcagattgcactcaatcaaagagtttattcattatgaaggatttgactatttcgcacatgatgggtttaggttatttgcagaggagctcaatgactctggtttgcagcaaatcaacttaaaagtcttgagaacaactaagttatcggatatttttgcaagcattaaggaaactatgaatattccacaagaaagggacgtcaaatattggaaaatggattatcgcagaaacagcactttgcgtttaacacaacccataaattttgaatccgtaaacatcactttgcaggaggcattaaaaaaggagaagaaaaggactatgcaaacgcaatatggagaggaaggtgttgctagtactgaggaagacgacaaggcacttttagaaactgtatcattcttagatcttttcattgaggagccctatctagagttacaatttttgaacaagctgaaggaagcttctttaatctcaaaggcccagctggatgatgagctgatatcaactataagaacgaatcttccagaactaacaaagggaggaatcgagcctgtttttgccaccgacaataaatctaatttgctattcgtcaagagctacgacccacatacccaaaagctattgggatttggccattttgccgtaaatcaattgcaacagctatcggatatatctgcaattattgaggacagcatttcttccaacgaaaagctgactttctacgaagaagtccaacctggtaccataaatgaaatatatatgaaggagacaatatatgatgctgatatagacacgggtgatatagtttcatttgaggttccaggtgctgttttgccagatacttttccagtttacgcaacaatcaaagatttttactcatatctgaggtatcgtgtaaaattgaagttttctaaatttgacggttcaagtgaggaatatggagttagtaatgaaatcccagagagcttcgaattctggatatccgcttatgcaccttatgatgaccttgctagaatggtgtcgaaatatgcgcacgttaagccagaatatctaaagattattgccctttattctaatggaagatttgtgttaaaatcaacctcacttttgaatgattaccttttgaaagatttcaattgcgatcaaataccgccttttgcatttgaagtattgtctgtgcctttgaaagaattggagcgtttgaggccaattaaattatattggctaaaaaatagttatattcattatcaatgtttcgaattcgaagtcgcaaacgattatacagaatctcaatttcttgaaaaagtgcaacacaagatcggctttaccgatgaagaaaaggagaacatcttactctggaccaacacaaatttccagtttcagggcttattatcggaccaaaacaccttcaaagatgtgagtaaacattctttactctttggtagaattttacccgaggagtctaaattgttcaaagaattaaatcgtctagaaaacgtacaaacatcttcattggaggattttatggatgatgaaaacgcgactgacagaccaatggacgatgagcaagatctaggtatggcgatagaacattctgaagatatgaaagggcgtatagtggttgttcaacaatatttcaaagaccttgagaatagacacggaatatccttcttatttaatttaataccagacgaaacattcccaaagacaaaagatcgtcttcatgcaaaatttggtctcggacaaaaagaattttcaaagatcaaattaagtattggttactccactgaagaaggtacggtgtttagaagtttgcaaggattttcggacgaagaattggacaaagttatattgtatgacattatgtccaacttagattatatctacatggatcatccggatagattgagatcgcattcttcctatgatagaccaatgatcattaaaaactga

SEQ ID NO: 25617 - DNA, 5358 bp, Saccharomyces cerevisiae
atggattttatgagtcccaagttttcgctaactgacgttgagtatcctgcttggtgccaagacgatgaagtcccaataacaatgcaggaaattagagaaatttttgtggagctcatggataagtttggcttccagaaatcttctatggaaaatatgtatcaacatttaatgggacagctggactccagggcaagtcgtacaggtgctcaaaatgctttagtatcgctacatgtttcatatattggaggcgaacacgcaaattatagaaaatggtattttgccgctcagctcgatttagatgaagagatcgggtttcaaaacatgcgactacatggaaaggcacgccaaagaaacgtaaaaatggcgaagaaaagaggcgtatcgataaaggaacaaattaagcaatggaatgagaaggagcaagagttcatcaataaccatccaaagatcacactgactcaagaacaattggaagatcagacaaacttgaaaagtgcagactacaaatggaaattgaaaatgaaaaaattgacgcccgaaaatatgataagacagctggccctttatttgctttgctggggtgaagccaatcaagtcagattcgccccagaatgcctttgctttattttcaaatgtgcacttgattatgatattagtacgtcaagtagcgaaaaaacggtgaaatcacctgagtattcatacttaaatgacgttattactcccttatacgaattcctaaggggccaagtatacaaaaaagacgcaaaggggaactggaaacgaagagaaaaagaccacaagaatattattggttacgacgacatcaatcaattattttggtacccggaaggatttgaacgtattattttaaacaatggagaacgattagttgacaagccattggaggagagatatctttactttaaagacgttgcatggtctaaagtattttataagacatatagagaaaccagaagttggaagcattgttttaccaatttcaatagattctggattatccattttgcaccgttttggttcttcaccacatttaattcccccactttgtacaccaagaattatatacagttattgaataaccagcctacaccccaagttagactatcagtgattgcctttggaggcacaattgcatgtttagttcaaattttagccaccgtgttcgagtggggatttgtacctcgagaatggccaggcgctcagcatttatcgagtagaatgattggcttacttttttgtcttgcaatcaatttgggaccttccgtgtatgttctggggtttttcgaatgggatgttcattcaaaatctgcgtatatcgtgtccatcgtccaactaatcattgcatttttaaccacttttttttttgctgtcagacctttgggcggcttatttcgtccatatttgaataaagacaaaaaacatcggaggtacatctcatcgcaaacctttaccgcttcatttcctaagctgacaggacgcagcaaatggttttcttatgggttatgggtatttgtgtatttggcgaaatatattgagtcctatttttttttgaccttgtccctcagggaccccatcagggtcctctctattatggatttgtccagatgtcaaggtgaatatttgttgggtcctattctatgtaaatggcaagccaaaattacattagttctcatgctgctttctgacttgggcctgttttttctcgacacttacctttggtacattatttgcaactgtattttttccattgtactgtcattttctcttggtacttcaattctcacgccatggaagaatgtatactctcgattgccaaaaaggatatattccaaaatccttgctacttcagagatggatgtaaaatttaaagcaaaaatactgatatcgcaggtttggaatgccattgttatatcaatgtatagggaacatcttctctccattgaacatttacaaagactcttgtttcagcaagttgactccttaatgggagacacaagaaccctgaaatcgcctacatttttcgttgcacaagatgattcaacgttcaagtcaatggaattttttccatcaaattcagaggcaaaaagaaggatatccttttttgcccaatccctggcgacccccatttcagaacctgttccagtggattgtatgccaacttttaccgttttggtaccccattattcagaaaagattctgttgggcttgaaggaaattatcagggaagaatctcctaaaagtaaaatcacggtgcttgagtatttgaagcatctacaccctacagaatgggaatgttttgttaaggataccaaactactaagcatggaaaagagctttttgaaagaggcagagagcagtcatgatgaagatagattggaaattccggatgctctgtacgatccaaggtctagcccgctttctgaccatactgagtcccggaagttgcccacagaagacgatcttattaaggagaaaattaatgatttgccattttcttactttggcttcaactcatcagaaccatcgtacaccctgagaacaagaatctgggcatcattgcggacgcagactttgtaccgaaccctttcagggtttatgaactattccaaagctattaagctactgtatcgaattgaaaacccctctttagttagcttgtatcgtggcaataatgaagcattggagaatgacttagaaaatatggctagcaggaaatttaggatggttgttgctatgcagagatatgcaaaatttaataaggatgaagtggaggcaacagaactacttttaagagcctatccaaatatgtttatatcttaccttttggaagaattagagcaaaatgaatctgagaaaacgtactattcgtgcctgactaatggctatgctgagtttgacgaagaaagtggattaaggaagccaatattcaaaattcgcctgtcgggcaatccaatacttggcgatggaaaatcggataatcagaaccattctattatattttatcgtggtgagtatattcaggtgattgatgcaaaccaagataattatttggaggaatgcctaaagatacggtctgttttaagtgagttcgaagagcttgagcttaatcccacaatcccatacattcctggcattgaatatgaagaagaaccaccgcccatcgctattgttggttcaagagagtatattttttcagaaaatattggagtgttaggtgatattgctgcaggtaaagaacagacttttggaaccttatttgctagaacgttggctgaaattggtggtaaattgcactatgggcatcccgattttctcaatggcatttttatgaccactcgtggtggcctgtctaaggcacaaagaggattgcatttaaacgaggatatatatgctggaatgaacgcaatctgccgtggtggaaagataaaacatagtgattactaccaatgtggtaagggtagagatttgggatttgggtccatcctgaatttcactactaaaataggtgcaggtatgggggaacagctactatcaagggagtactattatttggggacacaacttcccatggatagatttttatcgtttttttatgcacatcctggtttccatctgaataatctttttatttccttttcggttcaactgttcttcgttctgcttttaaacttgggtgcgttgaaccatgaaattatagcctgcttttacgacaaggatgcaccaattacaaatcttgagacacccgttggttgttataatattcagcctgcattgcattgggtatcgatattcgtactatcaatcttcattgttttctttattgcctttgcccctttgctgattcaagaagttttggaaaagggtatttggagagcagcttcaaggttcctacatcatcttctttcaatggccccattatttgaagtattcgtctgccaagtttattcgaattctctattgatggacttgacctttgggggagcaaagtacatatctacaggtcgtgggtttgcaataacacgcctcgatttttttacgctctattccagatttgttaatatatcgatatattctggtttccaagtgttcttcatgttattattcgcgattatttccatgtggcaacccgccttattatggttttggattacagtcatttcgatgtgcttcgcaccttttattttcaatccacatcagttcgcattcatggatttcttcattgattataaaacctttatccactggttattctcaggtaacacgaaatatcaaaaagaatcgtgggcaaactttgtcaagagttctcgatcaagatttacgggctataaaagtaaaactgtagatgatatttccgaagattcaggccatgattcaaagaaagcgaggttttggaacgtcttctttgcagaactatttctacctttctgtgtgttcctcttcaacttcaccgctttttctttcattaatgcacaaacaggggtctctgactcaacaccaactagcgctgttttccgtttgttgctcgtaacttttttgccaatctttcttaactcaatagtgctttttctattattttgggtttcactttttgtggttcctggattgtcatattgttgtaaagacgcaggtgccgtgattgcgtttattgcacacactttctcggttttggtctatcttttagatttcgaactgatgtggttcttacaaggttggaactttacccgtacattgatactgcttattacgtgcatcaatatgcatctgattcttttcaaggtctttacgacgatattcttgacaagggagtataaaaacaataaggcacatttggcatggtggaatggtaaatggtacaatacgggcatgggctggtctatcattttacagcccatacgagaatacttcgtgaagattatggaatctagttattttgcagcagatttctttcttggtcacttcctcttatttatacaaacgcccataatattgttaccatttatcgattactggcatacaatggtgctattttggatgaatccaagaagtattatcgcgcataaaagaattttgactcgaaagcagagagcattaagaagtaggatagtttcaaaatatttctctctatattttgtgatgctaggtgtgctcctttttatgctcatcgcgccattctttgctggtgatttcgtatctagtccgcaagaattgctggaaggcacccttttcgaaggaatcttccaacctaacaaccaaaacaacaacgatactggtccaaatgctccatcgacaatcctgactacaacaccaactttacctacctttaggactgtcgcatag

SEQ ID NO: 25618 - DNA, 705 bp, Saccharomyces cerevisiae
atgttcaggaacaattacgacggggacacagtcactttttctcctacaggccgtctgttccaagtggaatacgccttggaagctattaaacaagggagcgtcactgtggggttacgttcgaacactcatgctgttttagtagcgttgaaaagaaatgcagacgaattgtcatcataccagaaaaaaatcatcaaatgtgacgagcacatggggctctcgttagccgggttggctccagatgctagagttttaagtaattatttgagacaacagtgtaattactccagcttagtttttaacagaaagcttgccgtcgagagagcaggtcatttgctttgcgataaagcacagaaaaatacacaatcctatgggggcagaccctacggtgttggtttgttgatcatcgggtatgacaagagcggtgctcatcttttagaattccaaccttccggaaatgtcacagaactatatggtacagctattggcgcaagaagccaaggggcaaagacttatctagagagaactttagacacgtttataaaaattgacgggaacccggatgaactaatcaaagctggcgtcgaggctatcagccagtctctaagggacgaatccttgactgtagacaatctttcaatcgccatcgtgggtaaggatacgccttttacaatttacgatggagaagctgttgctaaatacatctag

SEQ ID NO: 25619 - DNA, 1083 bp, Saccharomyces cerevisiae
atgtcttatcctgagaaatttgaaggtatcgctattcaatcacacgaagattggaaaaacccaaagaagacaaagtatgacccaaaaccattttacgatcatgacattgacattaagatcgaagcatgtggtgtctgcggtagtgatattcattgtgcagctggtcattggggcaatatgaagatgccgctagtcgttggtcatgaaatcgttggtaaagttgtcaagctagggcccaagtcaaacagtgggttgaaagtcggtcaacgtgttggtgtaggtgctcaagtcttttcatgcttggaatgtgaccgttgtaagaatgataatgaaccatactgcaccaagtttgttaccacatacagtcagccttatgaagacggctatgtgtcgcagggtggctatgcaaactacgtcagagttcatgaacattttgtggtgcctatcccagagaatattccatcacatttggctgctccactattatgtggtggtttgactgtgtactctccattggttcgtaacggttgcggtccaggtaaaaaagttggtatagttggtcttggtggtatcggcagtatgggtacattgatttccaaagccatgggggcagagacgtatgttatttctcgttcttcgagaaaaagagaagatgcaatgaagatgggcgccgatcactacattgctacattagaagaaggtgattggggtgaaaagtactttgacaccttcgacctgattgtagtctgtgcttcctcccttaccgacattgacttcaacattatgccaaaggctatgaaggttggtggtagaattgtctcaatctctataccagaacaacacgaaatgttatcgctaaagccatatggcttaaaggctgtctccatttcttacagtgctttaggttccatcaaagaattgaaccaactcttgaaattagtctctgaaaaagatatcaaaatttgggtggaaacattacctgttggtgaagccggcgtccatgaagccttcgaaaggatggaaaagggtgacgttagatatagatttaccttagtcggctacgacaaagaattttcagactag

SEQ ID NO: 25620 - DNA, 1314 bp, Saccharomyces cerevisiae
atgtccatcacgaaggtacatgctagaacggtgtatgattctcgcggtaatccgactgttgaggttgaaattacaacagagaatggtctcttcagagcgatcgtcccatctggtgcctccaccggcattcacgaagctgttgaacttagagacgggaacaagtccgaatggatgggaaaaggggtgaccaaggcagtcagtaacgtcaatagtatcatagggcctgctttaatcaagtccgacttatgtgtaaccaatcagaagggcatagacgagctcatgatatcgttagacggaacttctaacaagtcaaggttgggcgccaatgctatccttggtgtttccttgtgcgttgctcgagctgctgccgcacaaaagggaattactctctacaagtatatagccgagttagcggatgctagacaggacccctttgttattcctgttccttttttcaatgttttgaatggtggagcccacgccggtggctctttagctatgcaagaattcaagatcgcgccagtcggggctcagagctttgcagaagccatgaggatgggttcggaggtttaccatcatttgaagatattggcgaaggagcaatatggaccttccgctggaaatgttggtgacgagggtggagtcgcccccgatatcgacactgccgaggacgccttggacatgattgtgaaagccattaacatatgcggttacgagggtagagtgaaagtaggaatcgatagtgctccttctgttttttataaggacgggaaatacgacctaaatttcaaggaaccgaactctgacccatctcactggctcagtccagctcagttagcagaatattatcattcattgctaaagaaatacccaatcatttccctggaagacccctacgccgaagatgattggtcctcgtggtctgccttcctaaagactgtcaatgttcagataattgcagatgacctgacatgcaccaacaagaccaggatcgcccgtgctatagaggagaaatgtgcgaatactctgttgctgaaactcaaccagatcggtactctgactgagtctattgaagccgccaatcaggctttcgatgctggatggggtgtaatgatatcacatagatcaggtgaaaccgaagatccgtttatcgctgatttggtcgttggtttaagatgtggtcaaattaaatcgggcgctttgtcgagatcagaaagactggccaagtataatgaacttttgcgtatcgaagaggaactgggggacgattgtatatatgctggtcataggtttcatgatggaaacaaactataa

SEQ ID NO: 25621 - DNA, 1302 bp, Saccharomyces cerevisiae
atggtatatgaagcaacaccttttgatccgatcacggtcaagccaagcgataaaagacgcgttgcatatttttacgatgcagacgttgggaactatgcatatggagcaggtcacccgatgaagccgcatagaataagaatggcacattcccttattatgaattatggcttgtacaagaagatggaaatttacagagctaagccggcaacgaaacaagaaatgtgtcagttccatactgatgaatacattgattttttatcgagggttactccagataatttagaaatgtttaaaagagaaagtgtcaagtttaatgtcggagatgattgtcctgtctttgatgggctctatgagtactgtagcatatctggtggtggctctatggaaggagctgctcgtctgaatagaggcaaatgtgatgttgctgtcaactatgcgggtggtttgcatcatgcaaaaaaatcggaagcttctgggttttgttatttaaatgacatagtactgggcattattgagctactacgataccaccccagagttctgtatattgatattgatgtgcaccatggtgatggtgtagaggaagcgttttatacaacggatcgtgtcatgacatgttctttccacaaatatggtgagtttttccctggcacaggtgaactgagagatataggggtgggtgcaggaaaaaactacgcggtcaatgtgccattaagagacggtattgacgatgctacgtatagatctgtgtttgaacctgtgataaaaaaaattatggaatggtatcaaccttctgctgtcgtgttacagtgtggtggggactccttgtccggcgatcgtcttggttgctttaatctttccatggaaggccatgctaattgtgtaaactatgtgaaatcctttgggatcccaatgatggttgttggtggaggaggctatactatgagaaatgttgcaaggacatggtgctttgaaacaggtctactaaataacgttgtcttggataaagatttaccgtacaatgaatattacgaatattacggtccagattataagttaagtgttagaccttcgaatatgttcaatgtaaatactcccgaatatcttgacaaggtaatgaccaatatatttgctaatttggaaaacacaaagtatgcccctagtgttcagttgaatcacacacctagggatgccgaagatttgggtgatgttgaagaagattctgccgaggctaaagatacgaagggtggttcgcaatatgcgagggacctacatgttgagcatgacaatgaattctattga

SEQ ID NO: 25622 - DNA, 3126 bp, Saccharomyces cerevisiae
atgaataaactattgttacatctagtacgagtcatttcgatactcggcctagcaaacgctctcacacaaacgcaaccgattttaaaagatattcaaataacagatagttataccaaaacaaaagaatgtacggatccagatcattggttcataatagaagggcaactgtctattccaaagggaagtcagcaaaatataacattccaagtaccagatgctttcagctcattccctcaagaacccttcagcataaaacataattctaacagtgttgccacgatatcacgcccagataaatcgacgaacaatttcaccatttctattccagaaaagagttcagaagatataactactacatttaacttccttgcacagcttacatcagatgctaaatccaaagttacagaaccaaaaagcatcgtttacagtttctattcagaaaatactatgtttaatgacgttattgattacgtcgctaaaaatacttctgctataacaacagatggtggtatatacaaaactaataataccgcctggtttaccgttgacttaccaatgagaacgttcagaaatcccgtttatttgacttctcagacatcttcctcctcagattacgtattcgatacttcgttaactaagtttgaggttgtcactgccgttgattcttttaacgaacctattaatgctatcccatatacaactgttcatgactactccacagaagatgaaattagatgtttatttaattctacaatcagcggtgggctatacttccgtgtgacttatttcacaaagaagctatctacctcgtccatatcaaatactgtcgaattaacatatcccgatgaaggtacatctgtcagacttttaggaaagagagatacttcaaccaccctagcctcagaattatattctgagtcagctgctaacattgattccaccaccagtgatgacacaactagctctgatgctgctataacaccaacatactcaaattcaacgctttcttcttatacttcgcaatcatccgctatccctgaagttgcggttactgcatcattgagtagcgggatcctttcttctacagttgacggtgctagcacctcggcggacgcttccatgtccgctgtctctacggtttcttctagcagtgaacaagcttcttcttcaagtatttctttatcggctccaagttcttcaaactcaacctttactactccttcatcttctctgtctgctactgaaacatatagtattatcagttcagctagtatatctgtcacacaggcttcctacattgataattctacaactaccgctgttacccaatctacttctactatagcagtttcatctgctgaaaaattgtcaagcactctatcatacaccagtaacgtcacaatatcagtatcatcagctacccaacatactactactccttcatatgttagtaactccactacactctcatcctcatctgttcttgaatctgtaattagctctccatacctggcaaacactactgtttcaggagcttcatctgcaagtcaatctactaatccgccatatgtctccaactccacaacatcatccgcaactcaattagccaccattgctccgttcgcgattaacataacaggaacaagtatttcttctagtatcactaatacttcttcagttagttctactacgtccagtttatcatccggcccatttgtttcaaacacagcggttgcctctgggtcttatattctaaccactactacagagtctgcacaacttactgaaatagggagtttgataccaatctcgactattactactagtaccaccacttctggtaccgataaaactggtagtaataaggtggcctcttcaactgaaatagcgcaatctatcgtaaacaacagttcactttcggtgtcaacaatcaacactaacgctgcgacagcagctgctaatgccagaaatgctactttcactcatgcaacccattctggttcgcttcaaccctcatatcatagcagctcactattatcgtccacaattgacaccaaggtaactactgctactacaagcaccagtagagacggtagttcgagtttggctttcaccactgggctcaatcaatccgtagttaccggtacagataaaagtgatacctatagtgtaatttcatccacagaatcagcccaggttacggagtacgacagcttacttccaatttccaccctgaagcctacagtcgttacaggtacaagtagaaacagtacctttagtatggtgtcctccaccaaattgaccgaagctactgcaacggataaaggtgatgcgtatagtgtaatttcatctacacagtcggctcaagttactgaatatggaagtatgcttccaatttctacgctggaaacaccaacagtcattatgagtaccgatgaaagcggctattttactttaactacatgtactgagtctgggcaagctacagaatatggtagtctgattccaatttccacactagatggttcagttatatatacatttactggcgaaagtgtagtggtgggttacagtaccacagtgggtgccgcccaatatgcacaacatacaagtttagtcccagtatctaccatcaagggttccaaaacttctctttcaaccgaggaaagcgtagtggctggctacagtactacagtgggtgccgcccaatatgcacaacatacaagtttagtcccggtatctaccattaagggttccaaaacttctctttcaaccgaggaaagcgtagtggctggctacagtaccacagtagattctgcccaatacgccgagcacacaaatttagttgccatagatacattgaaaactagcacattccaaaaagcaacagcaactgaggtttgtgtcacatgtaccgccctttcttcccctcattctgcaactttagatgcaggtactactatttcattgccaacaagttccagcacatctctatctacaataattacctggtattcctcatctactattaagcctccttcaatttctacatactcgggcgccgctggtcaattaaccatccgtattggcagtttgttgctagggttaatctcatttctgctgtaa

SEQ ID NO: 25623 - DNA, 1623 bp, Saccharomyces cerevisiae
atgactgctcagattccgtatcaacatagctcgggatacatctctcattttcacaataatgagcttgatgcaggcaggggaagggattataatgtaaccattaagtatctagatgataaagaagaaaatatagaaggccaagcagcaaagattagtcacaatgcgagtctgcatattcccgttttattgtgcttggtaatctcgcttggtggctttatttttggatgggacattggaaccatcggtggaatgacaaatatggttagctttcaagaaaaatttggcacaactaatattatccatgacgatgaaacaatttttgtatctactaagaaacttactgatctgcaaataggcctaattatcagtatttttaacatcagttgtggcgtaggggctttaactctgtcaaaaatcggtgattggattggtaggaaaggtggtatatggtttgccttagtagtgtactgcatcggtataaccattcaaattctctcctatggaaggtggtattttttgacattgggaagagccgtaacgggaatcggtgtgggagtaaccactgtcttggtgccaatgtttctctccgagaattctccactaaaaatcagaggctccatggtatctacgtatcaattgattgtaacatttggcatactaatgggaaacattttaaatttcatatgcgaaagatgttataaagatcctacacaaaatatagcctggcaattgccattgttcttgggatacatttgggcaattataattggaatgtcacttgtttacgttcctgaatctccacagtacttggcaaaaatcaaaaatgatgtgccctctgctaaatactcttttgcgaggatgaatggcatccctgcgacggatagcatggtaattgaattcatcgatgatttgctggaaaataactataataatgaggaaactaacaacgaatcaaaaaagcaaagcttagttaaaagaaacacatttgaatttattatgggaaagccaaagttatggttgagactgattattggtatgatgataatggcatttcaacagctgtccggaataaattatttcttttattacggaacgtctgttttcaaaggtgtcgggattaaggatccttatattacttcaatcatactgtcaagtgttaacttcctttctacgatattaggcatatattacgtggagaaatggggccacaagacatgtttattatatggttcaacaaatttattattttatatgatgacatatgctactgtggggacatttggaagagaaacggacttctcaaatattgttttaattatcgtgacttgttgttttattttttggtttgcaataacattgggcccagttacatttgtactagtgtccgaattgttccctctaagaacgagggccatatcaatggctatttgcacatttatcaattggatgttcaatttcttaatatcacttttaacaccaatgattgtatccaaaattgatttcaaactaggatacatatttgctgcttgcctattagcgttgataatattcagttggatactagttcctgaaacgaggaaaaagaatgagcaagagatcaataaaatatttgaaccggagtag

SEQ ID NO: 25624 - DNA, 930 bp, Saccharomyces cerevisiae
atggcaagtatgtattagtgctaggaattggaggatttgctcttttctgcatcattttttttatttttattggcgaatgttaaaattactaacaatggatgggattccaatacagcctatcaaccatataacgaatattcatcagtaacgggcggtggctttgagaactctgagtcccgcccaggtagtggggagtcggaaactaacactagagttaacaccttgacacctgtgacgatcaaacaaattctagagtccaaacaggatattcaggacggccccttcgtttcgcataaccaagaacttcatcacgtttgttttgtaggtgtggtgagaaacattacagaccatactgcaaatatttttttaactattgaggatggaactggtcaaatagaagtgagaaaatggagcgaagatgcaaatgacttggctgccggtaacgatgactcttctggtaaaggttatggttcgcaagtcgcccaacaatttgaaattggcggttacgtaaaagtttttggtgctttgaaagagtttggtggtaagaaaaatatacagtatgcggtgattaagcccatagattcattcaatgaagtgttgacgcatcacttggaagtcatcaaatgtcattccatagccagtggaatgatgaaacaacctttggagagtgcatccaacaacaatgggcaatcattatttgtcaaggatgataacgatacatcttccggctccagtccgttacaaagaattctagaattttgtaagaagcaatgtgagggcaaagacgctaattcattcgctgttcccattccattgatctcgcaatccttgaatttggatgaaactaccgtcagaaactgctgtacgaccttgactgaccagggttttatctacccaacttttgatgacaataacttctttgccctatga

SEQ ID NO: 25625 - DNA, 1128 bp, Saccharomyces cerevisiae
atgtctacggaagagcagaatggtgttcctctgcaaaggggatctgaattcattgcagacgatgtaacctcgaataaatcgaacaacacgaggcggatgctggtgaaagagtacaggaaaatcggtagaggtgcctttgggactgttgtacaagcatatttaacccaggataagaaaaactggttgggcccctttgcaattaaaaaagtccctgctcataccgagtacaagtccagggaattacagattctgaggattgccgaccatccaaatatcgttaaattgcagtatttctttactcatttgtccccgcaagataataaagtttatcaacaccttgccatggaatgcttaccagaaactctacaaatcgagattaatcgttatgtgacaaacaagctagaaatgccattaaaacatatcaggctatacacttatcagattgcccgcgggatgctttatttacacggtcttggcgtttgtcatcgtgatatcaaaccatccaatgttcttgtagacccggaaaccggtgtcttgaaaatctgcgattttgggtctgccaaaaaattggaacataaccagccttcaattagttacatctgttcaagattttatagagcgcctgaattgatcattggttgtacccaatataccacccagatcgatatatgggggcttggttgtgtcatgggcgagatgcttatcggcaaagccatatttcaaggtcaagaaccccttctacagctaagggaaattgctaaattgttaggtcctcccgataaaagattcattttcttttcgaatccggcctacgatggccctctattttccaaaccactgttctcgggctcttcgcaacagaggtttgagaagtattttggccattccggtccagatggtatcgatcttttgatgaaaatattggtctacgaaccacaacaaagactgtctccaagaagaatccttgcccatcagttctttaatgaattaaggaatgatgacactttcttaccaagaggtttcactgaaccaatcaagctaccaaatttgtttgattttaatgattttgagttacaaattctgggtgaatttgctgataaaattaaacctacgaaagttgctgaataa

SEQ ID NO: 25626 - DNA, 1878 bp, Saccharomyces cerevisiae
atgacaaggctcaaagcaaaatattcacctacaaaaggtaaaagaaaagaagataaacatacaaaacgtatgcgtaaatcatccttcacaagaacgcaaaaaatgcttgaagtatttaacgataatcgctcgcattttaacaagtacgagagcctcgctatcgacgttgaagacgatgacactttcggaaacctagtcttaatggaaaatgataaaagtgatgtcgacatacctgtaatagaagaagtcacatcaagtgaagatgaacaaagggcagaatctagcaaaagaaacaattctctcgaagataatcaagattttattgctttttcggacagctctgaagatgaaacagaacaaataaaggaagatgatgatgaaagaagcagttttctgttgaccgatgaacatgaagtttctaagcttacttcacagcaatctctgaacactgaaagcgcttgcaatgtggagtatccttggataagaaatcattgtcattcgaaacaaaggagaatagcagattggctaacttcagaaatcaaagatttcgttcattatatctctccaagcaagaacgaaatcaagtgcagaaatagaacgatcgataaactacgccgggcggtcaaggaactgtggtcggatgcagatttgcatgtgtttggttcttttgccaccgatttatatttgccgggttctgacattgactgtgtcgtaaacagccggaatcgcgataaagaggacagaaattacatttatgaattggcgagacatttgaaaaacaaagggctagctataagaatggaggttattgttaaaacgcgagtgcctattatcaaattcatagagccccaatcacagttacatatcgacgtttcatttgaaagaacgaacgggttagaggctgcaaaactcatcagggaatggctaagagactctccagggttacgtgaactggtactgataataaaacaatttttgcattcaagacgattgaacaatgtgcacacaggaggattgggaggtttcacagtaatctgtttggtttattcttttttaaatatgcatccgcgaataaaatcaaacgatatcgacgttctagataacctgggtgttctactgattgacttcttcgaactttacggaaaaaattttggttatgatgacgttgctataagcatatctgatggttacgcctcttatattcctaaatcgtgttggagaactttggaaccttcaaggagtaaattctcgctagctattcaagatcctggtgatcctaacaataatataagcagaggctcctttaatatgaaggatataaaaaaggcctttgctggtgccttcgaactgttggtcaataaatgctgggaattgaattctgctacattcaaagaccgcgttggaaaaagtatactcggaaacgtgatcaaataccgtgggcaaaagagagatttcaacgacgaaagagatttagtgcagaataaagccatcattgaaaacgagcgctaccacaagaggcgcacgaggatagttcaagaagatttatttataaacgacaccgaagacttgccagtagaggagatctacaaacttgacgaacctgcaaagaagaaacagaaggcaaaaaaggataagagagaaggggaaatcaaaaagagtgccattccatctccacctccggattttggagtgagcagaagcaaattgaaacgcaaagtgaaaaaaactgatcagggctctctcctacaccaaaacaacctcagcatagatgacttgatgggactttctgagaatgatcaagaatccgatcaagatcaaaaaggaagagatacccttcgggacaagatgagaaatcaccactggaaactaagacagtag

SEQ ID NO: 25627 - DNA, 2529 bp, Saccharomyces cerevisiae
atgtctctttcagctgcagcgaataagatatctgacaacgatttccaaaatatcggaccggcacctagacctcccagttcaaatagccagggccgtacttgctataatcaaacgcaacctataaccaaacttatgagtcaactggatttaacatcagcgtcccatttaggtacaagtacctccaaaaaaaaaagcgggtgggtgtcctacaaagatgacggtatactttcatttatatggcaaaagagatacctgatgctacacgattcgtatgtagccctttacaagaacgataaacaaaatgacgatgcgatcttgaagataccactaactagtattataagtgtaagcaggacacagttgaaacaatattgttttgagttggtgcgctgcagtgaccgaaattctgtatcatcaggatcctcgtcctctttgaatgtatcatcagacagtaactccaaaaaatcaatatacattgctacaaagacagaaagcgatttgcatagttggttagacgccatttttgctaaatgtccattattaagtggtgtatcttctccaacaaacttcacacataaagttcacgttggttttgatccagaaacaggtagttttgttggtatgcccaccaactgggaaaaattattaaagcactccagaattacaggagaagattggaacaataattctgcggctgtcattcaagtgttgcagttttatcaagagtataatggagccggaaatcccacaaatactttagacaagcctcaaagtggtgaaacttcctcctctcaaaaatcgctgccaaacagctataatgataacaaactcagaaataattcagtaaattcaaagtcatcttcaggcgtttcttcaagtatggtatcacagaggaaaacctcacaaccaccaaataccaaatcgcctgtttctctaggaagcggctcactgccaccaataaatacaaaattgcccactagtcagtcaaatattccaagacacttacaaaatgttcccaaccaacaatatcctaagatgagaaacggacactccccaaccaatggccaatttcctaggggacctatgcatccaaacaattctcaacgatctttgcagcagcagcagcagcagcagcagcaacaaaaacaacagcatcaacaatatccataccaccatcaaggaccatctccatctccatccccatctccgtctccattaaacccttataggccacatcacaatatgataaatccttattccaaacaacctcaatcgccattaagttcacagtcgacccaaaaccaagcaattccacgttatgcacaaaactcaagtcctacagccgcacactttcaacctcaaagaacagctccaaagccaccaatatcagctccaagggcgccatacccatcaaatcaaaatgctactagtaacacacatgtacagcctgttgcacctaagaatgaccagtcaaccccacaaacaatgaggcaggccccaaagagaccggatgcagatgtcgcacaaccgggtggtgtggccaaaccgaagaagccagcaaggcctaccatgtcaactgcagaaataatgagtaagctgaagaaagtcaccgtaaatgcggatccatctcaatgctttaaagtgatcgagaaggccggtcaaggtgcaagtgggtccgtctaccttgcagagaggacgcatattccgacagaaagtaatatgatcgaactcataaacaatgatattgatgagccgcacgtaggagataaagttgctatcaagcaaatggtcttatctaaacaacctcgtaaagaactcatagtgaatgaaattttggttatgaaggattcacgtcataaaaatatcgtcaattttctcgaggcttatttgagaacagacgatgacctatgggttgtgatggagtttatggaaggaggttcactaacagacattatcgagaatagtcccaccaacgataattcacattcaccactaacagaaccccaaattgcatatatcgtacgagaaacttgccaaggcttgaaatttctacacgacaagcatatcattcatagggatattaaatcagataatgtcttgctggacactagagctagggtgaaaattaccgattttgggttttgcgccagattaactgataaaagaagcaaaagagccactatggttgggacaccttactggatggcacctgaagttgtcaaacaacgtgaatacgatgaaaagattgacgtatggtctttgggtatcatgaccattgaaatgctggagggtgaaccaccatatttaaatgaagatccactaaaggcgttgtacttaattgcaactaatggtacaccaaagctcaagcatccagaaagtttgtctttagaaattaaacgctttctaagcgtttgcctttgcgtagatgttagatatagggcatcaaccgaagagcttttacaccacggttttttcaatatggcatgtgatccaaaggatttgacatcactgttggagtggaaggaatga

SEQ ID NO: 25628 - DNA, 1023 bp, Saccharomyces cerevisiae
atgtcgacaagtacagagaagaggagcaaagaaaaccttccatgggttgaaaaatacagacccgaaacgttggacgaagtgtacggacaaaatgaggtgatcaccacagttcgtaaatttgtagatgaaggtaaattgccacatcttctattctatgggcctccaggtaccggtaaaacttctacaattgttgctttggcacgtgagatatatggtaagaattactcgaacatggttttggagctgaatgcatccgatgacagaggtattgatgtggtgaggaatcaaattaaagactttgcctctacaagacaaatcttctctaaagggttcaagttaattatactggatgaagcagatgccatgaccaatgccgcacaaaatgcgttgagaagagttatagaacggtacaccaagaatacgcggttctgtgtattggccaattatgcgcataaacttacacctgcgttattgagtaggtgcacgagattcagatttcagcccttgccccaagaggccattgagcgtcggatagccaacgtcttggtgcatgagaagctgaagttgtctcctaatgcggagaaggccttaatagaactttctaatggggatatgagacgtgtgttaaacgttttgcagtcttgcaaagctactttagacaatcccgacgaggatgagatcagtgacgacgttatctatgaatgctgtggggcacccagaccaagtgacttaaaggcagtattgaagtcgatactggaggacgattggggtaccgcccactacacacttaataaggtacgcagtgccaagggtctcgcgttgatcgacctaatcgagggcatagtgaagatactggaagactacgaacttcaaaatgaggaaacaagagtgcatttgcttaccaaactggccgatatagagtactcgatatccaagggtggcaacgaccagattcagggcagcgcggtcattggcgccatcaaggccagcttcgagaacgaaactgttaaagccaacgtataa

SEQ ID NO: 25629 - DNA, 840 bp, Saccharomyces cerevisiae
atgtgtgaatacagcaaggctcttcatattctgctcaagtcgccagtaacggatgacataataaaattcttaacagacacaacattgagggttgttccttcaagcaactaccccacgcctcccggttctccaggagagaaacacctcacaaggctgccatcgctaatgacttttatcactagattggtcagatacaccaacgtctacacacccactctgctcaccgctgcgtgctatttgaacaaattaaagcgtattctgcccagggacgctactggtctcccctcgaccatccatcgcattttcttggcctgtttgatactgagtgctaagtttcacaatgactcttctcctttaaacaagcactgggctaggtacaccgatggtctctttacactagaggatatcaaccttatggaaaggcagttgttacagctgttgaactgggacctcagggtgaacacagaagatttgatcctagatctgcagcctctattagagcccatcaagcaagacttggcaagatccagcgaccaaaggaagagaattaacatgatgatgtccatgaacagaaggacttgtgctggcacgagtcctatcagatcaaacaacagattcaaactctacgaaaaacagagaaacgtgtcgatagcatccgatttaagttctgctactctagtcgacagttgtaatgatctaagaaggctaaaagatgtaaccaacatagcgaacaacacagtcgctaacacgaattacgtcaggacggtagagaaatggaacgacaatgtcaacaggcaaagttgggatctggaacagatcatgagtcaacatgggttttaa

SEQ ID NO: 25630 - DNA, 1512 bp, Saccharomyces cerevisiae
atgcacctagatctcatacacaagtccttcatcttagtgtggctcatatatatacgagccgcgttggctgaccaattcacatataaagcttgctattcagctagtgatatacgaaaattggggttgacttacaagggtgtttacgagtatcaatcagtttcctactgtcaaaatgaatgccctggtcaggctgtcgttgctcttttcaacggtacaggttgctactgtggtggttccgtagctcagttacagtctttgacgcaggtagattcgagcaaatgtgatgtttcgtgtgctggctggccctaccaaaattgtggtggttcttctgccatgaacgtttatatcaataacgctgcttctaccgcggactcaacttcatctactgctacctcaacatcgacaacatcttcatcaagcacaagtgttagttcaaaaacgtccacgaaattggacacgaaaacttcaactagttcttctgctacgcactcatcctcttcctcgtctacaacctccactaccacttcctcttcagagacaactacttcctcctcttcttcatcctcttcctcttctacgtctactacttctactacttctactacctctagtactacttctacttcttcttctccttccaccacttcctctagcacttctgcctcttccagttcagaaacgtcctctacgcaggcaacttcttcatccaccacatcgacctcatcctcaacttcgacagcaacggtcacttctaccccctcatcgacttcaataggtacttccacgcattacactacccgtgtggtgacgcagtccgtggtttctcaagctaaccaacaagcaagcacgatctttaccaccaggacctctgtttatgcaacagtatcgtctacgtcctcctctactagttctctcttaaacgggaaatcgagctcgtccaagagcaaaggcttgagtggtggcgccatcgcaggtgtcgtagtaggtgtggtttgtggtacagttgccttgttggctctggcgttattctttttcgtatggaaaaaacgtcgccaatcttctcagcatgtggacttggaagagacaaagcagtaccagccgtactcactgggtgatgctgacgctaaccctgttattccaccgtctgcttcgagcactaactggcacataccctctaggaataatacagcattgtccaagaatacagcgtctacttttgccacttatgatctgccgacaagggcgccgggcggcagagattctattattactggtgatgcacataatatcagcaaaagaagtcactttccctcggtagtgtacgaggagcctccttcgatctataacgggaaccaaaggttcagtgctacttcgctgcccgatatgatggaagaaagacaactacacattgtcaaccccgataatgtgagttcaaatattgggagtaatgtctcagatggtgatgatgattacgatgatgcaaaggattccaataatagttctttgcgctga

SEQ ID NO: 25631 - DNA, 1317 bp, Saccharomyces cerevisiae
atggtatcagctttgaatcccagaactacagagtttgaatttggtgggctgattggtgccttaggcatcagcatagggctgcctgttttcactatcatcttgaatcaaatgataaggcccgattattttattaagggatttttccagaatttcgatatagttgagctttggaacggtatcaagccattgcgctactatctgggcaatcgtgaattatggactgtctattgcctgtggtatggaatactggcagttttggacgtcattttaccgggcagagtcatgaagggtgttcagttaagggatggttcgaagctttcgtataagatcaatggaattgccatgtctacaactttggtcttagttttggctatcagatggaaattgactgatggacaattgcctgaattgcaatatctgtatgaaaatcacgttagtttatgcataatatctattttgttttcgttctttttggcgacgtactgctatgttgccagcttcataccattgatcttcaagaaaaatggtaatggcaaaagggaaaagatcttagcactaggtggaaattcaggaaacatcatttacgattggtttattggtagagaactgaaccctcgtctcggcccattagatatcaagatgttttcagagttgagacccggcatgttgttatggttactgatcaatctttcctgtctgcatcaccattacctgaagactggtaaaatcaacgatgcattggtcttggttaatttcttgcaaggattttacattttcgatggagtactaaacgaggaaggtgtattaaccatgatggatatcactacagatgggtttggtttcatgctagcgtttggtgacttaagtttagttccattcacctactcattacaagcgcgttacttgagtgtttcccctgtggaattgggatgggtgaaagttgtcggtatattagccataatgtttttgggtttccacatcttccactcggcaaataagcaaaaatctgagtttagacaaggtaaattagaaaatctaaaaagtattcagacaaagcgtggtacaaagttattatgtgacgggtggtgggctaaatcacagcatatcaattactttggcgattggctgatttcattaagttggtgtttggccacctggttccaaactcccttgacatattactactcgttgtacttcgccacgttgttattacaccgtcaacaacgtgatgagcacaagtgccgcctgaaatatggcgaaaattgggaagaatacgaaagaaaagttccttacaagatcattccatatgtttattaa

SEQ ID NO: 25632 - DNA, 5862 bp, Saccharomyces cerevisiae
atgttgaagaattcaggctccaaacattcgaactcaaaggaaagtcattcgaattcgagttctggtatattccaaaatttgaagcgtttggctaactcaaatgcaacgaatagcaatacgggttctccgacctatgcatcccaacaacagcactctccagtgggaaacgaagtgtccacttcacctgcatcttcgtcatcttttagaaaactgaatgcaccttctaggtctacatctactgaggcgaggccgttgaataaaaaatcgacattaaacacacaaaacttgtctcaatatatgaatggtaaattaagtggagatgttcccgtatcctcacagcacgcaaggtcgcattcaatgcaatcgaaatattcgtattccaagaggaattcttcacaggcgtccaataagctaacaaggcagcataccgggcaaagtcactccgcatcaagtcttctctctcaaggttcgctaactaacttgagcaaattcactacacccgatggtaaaatttatttagaaatgccgtcggacccatacgaggtggaagttttgtttgaagatattatgtataaaagaaatatttttcagtctttatcagaggacaaacaagaagctctgatgggctacagcattgagaagaaatggctgattgttaagcaggatttacaaaatgagctaaaaaaaatgcgagcaaacactacatcttcttccactgcctccagaacttcgatggcgtcggaccatcatcctatccttacggctaattcatctctttcgtctcccaaatctgttttgatgacaagcgcctcttctcccacctcaactgtatacagcaacagtttaaatcattctactactctttcatcggtaggtacgtcaacctcgaaggggaaaaaattagtgagcgggagtttgaaaaagcagccatctctaaacaatatttatagaggtggggctgagaacaatacgagtgcatctactcttccaggagacagaacaaacagaccaccgatacattatgtgcaacgaatcctggcagacaaacttactagcgatgagatgaaagatttatgggtaactttaagaactgaacagttagactgggtagacgcttttatagaccatcagggtcacattgctatggctaatgtactaatgaactctatttataagactgcaccccgagaaaacttgactaaagaattattagagaaagaaaattcattttttaaatgcttcagagtcttatcaatgctctcacaaggtttgtatgagttcagtacacataggttaatgactgatactgttgcagaaggtttattctctacgaaactggccacaaggaaaatggccactgaaatttttgtttgtatgctagaaaaaaaaaataaaagcagattcgaagcagttcttacctcactagataaaaagtttaggatagggcaaaatcttcatatgattcaaaacttcaaaaaaatgccccagtatttctctcatttaaccttggaaagtcatttgaaaattattcaagcctggttatttgccgttgaacaaactttagatggaagaggaaaaatgggttccttagtaggcgcgtcggatgaatttaaaaatggtgggggtgaaaatgcgattctagaatactgccaatggacaatggtttttatcaatcatttatgctcttgctctgataacataaatcaaagaatgctattaaggacgaaactagaaaattgtggaattttacgaattatgaacaaaataaaactgctagattacgacaaggtaattgaccaaattgagttatatgacaataataaacttgacgattttaacgttaaattagaggccaacaataaggcttttaatgtagatttacacgatccactatcattattaaaaaacctttgggatatatgtaaaggtaccgagaatgaaaagcttttagtatctttagttcaacatcttttcctttctagttcaaagttaatagaagaaaaccaaaattcctctaaacttactaagcaattgaaacttatggattctttggtgactaatgttagtgttgcctcaacttctgatgaagaaactaatatgaatatggctatccagcggctttacgatgccatgcagactgatgaagttgcacgtcgagctatattagaaagtagagctctaacgaagaaattggaagaaattcaggcagaaagggattctttaagtgaaaagttaagcaaggcggagcacggactcgttggacagttagaagatgagttgcatgagagagatcgtattttagctaagaatcagagagttatgcagcagctggaagctgagttagaagagttgaaaaagaagcatcttttggaaaagcatcagcaagaggtagaattgagaaaaatgttgactatattgaattcgaggcctgaagaaagcttcaataagaatgaaggcaccagaggtatgaactcgagcctaaattcttcagagaaagcgaatatccaaaaggtgttacaggacggattatcaagagcaaaaaaggattacaaggatgattcaaaaaaattcggcatgacacttcaacctaataagagattaaaaatgttaagaatgcaaatggaaaatattgaaaatgaagccaggcaactagagatgacaaattttgctgaatttgagaaagatcgtcttgaacctccaatacatattaagaagcccaaagtgaagaagatgaaaaataaggataggaaacctttagtcaagcctcaagaggcggacgtaaataaactaaatgacctaaggcgggctttgactgaaatccaaatggaaagtaatgatatttccaaatttaacgtcgaagaacgtgttaatgagctatttaatgaaaagaaatctctggctttaaagagactgaaagaactagaaacaaaatacaaaggatttggtattgactttaatgtcgacgagattatggacagtccaaagaaaaatactggggacgtggaaacggaagaagacgctaactatgccagtcttgaccctaagacatatcagaaaaagttagacgagattaatagaataacggaccagttgttagatattcagactcaaaccgaacacgaaatacaagtagaagaagatggggaaagcgatctttcctcttcaagttctgatgatgaaagtgaggaaatataccaagacgcatctccaactcaagaactaaggagcgaacactcagagctatcttcaggatcaggtcctgggtcttttctcgatgccttatctcaaaaatatggtactggtcaaaatgttactgcatcggctgcttttggagagaacaataacggttcgggtattggacctctacatagtaaagttgaaaagacctttatgaacagactcagaaaatccaccgtgtcttctgctccatatttagaggagttaacacagaaggtaaataaagttgaaccatatgaacaaaatgaagatgaaggtctagataaaaaatctttaccggaaaacagcacggcaagtgcagcttccgcctttgacaaagctgagaaagacatgagacaacatgtggaaaacggaaagcaagggcgtgtggtaaatcatgaagaagataaaacagcggatttcagcgctgtgagtaaactgaataatacagatggcgcagaagatctctctactcaatcatctgtactctcctcacagccgccaccgcctcctcctcctcctcctccagttcccgccaaattgttcggtgaatcgttggagaaagagaaaaagtcggaagacgacactgtcaagcaagaaactactggggattctcctgctcctccccctccaccaccaccacctcctcctccacccatggcattgttcggcaaacccaagggagaaacaccaccaccgccgccgctaccatctgtattatcttcatctactgatggcgtcattccgccagctccacctatgatgccggcatcgcaaatcaaatcagctgtaacatcaccattacttcctcaatcgccctcattatttgaaaagtatcctcgtccacacaagaaattaaagcaactgcattgggaaaaattagattgtactgataattctatttggggtacaggtaaagctgagaagttcgcagatgacttatacgaaaagggtgttcttgctgatttagaaaaggcctttgccgctagggaaattaaatcattagcaagcaagcgcaaggaagatctgcagaaaattacatttttatccagggatatttctcaacagtttggtatcaatttgcatatgtattcatcactttcggttgccgatctggtgaaaaagattctaaactgcgatagggattttttgcaaacaccgagtgttgttgagtttttgtcaaaatctgaaataattgaagtttctgttaatttagctaggaattacgccccgtattcgacagactgggagggcgtgaggaatctcgaagatgccaagccccctgaaaaagatccaaacgatttacagagggctgaccaaatttatttgcaattgatggttaatctagaatcatactggggttcacgtatgagagctctcacagtggttacttcgtatgaaagagaatataatgagttattggcaaagttaagaaaagtcgacaaagctgttagcgcgcttcaagaatcagataacttgcgcaatgtctttaatgttatcttagcagttggtaatttcatgaacgacacttctaagcaggcacaaggtttcaaactttcaaccttgcagaggttgacgtttatcaaggatactaccaatagcatgacctttctaaattacgtcgaaaaaattgtcaggttaaattatccaagcttcaatgactttctaagtgaattagaacctgtattggatgtcgtgaaagtttccattgagcagttagttaacgactgtaaggactttagccaatcgattgtaaacgtagagcgttcagttgaaattggtaatttaagcgattcctcaaagtttcatccattagataaagttttgataaaaacattgcccgtgttaccggaagccagaaaaaagggggacttgttagaagacgaagttaagctgactatcatggaatttgaaagtctgatgcatacgtacggtgaagattctggtgataagtttgcaaaaatctcattctttaagaaatttgcagattttataaatgaatacaaaaaagctcaagcgcaaaatctagccgcggaagaagaagaaagactttatataaagcataagaaaatagtggaagaacagcaaaaaagggcacaagaaaaggaaaaacaaaaagagaacagcaattcgccttcatctgaaggaaatgaagaggatgaagcagaagataggcgcgctgttatggataaactattagaacagttgaaaaatgcaggtcctgctaaaagtgacccatcttccgccagaaagagagccctagtgaggaaaaaatatctttctgaaaaagacaacgctccacaattactcaacgatttggatactgaagaagggtctattctttattctccagaagctatggaccctactgccgatacagtgattcacgctgaatcacccactccgcttgccacaaggggtgttatgaatacctctgaagatttaccatcgccatccaagacatctgcgctggaagatcaagaggaaattagtgacagagctagaatgttattaaaggagctaagaggctctgacacaccagtaaagcaaaattccatactcgatgaacatctagaaaaattgagggcccgcaaggaaagatccataggtgaggctagcacaggtaacaggctaagtttcaaataa

SEQ ID NO: 25633 - DNA, 1722 bp, Saccharomyces cerevisiae
atggatgaaactgtgaacatacaaatgtccaaggaaggtcagtatgaaatcaattctagctctataataaaagaggaggagtttgtagatgaacaatattctggggagaacgttacgaaggccatcaccacagagagaaaagtcgaggatgatgctgctaaggaaacagagagctcaccacaagaaagaagagaggtgaagcggaagttaaagcagcggcatatagggatgattgctctcggcggcaccattgggacgggcctcataattggtattggtccgccattggcacacgccggccctgttggtgccttgatatcgtatttatttatggggacagtgatttactccgttacacaatcgttaggagagatggtcacttttatcccggttacatcttcattttctgtcttcgcccaaagatttctgtcgccagcgctgggagcgactaacggatatatgtactggctgtcgtggtgtttcaccttcgcactggaactatccgttttggggaaagttattcagtactggacagaagcagtgcctctagcggcttggatcgtgatcttttggtgcctgttaacttcaatgaacatgtttcccgtaaagtattacggagaatttgagttttgtattgcctccataaaggtcatcgcgttgctcggttttatcattttctcattctgtgttgtgtgtggtgcgggacaatctgatggacccatcggtttcaggtactggagaaatccaggagcctgggggcctggcattatctccagtgataaaaatgagggccgttttctcggatgggtttcctctttgattaatgctgcatttacgtaccaaggtactgaactggttgggataaccgctggtgaagcggctaacccaagaaaagctctcccgagggcaataaagaaagttgtagtgaggattctagtcttttacattctttcactatttttcattggccttttggtcccatataatgacccaaagttggatagtgacggtatatttgtctcttcatcgccctttatgataagcattgagaattcaggcacaaaagttctcccagatatatttaacgcggtcgtgctaatcaccattctttccgcaggtaactctaatgtgtacattggctcaagagtactgtatagtctgtctaaaaatagcttggcgccaaggttcttgtctaacgtgaccagaggtggtgttccatacttttctgttctatctacatccgtgttcggatttttggctttcttagaggtttctgcaggcagcggcaaggcctttaactggttattgaacataactggtgtggccggtttctttgcctggcttttgatttcattttctcatatccgtttcatgcaagccataaggaaacgtggtatatcgagggatgacttaccttataaagctcaaatgatgccttttttggcatattatgcatcttttttcatcgctctaattgttctgatccagggcttcaccgctttcgcacctacttttcagcctatagactttgtcgctgcatatatatcaatattcctatttttggccatatggttatcattccaagtttggtttaagtgccgcttactctggaagctgcaggatatcgatatcgattctgaccgccggcaaatagaggagttggtatggatagagccagaatgtaaaacaaggtggcaacgagtttgggatgtcctttcataa

SEQ ID NO: 25634 - DNA, 1836 bp, Saccharomyces cerevisiae
atgggcaggtttagtaacataataacgtccaataaatgggacgagaaacaaaacaacattggcgaacagagcatgcaggaattaccagaagaccagatagaacatgagatggaagcaatagatccaagtaataagacgaccccatactctattgatgagaaacagtacaacacaaaaaagaagcatgggtcattgcaaggtggcgcaattgctgatgtaaattcgataactaattcgttaacaagattgcaagttgtctctcatgaaacagatattaacgaggatgaagaagaagcccactatgaggataaacacgtgaagagagccttgaagcaaagacacattggtatgattgcactaggtggtacaatcggtactggtcttttcgttggtatctccactcccttgagtaatgctggccctgtggggtccctgattgcttacattttcatgggcaccattgtctacttcgttacccagtcacttggtgagatggctacgtttatccccgtgacatcatctatcactgtcttttcgaagaggttcttatcacctgcattcggtgtttctaacggctacatgtactggttcaattgggctattacttatgctgtggaggtttctgtcattggccaagttattgaatactggacagataaagttccattagcggcctggattgcgatattctgggtaattattactttgatgaattttttccctgtcaaagtttatggtgaatttgagttctgggtggcctctgttaaagttttagccattatgggttacttgatatatgctttgattattgtctgcggtggatcccaccagggccctatcggtttcaggtactggagaaatccaggagcctgggggccaggcatcatctccagtgataaaagtgaaggccgttttctcggatgggtctcctccttgattaatgctgcatttacgtaccaaggtactgaactggttgggatcaccgctggtgaagcggctaacccaagaaagaccgttccaagagctatcaataaagtcgtctttagaatcgtactattctatattatgtctttgttctttattggtctactggttccatacaacgattcccgtttatctgctagttctgctgttattgcatcatcacccttcgttatttccattcaaaacgctggtacttatgctcttccagatattttcaacgccgtggtgttgattactgttgtatctgccgctaattcgaatgtttacgttggttcccgtgttctttactctttagctaggactggtaacgcaccaaagcaatttggatacgtcaccagacagggtgttccatatctcggtgttgtttgcactgctgcattgggtcttttggcattcctggttgtcaataacaatgcaaacactgcatttaactggttgatcaacatttccactttggctgggttatgcgcctggttattcatctctttggcacatattaggttcatgcaagctttaaagcaccgtggtatttctcgtgatgatctgcccttcaaggccaaattgatgccttatggtgcctactacgcagccttttttgtcaccgtcatcatattcatccaagggttccaagcgttctgtccgttcaaagtttctgagtttttcacatcttacatctccttgattcttttagccgttgtgttcattggttgccagatatactacaaatgcagatttatttggaagctagaagatattgacatcgattccgacagaagagaaatcgaagcaattatttgggaagacgacgagcctaagaatttatgggagaaattctgggctgctgttgcatag

SEQ ID NO: 25635 - DNA, 3201 bp, Saccharomyces cerevisiae
atgcataaagcatccagttcaaagaaaagctttgatgatactattgaactaaaaaaaaatgaacaattactgaaactgatcaactctagtgaattcacccttcacaattgtgtggagttactgtgcaaacactccgaaaatattggtatacattactatttatgtcagaaattggccacatttcctcacagcgaactacagttctatattccccaactagtacaggtcctcgtcaccatggagacagaatcaatggctttagaagatttactattaaggttgagggcggaaaaccctcattttgcactactgacgttttggcagttacaagcgttactaacggatttatctactgaccccgcttcttatggcttccaagtggctagaagagtcttaaacaacttacaaaccaatctctttaacacaagttcaggtagcgataaaaatgttaaaatacatgaaaacgttgcaccggccttagttctttcctctatgataatgtcggctatagcattcccccaattaagcgaagtgaccaaaccattagtggaatctcaaggtagaagacaaaaagctttcgtttttaagttggctagaagtgcaatgaaagattttaccaagaacatgaccttgaaaaataccctactaaacaagaaaacttccagatccaaaagagttagctcaaatcgcagttcaactccgacttctccaatagatttaatagatccaataaaaactaaagaagatgcatccttcaggaaatccagacatagtgaggtaaaattggatttcgacattgtggatgatataggtaaccaggtctttgaagaaagaatctcatcttcaatcaaactcccaaaacgtaaacctaagtatttggataattcatacgttcataggacatatgatggcaaaaatataaacagggacggaagcatttcaaataccgcaaaggctctcgatggaaataaaggtgattatatttctccaaagggacgtaatgatgaaaataatgagattggtaacaatgaagatgaaactggtggtgaaacggaggaggacgcggacgctttaaactctgatcacttcaccagttctatgccagatctgcataatattcaaccaaggacttcttctgcttcatctgcttctttagaagggacacctaagttaaacaggaccaattcccaacccctttcgcgccaggcattcaaaaacagtaaaaaagcgaattcttctttgagtcaagaaattgacttgtcgcaattatcgaccacttcaaaaataaaaatgttaaaagcaaattattttcgttgcgagacacaatttgccattgcgctagaaacaatatctcaaaggctagctcgagtaccgacagaagctagattgagtgccttacgagccgagttgtttctattaaacagggacctaccagcggaagtagatatccccactttattgcctccaaataaaaaaggaaagttacataaattagtgaccattactgctaatgaggcacaagttttgaactctgcagaaaaagttccatatttactcctgatagaatacttgagagacgaatttgattttgacccaacaagtgaaaccaatgaaagattattaaagaagatcagtggtaatcagggaggcttgatatttgatttaaattacatgaatagaaaagaaaacaacgaaaatagaaatgaaagtactcttactagcaacaacactcgatcttcggtatatgatagtaactcgttcaacaacggggcctcccgcaatgaaggtctatccagtacctcaagaagtgattcagcgtccacagctcatgttaggactgaagtcaataaagaggaagatttaggtgatatgtcaatggtaaaagtcaggaacagaacggatgacgaagcgtatagaaatgctttagtaatacagagtgccgcaaatgttccaattttacctgatgatagtcaagacagaagcccagagttgaactttggctcaaacttggacgaagtactcatcgagaatggaattaatagcaaaaatatacatagccaaactgacgctttagcagaccagatgagagtttcagctgttatgttagcacaattggataagtcgccacaacagttatcagaaagtaccaaacaaatccgcgctcaaattatttcatcaatgaaggaggtgcaggataaatttggttaccatgatttggaagcccttcatggaatggcaggtgagagaaaattggaaaacgatttaatgacgggtggtattgacacttcatatctaggtgaagattgggctaccaagaaagagaggatacgtaaaacttcggaatatggccatttcgaaaactgggatttatgttctgtaatcgccaagacgggtgatgatttgagacaggaggcgtttgcataccagatgattcaagcgatggccaatatttgggttaaagaaaaagttgacgtttgggttaaaagaatgaaaattttaattactagtgcgaatacgggacttgtggagaccatcacaaatgctatgtctgtgcatagtattaaaaaggctttaaccaaaaaaatgattgaagatgcagaactagatgacaagggtggtattgcctctttgaatgatcacttccttagagcttttggtaatcctaatggatttaagtatagaagagcacaagacaactttgcttcttcgttagccgcatattctgtcatttgctatctcttgcaggttaaagatagacacaacggtaacattatgatcgataacgaaggccatgtaagtcacatcgattttggatttatgctatcaaattcacccggctcagtgggctttgaggccgcaccattcaaattaacttacgaatatattgaactgctaggcggagtagagggagaagcgtttaaaaagtttgttgaactaactaaaagttcgttcaaggctctgagaaagtatgctgatcaaatcgtatcaatgtgtgagattatgcaaaaggacaatatgcagccttgtttcgatgctggcgaacaaacaagtgtacaactacgacaaaggttccaattggacttatcagaaaaagaagttgatgacttcgtagaaaatttcttgataggtaaatctttgggtagtatttacaccagaatatacgaccaatttcaacttattacacagggtatatatagctga

SEQ ID NO: 25636 - DNA, 1440 bp, Saccharomyces cerevisiae
atgaatgtgaccactccggaagttgcttttagggaatatcaaaccaactgtctcgcatcgtatatttctgctgatccagacataactccttcaaatttaatcttgcaaggttatagtggaacaggaaaaacctacactttgaagaagtattttaatgcgaatccaaatttgcatgcagtatggctggaacctgttgagttggtttcttggaagcccttactgcaggcgatagcacgtactgtacaatataaattgaaaaccctatatccaaacattcccaccacagattacgatcctttacaggttgaagagccatttcttttggtaaagacgttgcacaatatttttgtccaatatgaatctttgcaagaaaagacttgcttgttcttgatattggatggtttcgatagtttacaagatttagacgccgcactgtttaacaaatatatcaaactaaatgaattacttccaaaagattctaaaattaatataaaattcatttacacgatgttagagacatcatttttgcaaagatattctacacattgcattccaactgttatgtttccgaggtataatgtggacgaagtttctactatattagtgatgtctagatgtggcgaactcatggaagattcttgtctacgtaagcgtatcattgaagagcagataacggactgtacagacgatcaatttcaaaatgtagctgcgaacttcattcacttaattgtgcaggcttttcattcttatactggaaacgacatattcgcattgaatgacttgatagacttcaaatggcccaagtatgtatctcgcattactaaggaaaacatatttgaaccactggctctttacaaaagtgccatcaaactatttttaagcacagatgataatttaagtgaaaatggacaaggtgaaagcgcgataaccacaaatcgtgatgaccttgagaacagtcaaacttacgacttatcaataatttcgaagtatctgctcatagcctcatatatttgttcatatctggaacctagatacgatgcgagtattttctctaggaaaacacgtatcatacaaggtagagctgcttatggacgaagaaagaagaaagaagttaaccctagatatttacagccttctttatttgctattgaaagacttttggctattttccaagctatattccctattcaaggtaaggcggagagtggttccctatctgcacttcgtgaggaatccttaatgaaagcgaatatcgaggtttttcaaaatttatccgaattgcatacattgaaattaatagctacaaccatgaacaagaatatcgactatttgagtcctaaagtcaggtggaaagtaaacgttccctgggaaattattaaagaaatatcagaatctgttcatttcaatatcagcgattacttcagcgatattcacgaatga

SEQ ID NO: 25637 - DNA, 3939 bp, Saccharomyces cerevisiae
atgagcgctatctataaattatctattcagggcatacggtcttttgactccaatgatagggaaactattgaatttggcaagcctctgactttaatagtcggcatgaatggttcaggtaaaacgactatcatcgaatgtttaaagtacgctaccacaggtgatctaccgcccaacagcaagggaggagtattcattcatgacccgaagataactggtgaaaaggacattagagctcaggtcaaactggcgtttacgagtgccaatggactcaatatgattgtcaccagaaatattcagttgctaatgaaaaagactactactacatttaagactttagaaggccagttggtcgctataaataatagtggtgaccgcagtactttgtccacccggtctctggaattagacgcacaagtacccctgtatctgggagttccaaaagcgatcttggaatacgtgatattctgtcaccaagaagacagcctgtggccactgagtgaaccatccaatcttaaaaagaagtttgatgaaattttccaagcgatgaaatttacaaaggctctagacaatttaaaatccataaagaaagacatgtccgtggatatcaagttattaaagcaatcagtagaacacttaaagttggataaagacagatcgaaagcaatgaagctcaatatccaccaattgcaaactaagatagatcagtataatgaagaagtgtctgaaattgaatctcaattgaatgaaatcactgagaaatccgataaactgtttaaatctaatcaagatttccaaaaaatactatccaaagtagagaacttgaaaaatacaaaactctcaattagtgatcaagtgaaaagattgtcaaactcaattgatattctcgatttatcgaagccagatttgcaaaacttattggcaaacttctctaaagtcttgatggataagaataatcagttgagagatttggaaaccgatatttcaagtttgaaagaccgtcagtcatccttgcagagcctttctaattccctcatcaggcggcagggtgagttagaagctggtaaggagacatacgaaaagaacagaaatcacctttcatcgctaaaagaagccttccaacataagttccaaggcctttcaaatattgaaaacagtgatatggctcaagtaaatcacgaaatgtcacagttcaaggctttcatctctcaggatttaactgacactatagatcaatttgcaaaggatattcaactaaaggaaacaaatttatccgacttgataaaatcaataaccgtcgattcacagaatttggaatataataaaaaggacagatctaaattaatccatgactctgaagagcttgctgagaaattgaaatcatttaaaagtttgtctactcaagatagcctcaatcatgaactggaaaacttaaaaacatacaaagaaaagctgcaatcttgggaaagtgagaatattataccaaaattgaaccagaaaatagaagagaaaaataatgagatgattatcttagagaatcaaattgagaaatttcaagatcgcataatgaaaacgaatcaacaagcggacttatacgccaaactaggactaataaagaagtccattaatactaaattagacgagttacaaaagattacggaaaaattacagaatgattctagaataaggcaagtatttcccctcacccaggaatttcaaagagctgatttagaaatggattttcagaaattattcatcaatatgcaaaagaatatagcgatcaacaacaaaaagatgcacgaattggatagaagatatacaaacgctttgtacaatttgaacaccattgaaaaggatttacaggataatcagaagtcgaaagaaaaagtgatacaactactaagcgaaaacttaccagaggattgtactattgatgaatataatgatgtcctggaagaaacggagctctcctataagactgcgctggaaaacttgaaaatgcatcaaactactttagaatttaatagaaaagcattagagatcgctgaacgtgacagctgctgttatttgtgttctagaaagtttgaaaatgaatcgtttaaaagtaagttgttacaagaactaaaaacaaaaacagacgcaaattttgaaaaaactttgaaagacactgtccaaaacgaaaaggaatatcttcatagtttaaggctactggagaaacatattattacactaaattctataaatgaaaagattgataattcacagaagtgccttgaaaaagctaaggaggaaacaaaaacttccaaatcaaaactagatgaattggaagtagattccacaaaattgaaagatgagaaagagttagctgagtctgaaattcgtcctttgattgagaagtttacttacttagaaaaggaacttaaggatcttgaaaacagttctaaaacgatatctgaggagctatcgatttataataccagtgaagatggtattcaaactgttgatgaattaagggaccaacaaaggaagatgaatgattctttacgtgaactgaggaaaaccatttcagatttgcaaatggaaaaagatgaaaaggtgagagaaaattcaagaatgattaacttgattaaagaaaaggaattaacagtttctgaaattgaatcatctttaacacagaaacaaaatattgatgattctataaggtcaaaaagggaaaacatcaacgatatcgattctagagtaaaggagttagaagcacgtattatttcattaaaaaacaaaaaggatgaagcgcaaagtgttctagacaaagtaaaaaatgaacgtgatattcaagtacgcaacaaacaaaaaaccgttgcagatattaatcggttaatagatagatttcagaccatttataacgaagtggttgattttgaagctaagggcttcgatgaattgcaaacaacaataaaagaactagaattgaacaaagctcaaatgctggaactaaaggagcagcttgatctcaagtcaaatgaagttaacgaagaaaagagaaaacttgctgactcaaataatgaggagaaaaacttgaagcagaacttagaactaattgaattgaaatcacaacttcagcacattgaatctgagataagtagattagacgttcaaaatgcagaagctgaaagggacaaatatcaagaggaatcactaagactaagaacaagatttgaaaagctgagctctgaaaacgcaggtaaattaggtgaaatgaaacaattacagaatcaaatagattcattgactcatcaactgcggactgattacaaagatatcgagaaaaattaccataaagaatgggttgaattacagacaagatcctttgttactgacgacatagatgtctattcaaaagcattagatagtgctattatgaaatatcatggattgaaaatgcaagatataaacaggataattgatgaattatggaagcgtacgtatagtggtactgatatagacaccatcaaaattagatcagatgaagttagtagtacagttaagggaaaatcatacaactatcgtgttgtaatgtacaagcaggatgttgaattggatatgagaggacgatgttccgcgggtcaaaaagttcttgcatcgattattatcaggctagctctatctgaaacatttggcgcaaattgtggcgtaattgcactagacgaacctaccaccaatttagatgaagaaaacatcgaaagtttagcaaaatctttacacaatataattaatatgagaagacatcaaaagaatttccagctaatcgtgatcactcatgatgagaaatttttgggtcatatgaatgcagcggcatttactgatcacttcttcaaagtcaagagagatgataggcaaaaatcacaaattgagtgggtcgatattaacagagtcacttattga

SEQ ID NO: 25638 - DNA, 2907 bp, Saccharomyces cerevisiae
atgtccagaatagattcagatctgcagaaagcgcttaaaaaggcgtgttccgttgaggagaccgcacctaagagaaagcacgtacgcgcatgcatagtgtacacatgggaccatcagtcttccaaagctgtttttacaacccttaagacgctgcctctggccaatgacgaagtgcaactgttcaagatgcttattgtactgcataagatcatacaagagggacatccgtcagcgctagctgaggccatccgggatagggactggatcagatctctgggtagggtacattctggcggttcgtcgtacagcaaactgattcgggagtatgtgcggtacctggttttgaagctggactttcatgcgcaccatagagggtttaacaacgggacgtttgagtacgaggagtatgtgtcactggtttcagtttccgacccggacgaagggtacgagacgatcttagatttgatgtcgttacaggattctcttgacgagttctcgcagatcatctttgcgtcgattcagtccgagaggagaaatactgagtgcaaaatttcggcgctgatcccgttgattgcggagtcatatggtatttataaattcatcacctcgatgctgagagctatgcacaggcaattgaatgatgcggagggtgacgctgctctgcagcccttgaaagaacggtacgagttgcaacatgcaaggctgtttgagttttacgcggactgctcttctgtgaagtacttgaccacgttagtaaccattccaaaactacccgtggacgctccagacgtatttttaatcaacgatgtggacgagtcaaaagagattaagttcaaaaaaagagagccctctgtaactccagcgcggacgccggcacggactccaacaccaacaccacctgttgttgctgagccggctatttccccacgtccggtatctcaaaggactacttcgacgcctacgggttacttgcaaactatgccgacgggtgccaccactgggatgatgatccccactgccactggtgcacgtaacgccatttttccacaggcgacggcacaaatgcagccggacttctgggccaatcaacaagcccagtttgcgaacgagcaaaaccgtctcgagcaagagcgtgtgcaacagttgcaacaacagcaggcacagcaggaactgtttcaacagcagttacaaaaagcacaacaggatatgatgaatatgcagcttcaacaacaaaaccaacatcaaaacgatttaattgccctcaccaatcaatatgaaaaggaccaggctttattgcagcaatatgaccaaagagtgcagcagctggaaagtgaaatcacaacgatggattctacagcttccaaacaattggctaataaggacgagcaactaactgcattgcaggatcaattggatgtttgggaaagaaaatatgagtctttagccaagctatactcccagttgcgtcaagagcatctaaatcttttacctcgttttaaaaaactgcagttaaaggtgaatagtgcgcaggaatccattcagaaaaaggaacagttagaacacaaattgaagcaaaaggatttgcaaatggccgagttggttaaggaccgtgacagggcaaggttagaattagaaagatccattaataatgcagaggcggacagtgcagcggcgacagcagcagcagaaacaatgactcaggataaaatgaaccctattctggatgccatattggaaagcggtatcaacaccatccaggaatcggtctataatctcgattctcctttgagttggtcgggtccgctgactccacccactttccttttgtccttattggaaagtacttctgaaaacgccactgagtttgccaccagtttcaataatttgatagtagacggccttgcacacggcgaccaaacagaggtcatacactgcgttagtgatttcagtacttcgatggctacactggtgaccaattcaaaggcgtacgccgttactacattacctcaagaacagtctgatcaaattttgaccctggtgaagagatgtgccagagaggcccaatatttcttcgaggatttgatgtctgaaaatcttaaccaggtcggtgatgaggagaaaactgatatcgtcatcaatgccaacgtggacatgcaagagaagttgcaagagctatctttggctatcgaaccgttattgaacatacaatctgtcaaatcaaataaagaaacgaacccacattctgaattggttgccactgctgacaaaattgtcaaatcctcagaacacttacgtgttgacgttcctaaaccattgttgtcattggcattaatgattattgatgctgttgtggctttggtaaaggctgctattcagtgccaaaatgaaattgccaccacgacaagtattcctctgaaccaattctacttgaaaaacagcagatggacagaaggtttgatctccgcggcaaaggctgtggcaggtgcaaccaatgttttaatcactactgctagtaagttaatcacttctgaagacaatgaaaacacatcacctgaacaatttatcgtcgcctccaaagaagtggccgcatccacaatacaattggtagcagcatcgagagtgaaaacttccatccactcgaaggcccaagataaattggaacactgttccaaagatgttaccgatgcatgcagaagtttgggtaaccacgtcatgggtatgattgaagatgatcattcgacttcgcaacagcagcaaccattggacttcacatccgaacacacattgaagactgccgaaatggaacagcaagtggaaattttgaagttagaacaatccttgagcaatgccaggaagagattgggcgagataagaaggcatgcctactataaccaggatgatgattga

SEQ ID NO: 25639 - DNA, 1518 bp, Saccharomyces cerevisiae
atgagtgaaggccccgtcaaattcgaaaaaaataccgtcatatctgtctttggtgcgtcaggtgatctggcaaagaagaagacttttcccgccttatttgggcttttcagagaaggttaccttgatccatctaccaagatcttcggttatgcccggtccaaattgtccatggaggaggacctgaagtcccgtgtcctaccccacttgaaaaaacctcacggtgaagccgatgactctaaggtcgaacagttcttcaagatggtcagctacatttcgggaaattacgacacagatgaaggcttcgacgaattaagaacgcagatcgagaaattcgagaaaagtgccaacgtcgatgtcccacaccgtctcttctatctggccttgccgccaagcgtttttttgacggtggccaagcagatcaagagtcgtgtgtacgcagagaatggcatcacccgtgtaatcgtagagaaacctttcggccacgacctggcctctgccagggagctgcaaaaaaacctggggcccctctttaaagaagaagagttgtacagaattgaccattacttgggtaaagagttggtcaagaatcttttagtcttgaggttcggtaaccagtttttgaatgcctcgtggaatagagacaacattcaaagcgttcagatttcgtttaaagagaggttcggcaccgaaggccgtggcggctatttcgactctataggcataatcagagacgtgatgcagaaccatctgttacaaatcatgactctcttgactatggaaagaccggtgtcttttgacccggaatctattcgtgacgaaaaggttaaggttctaaaggccgtggcccccatcgacacggacgacgtcctcttgggccagtacggtaaatctgaggacgggtctaagcccgcctacgtggatgatgacactgtagacaaggactctaaatgtgtcacttttgcagcaatgactttcaacatcgaaaacgagcgttgggagggcgtccccatcatgatgcgtgccggtaaggctttgaatgagtccaaggtggagatcagactgcagtacaaagcggtcgcatcgggtgtcttcaaagacattccaaataacgaactggtcatcagagtgcagcccgatgccgctgtgtacctaaagtttaatgctaagacccctggtctgtcaaatgctacccaagtcacagatctgaatctaacttacgcaagcaggtaccaagacttttggattccagaggcttacgaggtgttgataagagacgccctactgggtgaccattccaactttgtcagagatgacgaattggatatcagttggggcatattcaccccattactgaagcacatagagcgtccggacggtccaacaccggaaatttacccctacggatcaagaggtccaaagggattgaaggaatatatgcaaaaacacaagtatgttatgcccgaaaagcacccttacgcttggcccgtgactaagccagaagatacgaaggataattag

SEQ ID NO: 25640 - DNA, 2445 bp, Saccharomyces cerevisiae
atgaaagtgaggaaatatattactttatgcttttggtgggccttttcaacatccgctcttgtatcatcacaacaaattccattgaaggaccatacgtcacgacagtattttgctgtagaaagcaatgaaacattatcccgcttggaggaaatgcatccaaattggaaatatgaacatgatgttcgagggctaccaaaccattatgttttttcaaaagagttgctaaaattgggcaaaagatcatcattagaagagttacagggggataacaacgaccacatattatctgtccatgatttattcccgcgtaacgacctatttaagagactaccggtgcctgctccaccaatggactcaagcttgttaccggtaaaagaagctgaggataaactcagcataaatgatccgctttttgagaggcagtggcacttggtcaatccaagttttcctggcagtgatataaatgttcttgatctgtggtacaataatattacaggcgcaggggtcgtggctgccattgttgatgatggccttgactacgaaaatgaagacttgaaggataatttttgcgctgaaggttcttgggatttcaacgacaataccaatttacctaaaccaagattatctgatgactaccatggtacgagatgtgcaggtgaaatagctgccaaaaaaggtaacaatttttgcggtgtcggggtaggttacaacgctaaaatctcaggcataagaatcttatccggtgatatcactacggaagatgaagctgcgtccttgatttatggtctagacgtaaacgatatatattcatgctcatggggtcccgctgatgacggaagacatttacaaggccctagtgacctggtgaaaaaggctttagtaaaaggtgttactgagggaagagattccaaaggagcgatttacgtttttgccagtggaaatggtggaactcgtggtgataattgcaattacgacggctatactaattccatatattctattactattggggctattgatcacaaagatctacatcctccttattccgaaggttgttccgccgtcatggcagtcacgtattcttcaggttcaggcgaatatattcattcgagtgatatcaacggcagatgcagtaatagccacggtggaacgtctgcggctgctccattagctgccggtgtttacactttgttactagaagccaacccaaacctaacttggagagacgtacagtatttatcaatcttgtctgcggtagggttagaaaagaacgctgacggagattggagagatagcgccatggggaagaaatactctcatcgctatggctttggtaaaatcgatgcccataagttaattgaaatgtccaagacctgggagaatgttaacgcacaaacctggttttacctgccaacattgtatgtttcccagtccacaaactccacggaagagacattagaatccgtcataaccatatcagaaaaaagtcttcaagatgctaacttcaagagaattgagcacgtcacggtaactgtagatattgatacagaaattaggggaactacgactgtcgatttaatatcaccagcggggataatttcaaaccttggcgttgtaagaccaagagatgtttcatcagagggattcaaagactggacattcatgtctgtagcacattggggtgagaacggcgtaggtgattggaaaatcaaggttaagacaacagaaaatggacacaggattgacttccacagttggaggctgaagctctttggggaatccattgattcatctaaaacagaaactttcgtctttggaaacgataaagaggaggttgaaccagctgctacagaaagtaccgtatcacaatattctgccagttcaacttctatttccatcagcgctacttctacatcttctatctcaattggtgtggaaacgtcggccattccccaaacgactactgcgagtaccgatcctgattctgatccaaacactcctaaaaaactttcctctcctaggcaagccatgcattattttttaacaatatttttgattggcgccacatttttggtgttatacttcatgttttttatgaaatcaaggagaaggatcagaaggtcaagagcggaaacgtatgaattcgatatcattgatacagactctgagtacgattctactttggacaatggaacttccggaattactgagcccgaagaggttgaggacttcgattttgatttgtccgatgaagaccatcttgcaagtttgtcttcatcagaaaacggtgatgctgaacatacaattgatagtgtactaacaaacgaaaatccatttagtgaccctataaagcaaaagttcccaaatgacgccaacgcagaatctgcttccaataaattacaagaattacagcctgatgttcctccatcttccggacgatcgtga

SEQ ID NO: 25641 - DNA, 2679 bp, Saccharomyces cerevisiae
atgtcggatagtatttcagattcaaagtcctcagaacttttaaattctactttttattcgtcgacgtcgataaatacacttgatcatgctagaacctttcgaaattctctgatattgaaggagatatcagatcaaagtctaaattcatcaataaagccatgcgaatccgtccttgatagggatgttgaaagctcagttctgcagcggtcgtttggagaaagtaatgcccgagactcagaagtacaaacggtaaatatgacaacttccccctcattaagtgcattggctgatattctgaacgaaagatccaaatatgctgaccaaaaaactagaaaggcacaaaatattgagtcttccataatagaagaagaagaagaggccgaagagcaaaacaactcgatcaattatcacgaggatataactggatccaggctgtctgtacgagaggaagcaaatgaaaacttggcgatgacctctccaaaccttattgacattgacggatccaatagtattcaagttgcccctttgagtttaccgtctttcgaagaacctgactttttgtccactcctagagtaaaacctgattctcagggacctcggagcaaagttagtacacgacgtactattctcgaacgagacaacaatttaccagttaagcgggaggaaaatactatcattaattcagaaactgaaagcacaacacatagcgcaccatttttaaaagaggatccgaaaccctcgcctccttcgagtaaattatacaacccaaaagttcgtttaaacaaagcagaagcgcgaaagtatactgattcttctgcccaaaggactacttcagcaggctcggtacttgaagacacttctatgcataaaaagaaaaagagtatattttcatttctgaagaagaaagaaccgaaaccagttattggtaataatagtgtaacgaatgaaaaaaataagatgtcttcatcgagcactttctcaatgaatattcaaacctctttaaaaacgcctgaaaaactaaagaagaagtctcacagtagcagtagcattttcaattccttcctaaagggaaaaattgaaacatcagactcacctcgaaaggaaccaatgaggcaaaaaaaaagaaccccaaaatccaaggacaaaaagcaagatactgaacaaataattgacgccgcatcagtgttatccactgaatcacctctactacgaaaaaaccacgacgatactcccgtgaaaatagatcacgtaacgagatcaattgatcagagaaaacctactcctttaaacatggatctcatattgggaggtgataaacagataaataccccgctacaagaacacgtaagagaagatgatgatgccaaaaatgatcttcaattaccaaccaaggataattttttatcactggactacgaagcaccctcaccagcattttccaaacacgatacaggtgaggttcttttcccaaaatttttggataatcatgaagtcgactcgatcgtttctttagaaagaacaagatctacaaagtctaacaagagaagttcaatgaactcgcaaagaaggtcattgacagatacgctatcgatcaaagcgcaaagtgagggaatgttcatcactgaggcatcttctgttgtattatctactccagacttgacgaagtctcctgctagcagcattttaaagaatggaaggttcgaatactcagataatttctccagagaacactcttacgaaggtaccacgaatgaggactttttagatatcaaggacgatagtggtccactaaaaaaagatgacatatttttagagtctattgaacaaaaatttgaccagctagtgatggcctctgatgaagaaaaaactgaagttgaaagggatgtaccaaaaccaagagaagaacctctgaagaaggattctgaaaggcaaagcgtttttgcagatgatgataacgagttaatttctgatataatggagtttgcaagttttattaacttcggtgatgatgatctcaatctagacctagacttgggagatacaacggcctcatatgcaacagaaacccctgaacctgttggaaatgatgaagtaaatcgctctggtacttttgatacacgaaataacaaagaggatagttacaaagaaagagaaactcaatcttattccgctgctggagctactacatacggagatgagcgtcaaggtcaattacatacatttgaacaagacggaagtgaaataaatgacaacgaatttgagaatgaagatttcaacaaacacatagaacagcccatagaagttactccaagaaataatgcatatttaccagaattcgaacccaatagacctgtttcaatgtcctttaaaggactaaaagccccaagaatgaatacttcttttattgactccatgacgcctgattctcccgtaaaatcagacttaacaagtctaggtgaggtgtatgtaaacagtaataatgaccagggtgtccggttttcgtcccagataatactttacgacacttatggagaattcgaatatgatagacatccagaaatttccacttgtaaccagcttactccacaactggctcaaatgatcaaattggaattaaatgagttaaagagcgcaatggaagtacacgatgattcgcgatgttacacacatttttattag

SEQ ID NO: 25642 - DNA, 1302 bp, Saccharomyces cerevisiae
atggttaacgttgtattgggctcccaatggggtgatgagggtaaaggtaaactagttgatttactggttggtaaatatgatattgtagcccgttgcgccggtggtaacaatgccgggcataccattgttgtagacggtgttaagtatgatttccatatgttaccatctggtttagtcaacccaaactgccaaaaccttttgggtaatggtgttgttattcatgttccatcttttttcaaagagttggaaaccttggaagctaaaggtttgaagaacgcaaggagtagattatttgtttcttccagagcacatttagtctttgactttcatcaggtgactgacaagctaagagaattggagttatcaggtcgttctaaagatggtaaaaatatcggtactaccggtaaaggtattggtccaacttattccacaaaggcttctagatctggtttgagagttcatcatttggtgaatgatcaacccggtgcctgggaggaatttgttgctagatataagagattattggaaacgagaagacaaagatacggtgatttcgaatacgactttgaagccaagcttgctgaatacaagaagttaagagagcaactaaagccattcgtcgtcgattctgtcgttttcatgcacaatgctattgaagcaaagaaaaagatattggttgagggtgctaatgctttgatgttggatattgattttggtacttatccatatgtgacttcttccaatactggtattggtggtgtcctcaccggtttaggtattcctccacgtactattgatgaaatttatggtgttgttaaagcctacacaactagagttggtgaaggtcctttcccaacggaacaattgaacgaaaatggagaaaaactgcagaccattggtgctgaatttggtgtcactactggtcgtaagcgtcgttgcggttggttagacttggtagtcttgaaatactcaactttgatcaatggatacacgagtttgaacattaccaagttagacgtcctcgatactttcaaagaaatcccagtgggtatttcatattctattcaaggtaagaagctagatttgttccctgaagacttgaatattcttggtaaagttgaagttgaatacaaagttttgccaggttgggatcaagatattaccaaaattacaaagtatgaagatttgccggaaaacgcaaagaagtacttaaaatatattgaagattttgttggcgttcctgttgaatgggttggtaccggccccgcaagagaaagcatgttgcataaagaaattaaatag

SEQ ID NO: 25643 - DNA, 1842 bp, Saccharomyces cerevisiae
atggctgaaggtgttttccaaggtgctatcggtatcgatttaggtacaacatactcttgtgttgctacttatgaatcttccgttgaaattattgccaacgaacaaggtaacagagttactccatctttcgttgccttcaccccacaggaaagattgatcggtgatgctgccaagaaccaagctgctttgaacccaagaaacactgtttttgatgctaagcgtttgattggtagaagattcgacgacgagtctgtccaaaaggacatgaagacctggcctttcaaggttatcgacgtcgatggtaacccagtcattgaagtccaatacttggaagaaaccaagactttctccccacaagaaatttccgctatggtcttgaccaagatgaaggaaattgctgaagctaagattggtaagaaggttgaaaaggctgtcattactgtcccagcttactttaacgatgcccaaagacaagctaccaaggatgccggtgccatttctggtttgaacgttttgcgtatcatcaacgaacctactgccgctgctattgcttacggtctaggtgctggtaagtccgaaaaggaaagacatgttttgattttcgatttgggtggtggtactttcgatgtttccttgttgcacattgctggtggtgtttacactgttaaatctacttccggtaacactcacttgggtggtcaagatttcgacaccaacttgttggaacacttcaaggctgaattcaagaagaagactggtttggacatctccgacgatgccagagctttgagaagattgagaactgctgctgaaagagctaagagaaccttatcttctgtcactcaaactaccgttgaagttgactctttgtttgacggtgaagatttcgaatcctctttgactagagctagatttgaagacttgaacgccgcattgttcaagtctactttggaacctgttgaacaagttttgaaggatgctaagatctctaagtctcaaatcgacgaagttgtcttggttggtggttctaccagaattccaaaggtccaaaagttgttgtctgacttctttgacggtaagcaattggaaaaatctattaacccagatgaagctgttgcttacggtgctgctgttcaaggtgctatcttgactggccaatccacatctgacgaaaccaaggacttgttgttgttagatgttgctccattatctctaggtgttggtatgcaaggtgacattttcggtattgttgtcccaagaaacacaactgttccaaccatcaagagaagaaccttcacaactgtcagtgacaaccaaaccaccgttcaattcccagtctaccaaggtgaacgtgtcaactgtaaagaaaacactttgttgggtgaattcgacttgaagaacatcccaatgatgccagctggtgaaccagtcttggaagctatcttcgaagttgatgctaacggtatcttgaaggttactgccgtcgaaaagtctaccggtaagtcttctaacatcactatctccaacgctgtcggtagattgtcttctgaagaaattgaaaagatggttaaccaagccgaagagttcaaggctgctgatgaagcttttgctaagaagcacgaagctagacaaagactagaatcctacgtcgcttccatcgaacaaaccgtcactgacccagtcttgtcttctaaattgaagagaggttccaagtccaagatcgaagctgctttgtccgatgctttggctgctttgcaaatcgaagacccatccgctgatgagttgagaaaggcagaagttggtttgaagagagttgtcaccaaggccatgtcttctcgttaa

SEQ ID NO: 25644 - DNA, 903 bp, Saccharomyces cerevisiae
atgcgtttgtttgaaaatagtaaagatatggaaaaccggaagagattgttacgtgccaagaaggctgccggcaataacaattgttttgaatgcaagagtgtcaatccacaatttgtttcttgcagcttcggcatatttatatgtgttaattgcgcaaaccttttgagggggatgggtacgaacatattttgtgtaaagtcaataacaatggataattttgaagaaaaggatgtcagaagagtagagaaaagcggaaataacagattcggttccttcttgtccaaaaatggtattttgcagaacgggattccattgcgtgaaaaatatgataatttgtttgctaaaagttacaagaggaggctggccaatgaagtgcgcagtaatgatattaatcggaacatgtatttgggattcaataatttccagcagtatacaaacggtgcgacgagccaaataagagataggacgttgagggaaatatctaataacagcaatgcttcggaaggggcggaatttgtactacctgagaaggtgttaggctctgacaattttcaagactgcgaaagatttcccgcttgtttgagttccgaaagaaacctggacgagaataacgttacaagtgctacgagtacgttaacaattgaaaaatttcaaaatgaccccataggaaccatttctagaagttggcagttgctttcagatgcattatacaaatcatacgaagactttaaaggctcggttgttcagccaacgattgaaaacattcaacaaaggaatttgccgaatgatatcaagagatcattcgtgcactttaacgagaagttgcatgaaacgccccatttaccctcgccagttttttcttgttttactgggggagacattctccctccagaattcaattag

SEQ ID NO: 25645 - DNA, 888 bp, Saccharomyces cerevisiae
atggatactatgaatacagcaaacactttggacggcaaattcgttactgagggttcttggagacctgatttatttaagggtaaagtggcatttgtcactggtggagctggcacgatatgtcgggtacagacagaagccttggttcttcttggctgtaaggcagctattgtcggcagggaccaagaaagaacagaacaggcagcaaaaggtatttcgcagttagcaaaggacaaagatgcagtcttggctattgcaaacgtcgatgttcgcaattttgaacaagtggagaatgcggttaaaaagaccgtagagaagttcggtaagatcgatttcgtcattgccggtgctgctggaaattttgtgtgcgattttgcgaacctctctccaaacgccttcaaatctgttgttgacatagatttactaggaagttttaataccgccaaggcatgcttgaaggagttaaaaaagtcaaaaggttccatccttttcgtctctgccactttccattattatggtgtgccgtttcaaggacatgtgggcgctgctaaagcgggaatagacgcattggcaaagaatttagcggttgagttggggcctctgggtatacgttcgaattgcattgctccaggtgctatcgataatacggaaggcttgaagagattagccggcaaaaaatataaggaaaaggccttggcaaagataccattacaaaggcttggatctacacgggatatagccgaatctactgtttatattttttcacccgccgcatcgtatgtcaccggtaccgtcttagttgttgacggtggtatgtggcatttagggacctattttggacatgagttgtatccagaagccttaataaagagtatgacatctaaattataa

SEQ ID NO: 25646 - DNA, 3396 bp, Saccharomyces cerevisiae
atgagtgatcaaaataatcgatcgagaaatgaatatcactcaaaccggaagaatgaaccttcctatgaactccaaaatgcacatagcgggctatttcactcttctaatgaagaattaacaaacaggaaccaaagatataccaatcaaaatgccagcatgggttcattcactccagtccaatctttgcaatttccagaacaatctcagcaaacaaatatgctttataacggtgacgatggcaataataatactatcaatgataacgaacgagacatatatggaggttttgtcaaccaccatcgccagcgtcccccaccagcaactgcagaatacaatgacgtttttaatacgaatagtcaacagctaccgtcggaacatcaatacaataacgtaccttcatatccacttccttcgataaatgtgattcaaaccactccagaactcatacataacggctcacagactatggccacccccatcgaaaggcccttctttaacgaaaacgactactattataataacaggaactctaggacgtcaccgagtattgcttctagtagcgatggttatgcagatcaggaagctaggcccattttggagcaacccaacaataacatgaatagcggtaatattcctcaataccatgaccaaccttttggatacaacaatggttaccatggcctacaggcaaaagattactatgacgatccggagggtggttatattgatcagagaggagatgactatcagattaattcatatttgggtagaaacggtgaaatggttgatccttacgattatgaaaacagtttaagacatatgactcctatggagcgtagagaatatcttcatgatgatagcagacccgtaaacgatggaaaagaagaattagacagtgtgaaaagcggttactctcatagagacttgggggaatatgacaaggatgatttttcaagggatgacgagtacgatgatctcaacactattgataaattacagtttcaagctaatggtgtacctgcatcatcctcggtgtcttctatcggatctaaagaatccgacataatagtaagcaatgataacttaaccgcaaatagagcactaaagagaagcggtactgaaattaggaaattcaaactttggaatggtaattttgttttcgattctccaatcagtaagacgctattggaccaatacgctactacaacagaaaatgcaaacactttaccaaatgagtttaagtttatgagatatcaagcagttacttgcgaacctaatcaacttgcagagaagaatttcacggtgaggcagttgaagtatttaactccaagggaaacggaattgatgctagtagtcacaatgtataatgaagaccatatcctgttaggaagaactttgaaaggtattatggacaatgtcaaatatatggtgaaaaaaaaaaattcaagcacttgggggccggatgcatggaaaaagattgtcgtttgtatcatttcagatggtagatccaaaattaatgaacgctcgctagcattactaagttcgttaggttgttaccaggacgggtttgctaaggatgaaattaatgaaaaaaaagtggcaatgcatgtctacgaacatacgacaatgatcaacatcacaaatatttcggaatcagaggtttcattagaatgcaatcaaggtaccgttccaatacaacttttgttttgtttgaaagagcaaaatcagaaaaaaattaactcacatagatgggcatttgaaggctttgcagaattactgcgtcccaatatcgttacattgttagatgctggtaccatgccaggtaaagattctatttaccagttatggagagagttcaggaatccaaatgttggtggcgcatgtggtgaaataagaactgatttgggtaagagatttgtaaagcttttgaatcctttagttgcatcacagaatttcgaatacaaaatgtccaatattttagacaaaacaaccgagtctaactttggatttattactgttctaccgggggcattctctgcgtataggtttgaagctgtgagaggccaaccattacagaagtacttttatggtgaaattatggaaaatgaaggttttcattttttttcttccaatatgtatcttgctgaagatcgtattttatgctttgaagtggtcacaaaaaaaaattgtaattggattttgaaatactgcagaagttcttatgcttcaacagatgtaccggagagggtccctgaatttattcttcagaggaggcgttggttgaatggttcattttttgctagtgtatattccttttgtcatttttacagagtctggagcagtggtcataatattggtagaaaactccttttgacggttgaatttttttaccttttcttcaatacattgatttcatggttttcattgagttcatttttcctattctttagaattctcactgtttctattgcactggcataccattcagcatttaatgtgttgtccgtcatattcctgtggctttatgggatttgtaccttatcaacattcatactgtcattgggtaataaacctaaaagtactgagaaattttatgttctaacttgcgtcatttttgcggtgatgatgatttacatgatattctgcagtatattcatgagtgtcaaatccttccaaaatatattgaaaaacgataccatcagctttgagggtttgattaccacagaagctttcagggatattgttatctctctgggctccacttattgtttgtacctaatcagttcaattatctatttgcagccatggcatatgttgacaagttttattcagtatattttattgagtccttcttacatcaatgttttgaatatctatgcattttgtaatgtccacgacttatcatggggtacaaagggtgcaatggcaaatccgctgggtaagattaatactacagaagatggtacgttcaaaatggaagttctggtctctagttcagagattcaagcaaactacgataaatatttgaaagttttaaatgacttcgatccaaaatcagaatctcggcctactgagccatcttatgatgaaaaaaagactggctattatgcaaacgttagatctctcgtgattatcttttgggtcatcacaaatttcatcatcgttgctgttgtcttagaaaccggtgggattgcagattatattgctatgaaatccatatcaactgatgacactttagaaactgcaaagaaggcggaaattcccttaatgaccagtaaggcctcaatttattttaatgtaattttatggttagttgcattatcggcattaataaggttcattggttgctcaatatacatgatagtaaggttttttaaaaaggttacatttcgctaa

SEQ ID NO: 25647 - DNA, 1629 bp, Saccharomyces cerevisiae
atggataatggtacagattcttccacgagcaagttcgttcccgaatatagacgaacaaactttaagaataaaggcagattctctgcagatgaacttcgtcgtcgtagagatacacaacaggtcgaattaagaaaagcaaaaagagatgaagctttggccaaaagaagaaactttattcccccaactgatggcgctgattctgatgaagaagatgagagctccgtttctgcggaccaacaattttacagccagttgcagcaagaactaccacaaatgactcagcaacttaactctgatgatatgcaagagcaattgagtgctactgttaagtttagacaaattttgtctagagaacaccgccctccaattgatgtcgtcattcaagccggtgttgttccaagattagtagaatttatgcgtgaaaaccaacctgaaatgttacaattggaggctgcttgggctttgactaacattgcatcaggtacatctgctcaaacaaaagtggttgttgatgctgacgctgtacctcttttcattcaactattatataccggctccgttgaagttaaagaacaagccatttgggccttaggtaacgttgcaggtgattcaactgactacagagactacgttttacaatgtaatgccatggagccaattttgggtctttttaactccaataaaccatctttgatcaggaccgctacgtggactttatccaatttatgcaggggtaaaaaaccacaaccagattggtcagtggtctcacaagcgttgccaaccttagcgaaattaatctattcgatggacactgaaactttagttgatgcttgttgggctatctcttatctatctgacggaccacaagaagctattcaagcagtgatcgatgttagaattcctaaaagacttgttgaattactgagccatgaatcgactttagtccagactcctgctttaagagctgtaggtaatatagtcactggtaatgacttacagactcaggtcgttataaatgctggtgtcttacctgcgttaagacttctgctaagctctccaaaagaaaatatcaagaaagaagcgtgttggaccatttccaatattacggctggtaatactgaacaaattcaagcggtaattgacgcgaacttgattcctccattagttaaacttttggaagttgcagaatataaaactaaaaaagaagcttgttgggctatttccaatgcctcttcaggtggtttacaaagaccagatatcataagatatttagtatctcaagggtgtataaaaccattgtgtgatttgctagaaattgctgacaacagaataattgaagttaccttagatgctcttgaaaatattttaaagatgggtgaagctgacaaagaagctcgtggtttgaatatcaatgaaaatgccgattttatcgaaaaggctggtggtatggaaaagattttcaactgtcaacaaaatgaaaatgacaagatttatgaaaaagcatacaaaatcattgaaacctactttggtgaagaagaagacgccgtagacgaaactatggctccacaaaatgccggtaatactttcggctttggttctaatgtcaaccaacaattcaattttaactaa

SEQ ID NO: 25648 - DNA, 1302 bp, Saccharomyces cerevisiae
atgaatgtaacttctccaaaagatgggaatcacagtttctcgaagaaaaatagatttaatacaaataaaccgcgattccacaaactaaatgagcaggcgcagagtataaatttaccagaagaccgtgattcaattgtttcaagtaatacaacgtcaattatgacagatgatgcatttgattacaatgagggcattgcatcgcgtaccaaaaatattaattctgatagtgatagaagcaatgataccataaaacaaaacaactacaataaaagggagaccggatataaccctttctacaatggatcagggatcaatcagcgatatacacagtttcgaaaaagagagtttgaaccaacacttgcagaaaacaaagccgaagagtacatatcggacgaagataatgtaaaaattgatgaagataatatagagaacgaactccagtttacgccgaaaattaaagaggctagtatactccgatctagtttactaggacaaagaaatgttttaaatactcggaatccaaaatcaaaagaatcacacattaaagtaaaacccatcatcaataacaagagctcctcacaaagaaaatctagtgcagcacttcggaaacaattaggaaaacccctaccgctgccgtatttgaatagccctaatagtgatagtacacccacattacagagaaaagaagaagtattcacagacgaagtgcttcaaaaaaagagagaattgattgagtctaaatggcatagacttctctttcatgacaaaaaaatggtggaaaaaaagctagaaagtttaagagaatacgaaaggaaaagaatgcctccacgaggaactgatgtttctagctctgagcaggacaattctttcaaaatatcgacgccaacaaaatcgtatgtttctttggagcaaaaacccttaccaaatctctctgctatgaataactttaatgatgttaccgacaataaggagaaagaagaaacgaacaacaatatattaaagttccaagcgcaacgagatccattacaaatactacagtctgagatcgaaatgcatactaagaaacttgacacgataatagagttactaaaagacgataccgattcaaaggaaaaaaggaaagtagtgactaatgacaacgcagcgcctgaacaaatggtcaacaaaggatggcggaaaaacgtgatgatgatctacaaaaaatcaggaaatattatgaaaaagtatagggaatatttcttatggacaatttgtattttaatattgttatattgcaatatatatgtgtattataggttttaa

SEQ ID NO: 25649 - DNA, 2379 bp, Saccharomyces cerevisiae
atgaccactcaagaatcgatcaaacctttggtagatagaatcctatcaaatcccctgcagttcaatgctgcaatgatctctaacaaatcgaataataatgatacttccgccgcgccggaaaatagctcgtatattgtgataggaaaacagcataataacaatagtaatagcacagctattgctgcaacggccgaatccaagcaaataaaagaaaataacttgatagacaggccaaacggaaagaaaaccaacactgttcctaaatctatggctgaagctttattgttgtatacttctaaaaatgataaagatgctgcagatgctactggtgccaagaagtcagcggagctttctacggagctttctacggagcctccttcctcttcttcggaagatgacaaagtaggaaaagaggaagaggaagagggtgaaatatttcatgaggcaagagactatgtagaaccccgaaaagctagtttgaaggaacgcgacaacgcagataagggcgatggtgaagacatcggcgaagacatcggtgaagacatcggtgaagacatcggtgaagacattggtgaagacattggtgaaaacttgggttctccattagcaaccattgatgattcatctaatgagaatgaaaaggaaaaaagaaaggaactgtctacaagcattagcagtgatgacgaaatagaagacgacgaggatgaggatgacatggattatgattctagtgctatggaaaaagagctccctgaagaagaggagaacgattccagctccaaaatttctgaaggcgaaaaaaagagtttatatcaagatttaatggaaaatagtacagtggaagtaaatcggtacgaaccagtaaacaacaccaaagaaaatggaaacaggaatccaaagggagaggaggaggaagaagaggaagaagatctgaaacataaatctaggtcaatcacccctccggttacaatatcaaatctatcaaacttttaccaattcaatgaaaatatcaatgatcgtggttctttaaactctactagaattgttaaaaattggggcgacaaattcaccaatttgaagcctcgtggccttttgaatcatggtgttacttgttacacaaatgctgctgtacaggctatgttacacattccttcgatacaacattatctttttgatatactaatggggaaatacgatagcaccatctcaaaaaattccgtttcctatactttagctgaaacaagtaaaaaaatgtggttaccggtctcaaaaaaccctagaaagaacgtttcagcttcctacattaatccaaaacatttgatttccagattggatgacattaattgtatgatgagcgaatggcagcaggaagattcacatgagtacttcatgtctctgatgtcaagattacaggaagattctgttcccaagggtcataaacttatagaatcgataatatatgacatattcggtggtcttttaaagcagatcgttacttgcaaatcttgtggcagtatatctaaaacagaacaaccattttacgatttatcgttgcacttgaaagggaagaaaaaacttgatccaaattctgacctgtcgagtgatagcattaacggcacttcagccaccacttctaccactacctccaatgctgccacaaaaccatctctttcatcctcttcatctgtcaatttaaacaatggctcaccatttgccgctgccagtgatttaagttcagccaaccgcagattttctattgaaaaatcaattaaagatttcttcaatcccgaattaatcaaggttgacaaggagcaaaagggttacgtttgtgagaagtgtcacaagaccacgaacgccgtgaagcatagttcaatattaagggctcctgaaactttacttgtgcatctgaaaaaattcagattcaatggcacgtcctcatcaaaaatgaagcaagctgtttcttatcctatgtttttagatttgacggaatattgtgagagtaaagagctacctgtcaaataccaactattaagcgtggtggttcatgagggccgctccctttcttcaggtcactacattgcccactgcaagcaaccagacggtagctgggccacttacgacgacgagtatattaatataatatctgaaagggacgttttaaaggaacccaacgcatattatctcctatacacgaggctaactccaaaatcggttccattgccattggcgaaatctgccatggccactggtaatgttacctctaaatccaaacaggaacaggctgttaacgaaccaaataaccgcccattgaagattaatagcaagaaaaataacagaaaaaaatggaaaaaaaataaaaaaaggaagttcaccaaatga

SEQ ID NO: 25650 - DNA, 990 bp, Saccharomyces cerevisiae
atgaggtctattaaatgtgtgataattggtgatggtgcagtaggtaaaacgtcacttctaatatcatatactaccaattcgttcccaacagactatgttccaacggtttttgataattattctactacgatagctatcccgaacggaactgcgagtagccccctagagcttgacaatggtaatgataaaagaggttcactttcatctgccagttcttcaccaagtacggacagaaaactatataaaatcaatttatgggacactgcaggacaggaagattacgatcgtttaagaccgttatgttatccccaaacagatatttttttaatatgtttctcagtaagcgaacatgctagttttgccaatgtcacagaaaaatggctacctgaactgaagcagacttccaatattgaaggtacctctctttatactaaattagggaagtatccaattctattggtaggcaccaaaagtgacctaagagatgatccggcaactcagaaaaaattgcaggaagcaaactccgattacgtgtctcaagaggaaatagatgaactcgtacaaagatgtgggtttatgggctataccgaatgttcagctgctacccaagcaggtgtccgggaagtctttgaacaggcggtgaggtacgctatctacgaaccagaatcccctaaccaaaaatcagcaaatcatactctaactgatgaattaacgactgcaacaaccaacaccaatggagataaaaatattcgagaacaaaaacagcaaccacaccataataatagtacagatagtactcttccgaaaggaagcttacagcaggagaaggaagctctcaatatcaaacccacaaaaaagggacaaaaagacaaaattcacgagcaatcaaaaagcaaaggtagtaaaattgcctcaaataatatcatcacaacaagcaagctaaaccaaagacgagaaacgacaagaagaaaaagaagtcaaagtgtgtaa

SEQ ID NO: 25651 - DNA, 1101 bp, Saccharomyces cerevisiae
atgcaatcgagcttacctcaatttacgttcaaatggcccaaaggacccgaagcaattattctgacaggcacgttcgacgactggaaaggtactttgccgatggtgaaggaccccagtggcgccttcgaaataacgctgccagtaacgtttgatagccctagcagcaagttttatttcaagtttattgttgatggccaatggctgccaagcaaagactacaaggtgaacatcgacgagggagtggaaaacaactttattaccgaggaagacgtaataaagcaacgcgaaaatggctctagcacgctggtacctgaaagtgccggattagctgtttcaaagaatgcccctcttatcgaaccagaagctgaaaaacgtgcaaaaaaattaagaaagttcaagatcaagagagtgatcaagacaaataaacaaaccggagaaaggtcgatattttcccaagaagtggttgaattgcccgatagcgaggatgaaacccagcaggtgaacaaaacgggcaagaatgcggatggcttaagcggtactacaacgataattgagaataatgttggtgtaaacgaggaaaaagcaatcaagccgtatgaagagaatcaccccaaagttaatctagttaagagtgaaggatatgttacggacggtttgggtaagacgcaatcttctgagtctagattatatgaactatcggccgaagatcttgaaaaggaagaagaggaagaggacgaagataaaggcggcggtaaggacaccagtacaagtgcagacgctgaagcttcagaagatcaaaataaggaaccattaagtaaatccgctaaatttgaaaaaccggaagaaaaagtacctgtaagctcaattacaagccatgctaaagagacttctgtgaaaccaaccggcaaggttgcgactgagactcaaacttacgagacgaaacagggcgctcctaccgctgccgcaaaaaaaatcgaagctaagaaagctactagaccttcgaaacctaagggcacgaaagaaacaccaaataaaggtgtccaaaagaaccctgctaagaatggagggttctttaaaaagttggcccagcttttgaagtga

SEQ ID NO: 25652 - DNA, 5247 bp, Saccharomyces cerevisiae
atgacttctaagccgtctactagaaatgattatttaccaagggaaactcacaatggcgaatatactggtgattctcccgaatggcagttgcagattaatatcacaaacaaaataggtggtataaatggagatatttggttgtcaagggacggaaggagtgttaaatggtgtattgaagaccagtgcttacgtcagtttacttataatcaaaagatcatcaaagctgggtacattgattttgaaaagacaccagattgttttgtggtagttctctctgatattgcgcatgtatatatgttgaaaaatgggggttctacgactgtatgtttcccattccagataggtaatgcattctggtatgcaaatggagtaattttagagagagagacttcagcgtccttcatggatggtggctacgatttaaaacccattgagttcgatttaaaacataaatacatcactttgacggatccgatggcgcctttcggcttgatttcgatcacaaatacctttaaaggcggtataaatagcgcttcaggtaacaaaacggatatcctgcaagactttcagctcgtgctcttcccgagtgacaaggacaagtgtatagctgtttttttagatcgaaattccaaagtgttgcgattttattacagtagaattctatcatcagatcagtcacggaagggagagctaacaatttcctcgaccaaaaaaacaggtttggacgcagcaggcaatagccaaaagagtggcgggattagcaaagatttgcgtaagttttcacatttgacgcgccggtcgacgtctataaactctaactctcatgatttcaatgcagccgaaagagtacttagtggcaatgttggcaacgcttcaggcagaacagatattttcgctttaccttcttcttgttcaagaaggagcttatctgcgaccctagatagaatggggaacaatattgccccgaccaatagagctgcaccttctggattttttgactcgtcatcagcaaatactgctactcactctaatataacgcctgtatcacaaccaatgcaacagcaacagcaagaatatttgaaccaaacagcgacctcttctaaggatattgttttgacggaaatatcgtctttgaaattaccggatgatatcatttttacttcacgacgcttgagctctattttaagtaaattaaagttcctatcgttgagatttgaacgtcgagaaggacttttaatatttcatgagcccacacatttctgcaaaatctggttgattgatcttttacccgatgttctggattctattccattcaaaatatacgggaactctccgcaaaacatgatcagactagagaacttaaagcttaaggaaccctcaagaatacaagctatgtatattcatgaactccttgaaagttgcctgattttggtgtcggagggacagaataaggaagaatacaaagcatgtctatatgaccccttcgttaaaattacatccccttccaaaaatatctccgaagagctcactaaacaaaattctcttccttccttacagaaactattcccttatcccgagactagtttcaccaaactgtgcttcgaagccgtcaagtatattacttctcctgcattcaatatttcatttatatttctatggcaatctgcatattcgatacttctttcaagggctaacgacgacgtagttgggggtttgaaaatggagcacgatgctttttcactggttctttcattgctgattttaccgatacctagctcctctgctcaagaataccaggagtacaaagaaatatatgaacgcgacctgtttcagcatttaaagcaggactcagaaataacaagctctgtgctaccaagaattgttattggattgcatttaataagggaggaatattccctgaatgtattgtgtcgaaatgagcatgcgttgttaggacagtttctaagattcgctactgccgcgatgggctggcctgatctgtggcaatcttactatgtaccgaaaatggattcagaatcgaaaactttcctacatccaagggaacaaaattccactttttttcatcccttagatgaaccgccatcgattaccaagtcgttatacagcataactgaaaacagttcaataccattatgtccgttcattagtttctcgagacttgttgcaaccgatacacaggtcgaattacgcattactccaagaagtttcaaaatcttgggcttgtatgaactcgtacactctccaaattttttaccggattatgttttaggcatcctttccagctttaaagtggataaagacgagttacaaacatatcccttaggcattttggtgcctttacaaaacattttaaaaattctggaagataagctatctgaagtaagagacaacttggagttattagatagggccgatttacaaaggtgtagtgccattatcaatagtataagaagtgattctaaagaagttctcaaaagaggccaaagagatagttatatgttatgcaaagtgccactcgccaagaacagaagctctttgtctaagaagcccagtgacatatattcaatattatccgagattgtgaaaagtgcaagtcaagttccactggatggatcagctatgaggatgtcgaatattcaggatgatgaagatattgatgaaggtcgatctctcaaattaaatgcaggactgattttttcagaagataaaagatttactcatgttgtatcactattagcttattacaggcccacaaaaactcaattttttaccaccaagacagaatatgcccagatactagctcaaaagaaatatttcgctaaaatcatggctttgaggacatgtacaaatggtgttggctggggtgcagtggcatatgcaacagaaaaaccaatatctacccaaaaatgggtcattcaacccctcaacttaatttccgtgtttcctgatgacacaaagataactgtgaaagctccagaagatatagcacacgatattgtggagtgggggcaatttcatgccggtgttagctccggcctccgtatctcaaagaaggcaactggaattacaggtagttggattgcatttaataagccaaaagaactagatgcttatcacggtggtttccttctcggactgggacttaatgggcatttgaagaatttagaggaatggcatatatacaattatctaagccccagaaatactcacataagtattgggttacttttgggaatgagttcaagtatgaaaggtagtatggactctaaactaatcaaagttattagtgtacacctagtggcctttcttccaagcggatctagcgatttgaatatagatctaaaactacaaactgctggtattatagggatgggtatgttatatttaaactcaaggcataaacgaatgagcgattcaatttttgcccagctggtgtcactgctcaatgtaaatgatgaaatggttgctgacgaagaatatcgattagcagcgggtatatcgctgggcctcataaacctaggggctggtcagacgaaactgagaaagtgggattcatcattgttgggcttgggggacgatcttccggaagatgtttatgactctagtgatgttgaacaaaatgtaatgtatgaagacctgactacgaagttattagagatcgtcacaagcacatatgatgtagaaaacgattggataccagagaattcgcaaattggcgcagtaattgcaatcatgtttttatttttgaagtcaaacaattttggaatttccaacatgcttaaagttgacttaaaggaaatattaaaagcaaatattaacacccgccctgaattattaatgtaccgagaatgggcatccaatatgattttatgggaatttataggcgacgacctatcgttcatcatgaaagatgttgatattggagtaaaatttagtgaacttaataccgatttgcttcctatatattacactatggcgggtaggatcttagccatgggtattagatttgcctctactggaaatttgaaaattcggaatatactgctttctctcgttgataagtttctgcctctttatcagtacccaggaaagcagaatctagactttaggttgacaatttctgttattaacgttttaactaatgtcatcgttgtttctttgagcatggttatgtgtgccagtggcgatttagaagttttgaggagggtcaaatatcttcatgaagttgcatctggtccatattcagacttatttcaagaaattcctagttctaaaagtgatgtttcaggtgtaacacaggtgacttcaaacactaacacgcctggaaatagtgatcgtgaaagggttgatgagaccgctgcttctctcgatgacgaaaggtcctcaaatggcagtgatattagtgatccaacagcatatctagaagacaaaaaggatatagatgaccattacggtaagtttatttcgacaaatcttgcactgggttttcttttccttgggtctggacaatacgctctcaatacttctactttagaatctatcgctttcttaagcatgtccgttttacccacatatacaactccacatcccttacaagaattgaagcatttctggagcattgctgtagagcctcgttgccttgttataaaggacatttccactggtgacgcagtaaacaacgttcctattgaattggtggtcgaggaagacgtcgaaaaagaagaagtaataagagagatatcaacaccttgcctgcttcctgatttctccaaaattaaatctattagggtaaaaatgcatggttactttccactggaagtaaatttcactaaggactactcagcttctgatttttttagtggcggtacaattatttatatacaaagaaaatccgaaagtgttttcgagaacaaagcctcttttaggaacgtagaagatattcatgtggcactcaaaagaaaggcagcagaatctaaaaattattcaagattaaacctaaaaaatgaacaaggaaataccacctcttcgcaactggttgaaagtttgggtattcaagatttgacaatggtggaactcgatactcttttgagtgcaggaaataatacagcattaacggattcagaatcttataatttaggtttgctgtgttcagataaaaacagtggagatattttggattgccaactcgaattgtggtacaaaagctttggaccacatgatgaataa

SEQ ID NO: 25653 - DNA, 1503 bp, Saccharomyces cerevisiae
atgtcaattatgccagttaagaacgccttggcgcaagggaggacgctcctcatggggaggatgcctgctgtaaagttttctacaagaatgcaattaagaaatagaactgcggtgctatggaatagaaagttttccacgcgtcttttcgttcagcaacgacgcagttctggagagattgtggatcgtgccaaagctgctgccgcaaatagcggaagaaaacaggtctccatgaaatgggttgttttaactagtttcaccattgttctaggaaccattttactagtgtcaaggaatgatagtacagaggaggatgctacagagggcaaaaaagggagaaggacaagaaaaatcaaaatatttaacaataattggctctttttctgctattctactttaccgctgaatgcgatgtctcgattatggggccaagtaaattctcttacgttacccatttgggttagaccatggggttacaggttatattctttcctttttggagttaacttggacgagatggaagatcctgatttgacacattatgcaaatttatccgaatttttctatcgtaacataaaaccaggcacacgtccagtagcacaaggcgaagacgttatagcttctccaagtgatggaaagattttacaagttggtataatcaactctgaaactggcgaaatcgaacaagtcaagggaatgacatattccatcaaagaattccttggcactcactcccaccccttgatgtctaagagtgcatctagtctagatttgacttctgatgaggaaaagcatagagaattcgccagggtaaatagaatacaattagcgggttccgaagacactgaacagcctcttcttaactttaaaaacgagggcgatcaatctgttcgagagttcaaaccaagtgtgtccaaaaatatacatcttttaagtcaactttctttaaactacttctctaatgggttttcgtgctctgagcctcatgatacggaacttttctttgccgtcatttatttggctcccggtgattaccatcatttccactctccagttgactgggtttgtaaggttcgccgccatttcccaggtgatttattctccgtggcaccttatttccagcgtaacttccctaatcttttcgttctaaatgaaagagttgctttgttgggtagttggaagtacggattttttagcatgactcctgttggtgcaacaaatgttggttcaatcaagttgaattttgatcaagaatttgtgacaaattcaaagagcgacaaacacttggaaccacatacctgctaccaggcagtatatgagaatgcaagtaaaatattgggagggatgcctttggttaagggtgaagaaatgggtggctttgaattgggtagcactgttgtactttgttttgaagctcccactgaatttaagttcgatgttagggttggtgataaggttaagatgggacagaaattaggcataattggaaagaatgatttaaaatga

SEQ ID NO: 25654 - DNA, 2271 bp, Saccharomyces cerevisiae
atgtataatagcagcaccaatcatcatgagggtgcacctacttcaggacatggctattatatgtcccaacaacaagaccaacagcatcaacaacaacaacaatacgccaacgaaatgaatccgtatcagcaaattcctagaccgcctgctgcaggatttagtagcaactacatgaaagagcaaggctctcatcaatcgttacaagagcatttacaacgtgagacaggtaaccttggcagcggttttacagacgttccagccctgaattatccagccacaccaccaccacataataattacgcagcttcaaatcagatgatcaataccccaccgccgtcgatgggtggtctttatagacataataataattcccagagcatggttcagaacggtaatgggagtgggaatgcacaattaccccaattatcaccgggccaatattctatagagtcagagtacaatcaaaatttaaatggcagttcttctagtagtccgttccaccaaccgcaaacgctacggagcaatgggtcatattcaagcgggttaaggagtgtgaaaagcttccagaggttacaacaagaacaggaaaatgtccaagttcagcaacaactttcccaagcacagcaacaaaattcccggcaacaacagcaacaacttcaataccagcagcagcaacaacaacaacaacaacagcaacatatgcaaatacaacaacaacaacagcagcaacaacagcagcagcaatcacaatctcccgttcagagcggctttaataatggtaccatatcaaactatatgtactttgaaagacgaccagatttgttgactaaaggaacgcaagataaagcagcagctgtaaagttgaagattgagaacttttaccaatcctctgttaaatacgccattgaaagaaatgaaagaagagtggagttagaaacagaactaacttctcataattggtcagaagaaaggaaatctaggcaattgagttctttgggtaaaaaagagtcacaatttttaaggctgcgtagaacgagattatcgttagaagatttccacactgtgaaagtcattggaaaaggggcatttggtgaagtcagactggttcagaagaaagacaccggaaaaatatatgcaatgaaaactttattaaaatccgaaatgtacaaaaaggaccaattagcacacgtcaaggctgaaagggatgttctggctggaagtgattctccatgggtggtttcgctatattactcattccaagatgctcaatacttatatttaatcatggaatttttgcccggtggtgatttgatgaccatgctaatcaggtggcaactatttacagaggatgttactagattttacatggctgagtgtattttggccatcgaaaccattcataaattaggattcattcacagagatattaaaccagataatattttgatcgatattagaggtcatataaaattatctgatttcgggttgtctacggggttccataaaactcacgactcaaactactataaaaagcttttgcaacaagatgaggcaactaatggtatttccaagccaggtacttacaatgcaaatacaaccgatactgcaaataaaaggcaaacaatggttgtggattctattagtctaacaatgtcaaacaggcaacaaattcagacatggagaaaatcacgtcgtttaatggcatattctaccgtaggtacaccagattatattgctcctgagatatttttataccaaggttatgggcaagagtgtgattggtggtcacttggagcaattatgtacgagtgtctgattggttggcctccattctgttccgaaactccacaggaaacgtacagaaaaatcatgaattttgagcaaactctacaatttcctgatgatattcatatctcttatgaagccgaagatctaatccgtcgactattaactcatgcagaccaaagacttggtagacatggtggtgcagatgaaataaaaagtcatccattttttcgcggtgttgattggaatacaatcagacaagtagaagcaccgtatataccaaagttgagctccatcaccgatactaggttcttcccaaccgatgagttggagaatgttccagattccccagctatggcacaagctgccaaacaaagggaacagatgacaaagcaaggtggaagtgcgccagtcaaggaagatttaccttttattggctacacttactccagatttgactatttgacaagaaaaaatgcgttgtag

SEQ ID NO: 25655 - DNA, 1641 bp, Saccharomyces cerevisiae
atgtctcaagtgcaaagtcctttgacagcaacgaactctggtttagctgtcaataataacacaatgaactcacaaatgcctaaccgtagcaatgttagattggtcaatggtactttacccccatccttacatgttagctctaacctaaatcacaacactggcaatagctctgcctcctattctggctcacaatcacgcgacgattccactatagtcgggctgcactataagataggtaagaaaatcggtgaaggttcatttggtgtactttttgaaggtacaaacatgatcaatggattaccagttgctatcaagtttgaaccaagaaaaacagaagccccacagctaaaggacgaatatcggacctataaaattttagcgggaacacctggtataccacaagaatactactttggtcaggaaggattacataacatattggttattgatctgcttggtccttctttagaagatttattcgattggtgtggaagaagattttcggtaaaaactgttgtacaagtcgcagtacaaatgataactttaattgaagatttgcacgctcatgatttgatataccgtgatattaaacctgataattttttgatcggaagaccgggtcaaccagatgctaacaaagttcatctaattgactttggtatggccaaacaatatcgtgatccaaaaactaaacaacatattccgtacagggaaaagaaatcattaagtggcacagcaagatacatgtcgataaatacacatttgggtagagaacaatcgagaagagacgatatggaagctatgggtcatgtcttcttttatttcttgagggggcagctaccatggcaaggtttgaaagcaccaaataacaagcaaaagtacgaaaaaattggcgaaaagaaaagactaacaaatgtttacgatttagctcagggtctcccaatccaatttggtaggtatttggaaatagtcagaaatttatcgtttgaggaaactcctgattatgagggctaccgcatgttacttttatctgtgttggatgatttaggtgaaacagcagatggacaatatgattggatgaagctgaatggtggccgtggttgggatttgtcgataaacaaaaagccgaacttacatggttatggtcacccaaatccaccaaatgaaaaatcaaaaaggcatagaagtaaaaaccatcaatattcatcacccgatcatcaccatcattacaatcaacagcaacaacaacagcaggctcaggctcaagcacaggctcaagcacaagccaaagtgcagcaacaacaattgcaacaagcccaggcccagcaacaggccaatcgttatcaattacaaccagatgactcgcactatgacgaagaaagagaggcgtcgaagcttgatccaacttcgtatgaagcatatcagcaacaaactcaacaaaaatatgctcagcaacaacaaaagcaaatgcaacagaaatccaaacagtttgccaatacaggtgccaatggtcaaactaacaagtatccatataatgcgcaaccaacggcgaacgacgaacaaaacgctaaaaacgcagcgcaagatagaaatagtaacaaatcatcgaaaggttttttcagtaagctaggatgctgttag

SEQ ID NO: 25656 - DNA, 117 bp, Saccharomyces cerevisiae
atgcaaccgatcaccactgcttccacacaagccactcagaaggataaatcctctgaaaagaaagacaactatataatcaagggcctcttctgggatcccgcctgtgttatcgcttaa

SEQ ID NO: 25657 - DNA, 1581 bp, Saccharomyces cerevisiae
atgcctgactctaagtacacaatgcaaggttataaccttgttaagctattaaaaaggctagaagaagccactgcaagattagaggatgtcaccatctatcaagaaggttatattcagaataaattggaggcatctaaaaataacaagccttccgactccggggccgatgcgaatactacgaatgaaccttctgcagaaaatgctcctgaagtagaacaagatccgaaatgcataactgcgttccaatcttacatcggtgagaatattgatccgctggtagaattatcaggaaagatcgacacggtggtcttagatgctttgcagttgctaaagggaggctttcaatcgcaattgacttttttaagagctgctgtgagatcaagaaaaccggattattcttctcaaactttcgctgattctttaagacctatcaacgaaaatattataaagctgggtcaattgaaggaatcaaaccgtcaaagcaaatacttcgcatatttgagcgctttatctgagggtgctcctttgttctcctgggttgcagtggacactcccgtgtctatggtcacagatttcaaggacgcagcacagttttggactaatagaattttgaaagaatacagagagtctgatcctaatgctgttgaatgggttaagaaatttttggcctctttcgataatttgaaagcctacattaaagagtatcatactactggggtttcctggaaaaaagacggtatggattttgctgacgcgatggcacaatcaacgaagaatacaggtgctacttcatctccttcgccagcaagtgctacagcggctccagcaccaccacctcctccaccagccccaccagcttccgtctttgaaatctctaatgatacaccagcaacgagtagtgatgctaacaaaggcggtattggcgcggtcttcgccgaactaaatcagggtgaaaatatcactaagggtttgaaaaaagtagacaaatcccaacaaactcacaaaaatcctgaattacgtcaatcctctacagtttcttccacaggaagtaaatccggtccaccaccaaggccaaaaaagccatcaacattgaaaactaagaggcctcctagaaaggaattggtaggaaacaaatggtttattgagaattacgaaaatgaaactgaatctctggttattgatgcaaataaagatgagtctatcttcataggtaaatgttctcaagttcttgttcaaataaaaggaaaagttaacgctatctcgttgagtgaaactgagtcatgcagtgttgttcttgattctagcatttccggtatggatgtcatcaaatccaacaagtttggcattcaagttaaccattccctacctcaaatctccattgataaatctgacggcggtaacatctatttatccaaggaatccttgaatactgaaatctacacctcgtgctcaactgctattaacgtcaacttaccaatcggcgaggacgatgattacgtagaattcccaatccctgaacagatgaagcatagcttcgctgatggtaagttcaaatctgctgttttcgaacatgctggttaa

SEQ ID NO: 25658 - DNA, 1602 bp, Saccharomyces cerevisiae
atgcgaattgcccgaatagtgaagcatttgcatgtcatacaacatctcgctgatttaccaaataacaagatttcctattgcataaaaattgatcttgtgcaatccttcctatattgttgtttcctatagtccagttctattactgaaacttatcgattaaagtgcatgtgaaaattcgcgggaagtgacgtttttttttttttttctttggcgttctgccaatatgaaagattagatagcaaaaggttaatggatactgaattcatgaatttgaaaatcatctaccatggattcgaaaacagtattactaactgattcaggggaaacaatgggattctttattcctcagagtagtttgggaaacttgaagctttacaagtatgttgcttatcttattgcaccctaaatcttctgtggcaagaaaaataaatactaactattgtaacattaaattactaatctgactttaggtatcaaagtgatgaccgctctttcctttcaaaccatgtattgaggcccttttggagaaagtttgcgactatttttccactatggatggcacccaatttggtaacattattagggttctgctttattatatttaatgtgttaacaacactttactacgacccgtattttgaccaggaatcgccacgttggacctatttctcctatgctataggtttgtttttataccagacttttgatgcttgcgatggaatgcatgcacgtcgtacaggccagcagggccctctaggggaattgtttgaccattgtattgattcaatcaacacaactttgtcaatgattcctgtctgttccatgacaggtatgggttacacatatatgaccattttttcacaatttgcgatattgtgcagcttttacttgagcacatgggaagagtatcacacccacaaactttatctagctgaattctgcggtcctgttgaaggtattattgttttgtgtatttctttcattgcagtcggaatttacggacctcaaaccatctggcacactaaagtagcgcaattctcctggcaagattttgtgtttgatgttgaaaccgttcatctaatgtatgcattttgcacaggagcattaatatttaatattgtcacagctcatacaaacgtcgtgaggtattacgaatcccaatcgaccaaatctgcaactccaagcaaaactgcagaaaatataagtaaagcagtaaatggtcttttgccattctttgcatacttctcttcaatttttaccttagtcttgattcaaccatcttttatttctttggctttaattttatcgattggtttttcggttgcctttgtagttggtcggatgattattgctcatttaaccatgcaaccattcccaatggtcaatttcccatttttaatcccaactatccaattggtattgtacgcatttatggtttacgttttagattaccaaaaaggaagcatagtttctgcattggtttggatgggactcggcttgacacttgctatccatggaatgttcatcaatgatattatctatgacatcactacctttctggatatttacgctttatcaattaaacatccaaaagaaatttag

SEQ ID NO: 25659 - DNA, 2541 bp, Saccharomyces cerevisiae
atggaactagagcccactctttttggtataatagaggcattggctcctcaattattgtcgcagagtcatttgcagacatttgtatctgatgtagtcaatttactgcgatcatccaccaaatcggcaactcaattaggccctttaattgatttttacaaattacaatcactagattcgcctgaaacaacaattatgtggcataaaattgagaaatttctcgatgctttatttggaatccagaacaccgatgatatggtaaagtacctctctgtctttcaatctttgcttccatcaaattacagagcaaaaattgtccaaaaatcatctgggctcaatatggagaaccttgctaaccatgaacatttacttagcccagtgcgggctccaagtatatatacagaagcttcatttgaaaacatggaccgattttctgaaagaaggtccatggtatcttcgcctaatcgttacgttccctcttcaacctacagttctgttactttgagacagttgtcaaatccttattatgtgaacactatacccgaggaagatatcctaaaatacgtatcatatacattattagctacgacatcggcactatttccgtttgatcatgagcaaatacaaattccgtctaagatacccaattttgagagtggacttttacatttaatatttgaagcgggtttattatatcaaagtttgggttataaagtggagaagtttaggatgttgaatatatctccaatgaaaaaagcattgattatagaaatttcagaagaattacaaaactacacagcatttgtgaacaatctggtctcttcagggacagtagtgtcattgaaatcgttatatcgtgaaatatatgaaaatataataaggcttcgaatatactgtaggtttacagaacaccttgaagaattgagcggagatacattcttgattgaattaaatattttcaaatcccacggagatcttactataagaaaaatagcaacgaatttgtttaattcaatgatttctctttattatgagtatttaatgaattggttgactaaaggtctactccgagctacttatggagaattcttcattgctgaaaacactgatacaaatggtacagacgatgattttatttaccacattcctatagagttcaaccaagaaagagttccggccttcataccgaaagagttggcatataaaatattcatgatcggcaaatcgtatatcttcctagaaaagtactgtaaagaggttcaatggacaaacgaattttctaaaaagtatcatgtcctgtaccagagcaattcttatcggggaatatcaacgaacttttttgaaattataaatgatcaatattctgaaattgttaatcatactaatcaaattctaaatcagaagtttcattacagagacgtggtatttgcgttaaagaatattcttctcatgggtaaatctgattttatggatgctcttatagaaaaggccaatgatattctcgcgacaccatcggattcattgccaaattataagttaacaagggttttacaggaagccgtgcagctttcttccttaagacatttaatgaatagtccccgtaatagttctgtcattaatggattggatgcgagggtactcgatcttggacatggatccgtgggttgggatgtttttactttagattacatcctctacccccctttgagtttagtattaaacgtaaatcgtccttttggcaggaaagagtatctacgaattttcaattttttatggagatttaaaaagaacaattatttctatcaaaaggaaatgttgaagagtaatgatataatcagatcattcaagaaaatcagaggttacaacccgctcatccgtgatattatcaataaactttctagaatcagtatacttagaactcaattccagcaattcaactcgaagatggaatcttattatttgaactgcattatagaggaaaattttaaagaaatgacccggaaactgcaacgcacagagaataaaagccaaaaccaattcgacttaattagattaaataatggcaccatagaattaaatgggattttaaccccaaaagctgaagtactaacaaagtcttcaagcagtaaaccccaaaaacacgcaatcgaaaagacgctgaatattgatgaattagaaagtgtacataacacgttcttgacgaatattctttctcataagctttttgcaactaacacaagtgaaataagcgttggtgattattctgggcaaccatacccaacttcattggttttacttttaaattcggtttacgagttcgtcaaagtttattgtaatttgaacgacattggatacgaaatcttcattaaaatgaatctcaatgatcacgaagcatctaacggattattgggaaaatttaatacgaatttaaaggaaattgttagccagtataaaaattttaaagacagactgtatatttttagggcagatttaaagaacgatggcgatgaagagcttttcttattgagcaaatcgctccgttaa

SEQ ID NO: 25660 - DNA, 2022 bp, Saccharomyces cerevisiae
atgtcaacgcactcaaacgactacttttctgcttcttccggaatggtctctgagacatcgtccgaggtttcttcgataaactcttcacagcctgtatcattctctaaggcttctattgctgctccggttccatgctctgatctacacagcaccaagtcgaacgatgcatcgagaaaattgtctattagtaggacgttaactaatcggctcaacgacattaaaaaggctgtcgatgacgacaacttgcagacggaagaaaattccgcagacgttaataaaatattagaatctagatttgacgtggccgatgccattaggctacagcacaatgagtcagtccagtcaaagttaaacatcccagtcacacacaccacgactgcaggcgcctcgttgtcggcaccatcttcctctgctttctctgcttcttctattcaaaatgatactacagaacataaagcttccatggactccaaactcatgaggaatagactatatccggcttccacgaaacactccggtaaggatcttgaggcccaaggaataaccgaattcgagcctgatgaaccgactgtaaaaaaagtattcaccaacaagtctaccgggcagctggaactgccccccgacggtggttatggctgggtcgtgacattctgtgtgttcttgaccatgttttccacgtggggctgcaacgcatccttcggtgtcgaccttgcctactacttaaaccatgatacttaccctggtgcttcgaagtacgattatgccttaattgctggcctaactgtctttctcggtcaactcttatccccccttgtgatggcactgatgagaataattggtctgcggaccaccatgctttttggtgatgctgtaatgcttgccgcatatctcttggcctcctttactaccaagttatggcaattgtatgtcacccaaggttttatggtcggttgttcaatatcactgattttcgttccagcaacaaccgtcttaccaggatggttcttgaaaaaaagagctgtcgcaatgggtgtctcattattgggtaccggtgctggtggtgtcgtttacggtttggctacaaacaaaatgctttctgactttggaaatacccggtggtgccttcgtatcataggcatatcgtgtagcataagtgttctagttgctattgcgctcttaaaagaaagaaaccctacacctgccataggattgaaatcgcctcgggccatgtttgaacagctcaaagcaatgttttcattaaaggttataactaagccatttgtggtacttattgcattatggttcatgttcgcattatttgcctacaatatgatggtttttactttatcttcatacgcaatctcgaaaggattatcatcgcacgacgcttccacattgactgccattttgaacggctcgcaatccatcggaagacctctgatgggtttagcgggagataagtttggtagggcaaacgtaacgatcgtattaaccactttgttaacaatatatatgtttgcgttctggatccccgctcatacgtttgttcaactcatctttttttcaattctagttggctcatgcgttggtgtcgccaacgtcatgaataccgttctgattgccgatatggttaaaccagaagagtttttgcccgcttgggccttcgtcaactactgtggtgcgcctttcttattggtttgtgaggtgattgcccaggcattgacggtggagaaagataagagcaatccttacttacatgcacaaattttttgcggttgctgctttattgccgcactaattttaatttctatccttcgtgaatattctatcaggatgaaattaacggaaagacaagctatgacaaacgagaagttaaaagaatggaaggcaagcgaatacgataccgattctgccgatgaagattggggtaaattaaaagaaagaaagactaaatatgaccttcttttaggtccgggcattaaaaaatacttcctaagaatggtatatccaatgaaggtctag

SEQ ID NO: 25661 - DNA, 2643 bp, Saccharomyces cerevisiae
atgacttacggtggtagagatcagcaatataacaagactaactacaagtctagaggtggcgacttccgcggtggaagaaactctgatagaaactcttacaatgacagaccacaaggcggtaactaccgtggtggtttcggtggtcgttccaattacaaccaaccccaggaattgatcaaaccaaactgggatgaagaattacccaaattgccaactttcgaaaagaatttctatgttgaacacgaaagtgttcgcgacagatcggacagtgagattgctcagttcagaaaggaaaatgaaatgactatttccggacacgatattccaaagccaatcaccactttcgatgaagctggtttcccagactacgttttgaatgaagtgaaggctgaaggatttgacaaaccaactggcattcaatgtcagggttggccaatggctttatctggtagggacatggttggtattgctgccactggttccggtaagactttgtcttattgtttaccaggtattgttcatatcaacgctcaaccattattggctccaggcgatggaccaattgttttggttttggctccaactagagaattggctgttcaaattcaaacagaatgttccaagtttggtcatagttccagaatcagaaatacctgtgtctacggtggtgttccaaaaagtcaacaaatcagagatttatctcgtggctctgaaattgttattgctactccaggtcgactaattgatatgctagagattggtaagactaatttgaagagagtcacttacctggttcttgatgaagctgatagaatgttagatatgggttttgaacctcaaatcagaaagattgttgatcaaatcagacctgatagacaaaccttgatgtggtctgccacttggccaaaggaggtgaagcaactagccgctgattacttgaatgatccaattcaagttcaagttggttctctagaactatctgcctcccataatattactcagatcgtcgaagttgtttctgatttcgaaaagagagatcgtttgaacaagtacttagaaacagcctctcaagacaacgaatacaagacattaatctttgcttctacgaaaagaatgtgcgatgatatcaccaagtatctaagagaagatggatggcccgccttggctattcatggtgacaaagaccaaagagaacgtgactgggttctacaagagtttagaaacggtagatccccaattatggttgctactgatgtggccgccagaggtatcggtatgttaaaattttctccatttttttattgattttatttttttttgttacccctaacgatattacagctatttcctaatggcttttaatgacattaatgactttatgacaaccatgatagtacagaagagagaccttttttcttttttttttttttttcttttttttttttttttctttttttcttttttttttttttgagccttttcgaatctagactctatgtgagtctattctcgatggggagtatcggaaattgaattttaattcgaatgacttctaatgcatcactacagaaaactaatattgggaggatgagaaaaattgactttaattagtcgttttgagagacgggaaattataaactcggagaagtgtatttgtgttcatgatttgcacttcatgtcaaaagaaatttcgctttttgacatcggcgcaaataaacaaggaattggcttttcagcttatttctagaacgcatacatacgcttcgttgatcgttgtttttttcaatgcttggcatttgtacaagggtagattgttttattggaaaaataatagtatattctactttgaaatgccgtcatccttcttgactattgttattctcattttgtgtagtttatgcattttgtagttatattgagatactgttgcatcccaagttcgaattattaagaagtgctgataaaaatggaaaataacaaaataaaaggatttcaaccatattcagaaatcatttactttgttttcctttttttaagtgctagctttcattcagtttgaataaggattctggagtattgatgattaaatatttcgaattctttaataaaaatataatttctgataatcttcaagccagggggaaatttgagacaatgttgggagtccaaacatgaatttgtggggggcatgaaaataaagttcatatacagaataacgaaccaaattactaacagtatgctttgtaaacgtttgtttacttctttattttttcagatgtcaaaggtatcaattacgttatcaactacgatatgccaggtaacattgaagattatgttcacagaatcggtagaactggtagagcaggtgctactggtactgctatatctttcttcaccgaacaaaacaaaggtttaggtgctaaattaatctctatcatgagagaagctaatcaaaatattcctcccgaattattgaaatacgacaggagatcttatggtggcggtcacccaagatacggtggtggtcgtggtggtcgtggtggctatggccgtagaggtggttacggtggtggccgtggtggttacggcggtaacaggcagagagatggtggctggggtaacagaggtcgttcaaactattga

SEQ ID NO: 25662 - DNA, 363 bp, Saccharomyces cerevisiae
atgcctaaagtttacagttaccaagaagttgccgaacacaatggcccagaaaatttctggattatcatcgatgacaaagtttacgatgtttctcaattcaaagatgaacatccaggtggtgatgaaattataatggatttgggtggacaagatgctacagaaagctttgtcgatatcggtcattctgacgaagcattgagactactgaaaggtttatacattggtgacgttgacaagaccagtgagcgcgtttctgtggaaaaggtatctacctctgaaaaccaaagtaaaggtagtggtacattggttgtcatattggccattttaatgctaggtgttgcttattatttgttgaacgaataa

SEQ ID NO: 25663 - DNA, 4407 bp, Saccharomyces cerevisiae
atgtcttctaaaagtgaaaaattagaaaaattgagaaagctgcaagccgctcgaaatggtacatccatcgatgattacgaaggtgacgaatcagatggtgacagaatatacgacgaaatcgacgaaaaagaatacagggccagaaagcgccaggaattgctgcatgacgattttgttgtagatgacgatggtgtaggctacgtcgatcgtggtgtcgaagaagattggagggaagttgataacagttcaagtgatgaagacactggaaaccttgctagcaaggattctaaaaggaagaagaatataaaaagggagaaagaccaccagattacagatatgctgcgaactcaacattccaaatcaacactgctagcacatgcaaaaaaatcccaaaaaaaaagtatccccatcgataattttgatgacattcttggtgagtttgaatctggtgaagtagaaaaacccaatattttactgccatccaaattaagggaaaatttaaattcttcgccgactagtgaatttaaatcgtcaataaagagagttaacggaaacgatgagtcaagtcatgatgccggtatttctaaaaaagtcaagattgatccagattcaagtactgataaatatttagaaatcgaatcatcaccgttaaaattacaaagcaggaaactgcgctacgcaaatgatgtacaggatttattggatgatgtggaaaattccccagtagtagccacaaagagacagaatgtacttcaagatacgttactagcaaatccaccatccgctcaaagtttggctgatgaagaagatgatgaagatagtgatgaagatattattctgaaaagaagaactatgagaagtgtgacaacaactagacgcgtgaatatagactcaagaagtaacccttcaacttcaccgtttgtcacagcacccggaacgccaatcggtattaaaggactaactccaagtaaatctttgcagagcaacaccgatgttgctacacttgcggttaatgtcaaaaaggaagatgtggtagatccggaaactgatactttccaaatgttttggttggattactgtgaagtgaacaacactttgattttatttggtaaggttaaactaaaggatgataattgtgtgtcagccatggttcaaatcaacggtctctgtagagagctatttttccttccaagagagggtaaaacacctaccgatatacacgaggaaataattccgttactgatggataaatatggactggataatatccgcgctaaacctcaaaaaatgaaatattcgtttgagcttcctgacattccatctgaaagtgattatttgaaagtcttacttccataccaaacaccgaagtccagtcgagacaccattccatcggatttatctagcgataccttttatcatgtttttggtgggaattccaatatttttgaaagttttgttattcaaaataggattatgggaccatgctggttagatataaagggagcagatttcaattcaattcgtaatgcttctcactgtgcggttgaagtttcggtagataagcctcagaatatcacgcctactacaacaaagacaatgcctaatctgagatgtctatctttatcgattcagacgttaatgaatcccaaggaaaataagcaagagattgtttcgataacgttatcagcatatagaaatatctcgttggattcaccgatacctgaaaatataaaaccagacgacttgtgtactttagtaaggccgcctcagtcaactagtttcccattaggtttagctgcactggcaaaacagaaactacccggtagagtcaggttgttcaacaacgaaaaggccatgctatcttgtttttgtgctatgttaaaagtggaagacccagatgttatcataggccatcgtttgcaaaatgtctacttagatgttttagctcatagaatgcatgatctcaacattccaacgttcagctctattggccgtcgtttaagaaggacttggcctgaaaaattcggtagaggaaattcgaatatgaaccatttttttattagtgacatttgctctggtaggctgatatgtgatatcgccaatgaaatgggtcaatcattaacacccaaatgtcaaagttgggatctttcagagatgtatcaagttacatgtgaaaaggagcataagccgttagatattgattatcaaaatccacaataccaaaatgatgtaaatagtatgacaatggccctacaagagaatattactaattgtatgatttctgctgaggtgtcttatagaattcaattattaaccttgactaaacagttgacaaatttggctggtaatgcatgggcccaaacgctaggcggtacaagagctggtagaaatgagtatatcttactacatgaattttcaagaaatggttttattgttcctgacaaagaaggcaatagaagtagagctcagaaacaaagacaaaatgaagaaaatgctgatgcaccagttaattctaaaaaggcaaaatatcagggtggtttagtttttgaacctgagaaaggtcttcataagaattacgttttagtcatggactttaattctttgtatccatctattatccaggaatttaatatatgttttaccaccgttgatagaaataaggaagatatcgatgagttaccaagcgtacctccttcagaggtggatcagggtgttttaccaaggttattagctaatctggtggatcgtcgacgtgaagttaagaaggtgatgaaaactgaaactgatccccataagcgagttcaatgtgatattcgtcaacaagctctaaaattgactgccaattctatgtatggttgtttgggttatgttaacagtagattttacgcaaagccgctcgccatgttagtcactaataagggtcgtgagattttaatgaatacaagacaactagctgaaagtatgaatcttcttgtagtttatggtgatacagattcggtcatgatagataccggttgtgataattatgcggatgcaattaaaattggcttgggatttaaaaggctagtaaatgagcgctatagattattggagattgatattgataatgtttttaagaagttactattacatgccaagaaaaagtacgctgctttgactgtaaatttggacaaaaatggtaatggaactactgttctagaagttaaagggttggacatgaagcgtcgtgaattttgtccactttcgagggacgtttctatacatgttttaaacaccatcctgtcagataaggacccagaagaagcattgcaagaagtgtatgattacttagaagacatcagaataaaagtggaaaccaataacattagaattgataaatataagatcaatatgaagctttcaaaagatcccaaggcctacccaggtggtaaaaacatgcctgcagtccaagtagctctaagaatgcgtaaggctggtagagttgttaaagctggctctgtcatcacttttgtgatcacaaagcaggatgaaatagacaatgcagcggatacgccggctctttctgtggctgaacgtgcccatgcattgaatgaggtaatgattaaaagtaacaatttgatacctgatccacaatattatctcgagaaacaaatattcgcgccggtagaaaggttgttagaaagaattgatagcttcaacgtggtgcgtttgagtgaagcgcttggtttagatagtaaaaagtattttagaagagagggcggtaataacaatggagaagatattaataatttgcaacccttagaaacaacaattacagacgttgaaaggtttaaggatactgtaacattagaattaagttgcccatcatgcgataaaaggtttccatttggtggtattgtatcttcaaattactatcgcgtgtcatataatggtttacagtgcaagcattgtgagcaactttttactcctcttcaattaactagccaaatagagcattctataagggcacacatttccttatattacgcagggtggttacagtgtgatgacagcacatgcggtatagttacaagacaagtctccgtttttggtaagcgttgtttgaatgacggctgcacgggtgtcatgagatacaaatacagtgacaagcaattgtacaatcaacttttatatttcgattctttattcgattgtgaaaaaaataaaaagcaagaattgaagccaatatatctacccgatgatctcgactaccccaaggaacagctgacagaatcatctattaaggctttaacagaacaaaacagagaactaatggaaaccggccggagcgttgttcaaaaatatttgaacgattgtggacgtcgctacgttgatatgactagcatatttgatttcatgctaaattag

SEQ ID NO: 25664 - DNA, 969 bp, Saccharomyces cerevisiae
atgcctttgaacaagtcgaacataagagagtacaagctagtcgtcgttggtggtggtggtgttggtaaatctgctttgaccatacaattgacccaatcgcactttgtagatgaatacgatcccacaattgaggattcatacaggaagcaagtggtgattgatgatgaagtgtctatattggacattttggatactgcagggcaggaagaatactctgctatgagggaacaatacatgcgcaacggcgaaggattcctattggtttactctataacgtccaagtcgtctcttgatgagcttatgacttactatcaacagatattgagagtcaaagataccgactatgttccaattgtggttgttggtaacaaatctgatttagaaaacgaaaaacaggtctcttaccaggacgggttgaacatggcaaagcaaatgaacgctcctttcttggagacatctgctaagcaagcaatcaacgtggaagaggcgttttacactctagcacgtttagttagagacgaaggcggcaagtacaacaagactttgacggaaaatgacaactccaagcaaacttctcaagatacaaaagggagcggtgccaactctgtgcctagaaatagcggtggccacaggaagatgagcaatgctgccaacggtaaaaatgtgaacagtagcacaactgtcgtgaatgccaggaatgcaagcatagagagtaagacagggttggcaggcaaccaggcgacaaatggtaagacacaaactgatcgcaccaatatagacaattccacgggccaagctggtcaggccaacgctcaaagcgctaatacggttaataatcgtgtaaataataatagtaaggccggtcaagtttcaaatgctaaacaggctaggaagcagcaagctgcacccggcggtaacaccagtgaagcctccaagagcggatcgggtggctgttgtattataagttaa

SEQ ID NO: 25665 - DNA, 663 bp, Saccharomyces cerevisiae
atggataaacatacagcagctattccaacattaactatcaaagtagtcttactcggagaatctgctgtcgggaagtcctcaatagtcctcaggtttgtatctgacgattttaaagagagcaaagaacctactattggtgccgcatttttaacaaagagaattacaagggatggcaaggtcattaaatttgaaatatgggatacggcaggccaggagagatttgctcctttagcgcctatgtactacagaaatgctcaagctgctttggtagtttttgatgttactaatgaagggtctttttataaggctcaaaactgggtcgaagaactacacgagaaggtaggacatgatatcgttattgccttggtggggaacaaaatggatttgctgaataatgatgacgagaatgaaaatagggctatgaaagcaccagctgtacaaaatctctgtgaaagagagaacctcttatatttcgaagcaagcgctaagactggtgagaatatttaccagatatttcaaacattaggcgaaaaagtaccatgtcctgaacaaaatacacgacaaagctctactcatgatcgcacaattaccgataatcaacgaatcgatctcgaatcaacgactgtagaaagtactagggagactgggggttgtaactgctaa

SEQ ID NO: 25666 - DNA, 579 bp, Saccharomyces cerevisiae
atgtctgaaaaggccgttagaaggaaacttgttattattggtgatggtgcttgtggcaagacctctttactatatgtatttacattaggaaaattccctgaacaatatcatccgacagtgttcgagaattatgtcactgattgcagagttgacggaataaaagtgtccttaacgctctgggatacagcgggacaagaggaatatgaacgtttacgtccattctcatattcaaaagcagatataatattaattgggtttgctgtagacaattttgaatcactaattaacgcaaggacgaaatgggcggatgaggcattacgatattgtcctgacgcaccaatcgttcttgtaggcttgaaaaaagatttgaggcaagaagcccattttaaagagaatgctaccgatgaaatggttcccattgaagatgcaaaacaagttgcaagggccattggggccaagaaatacatggaatgtagtgcactgactggtgagggtgtggatgatgtctttgaagtagctacaagaaccagtttgcttatgaagaaggaaccaggggctaactgttgcataattttataa

SEQ ID NO: 25667 - DNA, 4287 bp, Saccharomyces cerevisiae
atgtcaactgaaccggtaagcgcctctgataaatatcagaaaatttctcaactggaacatatcttaaaaagaccagacacttatatcggttctgttgaaactcaagagcagctgcaatggatatacgatgaagagaccgattgcatgattgaaaaaaatgtcacaattgtaccagggttgttcaaaatctttgatgaaatcttagtcaatgcggcagataataaagttcgtgatccatcgatgaaacgaatcgatgtaaacatacatgctgaggaacatactatagaagtgaaaaatgatggaaaaggtattcccatagagattcataacaaggagaatatttatattcctgaaatgatatttggtcatttgttgacatcatccaattatgatgatgatgagaagaaagtcactggtggtagaaacggttatggtgctaagctttgtaatatattttccactgaattcatattagaaactgcagatctaaatgttggccagaaatatgttcaaaaatgggaaaataacatgagcatttgccaccccccaaaaataacatcttacaagaagggtccatcatatacaaaggtgacatttaagccggatttaaccagattcggaatgaaagagctagataatgatatcttaggagtgatgcgaagaagagtttatgatatcaatggttctgttcgtgacattaatgtctatctgaatggcaagtccttaaagataagaaatttcaaaaattatgttgaactctacttgaaatcactcgaaaaaaaaagacaactagataacggtgaggacggtgccgctaagtctgatatcccgactattctttatgagagaataaacaacagatgggaagttgcttttgcggtttctgatatctcttttcaacaaatttcttttgtgaattccattgcaactaccatgggtggtacccatgtcaattacataacagaccaaattgtaaaaaaaatttcagaaattttgaagaaaaagaagaaaaaaagtgtgaagtcttttcagattaaaaataatatgttcattttcattaattgtttgattgagaatcctgcatttacctcacaaacaaaagagcaactgacaacaagagtcaaagattttgggtcccgttgtgagattcctcttgaatatattaataagattatgaaaactgatttggctacaagaatgtttgaaattgccgacgcaaatgaagaaaatgcgctaaagaagtctgatggtacaaggaaaagcagaattactaattaccctaaactggaagatgccaacaaagccggtacaaaagaaggctataaatgtactttagttctgacagaaggggattccgccttgtcattagctgttgcaggtttagctgttgttggtagagattattatggttgttatccacttcgtggtaaaatgctgaatgttagagaagctagtgctgatcagatactaaaaaacgcggaaattcaagccattaaaaaaattatggggttacaacatcgcaagaaatatgaagatacaaaatctttaagatatgggcatcttatgatcatgaccgatcaagatcatgatggttcgcatattaaaggtttaattataaactttttagaaagctcatttcctggtcttttggatatccaaggtttcttacttgaattcataactccgatcatcaaagtttccatcactaaaccaacaaaaaacactattgcattctacaatatgccggactatgaaaaatggagagaggaagaatcgcacaaatttacttggaagcagaagtattataaaggattagggacttctctagcacaagaagtccgagaatatttttcgaacttggacagacatttgaaaatattccattctttgcagggtaatgataaagattacattgatttagctttctccaagaaaaaggcagatgaccgtaaagaatggctgagacaatacgaacctggtactgttttagaccctactttaaaagagattccaattagcgacttcattaataaggaattaatccttttttctttggccgataatatacggtcgattcccaatgttttagatggatttaaacctggccaaagaaaagttctttatggttgtttcaaaaaaaatttaaagtcggaactgaaagtagctcaacttgcaccatacgtgagcgaatgtacggcatatcaccatggtgagcagtcattggcacaaactattattgggctagcccaaaactttgttgggtccaacaatatttacttgctattacctaacggtgctttcggtacaagagccactggtggtaaagatgcagcggcagcgagatatatctacacagaattgaacaaattaactcgtaagatatttcaccctgctgatgatccattatacaaatatatacaagaagatgagaaaacagtggagccagagtggtatttaccaattcttcctatgattcttgttaacggtgctgagggtattggcactggctggagtacttacattcctccattcaacccattggaaattataaagaatataagacatttaatgaacgacgaggagcttgagcaaatgcatccgtggtttaggggatggaccggtactattgaagaaattgagcctctgcgttacagaatgtacggtaggattgaacaaattggagataacgtcttagaaataactgagttgccagccagaacttggacatcgactataaaggagtacttacttttaggtttaagcggtaacgataaaataaaaccctggatcaaagatatggaggagcagcacgatgataacatcaaattcataatcacgctatcacctgaggaaatggctaaaacaaggaaaataggtttttatgaaagatttaaactaatttcgcctataagtttgatgaatatggtcgcatttgatcctcacgggaaaatcaagaagtacaattccgtgaatgaaatattaagcgaattttactacgtcagactagaatactatcaaaaaagaaaagaccatatgagcgaaaggttacagtgggaggtagagaaatactctttccaagtaaaatttattaaaatgattattgaaaaggagttaacagtcaccaataagcctaggaacgctattatccaagaacttgagaatttagggttccccagatttaataaggaaggtaaaccatattatggaagtcctaacgatgagatagctgaacaaattaacgacgtaaaaggcgcaacttctgatgaagaagatgaagaaagttcacacgaagatactgaaaatgttataaatggtcctgaagaactatatggcacatatgaatatttattaggaatgagaatatggtcattgaccaaggaaagatatcaaaagctgttgaaacaaaaacaagaaaaggagacagagttggaaaacttgttaaaactttccgcgaaagatatatggaacactgacttgaaggcttttgaggtgggatatcaagaatttttgcaacgagatgcagaagctcgcggtggtaatgttcccaataaagggagcaaaacgaaaggtaaaggaaaaagaaagcttgttgacgacgaagactacgacccatcaaaaaaaaacaagaaaagtactgctagaaagggcaaaaaaattaagttagaggataagaattttgaaaggattttgttagaacaaaaactagtaaccaaaagcaaggcgcctacaaagattaaaaaagagaaaacgccttctgtttcagaaacaaaaacagaagaagaagagaatgctccttcttccacgagttcttcttctattttcgacataaagaaagaagataaagatgagggcgaactgagtaagatttcgaacaagtttaaaaaaattagcacgatttttgacaaaatgggttctacttccgctacatcgaaggaaaatacaccagaacaggacgatgtagccactaaaaaaaatcaaacaaccgctaaaaaaacagctgtaaaacctaaattggccaagaagccagtcaggaaacaacaaaaagttgtggaactatctggtgaaagcgacctagaaattttagattcatacactgatcgggaagatagcaataaagatgaagatgatgctataccacaacgatcaaggagacaaagatcgtcgagagctgcgtcggttcctaagaaatcttacgttgaaactttagaattatctgacgacagtttcatcgaagatgatgaagaggaaaaccaaggatcagatgtttcgttcaatgaagaggattga

SEQ ID NO: 25668 - DNA, 1050 bp, Saccharomyces cerevisiae
atgcccaagttggaacaatttgaaataaaaaaatactggcaaatcttctcgggtttgaaaccaatagagaataaggtaaaccatgaccaggttttaccaattctttataattccaaattagattcatcggttctaaacaagatttggtttttagctgatattgatgacgacgacaatttagactttgaggaatttgtaatttgcatgagattaatatttgatatggttaataaaaacattagctctgttccagatgaattgcctgattggttgattccagggagtaaggtgaatctaatcaaagaaagaaagaagcgcaagcaaatagaaaacgcagacttgcctccaaagaaggaaatcaaagtagattggtacatgtctccagatgatttgaatcaatatgaaaaaatttataatagctgtgcaaaactaaccgatggtactattacattcaacgaactgtcaacaaaactttccacaaaattttttaacatcagtaagacagatttaaataaggtttggagtttaattaacccacaaaatttgccatcaattgatagagatcctactttttattttattcactgtttaagacaaagaaatgatttgggtgctgaaattccagcaagtttaccaaattctctggcggaggtgtgcaataaaaaacaactgagctatgatttacggtcctctcaacctcctacaaagagaaaagaagaagctaacgaagtggacaatctgcgtgacaatgggcagaactcgagttccgatagcagtggcagtaacgtgctttcaaatgaagacagtataaagcaaaaatatgcttctctgacagatgatcaagttgcgaacatgagagaacaattagaaggccttttgaactacaaaaagagtgaaaaaactcaaggaggctcaaaactttctaagcggattaacatcaggtcgataactgatgacttggataacattgaacagcaggttgaagtattggagaattacttgaacaataagagacacgaattgcaagcattacaagcagaaatcaattga

SEQ ID NO: 25669 - DNA, 924 bp, Saccharomyces cerevisiae
atggtaccccccacggtagaagcatccttggagtctccttacactaagtcgtacttttcacctgtcccaagcgcgctcttggaacagaatgactctccaataataatgggtatcgatgaagctggcagagggcccgtattagggccaatggtctacgcagtagcctattctacacagaaatatcaggacgaaactataatccctaactacgagtttgacgactctaaaaaacttacagatcccatcagaagaatgctgttttccaagatataccaggacaacgaagaactaacccagatcggctacgcaactacgtgcatcactccgttggatatctctagaggaatgagcaagttcccaccgacgagaaactataacttgaatgagcaggcgcacgatgtcacaatggcactcattgatggcgtgataaagcagaacgtgaagctcagtcacgtgtatgtggatactgttggaccaccagcgtcctatcagaagaaactggagcaacgatttcctggtgtcaagtttacggtcgccaagaaggcagactcgctctactgcatggtcagtgtggcgagtgtcgttgcaaaagtgaccagagatatactagtcgaatccttgaagagggatcccgatgagatcctgggttctggatacccctccgacccgaagacagtcgcatggctgaagcgcaaccagacaagtcttatgggctggcccgccaacatggtaagattctcatggcagacatgccagactctgttagatgacgccagtaagaatagtatccctatcaagtgggaagaacaatatatggacagcaggaagaacgccgcacaaaaaaccaagcaattgcagctccagatggtcgctaagcctgttagaaggaagaggctgagaaccctagataattggtaccggtga

SEQ ID NO: 25670 - DNA, 1449 bp, Saccharomyces cerevisiae
atgtctgcctttgtcagggtggttccaagaatatccagaagttcagtactcaccagatcattgagactgcaattgagatgctacgcatcgtacccagagcacaccattattggtatgccggcactgtctcctacgatgacgcaaggtaatcttgctgcttggactaagaaggaaggtgaccaattgtctcccggtgaagttattgccgaaatagaaacagacaaggctcaaatggactttgagttccaagaagatggttacttagccaagattctagttcctgaaggtacaaaggacattcctgtcaacaagcctattgccgtctatgtggaggacaaagctgatgtgccagcttttaaggactttaagctggaggattcaggttctgattcaaagaccagtacgaaggctcagcctgccgaaccacaggcagaaaagaaacaagaagcgccagctgaagagaccaagacttctgcacctgaagctaagaaatctgacgttgctgctcctcaaggtaggatttttgcctctccacttgccaagactatcgccttggaaaagggtatttctttgaaggatgttcacggcactggaccccgcggtagaattaccaaggctgacattgagtcatatctagaaaagtcgtctaagcagtcttctcaaaccagtggtgctgccgccgccactcctgccgccgctacctcaagcactactgctggctctgctccatcgccttcttctacagcatcatatgaggatgttccaatttcaaccatgagaagcatcattggagaacgtttattgcaatctactcaaggcattccatcatacatcgtttcctccaagatatccatctccaaacttttgaaattgagacagtccttgaacgctacagcaaacgacaagtacaaactgtccattaatgacctattagtaaaagccatcactgttgcggctaagagggtgccagatgccaatgcctactggttacctaatgagaacgttatccgtaaattcaagaatgtcgatgtctcagtcgctgttgccacaccaacaggattattgacaccaattgtcaagaattgtgaggccaagggcttgtcgcaaatctctaacgaaatcaaggaactagtcaagcgtgccagaataaacaaattggcaccagaggaattccaaggtgggaccatttgcatatccaatatgggcatgaataatgctgttaacatgtttacttcgattatcaacccaccacagtctacaatcttggccatcgctactgttgaaagggtcgctgtggaagacgccgctgctgagaacggattctcctttgataaccaggttaccataacagggacctttgatcatagaaccattgatggcgccaaaggtgcagaattcatgaaggaattgaaaactgttattgaaaatcctttggaaatgctattgtga

SEQ ID NO: 25671 - DNA, 1263 bp, Saccharomyces cerevisiae
atgaaactgtccgccaccactcttaccgcggcttcattgatcggttatagcacaatcgtttccgctttgccgtatgcggctgatattgacacaggatgtactactactgctcatggttcacaccagcataagagggccgttgcagttacatacgtttacgaaacagtcactgtcgataaaaatggtcagaccgtcactccaacctcaactgaagcctcttctacagttgcttccactactactctgatttccgaatcttcggtcaccaagtcttcttccaaagttgcttcttcttctgagagtactgaacaaatcgctaccacctcgtcttcggctcaaacaactctgacatcttcagaaacttctactagcgaatcctctgtgcctatttccacatctgggtcagcttccacatcttcagcagcttccagtgcaactggaagtatctacggtgatttggctgacttttcaggtccatatgaaaaatttgaagacggtaccattccttgcggccaatttccatctggtcaaggtgttatccccatcagctggttagatgaaggtggctggtctggtgttgaaaatactgacacttctacgggtggctcttgtaaagaagggtcttactgctcatacgcttgccaaccaggtatgtccaagacacaatggccttctgaccaaccatctgacggcagatccattggtggtttgctatgtaaggacggctacctgtaccgttcaaatacagatactgactatttatgcgaatggggcgttgatgccgcttacgtcgtctctgaattgagcaacgatgttgctatctgcaggaccgattacccgggtaccgaaaacatggtgattcctacatatgtgcaagcaggtgactctttacccttgactgtcgttgatcaggacacctactacacttggcaaggattgaagacatccgcgcaatactacgttaacaatgccggtatttctgtcgaagatgcttgtgtttggggttcttcaagttcaggcgtcggtaattgggctccattgaactttggcgctggttcttctgatggtgtcgcctacctttctttgattcccaacccaaacaacggtaacgcattgaatttcaatgtcaaaattgtcgccgctgatgactcttctacagtcaacggtgaatgtatctatgaaaacggtagcttcagcggtggctctgacggttgtaccgtttccgttactgctggcaaagctaagtttgttctatacaactaa

SEQ ID NO: 25672 - DNA, 2268 bp, Saccharomyces cerevisiae
atgtctagcagagacgcctctttgactcctcttaaggcagtagtgatagacgaccctccattgagacaaaccccagaaccattcgatgaacagtcagcttacaatccccagtcgcccattgccattgattttggatcaagcaaactgagagcaggattcgttaaccatgctacccctacacatatttttccgaatgcattgaccaagtttagagacagaaagttaaacaaaaatttcacttttgtcggtaatgacaccttgttggatcaagctgtgcgttcgcaatcgagaagcccctttgacggaccatttgtaaccaattggaatctcactgaagaaatattggactacacttttcatcatttgggagtggtaccagataacggaattcctaatccaatattacttaccgaaagactggcaactgttcaatcacaacggacaaattggtaccagattttgtttgaaacttacaatgtaccaggcgttactttcggaatagacagtctgtttagtttttacaattataacccaagcggaaataaaacaggtttggtcatcagttgtggccatgaggacaccaatgtaattcccgtagttgatggtgcaggtatcttgacagatgcaaaaaggattaattggggaggacatcaagcagttgactacttgaatgatttgatggctttgaagtatccatattttccaacaaagatgtcttatttgcagtatgaaacgatgtataaagattattgctatgtttcgcgaaattatgatgaagatattgaaaaaatcctcaccttggagaaccttgatacaaatgatgtggtagtggaagccccttttacagaagtccttcaacctcaaaagacagaagaagaattacgaattcaagccgaaaaaagaaaggaaactgggaaacgcttgcaagaacaggcacgtttgaaaagaatggaaaaattggttcagaagcaggaagaatttgaatacttctcaaaagttagagaccaattaattgacgaacctaagaagaaagtactctcggttttgcaaaacgctggttttgatgacgaacgtgattttaaaaagtatcttcatagcctagaacaatcattaaaaaaagcccaaatggttgaagcagaagatgatagtcacctggatgaaatgaatgaagacaaaacagcccagaaatttgatttgcttgatattgcagacgaagatctaaatgaagatcaaatcaaggagaaaaggaagcaaagatttttgaaggccagtcaagacgccaggcaaaaggctaaagaagaaaaggaaagagtcgccaaggaagaagaagaaaaaaaattaaaagagcaacaatggcgtgaaactgacttaaatggttggataaaggacaaaagattgaaattaaacaaattaataaaaaggagaaaagaaaagttaaaactacgtgacgaaatgaaggacagaaaatctcaagtttcacagaacagaatgaaaaatctagcttcattggctgaggataatgtcaaacaaggggccaaacgtaatagacaccaagcgacaatagataatgatccaaatgacacttttggcgctaatgatgaagactggcttatttatactgatattactcaaaatcctgaggcttttgaagaagcattagagtacgagtacaaagacatcgtggaactggagagactacttttagaacacgatccaaactttactgaagaagatacgctggaagcacagtacgattggagaaattctatcctccacctgtttttaagaggacctagacctcatgatagcgaaaatatacatgaacaacatcaaatgcatttgaatgtagaacgtataagggtaccagaagtgatatttcaaccgacaatgggcggacaagaccaagccggtatttgcgaattatcagaaaccattttactaaagaagtttggttctcaaccaggaaaattgagtcaaacttccatagacatggtgaacaacgttcttattaccggcggtaatgctaaggtgccaggattgaaagaacgtattgtgaaggaattcactggattccttcctaccggtaccaatatcactgtaaatatgtcttcagatccttcattggatgcctggaagggtatggcagctctagcacgaaacgaagaacagtataggaaaacagttatcagtaagaaagaatacgaagagtacggtccagagtacatcaaagagcataagttagggaatacgaagtattttgaagactaa

SEQ ID NO: 25673 - DNA, 1470 bp, Saccharomyces cerevisiae
atgcaatttcactcagataagcagcatttggacagtaaaaccgacatcgatttcaagccaaactcaccgcgttccttacaaaataggaataccaaaaatttatctttagatatagcagcactccatccattaatggaattctcatcgccaagccaagatgtgccaggttcagtaaaattcccatcgccgacacctttgaatctatttatgaagcccaaacctattgtgttggagaaatgtccaccaaaagtaagtccaaggccaacgccaccatcgctgtcgatgaggcgaagcgaggcctctatatacacactaccaacatctttgaagaaccgaactgtttctccaagcgtgtatacaaaatcatccacagtatcgtctatcagtaagctgtcatcatcatcaccgttatcgtcattttcagaaaaacctcatctgaatagagtccattcattatccgtgaaaactaaagacttgaagttgaagggaattagaggacgttctcaaacgatctcagggttagagacatccacgccaatttctagtactcgtgaaggtactttagatagtacggatgtcaacagattttctaaccaaaagaatatgcaaacaacattgattttcccggaggaggactcggatctgaatattgatatggtgcatgcagagatttatcaacgaacggtttatttagatggaccattgctggtactgccgcctaatttgtatctatattcagaacccaaactagaagatatattatcgtttgatttagtcattaatgttgccaaagaaataccgaacctggagtttttaataccgccggaaatggcacataaaataaaatattaccatattgaatggacacacacatccaagatcgtcaaggacttatcccgattgacacgcattatacataccgctcattcgcaaggcaagaaaatactcgtacactgtcagtgtggagtatcaagatcggcgtcattgattgtggcgtatatcatgcgatattatggcttgagtttaaatgatgcatacaataagctgaaaggtgttgctaaggatataagtccaaacatgggtctcatcttccaacttatggaatggggaaccatgttgtccaagaactcaccgggcgaagaaggagagactgttcacatgcctgaggaagatgacatcggaaacaacgaagtttcctcgactacgaagtcctactcttctgcgtcctttagaagttttcccatggtaacgaatctatcatcgtcgccgaatgacagttctgtcaattcttcggaagtaacgccaagaactcctgctacgttgactggagcaaggaccgcactggccacagaacgcggggaagatgatgagcactgtaaaagtttgtctcaacccgcagattcactggaagcttctgtggacaacgaatcaatatctactgccccggaacagatgatgtttcttccttaa

SEQ ID NO: 25674 - DNA, 2016 bp, Saccharomyces cerevisiae
atgttcttgcttccatttgtcattcgtcattccagctctatttacctgcccacgcttcgatttcgaggtttacttactgtaatctcaagaaacatacacatttccacccctcataaaatgttgcctctttcaattgagcagagaagaccttcccgctcccccgaatacgatcagtctactttatcaaattataaggacttcgcagttcttcacaccgatttaaacctgtctgtttccttcgaaaagtcagccatttcagggagcgttacattccaattgaaaaaactgcacgaaggtaaaaataaatcggatgaattacatctggatacatcctatttggatgtccaggaggttcatattgatggttccaaggcagattttcaaattgagcaaagaaaggagccattgggctccaggttagtcatcaataacgcttcttgcaacgataactttaccttgaatattcaatttcgtacgactgacaagtgcaccgctttgcaatggttgaacagcaagcaaaccaagggcggtaaaccgtacgtgttttcacagttggaagctattcatgcgaggtctttgttcccctgctttgatactccctctgtgaagtctactttcactgcatctatcgagtccccactaccagtggttttttcaggcatcaggattgaagatacaagcaaggatactaatatttacagatttgaacagaaagtccctatcccagcctacctgatcggtattgcttccggtgatttgtcaagcgctccaattggacctcgttccacagtttacactgaaccatttcgtttgaaagattgtcaatgggaatttgaaaacgatgtagagaaattcattcaaactgcagagaaaattatctttgaatacgagtggggcacttatgatatcttagttaacgtcgattcgtacccttacggcggtatggagtctccgaatatgacttttgctacgcccaccttgattgcacatgacagatccaacattgatgtcatcgcccatgaacttgctcactcatggtctggtaacttagtgaccaattgttcgtggaatcatttttggttgaatgaaggttggaccgtttacttagaaagaagaattattggtgccattcatggcgaaccaactagacatttcagtgctctgattggttggagcgatttgcagaattctattgattctatgaaagatcctgaaagattttccactttggtacaaaacttgaacgataacactgaccctgacgatgccttttccactgttccgtacgaaaaggggttcaacttactatttcacttggaaactattttgggtggtaaggctgaatttgatccatttattagacactatttcaagaagtttgccaaaaaatcattggatactttccagtttttggatactttgtatgagttctatcccgaaaagaaagaaattttggattccgttgactgggaaacttggctgtataaaccaggtatgccaccaaggcctcattttattacggctttggctgataatgtttatcaattggctgacaagtgggtcgaaatggctcaacatttgaaaaccacagaggatttccggtctgaatttaacgctattgacattaaggattttaattcaaatcaattggttttgttcttggaaactttgacacaaaatggccattccaacaagaaaccaaaagattttgactgggccaagtttcccgtggcatctagggcactgttagatatctatcaagataacattgttaaatcacagaacgcggaagttgttttcaagatgttcaaatttcagatctttgccaagctgcaagaagaatataagcatttggccgattggttgggaactgtaggtagaatgaagtttgtccgtcccggttacagactattaaactctgtagaccgtcgattggcacttgcaactttcgacaaattcaaggacacgtatcatccaatctgtaaagctcttgtgaaacaagatttaggtctttga

SEQ ID NO: 25675 - DNA, 1083 bp, Saccharomyces cerevisiae
atgcttaacagaacaattgctaagagaactttagccactgccgctcaggcggaacgcaccctacccaagaagtatggcggtcgtttcaccgtcactttgatacctggtgacggtgttgggaaagaaatcactgattcagtgagaaccatttttgaggctgaaaatatcccgatcgactgggaaactataaacattaagcaaacagatcataaggaaggcgtctatgaagctgttgagtctctaaagagaaataagattggtcttaaggggctatggcacactcctgctgaccaaacaggtcacggttcactaaacgttgctttgcgtaaacaactagatatctacgccaatgtggcccttttcaaatccttgaagggtgtcaagactagaattccagacatagatttgattgtcattagagaaaacacggagggtgagttctcaggcctggaacatgaatccgtccctggtgtagtggaatctttgaaagttatgactagacctaagacagaaaggatcgccagatttgcctttgacttcgccaagaaatacaacagaaagtctgtcacagctgtgcataaggcaaatatcatgaagttaggtgacggtctgttcagaaatataataactgaaattggccaaaaagaatatcctgatattgacgtatcgtccatcattgtcgacaatgcctccatgcaggcggtggccaaacctcatcaatttgatgtcctagttaccccttcaatgtacggtaccatcttaggcaacattggcgctgctttgatcggtggtccaggattggtggcaggtgccaactttggcagggactatgctgtcttcgaaccaggttccagacatgttggtttagatattaaaggccaaaatgtggctaacccaactgccatgatcctttcctccacgttaatgttgaaccatttgggtttgaatgaatatgctactagaatctcaaaggcagttcatgaaacgatcgcagaaggtaagcataccactagagatattggtggttcctcttctactactgacttcacgaatgaaatcatcaacaaattatctaccatgtaa

SEQ ID NO: 25676 - DNA, 1569 bp, Saccharomyces cerevisiae
atgttgctaataagaaggacgataaatgcatttctgggatgtatccattgcaatcttacggcgacgtgcatcctgattgccttcgtcataaccatgtatgtggtacttgtatctgagcctgcatccgtagacggaactatgggaaattttcttccgttttccaagatggatcttgcgacgaagagggacagacccttttattcgaattgtgtgaatactcaggactatttgttgaatccatcgtacatcaagcagaatgcctcgtttgtcatgctaacaaggaacggggagctagaagatgttatcaagactatcaacagtatagaagagcatttcaatcagtggttccactatccatatgtgttcttaaatgaccagccgtttgaagaggacttcaaagcaaaagtacgtgatgttacagtgggcgcgctggtggaatttggcactatcgatgagatatcttggaattttcccagtgacgtaaaggatacgttcgagttctacaacgcaattgaggatcaaggtgatagaagcatactttacggaaacttagaatcatatcataagatgtgccggttttattcaggattattttacaagcacccgctagtacagaagtacgaatggtattggagattggaacccgatgttgagtttttctgtgatattacctacgatccctttttggagatgctccgaactaataagaaatatggatttacgatcatcatccccgaattgtattggacagtcccaaatttgtttagacacactaaaagctttatcagtcaaaaaggcgttacgcttgggtcattatggaaactatttacaaaggattacgacatttttgaatccgatgatccggagttacgggactggatcaactatgattttcaggccaaggctaagatatccgaaaagatagccatcgagcagcttttgaaaaagggtgatgatttccaacagataaatgatgacaaagagggaataatgaatttgatacataaggctcgctctaggaagcatatcgtagaagacaaatttttcaatgaagagtacaatctatgccatttctggagtaattttgagattgcgcggctaagcgtgttcgacaatgacatttacaacagtttttttcaatatttggagaaaagtggtggattttggaaggaaagatggggggacgctcctgttcactctattggattgtcgctaactctggatttggacgatgtacactattttagagacatcggatatagacactccacaatacagcattgtccacataatgccatggggaatgaggaattctcctacttagccagtgactcaaaattcaaacgtaaaaacgcggcctacgacgagggaagggaatttgggtgtggctgcaggtgcagatgtcccaagaaaaagcgtgaaattgaggattccatgggtttctgcgtaaatatttgggtaaatctgcttaaccaacagaggggacacgaacgccacgtcgaagcactcaacggcaatgaaatggaggagcacataagggaagactatctaagacagttcggaaactag

SEQ ID NO: 25677 - DNA, 972 bp, Saccharomyces cerevisiae
atgtcggggagcttctggacatctacacaaaggcatcattggcaatataccaaggcatcattggctaaagagaggcagaagttatggctattggagtgccagctgtttcctcaaggtttgaatattgtaatggattcgaagcaaaacggcatcgaacaatccatcacaaagaatataccaataactcaccgagacttacactatgataaagattataatctaaggatctactgctatttcctgataatgaagcttggaaggagactaaatataagacagtatgcactggctacagcacatatttatctatcaaggtttttaataaaggcttcagttagagaaataaacctatatatgctggttactacgtgtgtatatttagcatgcaaagttgaagaatgcccgcaatatatcagaactttggtaagtgaagcccgtaccttatggcccgaatttattcctcctgaccctactaaagttactgagtttgagttctacttactagaagaattggaaagttacttaattgtccaccacccttatcaatccttaaagcaaattgttcaagtcttaaagcaaccgccatttcaaataacactatcgtcagatgatctacaaaactgttggtccttaatcaacgacagttatataaatgatgttcatttgctttaccctcctcatattatcgctgttgcatgtttattcattacgatttccattcatgggaaaccaaccaaaggatcatcgttagcatctgcggcttctgaagccatcagagatcctaaaaattctagttctcctgttcaaatagcttttaatcgttttatggcagaatctcttgtagatcttgaggaggttatggatacgattcaagagcaaattacattatacgatcattgggacaagtaccacgaacaatggataaagtttctgctacatactttgtatcttagaccagcatctgcaatttaa

SEQ ID NO: 25678 - DNA, 1917 bp, Saccharomyces cerevisiae
atgaatcaacctcaaattggcacttacaatgtaggtacacagttaacagttgggtcacatcaggttgagatcattaaatatctaacaagcggtgggttcgctcaagtatattccgcgttaatcaacccacctgacccacattctaattcaagcgttgcatgcttaaaaagagtcattgttccagacaaacctagtctaaacactttaagagctgaagtagatgctatgaggttgctgaaaaacaataggtatgttgtatcttacattgattctcatgcagctaaggcaatgttacataatggttcgtatgaagtattcgtcttaatggaatattgtgaaagaggtggtctcattgattttatgaacacaaggctacaaaacaggcttcatgaatttgaaattttgcaaataatgagccaagttactcaaggagttgccgctatgcatgctttgcaacctccgttaattcaccgtgatataaagatagaaaatgttcttatctcagccaataatgagtacaagctttgtgactttggttctgtatgcggtattataaggcctcctaggaattcacaagagctatcatatgttcagcaagacattttgaaaaacacaactgcacagtaccggtcgccagagatgattgatacatttcgcggtctgccgatagatgaaaagtcggatatatgggcgctgggtatttttctatataagctttgctattacacaacaccgtttgaaaagggcggtgatcttgccatattaagcggaaagtttgaatttccattgtatccgaactacagtgaacagttgaaaggcttaatacgtgatatattggttcaagatccgcgccataggcctaacgtttatcaactactgaagaggatatcaattatgcaaaatgttccgtgtccaataaatgacatacaagtggttcaggcgcccagtagccatttgaatttgaccgaacttcatcagctttcggcaacacaaaatattctaagcttgaactctcccacaaccatggaaaatacgatgccgaacgctacatttcaaatcagcatggctgataatactacaacagcacaaatgcatcctaatagaaaaccatcacaaatagcatatgacgctagcttcagtaattccgccaaaggttctcaaccactttttgacaaatcacagaatatgtaccacgcattggatcctccacttgttgaaccgctagcgagtagtgtttcaaataatgacaacgaactcaaggcaaattccgcaaccaagttaaagcaggcaattgtctctgaagcacatacttttaggcagaataattcaatagactttccactacaaaacataataccccagtacgaagattcttcttcctcttcagatgaatcttattctggagacgtagatgaattaaagaaaactcgatctctaggttcttattccacacgcggtaacataaaaaaaaaccaatccgtaaaggaatctcttacttcatcaagcctaccaggcactagcttcaccccaacgtctacaaaggtaaatttgaaacacgaaaattcaccttttaagtcgacattcgttaatacgattgataattccaaagacgatcttaacaaaccatcttatgaagatttggacgtatctaagcagaatttgaagaactccattcaacagcgtatgatcgataaactcaactcttctgaggagtcattcaacgctaggaaaatgtccaaggtcaagctgcatgagaaaggggagatagataagccaacaatgctgaaatcaagtggcccgatttcaaaagacaaaaaaacaaaacctaccccaccacctaagccttcacatttaaagcctaaacctcctccaaaaccactgctcctcgcgggacgaaagttatccttggataagtga

SEQ ID NO: 25679 - DNA, 1611 bp, Saccharomyces cerevisiae
atgttagtaggtaccggatttatttcccaaatgaacgattatggcctttttgaatattcggattatattgctggattatcaggcggaagttggatcttgatggatttggtagttcaaaattttgaagtaaaatccctgctacaagagtgggaccttgaagaggatcttttattaggcataccggaattcgatatttccgaagaagaaattgttaccaatgcaaaaaaggagtataatgataatgatttgaagatgaagaagcgtcaggggggttctctgattacaagctcttcaaatttttatgaacaaatagaggagatcatgaattccatagaagaaatcccagaagactatatgataacgaagagaaacttgaatccattagcaagactaaaaaaaatattctttcctaacaacactttcactggaactgatgcgaagattgaaacctttaaaaaagtgctagacttttacaaaagtttgcatttgaaaattaagcctaaaaaaatggagggtttccaaatatcgttcaccgattattggggtaaagcaatcgttcaaagactaaaaaaaaatttcgatgacgatcccaaccattccttttcgttttcgaagcttgtaaactcgtctaaaaaatttaaggaatgcagtgtgccgatcccaatattcgttgcaaattgcaaaaatggacttctttcaaacgttatatttgaatttacgccctttgaatttggatcttgggaaaatatcctcagacttttcgtcaagttgccctatttgggctcaaaaattgtttctggaaaggccgagaagtgtattaataactttgatgatctaggttttattactgcgacgtcttcttcaatattcaacaatgtgctcatcttcatctggaatttggcttctcagtcctccagagaagcaatgaaagctttgaatatggttatgggaatttttggcctaggtaaagaggaaatatttagtatttcgaaagactcctcgagattagagacagactatgccgtatatcaacccaatcccttttatctttatcctgaaaaagacaatgtcctaactaacaaaaatcatttataccttgtagacggcggagaagacggcgagaatattccactcagaacattggtgattcctgaaagggaactagatgtaatttttgttctggattctagttcggatattgacaactatccaaacggctccaagttaaaaaggatattcgaaaaattagatgaagagaacgttcattaccaatttccgaacaatgtaaaaacattcactcaccccattgttataggatgcaatgctaccaaaagaactggacatgattcatttttgccaattataatttatcatgccaatgcgaatcatggaaacgcatctaatacgtcgacattcaaaataacttacaatcagtctgaagttagcagtatgttacccactggaaggggagtgtttagcaatgattatgacctttattataaaaattgcttaggctgtatattaaccaaaagaacaatggacaggctcccaagaaaaaagaaattttcgccattttgcttacaatgctttaaagactactgttactcataa

SEQ ID NO: 25680 - DNA, 1263 bp, Saccharomyces cerevisiae
atgagtaaaattaaagttgttcatcccatcgtggaaatggacggtgatgagcagacaagagttatttggaaacttatcaaagaaaaattgatattgccatatttagatgtggatttaaaatactatgacctttcaatccaagagcgtgataggactaatgatcaagtaacaaaggattcttcttatgctaccctaaaatatggggttgctgtcaaatgtgccactataacacccgatgaggcaagaatgaaagaatttaaccttaaagaaatgtggaaatctccaaatggaacaatcagaaacatcctaggtggaactgtatttagagaacccatcattattccaaaaatacctcgtctagtccctcactgggagaaacctataattataggccgtcatgcttttggtgaccaatatagggctactgacatcaagattaaaaaagcaggcaaactaaggttacagtttagctcagatgacggtaaagaaaacatcgatttaaaggtttatgaatttcctaaaagtggtgggatcgcaatggcaatgtttaatacaaatgattccattaaagggttcgcaaaggcatccttcgaattagctctcaaaagaaaactaccgttattctttacaaccaaaaacactattctgaaaaattatgataatcagttcaaacaaattttcgataatttgttcgataaagaatataaggaaaagtttcaggctttaaaaataacgtacgagcatcgtttgattgatgatatggtagcacagatgctaaaatcaaagggcgggtttataatcgccatgaagaattatgatggcgatgtccagtctgacattgtggcacaaggatttgggtctcttggtttaatgacgtccatattgattacacctgatggtaaaacgtttgaaagcgaggctgcccatggtacggtgaccagacattttagaaaacatcaaagaggcgaagaaacatcaacaaattcaatagcctcaatatttgcctggacaagggcaattatacaaagaggaaaattagacaatacagatgatgttataaaatttggaaacttactagaaaaggctactttggacacagttcaagtgggcggaaaaatgaccaaggatttagcattgatgcttggaaagactaatagatcatcatatgtaaccacagaagagtttattgatgaagttgccaagaggcttcaaaacatgatgctcagctccaatgaagacaagaaaggtatgtgcaaactataa

SEQ ID NO: 25681 - DNA, 855 bp, Saccharomyces cerevisiae
atgaatactttttttctttccttgctaagtggcgccgctgctggtacctctacggatttggtttttttccctatagacacaattaaaaccaggcttcaagctaagggtggattctttgctaatggaggatacaaaggcatatatcgtggtttgggaagcgctgttgtagcatcggcgccaggtgcttcacttttctttattagttatgattatatgaaagtaaaatcaaggccatatatcagcaaactttactcacagggatctgagcaattgattgatacgacaacgcacatgctttcctcttccattggtgaaatttgtgcttgtcttgttcgagttcccgcagaagtcgttaagcaaaggacgcaagttcactctaccaattcttcctggcagactttacagtcaattctacgaaatgacaataaggaaggtttaaggaaaaatctttatagagggtggtctaccaccattatgagagaaataccgtttacttgtatacagtttcctttatacgagtatctaaaaaagacttgggcaaaagccaatggccaaagtcaagtggagccatggaaaggggctatctgcggttctattgcgggtgggatcgcagcagctacaacgacaccattagatttcttgaaaaccagattaatgctcaacaaaacaaccgcctcacttggaagcgttattattaggatttacagagaggaaggtcctgctgtatttttcagtggagtggggccccggacaatgtggatcagtgcaggtggtgctatcttcctaggcatgtatgaaactgttcattcgttattatcgaaaagtttcccaacggctggagaaatgagagcgtaa

SEQ ID NO: 25682 - DNA, 1440 bp, Saccharomyces cerevisiae
atgtcagcgatattatcaacaactagcaaaagtttcttatcaaggggctccacaagacaatgtcaaaatatgcaaaaggctctttttgcactattgaatgctcgccactatagtagcgcctccgaacaaacgttgaaggagagatttgctgaaattatcccagcaaaggcagaagaaattaaaaaattcaagaaagaacacggtaaaaccgttattggtgaagttcttttggagcaagcttatggtggtatgagaggtattaaaggccttgtttgggaaggttccgtgttagaccccgaagaaggtattagatttaggggtcgtactattccagaaattcaaagggaactaccaaaggctgagggtagtacagaacctttgccagaagctttattttggttgcttttgactggtgaaatacctactgacgctcaagttaaagccctttctgctgatttagctgccagatcagaaattccagagcacgttatccaacttttagatagcctcccaaaagatctacatccaatggcgcaattttctattgccgtgactgctttagaaagcgagtctaagtttgccaaagcatatgctcaaggtgtatccaagaaagaatattggagctatacatttgaagattcgttagatctgctgggtaaattacctgttattgcttccaaaatttatcgtaatgtgttcaaggatggtaaaattacttcaaccgatcctaatgctgactatggtaaaaatttggcccaacttttgggctacgaaaacaaggattttattgacttaatgagactatatttaactattcattctgatcatgaaggtggtaacgtttctgcccatactacacatttagtgggttctgccttatcttcgccatacttatctttggccgctggtttgaatggtttagctggcccattacatggtcgtgccaatcaagaagttttagaatggctatttaaattgagagaagaagtgaaaggtgactattcaaaagaaacaattgaaaagtacttgtgggatactttgaacgcagggagagttgttcctggttatggccatgcggttttgagaaaaactgatcctcgttatacggctcaacgtgaattcgcattgaaacatttcccagattacgagttatttaagttggtctccaccatttatgaagttgccccaggggttttaactaagcatggtaaaactaagaacccatggccaaatgttgattcacattccggtgttttattgcaatactatggtctaactgaggcttcgttctacactgtattgtttggtgttgccagagctattggtgtgttaccccaattaatcatcgatagggctgttggtgctccaatcgaaaggccaaaatcattctccaccgaaaaatacaaggagttggtaaagaaaatcgaaagtaagaactaa

SEQ ID NO: 25683 - DNA, 450 bp, Saccharomyces cerevisiae
atgaatctacagaacaacgttttaaatcagatacaccagattctgctgcctacgaatcctactctcgataaacctaatgctgaggctacaaaggaagaattttcgtctgcagaaaatagagatgaaaaagactatcttaccaaccagcagccgaaaaatctgagtactccctccaccagttccaacggtgaatttataccgcatattttttattcgctgcaccaaataaggaaggatccaaacaatctctcaaatcaattggaaaccttaacaggttcgattagacatcgtttgaaactttgtaaatctttgatatcggaaaacgaagataccaaggatttattaagtaaaagtccatcagaatggcaggatatcatccatcaacgtgaacaagaactgcaaattaagagagacgtcttggatgatctttatcgcaagttacaacgataa

SEQ ID NO: 25684 - DNA, 2631 bp, Saccharomyces cerevisiae
atgtcaagtattacatctgaaaccggtaagcgaagagtgaaacgaacgtatgaagttacaagacagaatgacaatgcagtaagaatagagccttcttccttgggtgaggaagaagacaaagaggccaaggataagaactctgccttgcagctaaaacgatcacgctatgaccccaataaagttttttctaatacgaaccaaggtccagaaaagaacaatttaaaaggagaacaacttggatcacaaaaaaagtcatcaaagtatgatgaaaaaataacgtcaaataatgaacttactacaaagaagggtctactaggtgactccgagaatgaaactaagtacgcctcttctaattctaaatttaacgtagaagttactcataaaataaagaatgcaaaagaaattgacaaaataaacagacaacgcatgtgggaagaacaacaattgcgaaatgctatggcggggcaaagcgatcaccctgatgatataacattggaaggctctgacaagtacgattatgtgttcgacacagatgcaatgattgattatactaatgaggaggacgatttactacctgaagagaaacttcaatatgaggcacgtctagcacaagctttagaaactgaggaaaagcgtatactgactatacaagaggcaagaaaacttttgcctgtacatcaatacaaggatgagctactacaagagatcaaaaaaaatcaagttttgattataatgggtgaaaccggttctggtaaaaccacacagttaccccaatatttggtagaagatggattcactgatcagggaaagttacagattgccataacacaaccacgtcgtgtggcggccacttctgttgctgcaagagtagcagatgaaatgaatgttgtgcttgggaaggaagtgggttatcagatccgttttgaagacaaaacaaccccaaataaaacggttctaaagtatatgacggatggtatgttactaagagaatttcttacagattccaaattaagcaaatattcttgtattatgattgatgaagctcatgaacgtactctagccacagatatcctgataggtttgctgaaagatattttgccgcagaggcccactttaaaattgcttatatcatcagcaacaatgaacgcaaaaaaattttcagagttttttgataattgtcccattttcaacgttcctgggagaagatatcctgtagatatccactacacattacagccggaggcaaactatatacatgccgctataacaactatttttcaaattcatactacgcaaagtttaccgggggatatattggtgtttttaacggggcaagaagaaattgaaagaacaaaaaccaaactggaggagatcatgtctaaattaggttctagaacaaaacaaatgattataactcctatatacgcaaatttaccccaagagcagcaattgaaaattttccagccgactccggaaaattgtaggaaagttgttttggcaactaatattgcggaaacttcattgaccattgatggtattagatatgtcattgatcctggatttgttaaggaaaattcgtacgtaccctccactggaatgacccaacttttaacagttccatgctcaagagcttcagttgatcagcgtgccggtagggctggtcgtgttgggccgggaaaatgttttagaatttttaccaaatggtcatatttgcacgagttggaacttatgcctaagcctgagatcacaagaacaaatctttctaatacggtgttattattattatcgcttggcgttactgacctaataaagtttcccctgatggataagcccagtatccccacattacggaagtctttggaaaatttatacattttaggtgccttaaatagcaaagggacaatcactcggttaggtaaaatgatgtgcgagtttccttgtgaacctgaatttgcaaaagtgctttatacagctgctacgcacgaacaatgtcaaggtgtactagaagagtgtttgaccatagtttcgatgctacatgaaacaccttcattatttattggtcaaaaaagagatgctgcggcaagtgtgttaagcgaagtggaaagtgatcacatattgtatttggaaatcttcaaccaatggagaaactctaaattttccagaagttggtgtcaagaccacaaaattcaattcaaaacgatgttgagggtaagaaatattagaaaccaattattcaggtgcagtgaaaaggttggattagttgaaaagaacgaccaagccaggatgaagataggcaatatagcgggctacataaatgctagaataactcgatgcttcatcagcgggtttccgatgaatattgtacaattaggccccaccggctatcaaaccatgggtaggtcatcaggtgggctgaacgttagtgttcatcctaccagtatacttttcgttaatcataaggaaaaggcgcagagaccaagcaaatatgtgctttatcaacaattgatgctaacgtcgaaggaatttatcagggactgtctagttatccctaaggaagaatggttgatagacatggttccacaaatctttaaagatttaattgacgataaaacaaatagggggaggcggtga

SEQ ID NO: 25685 - DNA, 6702 bp, Saccharomyces cerevisiae
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 25686 - DNA, 1929 bp, Saccharomyces cerevisiae
atggacaagaagaaggatctactggagaacgaacaatttctccgcatccaaaagctcaacgctgccgatgcgggcaaaagacaatctataacagtggacgacgagggcgaactatatgggttagacacctccggcaactcaccagccaatgaacacacagctaccacaattacacagaatcacagcgtggtggcctcaaacggagacgtcgcattcatcccaggaactgctaccgaaggcaatacagagattgtaactgaagaagtgattgagaccgatgataacatgttcaagacccatgtgaagactttaagctccaaagagaaggcacggtataggcaagggtcctctaactttatatcgtatttcgatgatatgtcatttgaacacaggcccagtatattagatgggtcagttaacgagcccttcaagaccaaattcgtgggacctactttagaaaaggagatcagaagaagggagaaagagctaatggccatgcgcaaaaatttacaccaccgcaagtcctccccagatgctgtcgactcagtagggaaaaatgatggcgccgccccaactactgttccaactgccgccacctcagaaacggtggtcaccgttgaaaccaccataatttcatccaatttctccgggttgtacgtggcgttttggatggctattgcatttggtgctgtcaaggctttaatagactattattaccagcataatggtagcttcaaggattcggagatcttgaaatttatgactacgaatttgttcactgtggcatccgtagatcttttgatgtatttgagcacttattttgtcgttggaatacaatacttatgcaagtggggggtcttgaaatggggcactaccggctggatcttcacctcaatttacgagtttttgtttgttatcttctacatgtatttaacagaaaacatcctaaaactacactggctgtccaagatcttcctttttttgcattctttagttttattgatgaaaatgcattctttcgccttctacaatggctatctatggggtataaaggaagaactacaattttccaaaagcgctcttgccaaatacaaggattctataaatgatccaaaagttattggtgctcttgagaaaagctgtgagttttgtagttttgaattgagctctcagtctttaagcgaccaaactcaaaaattccccaacaatatcagtgcaaaaagctttttttggttcaccatgtttccaaccctaatttaccaaattgaatatccaagaactaaggaaatcagatggagctacgtattagaaaagatctgcgccatcttcggtaccattttcttaatgatgatagatgctcaaatcttgatgtatcctgtagcaatgagagcattggctgtgcgcaattctgaatggactggtatattggatagattattgaaatgggttggattgctcgttgatatcgtcccagggtttatcgtgatgtacatcttggacttctatttgatttgggatgccattttgaactgtgtggctgaattgacaagatttggcgacagatatttctacggtgactggtggaattgtgttagttgggcagacttcagtagaatttggaacatcccagtgcataagtttttgttaagacatgtttaccatagttcaatgagttcattcaaattgaacaagagtcaagcaactttgatgacctttttcttaagttccgtcgttcatgaattagcaatgtacgttatcttcaagaaattgaggttttacttgttcttcttccaaatgctgcaaatgccattagtagctttaacaaatactaaattcatgaggaacagaaccataatcggaaatgttattttctggctcggtatctgcatgggaccaagtgtcatgtgtacgttgtacttgacattctaa

SEQ ID NO: 25687 - DNA, 4740 bp, Saccharomyces cerevisiae
atgtcgcattcagactacttcaattataagccttacggcgattccacggaaaagcccagcagctccaagatgaggcagtcatcttcatcatcttcatctagactaaggtcggaaagtttagggcgaaattccaatactacgcaggctcgagtagcgtcatcgcccatcagcccagggctgcattctacccagtactttagatcaccaaacgctgtttacagccctggagagtctccattaaatacagtacagctattcaatcgtcttccgggtatacctcaaggtcagttttttcatcaaaatgccatttctgggtcctccagctcctcggcaagatctagtagacggccctcgaatattggtcttcctctaccaaaaaatcctcagcagtctctaccgaagttgtctactcaacctgttcctgtacataagaaagttgaggctagtaaaacagagagcgagattattaagaagcccgctcccgtgaatagtaatcaagatccattattgacgaccccaacgttagtgatatcaccagaactggcttcactaaatacaacgaatacatcgattatgtcaacgccacaaaatattacaaaccaaacttcgaacaaacacattcccaccagatcgcaaccaaatgggtcaacaagttcctccactttgcaggatattgtcacgacaaatagctcgcaacggtctgtaggccaccatggtggaagcacaacgagcctccgaacatacaaaaaacaatatgtattaaatgaacagttatatttaagaaaaatgagaaaccgtgctaatgatgattattacactagaggtatagtcgcatcatccaactttgaagatgacgaagaaaattttagtaacaaaggtgaagatgacttagaactagaaatggatgatcttttaaaggtagaaggtgaggataaagataacgacttcaattttggttataattttattacgtcgagcacaaaaaataatgaaaatgttgtttcgatgagcctaaattatctaaagggcaaattggattggttgagggatgtgaacaatgatcaaccgtgtgaaatagaagatgaggagtggcattccatactggggagcgaggatttgctgtcaaaattgttacaaaatcctatggtgaacaaccgatttgaatggcaaacaatgttatctaaggtactgaagggagatattgtgaggaatgaaaaaacgaagattgcaaatcaagggaaaggccctggcttcaatactcagttttcagatgacatttggattgagttgaaggcatggatgaatgggaggaccgtggaagatcagaacaaatctctgaggatttttagggattctactgactccgtatttcaagaaatcatggcctttaaactagaagataatatgagcgctgacgaggctgcagagactatcaaatcactagtagacaaatattatagagtcttaaatctatggcctaacattaaaagaatgcatgctgaaaaacccattactaaaacagaagcattcaggaatcgaatagatactttgaatagttggcttaatttcaaatttaactttgatactaatattgcgtacctgaaaaaatggatagttggcaataaagagctagaaagcactaccgaagtggataacaccaccgtgaatttggatgatccagccgttttcgccactaattgtaaacgctttgcggagcaaattatgaaggaaaaggatattgaactgatatttcaaaaaaaaatattctttccattagcaccatggattttgaaggccaaatttttcttcttgaaataccaaaaaacttggaatgaattgaatctatcttatttggatcaagatctggaatttttattgatgtttccaatgcgtttggtaaaagatataatactaattcgcctatcttacgcgaagaaaatacagaatccaaccttgatgatgatcgatcaaatgatggacgattttagtacatatattaagttggcagtccaaatgaaattcactgttgcttcttactgtaatgactggttttttaaagtgaaaatcgatcccgaatttgatcataccgttgttgaaggattggaatattttttctccattttggaactgagaatattatatagtggcaaaaactcattcaagacttctaaagaacctgatctgttattaaaatattgggaaatgtttagaaacgtcggctattatattgatgatgcaggcgaactgatcgcagcagaatttacgaagttgacacttagattggttcacagattgcacgcttaccttttaaggcagcaaaacactccgccaaaattagagaatgaagctgctgctgaaaaatggctggtgcaaatattcgaaatacttggatccatgaaaagaaaactcaatagattcaccaatattttgacaaaagcatttcaaaattttgtccgctacaagatagaagatcacaactatctgctaaagcaactaaaagaaacaggccactttcttatatacacaggaggttacctagagcaaaatggtacttatttaattggtagcccagagctattaggctgtaaagatgatgatattttaagaatcattaagaattcagacatcggttgtgatttagtgcctaagctagaaattaataacagtctgacaatttataatgctttggatgataattggaactccaactcatcactgggttcagatatctcgaatgatggtaccccattttattatatcaaaaacgatttgaccacccagcctagatcttataacggtaatagagtcaatcgtgaaccggattttgaaaacagcaggagcacggaggaagagttttatgaactggagacaagattgaactctcttggttatgtattggtattgactccgcaagagccattactttgggagggtgagatgtataatctatccgataacaaaacaattaaaccagagggattgaacttgaaagtaattcctaattcaatagatttgatgtgccaaggatccagttatgccttagaataccaatgtgacaggttccaacagatatctggtagctcagtttctttcttggaaaaaaaatcttcctcagaaacggttaaaaacaacttacaaaggataaataaagcatatttcagatgcacgtacagtgttctgaagaactatacaaagattgtgaccacgttcaagaaggtaagtcctgtcaatgatttattgaataatattttcctttttgggagggattttggtctgaactttttgagaattaatgttgccaacaatgaaaaaagatccattataatacttttaatgatgcggttaagtatcggatggctgaagttcttagctgaagactgtgatccgactgatcaaagggtatttaggtggtgtgtcacgtcaatggagttcgcgatgcatatggtaagcggttggaacatactagctcttgatgaatgccaattttcttctttaaaacaaaaaatttcagaatgcatgtcattacttatttctcattttgatataataggcgcacgctccatagaagttgagaaaatcaatcaacaagctagatcaaatcttgatttggaagatgtgtttgacgatgatatgatgctacaagtgaattccgagttccgagtacaaagtataatggaattggaagaaaggataaagcggaatcctcatcaaactggtaaagtaattgatgatagtgacaaaggtaacaagtaccttgtttctttggcatcttccatatcgaacgtttctatgagatggcaaaagaggaactttattggtggcggtacttttggaagggtatattctgctgttgatttggataatggtgagattttagcagtcaaggaaatcaatattcaagatagcaaatcaatgcaaaaaatattccccttaatcaaggaggaaatgagtgtcttagagatattgaaccatccaaatatagtttcatattacggtgttgaagttcatcgtgataaagttaacatctttatggaatattgtgaaggcggttccctagcagctcttttggagcatggtcgtattgaagatgaaatggtcactcaagtctacactttacaattgctagaaggacttgcatatttgcatgaatccggcattgttcaccgtgatgttaaacccgaaaacatcctactagattttaatggtgttattaagtatgttgattttggtgctgctaaaaaaattgctaataatggaactagattggcaagtatgaacaaaatcgaaaacgcagatggtgaacacgaagatgttacccatgtttctgattcaaaggcagtgaaaaataacgaaaatgctctattagacatgatgggaactcctatgtacatggctccagaatccatcactggatctaccaccaaaggcaaacttggggcagacgatgtttggtcgttaggctgcgtggtattagaaatgatcactggtagacggccatgggctaacttagataatgaatgggctatcatgtaccatgttgctgcaggacataccccacaattccctactaaggatgaagtgtcgtctgctggtatgaaatttctggaaagatgtcttattcaaaacccctccaagagagccagtgcggttgagctgttgatggatccttggattgtacaaattagagaaatagcctttggcgacgattcttcctctacagatactgaggaaagagagtag

SEQ ID NO: 25688 - DNA, 1107 bp, Saccharomyces cerevisiae
atggaattggacgaatgtttagaaaggctatacaaggcccagttactacctgaagtgactgtaagggcactctgctttaagctgaaggaaatgctagtgaaggagtcaaacgtgattcacattcagacccctgtcacagtcgtgggggatatgcatggacagtttcacgatatgctggagatcttccaaataggcggccctgttcctgatacgaattatctgttcttgggcgactatgtagacagggggttgtacagtgtggaaacaattatgctattgattgtgcttaagcttcgatatcctagtagaattcatcttttgaggggaaaccacgagtcacgtcaaatcacgcagagctatggtttctacacggagtgcttgaacaagtacggtggcaattcaagagtttggcaatatttgacagatatatttgactatctagtgttatgctgtattatcgacgacgaaattttttgtgttcatggtgggctctcgcccaatgttcaaaccatagatcagatcaagattattgatagatttcgagaaattccacacgatggcgccatggcagacttggtttggtctgatccggaagaaaacaataaccccacgttagatcatccagataactctggacaacatttccaggtgtcacctcgtggagcaggttatactttcggaagaagcgtggtggagaaattcttacgtatgaacgatatgaacagaatatacagagcccatcagttatgtaacgaaggttaccagatatattttgatggattggttactactgtatggtcggcgccaaactattgttatcggtgcggcaataaagcatctattctggagctgtatagtaaagatcaattctacttcaacgttttcgaagaggcacctgaaaataaactgttgaaagagaacagtatgaacgacaatgccttagaagatagcatatctaatccggtagccaacaggaaattgattgcagattatttcgaagacgactctgcctccgcagatggctccacggaccctgaaatgtacatattttcagatgtataccaagccagatctgcttctaacagacatgttgattacttcttgtag

SEQ ID NO: 25689 - DNA, 1890 bp, Saccharomyces cerevisiae
atgtttgcatcgagatttgaccctagccaattgactgctcctgcagctagcgcaccagaaggaatcgtcggaactactcccccggccattgtgcctttaaagaggcaggctactgaatctgataatgaagaatatggctctcaccaagattctgatgagagttccaactctagttcagaggaagacgaagaccgtatgcaagtagattatggggctagtgaagaggattcgagtgaagtggaagaggaagagagtaagccaagtactcacagcacagtgctatcgagattcaagcaaacagtatcattgcaagaaaggctaggtgcatctgatattgctgagagtaaggaagacgaaggtattgaagacgaggcggcctcaactcaccaactaaaacagattcctcaacctgaattcgtcaaaaacccaatgaatttgaatacaaattcattacagttcaaatctacgggttggttaaatactgagaagatatattatgataattccttgatcaaaccgttctcggattacgcaaatgaattagaagcaaaactactgcagaatatttgcaagaatttctctacaaacacttttcccatccaatcgatcatcctagactccatattaccggtattgaacttcacgttgaacgtatctaagagaaacttcaccagaagaatcggtgatattcttgtaaatgctgctaccggttcaggtaaaactttggcttactccattcctattgttcaaaccctcttcaagagacaaattaacagactgcgttgtataatcatcgtccccacaaaactattgataaaccaagtttatactacgttgacaaagctaactcaagggacgtcgcttattgtgagcattgccaaattagaaaattctttgaaggacgaacacaaaaaattatcaaatttggaaccagatatcttaatcactacacctggtagattagtagatcatctaaatatgaaatcgataaatttgaaaaacctaaagtttttgattatcgatgaggctgatcgtcttttgaaccagtccttccagggctggtgtccaaaactaatgtcccatttgaaaacggataaattagatacacttccagggaacgtgatcaaaatgatcttcagtgcgacattgactaccaacacagaaaagttaaacggcttgaacctttacaaaccaaagttgttcctgaagcaaaccgataaattgtaccagctacctaacaaattgaatgaatttaacatcaacattcccacggcgaaaagtgtttacaagccattgatattgttgtattcaatatgccaatttatggcacattcccccattgctgcaaagattttgattttcgttaaatcaaatgaatcgtctatcagattaagcaagttactacaacttatctgtgaatctcgctcacaatccagcgtattgaaaaaccttcaaaatttggcggtgagtattaattctgtcaattcaaacaactccaaagcagaaaataaaaaaattgttgcgaacttctcgcatcactcggaaagcgcaggcattaccatcttaattactaccgatatcatgtcccgtggtattgatattaacgatatcactcaagtaataaactatgacccaccaatgtcttctcaacaatatgtccatcgtgttggtagaacagcaagagctaacgaacttggttccgcttataacttactagtaggtagaggtgaaagaacgtttttcgatgacttaaacaaagatctagatagagacggtaaatctgtccagccattagaactcgattttaccctattggaatctgattctgaactatatacttcgtctctagaaagtttgaaaaactatcacaataacaccgcacaagcttaa

SEQ ID NO: 25690 - DNA, 1191 bp, Saccharomyces cerevisiae
atgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataa

SEQ ID NO: 25691 - DNA, 2178 bp, Saccharomyces cerevisiae
atgacattatctttcgctcattttacctacctgttcacaatattgttgggattaactaatattgccttggcatctgatccagaaacgattctagtgacgataaccaagacaaacgatgcaaatggggttgttacaactacagtttcacccgcgctagtctccacatccactatcgttcaagctggcactacgacattgtatacgacttggtgtccattgacggtatccacttcatctgctgccgaaataagtccttcaatatcgtacgctactaccctatccagatttagtactttgacattatctacagaagtctgctcccatgaggcatgtccttcgtcatcgacgttgccaaccaccaccttatctgtgacttccaagttcacttcatatatttgccctacttgtcacacaaccgctatcagctcattatccgaagtaggaactacaaccgtggtatcatccagcgccattgaaccatcaagtgcctctataatctcacctgtcacctctacactttcgagtacaacatcgtccaatccaactactacctccctaagttcgacatctacatctccaagctctacatctacatctccaagctctacatctacctcatcaagttcgacatctacctcatcaagttcgacatctacctcatcaagttcgacatctacatctccaagttcgacatccacatcttcaagtttgacatccacatcttcaagttctacatctacatcccaaagttctacatctacctcatcaagttcgacatctacatctccaagctctacatctacctcatcaagttcaacatctacatctccaagttctaaatctacttctgcaagctccacttccacttcttcatattcaacatctacatccccaagtttgacttcttcatctccaactttggcttccacttctccaagttcaacatctattagctctacttttactgattcaacttcatcccttggctcctctatagcatcttcatcaacgtctgtgtcattatacagcccatccacacctgtttactccgtcccttcgacttcgtcaaatgttgcaactccttctatgacttcttcaactgttgaaacaactgttagttcacaaagttcgtctgaatatatcaccaaatcctcaatttctactactatcccatcattttccatgtctacatatttcaccactgttagtggagtcactacaatgtatacgacatggtgtccttatagctctgaatctgagactagcacattaaccagtatgcatgaaacggttacaacagacgctacagtctgcactcacgagtcttgcatgccctcgcagacaacaagtttgattacatcttctataaaaatgtccactaaaaacgtcgcaacttctgtaagcacctcaacggttgaatcctcatatgcatgctccacatgtgctgaaacgtcacactcgtattcttccgtgcaaacagcttcatcaagttctgtaacacagcagaccacatccacaaagagttgggtaagttcaatgacaacttcggatgaagatttcaataagcacgctaccggtaagtatcatgtaacatcttcaggtacctcaaccatttcgactagtgtaagtgaagccacgagtacatcaagcattgactcagaatctcaagaacaatcatcacacttattatcgacatcggtcctttcatcctcctccttgtctgctacattatcctctgacagtactattttgctattcagttctgtatcatcactaagtgtcgaacagtcaccagttaccacacttcaaatttcttcaacatcagagattttacaacccacttcttccacagctattgctacaatatctgcctctacatcatcactttccgcaacatctatctctacaccatctacctctgtggaatcgactattgaatcttcatcattgactccgacggtatcttctattttcctctcatcatcatctgctccctcttctctacaaacatctgttaccactacagaagtttccactacttcaatctccatacaataccaaacttcatcaatggtaacaattagccaatatatgggcagtggatcgcaaacgcgtttgccattaggaaagttggtcttcgccatcatggcagttgcttgcaatgtaattttcagttaa

SEQ ID NO: 25692 - DNA, 1443 bp, Saccharomyces cerevisiae
atgtcccaagaaatttcatatacaccagatgtcgcggaactgctagactttgataaaaaacatatttggcatccttatacgtcattgagttcaccattgaacgtttatccggtaaagagtgctcacggatgcaagctggtgttggataccgactcaccagtggacgtcgaggtgatcgacgccatgtcgtcgtggtggtgtgttattcacgggtacaataatccagaactaaatgaggcccttaccaagcagatgttaaagttttctcacgtccttcttggtggattcacccataaaggagctgtgaatctagtccaaaaacttttaaaagtgattgatgaaccctctttgcagtactgtttcctcgcagattctggctcagtagcagtggaagtagctttgaagatggctttacaatcaaacatgtcaggggaagctactaaaaatagaacaaagtttttgacaatcaagaacgggtatcatggtgatacatttggcgctatgagtgtttgtgatcctgagaattctatgcatcatatctacaacgatcgactcagtgagaacatcttcgcccaagctccctctattgtcgatggccttccaaccagccagaacggtttcgaggaccattggaatgcagaagaagttaccgatctcaagaagcaatttgaattgcatagtgataagatctgtgctgtgattttggagcctatcttacagggtgcaggaggtttgcgaccataccatccacagttcttaatcgaagttcagaaactatgtaaccaatacgacgttttattcatcatggacgagattgctacaggatttggtagaacaggtgagattttcgcattcaagcactgtcaaaaataccaggaccaacatggcatcagtccttccgatcagatcaaagttgttcctgacatattgtgcgttgggaagggcttaaccagtggatatatgactatgagtgcagtggtagtcaacgacaaagttgcttccagaatctcttctccaaatagccctactggtggctgcttcatgcatggccccaccttcatgggcaatgccctggcatgcagtgtggcagaaaagtctatggatatactactgcgtggcgagtggagaaaacaagtgtctgcaattgaaaaccaaatttatagagaactataccagtacatcaagaacccagataatgggctcattggaactgttgttaagcgtgtgtcagttattggagctgtaggtatcgtagagctatacaagaagacagatcccgagtggttccagaaaaagtttatatccaagggagtacatatccgacctttcaactgcctgtgttacattatgccaccatatgtgatcacgacagaggaattgacgaaggttaatcaagtcttgattgaagtattacatgagtggaaatcccacataaaccaatga

SEQ ID NO: 25693 - DNA, 1695 bp, Saccharomyces cerevisiae
atgcaatcatccactgaaagtgatagagatattcaggatggtcctgatgctgatattcacgtcgcaccacccgtggaaaaagagtggtcagatggatttgatgacaacgaagtcataaacggggataacgttgagccaccaaaaagagggctcataggttatcttgtcatttacttattgtgttatccaatatccttcgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggtcttatttttgcccgtcttgctgatactttaggtagaaggctggcaattgtaatcgtggtgttggtatatatggttggtgcaattattcagatcagttcgaatcacaaatggtaccaatacttcgttggtaagattatctatggtcttggtgctggtggctgttcggtgttgtgtccaatgcttttgtctgaaatagctcctacagatttgagaggtggacttgtctcattgtaccaacttaacatgaccttcggtattttcttgggttattgtagcgtttatggtacgagaaaatacgataacactgcacaatggagagtcccacttgggctttgctttttatggactttgattatcatcattggtatgttattggttccagagtccccaagatatcttattgaatgtgagagacacgaagaggcccgtgcttccattgccaaaatcaacaaggtttcaccagaggatccatgggtactcaaacaggctgatgaaatcaacgccggtgtccttgcccaaagagaactaggagaagcttcatggaaagaacttttctccgtcaaaactaaagtccttcaacgtttgatcacaggtattcttgtgcaaacctttttgcaacttactggtgaaaactactttttcttctacggaactaccattttcaaatcagtcggtcttactgatgggtttgagacgtcgatcgttctaggtacagtgaacttcttttccactattattgctgttatggtcgtagacaaaattggccgtcgtaaatgtcttttatttggtgcagctgggatgatggcttgtatggtcatatttgcaagtatcggggtgaaatgtctttaccctcatggccaggatggtccatcctcaaaaggtgcaggtaatgccatgattgtgttcacttgcttctatatattttgctttgcaacgacatgggctcctgttgcttatattgtggttgccgagtcgttcccttcgaaggtcaaatctagggccatgtcgatttcgactgcatgcaactggttgtggcaatttttgatcgggtttttcacaccattcattactgggtctatccacttctattatggttatgtgttcgtaggttgtttggttgcaatgtttctgtacgttttcttctttttaccagaaacgattggtctatctttggaggaaatccaattactatatgaagaaggtataaaaccatggaaatctgcatcttgggtcccaccttctaggagaggtattccttccgaagaaagtaagaccgagaagaaggattggaagaaatttttgaagttctcaaagggttctgattga

SEQ ID NO: 25694 - DNA, 1770 bp, Saccharomyces cerevisiae
atgactatttcttctgcacatccagaaacagaacccaagtggtggaaagaggccacaatctatcaaatttatcccgcaagtttcaaagactccaacaacgatgggtggggtgatatgaagggtattgcctccaagttggagtatatcaaagagcttggtgccgatgccatttggatctcaccattctacgactcgccacaagatgatatgggttacgatattgccaactacgaaaaggtctggccaacctacggtacgaacgaggactgctttgccttgatcgaaaagacacataagcttggtatgaaatttatcaccgacttagtcatcaaccattgctcgagcgaacatgaatggttcaaagagagcagatcctcaaaaaccaatccaaaacgtgactggttcttctggagacctcctaagggttatgacgccgaaggcaagccaattcctccaaacaattggaggtcttacttcggtggttctgcatggacgttcgatgaaaagacacaagagttttacttgcgtttgttttgctccacccaacctgatttgaattgggagaatgaggactgtagaaaggcaatctacgaaagtgccgttggatactggttagaccatggtgtagacggctttagaattgatgtgggaagcttgtactccaaggttgctggtctaccagacgctcctgtgattgacgaaaactcaaagtggcaacccagtgatcctttcacaatgaacggaccacgtatccatgagtttcatcaagaaatgaacaagttcatcagaaacagagtgaaggatggcagagaaattatgacagttggtgaaatgcaacatgctactgatgaaaccaagaggttgtatacaagtgcatcaagacacgaacttagtgagttattcaacttttcccacactgatgtcgggacttcgcccaagttccgtcaaaatttgatcccatatgaactaaaggattggaaggttgcccttgctgaacttttcagatacgttaacggaactgattgttggtcaacaatttatctggaaaatcacgaccaacctcgttcaattaccagatttggtgacgattctcctaagaaccgtgttatttctggtaagttgttgtctgtgttgttggtgtcactgagcggtactctatatgtgtaccaaggacaggaactgggtgaaatcaatttcaagaactggcctatcgaaaaatacgaggatgtcgaagttagaaataactatgatgcgatcaaggaagagcatggagaaaactcgaaggagatgaagaggtttttggaagcaattgcccttatttccagagaccatgctagaacacctatgcaatggtctcgtgaggagccaaatgctggtttttctggtcctaatgctaaaccatggttttacttgaacgagtctttcagggaaggaattaacgctgaagacgaatccaaggatcccaactcggttttgaacttctggaaggaggccttgagatttagaaaggcacacaaggatattactgtatatggatatgattttgagtttattgatttggacaataagaaactgttcagcttcacaaagaaatacgacaacaaaacattgtttgctgctttgaacttcagctctgattcgattgacttcacgattccaaacaatagctcgtcgtttaagttggaattcggaaactacccaagaagcgaagttgatgcgtcttccagaacattgaagccatgggagggcagaatttacatatctgaatga

SEQ ID NO: 25695 - DNA, 1704 bp, Saccharomyces cerevisiae
atgtcaggtgttaataatacatccgcaaatgagttatctactaccatgtctaactctaactcagcagtaggcgctccctctgttaagactgaacacggtgactctaaaaattcccttaacctagatgccaatgagccacctattgacttacctcaaaaacccctctctgcgtataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacatatcagaggaactctggtccaattgtaccagctgatgggtacgatgggtatttttctaggatactgtaccaattacggtaccaagaactatcacaacgccactcaatggagagtcggccttggtctttgctttgcctgggctacattcatggttagtggaatgatgtttgtaccagaatcaccacgttacctgattgaggttggtaaagatgaggaagcgaaacgttcactatcgaaatccaacaaagtctcagttgacgatccagccttgctagttgaatatgacactataaaggcaggaattgaacttgaaaagctggcaggtaacgcatcatggtctgaactactctccactaaaacaaaggtctttcagcgtgttctcatgggagtgatgatccaatcgctgcagcaattaaccggtgacaactacttcttttactacggtaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttacgtattcttaggctgtctggtttttgcatacttttatgtctttttctttgtcccagaaacaaaaggcctgacactggaggaggtgaatactatgtggctggaaggtgtgccagcatggaaatcggcctcatgggtgccaccggagagaagaaccgcagattacgatgctgatgcaatagatcatgacaatagaccaatttacaagaggttcttttccagctga

SEQ ID NO: 25696 - DNA, 3234 bp, Saccharomyces cerevisiae
atgacaaacgcaatgaaggtggaaggctacccttctatggaatggccaacgtccttagatattccattaaaggcttcagaagaattggtcggtatcgatttagaaaccgacttgccggatgatccaacagatttaaagactcttttagttgaggaaaattctgaaaaagaacattggttgaccattgcacttgcttattgcaaccacggaaaaacaaacgaaggtattaagctaattgaaatggccttggatgttttccaaaactctgaaagggcttcactacacacttttctgacctgggcacatttaaatctagcaaagggacaatcgctgagtgtggaaacgaaagagcatgaactgacacaggctgaattaaacctaaaggatgctattgggttcgaccccacatggattggaaatatgctagccacggtcgagttatactaccagcgcggtcattatgacaaggctttggaaacatccgacctttttgtaaagagtattcatgctgaagaccacaggtctggtaggcaatccaaacccaattgcttgtttttacttttaagagcgaaattgctttatcagaaggaaaattatatggccagtctgaaaatttttcaagaattgctggtcatcaaccctgttttgcaaccagatcctcgtattggaattggtctgtgtttttggcaattaaaggattctaagatggctatcaaatcgtggcagagagccttacaactaaatccaaaaaatacgagtgcctccattttagtattattgggtgaatttcgcgaatctttcaccaattctacaaacgataaaacattcaaggaggcttttacaaaggcattgagtgacttgaacaacattttctccgaaaaccagcataatcctgttttattgacgttattacaaacgtactactacttcaaaggtgattatcaaactgttttggatatttatcaccataggattttaaaaatgagtccgatgatagccaaaattgttctatctgaatcttcattttggtgtggtagagcgcattatgcattaggtgattatcgtaaatcattcatcatgtttcaagaaagtttaaagaaaaatgaagataacctgctcgcgaaattagggctgggtcaaacccaaattaaaaataacttgttggaggaaagtatcatcactttcgagaatctttacaagacaaatgaaagtttacaagaattaaactatatcttgggtatgctttatgcaggcaaggcctttgatgccaagacagccaaaaacacttcagcaaaagaacaaagcaacttaaatgaaaaagctctaaagtatttggagagatacctaaaattaacgcttgccacaaagaaccaattagttatatctagagcttacctagttatctctcagctgtatgaattacaaaaccaatataaaacttcattggattatctttccaaagctttggaggaaatggaattcattaaaaaggaaattccgttggaagtgctcaataatttggcatgttaccacttcattaacggtgactttataaaggctgatgatctctttaagcaagcaaaggcaaaagtgagtgataaagatgaaagtgtcaatattacacttgaatataacatagcaagaactaatgagaaaaacgactgtgaaaaatcagaatctatatattcccaggtgacgtctttacatccagcttacattgcggcaagaataagaaatctatatctcaagtttgcacaatctaagatagaagattcagatatgagtacagaaatgaataagctattagatttgaacaagtctgatctggagattcgttcattttatggttggtacttgaaaaacagcaaggaaagaaaaaacaatgaaaagagtacgacccataacaaggaaactttggtaaagtataattctcacgatgcatatgccttaatttctctagctaatctatatgtgacaattgccagagacggtaaaaagtccaggaatccaaaggaacagggaaaatcaaagcattcttatttgaaagccatccagttgtatcaaaaagttctacaagttgatccatttaatattttcgctgctcaaggtcttgccataatttttgcagaaagcaaaagattgggaccagctctagaaattttaaggaaggtaagagattctttagacaatgaagatgttcaactgaaccttgcccattgttatctggaaatgcgtgaatatggtaaggcgatcgaaaattatgaattagttctaaaaaaatttgacaatgaaaagacaagaccacatattttgaacctattaggtagagcttggtacgcacgtgccattaaggaaacctctgtgaatttttatcaaaaagccttggaaaatgccaaaactgctttggatcttttcgtgaaggagtcttctaagagcaagttcattcatagtgttaagtttaatatagctttgttgcattttcaaatagcagagacattaagaagatcaaatcccaaatttaggacggttcaacaaatcaaggattccctggaaggcttaaaagaaggtttagaactatttagagaattgaacgacctaaaagaattcaatatgattcctaaggaagaactagaacaacgtatacaattgggtgaaactactatgaaaagtgcattagaacgttccttgaatgagcaagaagaatttaagaaggaacaacgcgccaaaattgatgaagcacgtaaaattctggaagaaaatgaattaaaagagcaaggatggatgaagcaggaggaggaagccaggcgtttgaagttagaaaaacaggcagaggagtataggaaactccaagatgaggcacaaaagatattccaggtgcgagaagccatggccataagtgaacataatgttaaagatgattcagatctgtctgataaagacaatgaatatgacgaagaacagccaagacaaaaaagaaagaggtcaacaaaaactaaaaatagcggtgaatctaagagaaggaaagctgctaaaaaaactctttccgacagcgacgaggatgacgatgatgtggtgaaaaagccttctcacaataagggcaaaaaatctcaactatcgaatgaatttattgaagatagtgatgaggaagaagctcaaatgagcggttcggaacaaaataaaaacgatgacaacgacgaaaacaatgataatgatgataacgacggattgttctaa

SEQ ID NO: 25697 - DNA, 1272 bp, Saccharomyces cerevisiae
atgtttaaaagatatttatccagtacgtcatcaagaagatttacaagcattttagaggaaaaggcctttcaagtgaccacttactctagacctgaagatctatgtataactagaggtaaaaatgcaaagctgtatgatgacgtgaatggtaaagaatatatcgatttcaccgcaggtattgcggtgaccgcattaggccatgcaaatcctaaagtggcagaaattctgcaccatcaggctaacaaactggttcattcctccaacctttacttcactaaggaatgtttggatttaagtgaaaagattgttgaaaagaccaagcaattcggtggtcaacacgacgcctcaagagtatttttatgtaattctggtacggaagcaaatgaagctgctttgaagtttgcaaagaaacatggtataatgaaaaatcctagcaagcaaggcattgttgcatttgagaactcttttcatggccgtactatgggcgctttatctgtcacttggaatagtaaatatagaactccttttggggatttggttccccatgtctcattcttaaatttgaatgacgaaatgaccaaactacaaagttatatcgagaccaaaaaggacgagattgctggtttaattgtcgagcccatacaaggtgaaggtggggtttttcccgtagaagttgaaaagctaaccggattgaagaaaatatgtcaagataatgatgtgattgtcattcatgatgaaattcaatgcggtttgggccgttcaggtaaactatgggctcatgcttatttaccaagtgaggctcatccggatatttttacatctgccaaagcattgggaaatggcttccccatcgctgccaccatcgtcaatgaaaaagttaataatgctttgagagttggtgaccacggcaccacgtatggtggtaatccgctggcctgttctgtaagcaactatgttttggataccatagcagacgaagcttttttgaaacaagtctctaagaagagtgatatcttacaaaagcgcttgcgcgaaattcaagccaaatatccaaatcaaataaagactatcagaggaaaaggtttgatgcttggtgctgagttcgtcgaaccacccaccgaggtcatcaaaaaggccagagaattgggacttttgatcattaccgctggtaagagtaccgttagatttgttcccgcattaacgattgaagacgaactaatcgaagaagggatggatgcttttgaaaaggctattgaagcggtttacgcttaa

SEQ ID NO: 25698 - DNA, 642 bp, Saccharomyces cerevisiae
atgtccgttgaagaagttagcaagaagtttgaagaaaacgtttcagtcgatgataccacagctactccaaagactgttttaagtgacagtgctcacttcgatgtcaagcacccattgaacaccaaatggactttatggtacacaaagccagccgtcgataaatctgagtcgtggtctgatctattacgtcccgtcacttcattccaaactgttgaagaattttgggctatcattcaaaatattcctgagccacacgaactaccattgaaatcagattaccacgtcttccgtaatgacgttagacctgaatgggaagatgaagccaatgctaaaggtggtaaatggtctttccaacttagaggaaaaggtgctgatattgatgaattatggctaagaactttactagcagttattggtgaaacaattgatgaagacgactcccaaattaacggtgtcgttttaagcattagaaaaggtggtaacaagtttgccttatggactaaatctgaagacaaagaaccactattgagaattggtggtaaattcaagcaagttttaaaattaaccgatgacgggcatttggaattctttccacattccagtgccaatggtagacaccctcaaccatcaatcaccttgtaa

SEQ ID NO: 25699 - DNA, 1128 bp, Saccharomyces cerevisiae
atgcttaaagtgaataacgttttcgggagcaaccccaatagaatgacaaaattggaggatgaacactactttatcgatgacatcgtatcgattaaaaacagacaaaagagcaaaatgtacgtcagggaagggaaacggataggccacggctcgtttggaactgtgacacagtccattctgtcgagcaatagtattgaatggctaggaccttatgccataaaaagagtagtgaaatctcccaaagtacaatctttggaattggagatcttacagaatatcagacatccaaatctggttactttagagttcttcttcgagagccactgtactaccaaggacggtgggcacttatatcagaaaaactttgttatggaatacattcctcaaaccttaagttctgaaattcatgaatattttgacaatggttctaagatgcctacaaaacatatcaagctgtacacattccaaatacttcgagcacttctgaccttacattccatgagtatatgccatggcgatctgaaaccgagcaatatattgattataccaagtagcggtattgctaaagtgtgtgactttggctcggcacagcgactggatgataatacagaattgaagacctatttttgctcgaggttttatagagcacctgaacttctcctaaattcgaaggattatacaactcaaatagatatatggtcgcttggttgtataataggcgaaatgataaaaggccagccactttttaaaggcgatagcgctaactcacaactggaggagatagctaaactattaggccgctttcctaaaagttctataaaaaattctcaagagttacaggatagcttaaatgaccaaaaattcaagaagtttatgcattggtttccctctatagaattttttgatgtggaattcttgctaaaggtgttgacgtatgatgccactgaaaggtgcgatgctagacaattgatggctcacgaattttttgacgcgttaagaaatgaaacctattttttgccaagaggttcgagtatgccggttcacctaccagacctctttaattttagtgcatcggagaaaagggctcttggagagtattacaacttgattgtgccatctctggattag

SEQ ID NO: 25700 - DNA, 1272 bp, Saccharomyces cerevisiae
atgattctccttctgattctttttccctgtatatattttctccccttctgtataaatcgtacagtcagaagtagtccagaatatagtgctgcagactattacaaaagttcaatacaatatcataaaagttatagtaacatgcctcactcagttacaccatccatagaacaagattcgttaaaaattgccattttaggtgctgccggtggtatcgggcagtcgttatcgctgcttttgaaagctcagttgcaataccagttaaaggagagcaaccggagcgttacccacattcatctggctctttacgatgtcaaccaagaagccatcaacggtgttaccgccgacttgtctcatatagacacccccatttccgtgtcgagccactctcctgcaggtggcattgagaactgtttgcataacgcttctattgttgtcattcctgcaggtgttccaagaaaacctggcatgactcgtgatgacttatttaacgtgaatgctggtatcattagccagctcggtgattctattgcagaatgttgtgatctttccaaggtcttcgttcttgtcatttccaaccctgttaattctttagtcccagtgatggtttctaacattcttaagaaccatcctcagtctagaaattccggcattgaaagaaggatcatgggtgtcaccaagctcgacattgtcagagcgtccacttttctacgtgagataaacattgagtcagggctaactcctcgtgttaactccatgcctgacgtccctgtaattggcgggcattctggcgagactattattccgttgttttcacagtcaaacttcctatcgagattaaatgaggatcaattgaaatatttaatacatagagtccaatacggtggtgatgaagtggtcaaggccaagaacggtaaaggtagtgctaccttatcgatggcccatgccggttataagtgtgttgtccaatttgtttctttgttattgggtaacattgagcagatccatggaacctactatgtgccattaaaagatgcgaacaacttccccattgctcctggggcagatcaattattgcctctggtggacggtgcagactactttgccataccattaactattactacaaagggtgtttcctatgtggattatgacatcgttaataggatgaacgacatggaacgcaaccaaatgttgccaatttgcgtctcccagttaaagaaaaatatcgataagggcttggaattcgttgcatcgagatctgcatcatcttaa

SEQ ID NO: 25701 - DNA, 1506 bp, Saccharomyces cerevisiae
atgttgaacattcccataattgctaactccaagaggttcctgttctcaaaggatcacgaagcgcaatctacgagagatcacgatgtggagctggagacaagggagggcccaagttcaggatataatccaaacttcaatgcagcggacgcgattttgaaaaagaacagcgatcaagtagatcttgacgttaataagttaacgaacgtcacctcaagagttttaaacaccccagaggcctctttgatttatgatgatgacagagagttcccagatggtgggttaaaagcatggctggtagtatttggtgcgtttatgggactggtcccggtttttggcttaatcaactccttaggggctattgaatcatatatctctaaacatcaattggcaaatatatcttcttcaacaatatcttggattttttccctatacttagctatcagctttttaagctgtatattatccggtggctattttgatagaaatggtagtattggtttgatgtgcacaggtacagtcatatatgctggaggactattcgcattggcaaattgtaagtccgtatggcagttcattttggcattttctgtgtgctctggacttgggacgggaattttaatgactcctctgataggaactgttgcaacctggtttttaaaaagaaggggtatagcaacatctataagtaccatggggggttcaatagggggtatagttttccctattatgctgagaaagttatataaagaagtgggctttcaatgggccattagaatcctatcattcatttgtttaacatgcctcatttgtgcttcagttttggctagagaaagaactaaaccggtcgttcaaccattcaaatccaaggcggaagtagcaaagtggtacatttcctctgtgttcaattggagatattttttggaaggaaaattcttgttcgtcgcaataggcgcttcttttgcagaaagttccctaacttcatgcgctacatatttagcatcttattctatgacaagaggaaacacagaaaatgttgcttataccatgatcactgcttcgaatgctgttggtatacttggaaggtatataccaggctattttgcggataagttcatcgggagattcaatgtagaaattatcaccatttcaatggctgccttatttaattttgtcatgtggctgccatttggcggtaatacaaaggtactttgggcgtacgtttgtttgtgggggttttcgacgggttctatcctatcactgacacccgtttgcatcgggcagatatctaaaactactgattttggtaaacgttatgcaacggtatatctattgcaagcgttggtaacgattccggttttacctatcggcggtaccttaatcggtaaaggtacagttgcaaattataaccattttataatattcaattcagcgttaatggcggcaggtgcggcatgttatataatatcaaggcatatttgcgttggtgcgaagctttgtaagttttaa

SEQ ID NO: 25702 - DNA, 1755 bp, Saccharomyces cerevisiae
atgggggcaaagagtgtaacagcctcttcttcaaagaagattaaaaaccggcataatgggaaagtgaaaaagagcaagaaaatcaagaaagtacggaaaccacagaagtctatatccttgaacgacgaaaacgaagtagagattttacctagtcgtaatgagcaagagacaaataaattacctaaagatcacgtcacggcggatggaattcttgtattagaacataaatctgatgatgatgaaggattcgatgtctacgatggacatttcgataaccctactgatattccctcgactactgaagaaagtaaaacgccttcattagcagtgcacggggatgagaaggatcttgctaacaatgatgattttatctctctttctgctagttctgaggatgagcaagccgaacaggaagaggagagggagaaacaagaattagaaattaaaaaagaaaagcaaaaggaaatccttaatactgattatccatggattttaaatcatgatcactccaaacagaaagaaatctcggactggctaacctttgaaatcaaggattttgttgcctatatctcaccaagtcgtgaagaaattgaaattcgtaatcaaaccataagtacaataagagaggctgtcaaacagttatggccagatgctgatttgcacgtgtttggatcatattctaccgatttgtatttgcctggttccgatattgattgcgtggtaacgagcgaacttggtggtaaggaaagtaggaataacttgtattcgttagcaagccatttaaaaaaaaaaaatttggcaacagaggttgaagttgtcgccaaagctcgcgttccaatcatcaagtttgttgagccacattcagggatccacatagatgtttcatttgagagaacaaatggtattgaagcagcaaagcttattagagagtggttggacgatacccccggcctgagagaattagtccttatcgtaaaacaattcctacacgcaagaagactaaataatgtgcataccggtggtcttggtgggtttagtattatatgtcttgtcttttcctttttgcatatgcacccacgtataataactaacgaaatagatccaaaggacaacttgggtgtgctcctgatagagttttttgaactttatgggaaaaattttggttatgatgatgttgcactgggatcatcggatggatatccagtatactttccaaaatcgacatggagtgctattcagcctattaaaaatccattttcattggccattcaagatccaggtgatgaatcaaataacatcagtcgagggtcctttaacattcgagatattaaaaaggcatttgctggtgcttttgatctgttgacgaatagatgttttgaattacattcagcaacttttaaggatcgattggggaaaagtatattgggaaacgtgatcaaatatcgtggaaaggcaagagatttcaaggatgaaagaggtctagtactgaataaggctattattgaaaatgaaaactatcacaagaaacgtagcagaataattcatgatgaagattttgccgaagatacagttacctccacagccaccgctaccacaacagatgatgattatgaaataacgaacccacctgctaagaaggctaaaatagaagaaaaacctgaaagtgaaccggccaagagaaatagtggagagacatatatcactgtctctagcgaagatgatgatgaagatggatataatccttataccctttaa

SEQ ID NO: 25703 - DNA, 1968 bp, Saccharomyces cerevisiae
atgaagggcgtaaaaaaggaaggatggatatcttataaagttgatggattgttttcgttcttatggcaaaagagatacttggtactgaatgattcgtatttagcattttacaaaagtgataagtgcaatgaggaaccagtcttatctgtgcctttgactagtataacaaatgttagcagaatacaattgaaacaaaattgttttgagattcttcgggcaacagatcaaaaagagaacatatcccccataaactcctacttttatgaatcaaattccaaaagatcgatattcatttccacaagaaccgaacgggatttgcatggctggcttgatgccatttttgccaaatgtcctctccttagtggtgtttcatcaccaacaaattttacacacaaagtacacgttgggttcgacccaaaagtgggaaactttgttggagtacctgatagttgggctaaactactacaaacctcagaaattacgtacgacgattggaacagaaactcaaaagctgttattaaagcactgcaattttatgaagattacaatggactggacacaatgcaattcaatgatcacctcaacacaagcttagacttgaaacctttaaaaagtccgacaaggtatattataaacaagaggactaattccatcaagagatcagtaagtaggacgctccgaaaaggcaaaacagattccattttacccgtctatcaatcagaacttaaaccattcccaaggcctagtgatgatgattataagtttaccaacatagaggacaataaagtacgcgaagaaggcagggtgcatgttagtaaagaaagcacggcagattcccagacaaagcagttaggaaagaaggaacagaaagtcattcaaagccatctgcgaaggcatgataataattcaacatttagacctcatcgactagcaccatctgcacctgctacaaaaaatcatgatagtaaaactaaatggcataaggaggatctccttgaacttaagaataatgatgattcgaatgaaataataatgaagatgaaaactgttgcaattgatgtaaacccaagaccgtatttccaactggtagaaaaggctggtcaaggagcaagtggtgcagtatacctgtcaaagcgaataaaattacctcaagaaaatgacccgagattcttgaaatcacattgccaccgagtcgtaggcgaaagagtggccattaagcagatacgtttatctgaacaaccaaagaaacaattgattatgaatgaactcctagtgatgaatgattcgcgccaagaaaatatcgttaatttccttgaagcctatattattgatgacgaagagttatgggtgataatggagtacatggaaggtggctgcttaacagatatattggatgctgtagcaaggagcaataccggtgagcactcatcgccgttaaacgaaaaccaaatggcatatatagtaaaagagacgtgccaaggtttgaagtttttgcataacaagaaaattatccatcgagatatcaaatctgataatatccttctgaattcccaagggttagtgaaaattacagacttcggtttttgtgtggaattaacagaaaaaagaagcaagcgtgccacaatggtaggtactccatattggatggcacctgaaatagtgaatcaaaagggatatgatgaaaaagtcgacgtttggtctctagggataatgcttattgagatgatagaaggtgaaccgccttacctaaatgaggatcctttgaaggcgctgtatctgatagctaacaacggttcaccaaaattgcgtcatccagagtcagtgtccaagcaaaccaaacaattcttagatgcctgtttgcaagtgaatgtcgaatcaagagcatccgtgagaaaactactaacgtttgaatttttgtcaatggcatgcagccctgagcagctcaaagtatccttaaagtggcattga

SEQ ID NO: 25704 - DNA, 714 bp, Saccharomyces cerevisiae
atgtgcgatagccatcaaaaggaagaagataacgcaaatacgagcgaaagggcgttattttttaattaccatgagttttcgtattcattctacgaagacctcggttccgaagacgctaaacccacagagcacgacgaagaccacaaattgtgtattacacatttcccgaatgtgtatgctgctcggggctctgccgagttccaggtgacccgggtggtacgagtgccccggcggttcgatgagtctcgcagcagccttgaaacgccacaatttagtacacagcttcccggtagcgagccggcggcaatcgtgggcgacgatggcactagctttgtgcggtgcgggcgttacgacattggggatcacgtgtttggctgctcctccgtctcgcctctgtcagaatatcttagtgcggcagagctcgcggaggttgtgcaccgggtaaacggattcttgctgcgtgaagaaggtgaggtgttcgggtggcgtaacttaagtggcctgttgctcgatatgcttacgggcggtctgtggagctgggttttggggccccttctttctagacctgtgtttcaggagtctctcgcgttagagcagtacgtggcgcagctaaactcgccgggaggtctgcttcacgagcgcggtgtgcgcctagtattgccccgacggtccgggtgcctatccctagatttcgtcgtgccccgacccaaatag

SEQ ID NO: 25705 - DNA, 1671 bp, Saccharomyces cerevisiae
atggaaagagtatggtttgcaaaattaacaaataaaggaactattaaaatcgggtatatctcatttatacttctaagtttgctatgtcaatctctgattgggctggttaatgctgattttaattatgaaggctgttacagtgccgcggatatccagtctgctggactgtctctgaaaaactcatacatatatcaatcagtgtcatactgtcaaaaccagtgccctgagtcagcagtagtagcattatttaacgggtcagattgttactgcggtaattcggtaagttttctgacttctttgacgaaatcaacagattcaaactgtggaactaaatgctctggctggccttaccaaatgtgtggagggtcatcgtacatgaacgtgtatgtaaatgctgaaacttttgtttcatcggttgaatcttcctcttccaaagaagggtctagcacttcctatatgccctcaacaacttcttcattgtcctccgcccaaatttcttcaactactaggagaacgtcaacagatatgaaaagttctgaaatgatagccacgacagtttctaccacttcaacaacctcttcctcgacttcctctactacctcttctaccacctcttctaccacctcttctaccacctcttctactacctcttcctcgacttcctctactacctcttctaccacctcttctaccacctcttctaccacctcttctaccacctcttctactacctcttctactacctcctctactacctcctctactacctctatcttttctgttacgtctagctcctcatccattacattgtcctcatctgagcataccacagtcgatagccgtacttcttcaccctcttccaccttggtgccagtgtcctcgagtagcagcacactatcaactccaaaagtgacctcaatgacccctagtacgtcatcaacgataccaatagttacctcagtggaactagtgactagtgtggttacaaaagcgatcgtgagtacttctgatcaacatcaggaaacaatatttgttacgaggacatccgtggttgaacgatcttctgaggtagctactgctactgctgccgcctcaaataatagatctaattcgacttcgaagcagcgtctgagtggtggagccattgccggtattgttattggtgttgtgtttggcgtaatttttattattttgattctattgttcctgatatggaggagacggaaatcgcacgaccaattagacttggaggaaacgaaacattatcagccctattcgttcggtgatgaggatgcaaatccaataggaccgcctccctcctctggtacgacaaattggatgagacattcaaggggtaatacagcgggttctatcggtacaagtaatatgtatggtttttctatgagtaatggtgcaaattatagtagtcctagttcaaacaccagtggaagcatcataaacaacttggctggcttacaagatgctacggttcagaaacagaaccttccatcgacagtttttgaagaggcaaatactttgaatagtgcaaatgaaaggttcagtgccaattctttacccgacatgatgatgagcggaccattgcaagtggtaaaccctgataatcctgataatcctgaattatctagtaccgtatctcataatcgagcctga

SEQ ID NO: 25706 - DNA, 1839 bp, Saccharomyces cerevisiae
atggctgaaatgaagaattcgacagctgctagttccagatggacgaagagtcgtctctcccatttctttccctcgtacactaatagcagtggtatgggggccgcctcaactgatcaatcttctacgcagggagaagaactgcaccataggaagcactgtgaagaagacaatgatggtcaaaaaccgaaaaagtctcccgtatccacctctacaatgcaaataaaatctagacaggatgaggacgaggatgacggtcgaattgtcattaaaccagttaacgatgaagatgatacatcagtgattataactttcaatcagtcaatatccccttttattattacattgacattcgttgcgtccatttctgggttcatgtttggttatgatactggttacatatcgagtgcgctaatttctatcaatagagatttagacaacaaagttttaacttatggagaaaaagaattaattacggccgccacatcattgggcgctttgattacaagtgtgggcgctggtactgctgctgatgtgtttggaagaagaccatgtttaatgttctccaatctgatgtttttgatcggagcaattttacaaattaccgcgcacaagttttggcaaatggcggccggtagactgattatgggtttcggtgtcggtattggttctttgatttctcctctttttattagtgaaattgctcctaagatgatcaggggtaggttaaccgttataaattccctatggctgacaggtggtcaattgattgcttacggttgtggtgcgggcctgaaccacgtcaaaaacggttggagaatcttagttggtttgtccttgatacctactgttttgcagttttcttttttctgttttttgccggatacaccaagatactacgtaatgaaaggcgatttaaagagagcaaaaatggttctcaaacgaagttacgtaaacactgaagatgaaataattgatcaaaaagttgaagaattatctagcttaaatcaatcgataccaggaaaaaatccaataacaaaattctggaatatggtcaaggaattgcacactgtgccttcaaatttcagagctttgattattggttgtggtctacaagccattcaacaattcacaggttggaattccttaatgtatttctccggtacaatatttgaaactgttggattcaaaaattcttctgccgtttctattattgtctcaggtactaattttgtgttcacattaatagcatttttctgtattgataaaatcggccgtaggtacattttactgattggactacctggtatgactgtggcgctggttatatgtgctatagcgttccatttcctaggtattaagtttaacggtgctgatgcagtagtggcatctgatggattttcatcttggggcattgtcattatcgtatttattattgtgtatgcagccttttatgccctcggtatcggcactgttccatggcaacaatcggaattatttccacaaaacgtcagaggtgtagggacatcctacgctactgccaccaattgggcaggttctttagtcattgcgtctacgttcttgactatgttacaaaatattacaccaacgggtacattttcattctttgccggtgtagcatgtttatcaaccattttttgttacttttgttatccagaactatcaggattggagttagaggaagttcaaacaattttaaaggacggattcaatatcaaagcctctaaagctctagctaaaaagaggaaacaacaggtggccgaaggtgctgcccatcataaactcaaattcgaacctacacaggaaattgtagaaagttag

SEQ ID NO: 25707 - DNA, 972 bp, Saccharomyces cerevisiae
atgtccaaaactttatctttgcaacttccatgggttgagaaataccgtccccaagttttatctgatatagtcggtaataaagagaccattgatagacttcagcaaatcgctaaagatggtaacatgccccatatgatcatatcaggtatgccaggtataggtaagaccacttcggtacattgccttgctcacgagctccttggccgctcttatgctgacggtgttttagagttgaacgcttcagatgacagaggtattgatgtcgtcagaaaccaaataaaacattttgcccagaagaaactacatttgcctccagggaaacataaaatcgttattcttgatgaggcggattccatgactgctggtgctcagcaagcgttgagaaggaccatggagctatattcgaactctacaaggtttgcatttgcttgtaatcaatcaaacaagatcattgagccgctgcaaagtagatgtgcgattttgaggtattctaaactatccgatgaagacgttctaaaacgtcttttacaaatcataaagctagaggatgttaagtatacaaatgatgggttagaagcaatcatttttacagcggagggtgacatgagacaggccataaacaatctacaaagtacagtagcaggacacggtttagtgaacgcagacaatgtcttcaaaattgttgattctcctcaccctctaatagtgaagaaaatgttactagcctccaacctagaagattcaattcaaatcttaagaacagatctttggaaaaagggttattcctcgattgatatcgtcacaacatctttccgcgttaccaaaaacttagcacaagtgaaagaatcagtaagattggaaatgataaaagaaatcggtttgacccatatgagaattctggagggtgttggaacgtacttgcaactggctagtatgttagcgaaaattcataaactaaataataaagcctga

SEQ ID NO: 25708 - DNA, 1830 bp, Saccharomyces cerevisiae
atggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagttttttaaactttccaaatctccagcttccaaaagcagccggagtataggttccatgaaaagtaaccagagcctcgtttcaatgaaaagtagtgacgatggcaacagttataaaaatgattactcttctatctgtggtaacagccttccatctgcaggcttgagtcgttcgaatagtgtgaaagaattaaaattagattcaactggaagtcagagatcaaaaaataatgttgccatgttagcacgttcttctacaacatctcagacaacgtgctcttcttcttcatcatcatcttcttataactctataaaaggaaatgaaaatgatattttattgcagaataacaatcactttaggcataacaaagaaattcctcaaagtaaagggagctccaacattaacaccgcatcgattatgagccaatacaatgtcgatacgcaagcaaccgctataatgagcgatatgcaaaagcaatacgactcgcaacagatgacatcaccatttgtaaacgaagacttgcatttcgatccaaatggtgaagtttcacacgtaataaaagcaatttttaaagaaattggttataaatacgatgatttcagtgatattcctgtttttcaattaatgcaagaaatgtatcaactagtgaagaagaattccagcgctagaagaacaaagataacagactatgcctctaaacttaaagaaaaagaagcgcaattaaaaagtcaaaatgacaaaattttgaagttagaaacaacaaacaaggcctacaaaactaaatacaaggaggtctctctggaaaataagaaaataaaagaggctttcaaagaactagacaatgagtcatacaatcacgatgaggaattactaaaaaaatacaaatatactagggaaaccttagatagggtcaatagagaacagcaattaatcattgatcaaaacgagtttttgaagaaaagtgtcaatgaactacaaaatgaggttaatgctaccaacttcaagttctctttatttaaagaaaaatatgcaaaattagctgatagcatcactgaattgaatacctctacgaaaaaaagagaggccctgggagaaaacttaacttttgaatgcaatgaattaaaagaaatatgtttgaaatacaaaaaaaacatcgaaaatatatcaaataccaataagaatttacaaaattcgttcaaaaatgaaaggaaaaaagttttagatttgagaaatgagagaaatttgttgaaaaaggaaatactgttgattgaatgtcatggttcatattctctactccttgtatctaatattctgacatgttatcggttcttactgccaagtgatactattattgaaactgaaagcttaattaaggagctactcaacatgaataattcactttcgaaccatgtgtcttcttctgacgagcctccagcggagtactcgaaaagattagaattaaaatgtgtagagtttgaggaaaagttactttatttctatcaagaacttgtgacgaagaaaattatagacgtcatttacaagtgctttattaattattacaagaaaagtaggcaaactgaccaaaaatccaatcagaactccagcactccgtataaacaaagccaaagacaagttccgcactccatcaagtga

SEQ ID NO: 25709 - DNA, 2895 bp, Saccharomyces cerevisiae
atgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgtggcagattcagtctatcatactcaatctgttttaaagaactgccaattggaccctgtaacggcaaagaacttccatgaaccaactaaatatgttactgtttcgctacaagttcttgccactctgctgaagttatgtttgttggatctgggatataaagttgagatatacgataagggttggaaattaataaaaagcgcatctccagggaacattgagcaagttaatgagctaatgaatatgaatattgattcgagtatcatcattgcaagtttgaaagttcaatggaattcccaagatggaaactgcattattggagttgctttcattgataccactgcatacaaggtgggaatgcttgatattgtcgataatgaagtgtattccaacctagagagtttcttgattcaattgggtgtaaaggaatgtttggtgcaggacttgacatcaaattcaaactccaatgctgaaatgcagaaagtaataaatgtaattgatcgctgtgggtgcgtcgttacattattgaaaaactcagaattttctgaaaaagatgtcgaactggatttaaccaagttactgggcgatgatttggcattatcgttaccacaaaaatactctaaattatctatgggtgcatgcaatgcattgattggatatttacaattgctctcagagcaagatcaagtaggcaagtatgaattagttgaacataaattaaaggagtttatgaagttggatgcctccgctattaaagcccttaatttattcccacaaggaccacaaaatccatttggtagcaacaatttagctgtatctggatttacgagtgctggtaattctggtaaagtaacttctcttttccagttactgaatcattgcaaaacaaatgctggtgttcggcttttaaatgaatggttgaagcaaccactgaccaatattgacgaaattaataaaagacatgatttagtcgactatctaattgaccaaatcgagttaagacagatgttgacttctgaatatttacccatgattccagatattcgtagattgactaagaaattaaataaaagaggaaacttagaggatgtcttgaaaatttaccaattcagtaaaagaataccagaaattgttcaagttttcacttcgttcttggaggacgacagccccactgaaccagtaaacgaactggtccgctccgtttggctagctcctttaagccaccacgttgaacctttgtccaaattcgaagaaatggttgaaacaacggttgatttggatgcttatgaagaaaataacgaatttatgattaaagttgagtttaatgaggaattaggaaagataagaagtaaactggatacgttgcgtgatgaaattcattcaatccatcttgattctgctgaagatctaggattcgatccggacaaaaaactgaagttggagaaccatcatctgcatggttggtgtatgaggttgacacgtaatgacgccaaggagttacgtaaacataagaagtacattgagttgtcgacagtaaaagctggtatattttttagtaccaaacaattaaagtcaatcgccaatgaaaccaatattcttcaaaaggagtacgacaagcaacaatcggctctggttagagaaattataaatattacattaacgtacacaccagtttttgaaaaactatccttagtcttagcgcatttagatgtgattgcctcttttgctcatacttcctcgtatgctcctataccatacattagacccaagttgcatcccatggattcggaaagaagaactcacctaataagctcccgtcatccagtactggaaatgcaagacgatataagctttatatctaatgatgtcacattagagagtggaaagggcgactttttaatcataactggaccaaacatgggaggtaaatctacttacatcagacaggttggtgtgatttctttaatggcccaaattggttgtttcgtaccttgtgaagaagctgaaatagccatagtagatgcaattctttgcagggtcggggcaggagattcccaattgaaaggtgtttccacatttatggttgaaatattggaaactgcttctatactaaagaatgcgagtaagaattctttgattattgtagatgaactagggcgtggtactagtacatatgatggttttggtctagcttgggcaattgctgaacatatcgcaagtaagattggatgtttcgctttgtttgcaactcactttcatgaattgacagaattgtctgaaaaattgcccaatgtcaagaatatgcatgttgttgcacatatcgagaaaaatttaaaagaacaaaaacatgacgatgaggacatcacgttgttatacaaagttgagcctggtatttcagatcagtcttttggtattcatgttgcagaagttgttcaatttccagaaaaaattgttaaaatggctaaacgtaaagccaatgaattggacgatctaaaaactaataatgaagatttgaaaaaagctaagctatcattacaggaagttaacgaaggtaatattcgtttgaaggctttactgaaagagtggattagaaaagtgaaggaggagggtttacatgacccaagcaaaattactgaagaagcttcccagcataaaatacaagagctattgcgtgctatagcaaatgaaccagaaaaggaaaacgataattacctgaaatatataaaagccttgttgttataa

SEQ ID NO: 25710 - DNA, 1047 bp, Saccharomyces cerevisiae
atgtctatcccagaaactcaaaaaggtgttatcttctacgaatcccacggtaagttggaatacaaagatattccagttccaaagccaaaggccaacgaattgttgatcaacgttaaatactctggtgtctgtcacactgacttgcacgcttggcacggtgactggccattgccagttaagctaccattagtcggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaacaatacgctaccgctgacgctgttcaagccgctcacattcctcaaggtaccgacttggcccaagtcgcccccatcttgtgtgctggtatcaccgtctacaaggctttgaagtctgctaacttgatggccggtcactgggttgctatctccggtgctgctggtggtctaggttctttggctgttcaatacgccaaggctatgggttacagagtcttgggtattgacggtggtgaaggtaaggaagaattattcagatccatcggtggtgaagtcttcattgacttcactaaggaaaaggacattgtcggtgctgttctaaaggccactgacggtggtgctcacggtgtcatcaacgtttccgtttccgaagccgctattgaagcttctaccagatacgttagagctaacggtaccaccgttttggtcggtatgccagctggtgccaagtgttgttctgatgtcttcaaccaagtcgtcaagtccatctctattgttggttcttacgtcggtaacagagctgacaccagagaagctttggacttcttcgccagaggtttggtcaagtctccaatcaaggttgtcggcttgtctaccttgccagaaatttacgaaaagatggaaaagggtcaaatcgttggtagatacgttgttgacacttctaaataa

SEQ ID NO: 25711 - DNA, 9240 bp, Saccharomyces cerevisiae
atgtcccagcccactaagaataagaagaaagaacacgggaccgattccaagtcatcccgcatgactcggacgttggttaatcatattctttttgaaagaattctcccgatccttccggtggagtctaatctaagtacctattcggaagtggaagagtattcctcattcatttcatgcagatctgtgctcattaacgttaccgtttcccgagatgcaaatgctatggtggaaggcaccttggagttgatagaatcgcttcttcaagggcacgaaatcatttcagataagggtagcagtgacgttattgaatcaatactgattatactaagattgttaagtgatgcgctagagtataattggcaaaatcaagaaagccttcattacaacgacatttcgactcacgtagaacatgaccaagaacagaagtacagaccaaagcttaacagtattctgcccgactactcgtcgactcattccaatggcaacaaacactttttccaccagagcaaacctcaggcactgataccggaactggcatcgaaattgcttgagagttgcgcgaagttgaagttcaatacaagaactttgcaaattttacaaaatatgatcagtcatgttcatggaaacattctaacgactttgagttcctcgattcttccccgccacaaatcctatctgacaaggcacaaccatccttctcattgtaaaatgattgactctactctaggccatattctccgatttgtagcggcttccaatccgtccgagtattttgaatttatcagaaagagtgtgcaagtgcccgtaacacagacacacacgcattcacactcccattcacactctttgccatcttccgtttataacagcatagtgccccactttgatcttttcagcttcatctatttaagcaagcataattttaagaaatacttggaactcatcaaaaacttatcggtgacgttaaggaaaacgatttatcattgcctacttttgcattacagcgccaaagcaataatgttttggataatggctaggcctgcggaatattatgaactcttcaacttattaaaagataataacaatgaacactcgaaatccttaaacacgttaaaccatacacttttcgaggagatccattcgacttttaatgtgaatagcatgataaccaccaatcaaaatgctcatcaaggctcatcttccccttcgtcctcctcgccatcgtcaccacctagctcatcatcatcggataacaacaatcaaaacataatagcaaaatccttaagtcgtcagctttctcaccaccagtcatacattcaacagcagtctgaaagaaaactacattcttcatggactacaaactctcaatcctctacttcactgtcatcttcaacgtctaattcaacaacaactgatttctctactcacactcaaccaggagaatatgacccttccttaccagatactcccacgatgtctaacatcactattagtgcatcttcattattatctcaaactccaactccaacaacacaattgcaacagcggttgaactcagcagctgcagccgccgccgcagctgcttcaccatcgaattccaccccaactggatacacagcagagcaacaaagtcgcgcttcatacgatgcacacaaaactggccatactggtaaggattatgacgaacattttttgtctgtcactcgtttggataatgttttggagttatacacgcactttgatgatactgaggtactaccacacacatccgtactgaagtttttaactactttgacaatgttcgatattgacctttttaatgaattaaacgctacatcattcaaatatattcctgattgtactatgcatcgtccaaaagaaagaacaagttctttcaataatactgcacacgagacaggttccgaaaagacttcgggtataaaacatattacacaaggcttaaagaaattaacttctttaccttcctcaaccaaaaaaactgtaaaatttgtgaagatgttgctaagaaatttaaatgggaatcaagctgtatcagatgttgccctcttagatacaatgagggccttactatcattctttacaatgacttctgcggtctttctcgtggatagaaacttaccctcagtactttttgccaagagactcatccccataatggggacaaatttaagcgtcggtcaagactggaattcaaaaataaataacagtttgatggtttgtttgaaaaaaaactccaccacgtttgttcaattacaattaatattcttctcttcagctattcaattcgatcatgaattattactggcacgtctgagcatcgatacaatggccaacaatttaaacatgcagaagctatgcctttatactgaaggattcaggatattcttcgacataccaagtaagaaggaattgcggaaggcaattgcggttaaaatttctaaatttttcaaaacattattctccattatagcagatattcttttacaagaatttccgtattttgatgagcaaatcaccgacatagttgcttccattcttgacggtacaattatcaatgagtatggtacgaagaaacatttcaaggggagctcaccctctttatgttcgacaacccggtcaagatcaggatctacatctcaaagttcaatgacaccagtttctccgctgggactggatactgatatatgtccaatgaacaccctgtctttagttggttcaagtacttcaagaaattctgacaacgttaattcattaaacagttcaccaaagaacttgtcttctgatccatacttgtcacatcttgtggccccaagagcgcgtcatgctttaggtgggccatctagtattataaggaataaaataccgactacattgacttcacctccaggaacggaaaaatcttcaccagtacaacgtccgcaaacggaaagcatcagtgccacaccaatggccataacaaattctactccattatcgtcggcagcattcggaattcgatcgcctttgcagaaaataagaacgaggcgttattccgatgaaagtttaggaaaattcatgaaatcaacaaataattacattcaagaacatttgataccaaaagatttgaatgaagcaactcttcaagatgctagaagaataatgattaatattttcagtatttttaagagaccgaatagttacttcatcattcctcacaatataaactcgaatttacaatgggtttcgcaggattttagaaatattatgaaaccgattttcgtcgccatcgtaagtccggatgtagatttacagaatactgctcaatcattcatggataccttattatcgaatgttattacttatggtgaatcagatgagaatatcagtattgaagggtatcatcttctttgcagttacactgtaacattatttgcaatgggccttttcgatttgaaaattaataatgaaaagcgtcaaattctcttggatataactgtcaagtttatgaaggttagatcacatttagcagggatcgcggaggcctcacaccacatggaatacataagtgattctgaaaaactcacctttccgctgattatggggactgttggtagggccctatttgtttcattatactctagtcaacaaaaaattgaaaagactttaaagattgcttacacagagtatctttctgcaatcaattttcatgagaggaatattgatgatgctgataaaacttgggttcataatattgagtttgtagaagcgatgtgtcatgacaactacacaacttctggttcaattgctttccaaaggaggacaagaaataatattttacgatttgctactattcctaacgctatcttacttgattctatgaggatgatctataagaagtggcatacttacacacacagtaaaagtttagaaaaacaagaacggaacgacttcagaaatttcgcgggtattttagcctctttgtcgggtatcctattcatcaataaaaagatattgcaagaaatgtatccatacctactcgacaccgtttcagaattgaaaaaaaatatagactcttttatctcaaaacaatgccaatggttaaactatccggatttattaacgagagaaaattcaagagatattctaagtgtagaactgcatcctttgtcttttaacttactttttaataatttgaggctcaagttaaaagaacttgcttgttcagacttatcaataccagaaaatgaaagttcctatgttttattagaacaaataatcaaaatgctgcggacaatcctaggtcgtgatgatgacaattatgtaatgatgcttttttccacagagattgtagatcttattgatttattgacagatgaaataaaaaaaataccagcctattgtccaaaatatctcaaggcaattattcaaatgaccaaaatgttcagtgccttgcagcactcagaggttaatttaggtgtcaaaaatcattttcacgttaaaaataaatggttgaggcaaatcactgattggtttcaagtgagtattgcgagagagtacgatttcgaaaacttgtcaaaacctctaaaagaaatggatttggtaaaaagagacatggatattctatacatagatacggcaatcgaagcttcaaccgctattgcgtacctcacgagacatactttcttagagattccacctgccgcgtcagatcccgaactatctcgatctaggtctgtgatatttgggttttatttcaacatcttaatgaaaggccttgaaaaaagtagtgatcgtgacaattacccagtattcttgaggcacaaaatgagtgtcctcaacgacaatgtaatactttcattaacaaatctttcaaacaccaatgttgatgcgagtttgcagttcaccttaccgatgggctattccggaaatcgaaacattaggaatgcatttttggaggtcttcattaatatcgttacgaactatcggacatacacggctaaaactgaccttggaaaattagaggcagcagacaaatttttgcgatatacgattgaacatccccagctatcgtcctttggagcagcggtttgtcccgctagcgatattgatgcttatgctgctggcttaataaatgcatttgaaacgaggaatgccacccacattgtagtggcacagttgattaaaaatgaaattgaaaaatcttccagacctacggatatccttagaagaaatagctgtgctacgagatcattatctatgctagccaggtccaagggtaacgaatatttgattcgcactttgcaaccattactaaaaaaaattatccagaacagagatttttttgaaattgagaaactaaaaccggaagattcagatgctgaacgtcaaatagagctcttcgttaaatacatgaatgaattattggaatccatatccaactccgtatcttattttccccctcctttattttatatttgccaaaacatttataaagttgcgtgtgaaaaatttccggatcacgcaattatcgccgctgggtctttcgtgtttttacggtttttttgtcctgctttagtcagccctgattctgaaaatatcatagatatttctcacttgagcgaaaagcgtaccttcatcagcttggctaaagttatccaaaatattgccaatggctcagaaaatttctccagatggccagctttgtgttcccaaaaggattttcttaaggaatgtagcgatagaattttcagattcctagctgaactttgtagaacagatcgcacgatagacatccaagtgagaacagacccaacgccaattgcatttgactatcaattccttcattcctttgtttacctttacggtcttgaggtgagaaggaatgtgctaaatgaagcaaaacatgatgatggtgacattgatggtgacgatttctataagaccacatttttacttattgatgatgttcttggccaattaggccaacctaaaatggaattttccaatgaaataccaatatacataagagaacatatggacgactatccggaactgtatgagttcatgaataggcacgcgttcagaaacattgagacttcaacagcgtacagcccaagcgttcacgagtccacctcaagtgaaggcattccaattattacgttaacaatgtcaaatttctcagacagacatgtggacattgatacagttgcttacaagttcttgcaaatttatgctcgaatctggaccaccaaacactgtttaataatcgactgtacagaatttgacgagggagggcttgatatgaggaaatttatttctttggttatgggactattaccagaagttgcacccaaaaattgtataggctgttactactttaacgtaaacgagacatttatggataattatggaaaatgtttggacaaagacaacgtatatgtttcctcgaaaattcctcattatttcattaatagtaactctgatgaaggacttatgaaatctgtgggtataactggacaagggttgaaggttctgcaagatattcgtgtctctctgcatgatatcacgctttatgacgaaaaaagaaatagatttacgccggtatcgttgaaaataggcgatatttactttcaagtcttgcatgaaactcctaggcaatataaaataagggacatgggtactttattcgacgtaaaattcaatgatgtctacgaaattagccgaatatttgaagtacatgtttcgtcaataactggagtggcagctgaatttacagtaacttttcaggacgagagaaggttgatttttagtagtccgaaataccttgaaattgtgaagatgttctattacgcacagatccggttagaaagtgaatatgaaatggataataattcgagtacctcctccccaaattcaaacaacaaggacaaacagcagaaagagagaacaaaactattgtgccacctactgttagtatctcttattggtctgtttgatgagagtaaaaaaatgaaaaacagttcgtataacctaatagctgccactgaggcgtcatttggtttgaactttggctcccattttcatcgctctcccgaggtgtacgtccccgaagatactacaacatttttaggtgttattggaaagtctcttgcagagtctaatccagaactcacagcctatatgtttatctatgttttggaggcattgaagaacaacgtaattcctcacgtttacatccctcataccatttgcggtttgtcttattggatccctaatttataccaacatgtgtatttggctgatgatgaagaaggccccgaaaacatatctcacattttccgaattcttatcaggctctctgtgagagagactgactttaaagccgtatacatgcaatatgtttggttgctacttttagatgatggccgcttaactgacattatcgttgatgaagttattaatcatgcgttagaaagagactccgaaaaccgcgattggaagaaaacaatatcgttactgactgtcctacccactactgaggttgctaataatattattcaaaaaatattggcaaaaattagatcatttttaccgtcattgaagttagaagctatgacccaaagttggtctgaactaacaatattagttaagataagcatccacgttttttttgaaacttctttgctggtacagatgtacttaccagagatcctgtttatcgtatccttattaattgatgttggtccaagggaactcagatcatcactacaccagctattaatgaatgtatgccattccttggctattaactcagctttaccacaagatcatagaaataatctagatgaaataagtgatatatttgcacatcaaaaggtgaagtttatgtttgggttcagcgaggacaaaggacgaattttacagatttttagcgcttcttcttttgcaagcaagtttaatattctggatttcttcatcaataatatattattgctgatggaatattcttcaacgtacgaagcaaacgtgtggaagacaagatacaagaaatatgtcttggaatctgtgtttacaagtaattcttttctttcggcacgttcaatcatgattgttggtataatgggtaaatcttacataactgaagggttatgcaaggctatgttaattgaaaccatgaaagttatcgccgaaccaaagattactgacgagcatcttttcttagccatatctcatatttttacttattccaaaattgttgaaggtttggatcccaaccttgacttaatgaagcacttattttggttttcaacactcttccttgaatcacgtcacccgataatttttgagggtgcccttctctttgtgtcaaactgtataaggcgcctatacatggcccagtttgaaaatgaaagcgaaacatcattgataagtactttacttaaggggagaaagtttgctcatacctttttaagcaagatagagaatcttagtggtattgtttggaatgaagataattttacacacattctgattttcatcattaataaaggactatccaatcctttcattaagagtacggcttttgatttcttgaagatgatgtttagaaactcctactttgagcatcaaatcaatcagaaatctgatcattatttgtgctatatgttcctattgtattttgttttaaactgcaatcaatttgaggaacttttaggtgacgttgattttgaaggagaaatggttaacattgaaaacaagaacaccattcctaaaattttgttagagtggttgagttcggataacgaaaatgcaaacattaccctctatcaaggtgcgatactgttcaaatgttcagttacggatgaaccaagtagatttaggtttgcgttgattattaggcatctattgacaaagaaacccatttgtgcattgcgtttttacagtgttattcgtaacgaaataagaaaaatatcagcatttgagcaaaattcggattgtgttccacttgctttcgatattttaaacttattagtgacgcattcagagtctaattcgttagaaaaacttcacgaagaatccattgaacgtctaaccaaaagaggtttatcgattgtgacttcttctggtatatttgcgaagaactccgacatgatgatacctttagatgtaaaacctgaagatatctatgaacgtaagagaataatgacaatgattttatcaaggatgtcatgttctgcttag

SEQ ID NO: 25712 - DNA, 3288 bp, Saccharomyces cerevisiae
atgatttcaaacccttccatcatgttcttagatgagcctaccactggactggatgcatattctgccttcttggttattaaaactttgaaaaaattagctaaagaagatggcaggacttttatcatgtcaattcatcagccgagatcggatatattgtttttattggaccaggtttgtattttgtcaaagggaaatgtggtatattgtgacaaaatggataatactatcccttattttgagtctattggttatcacgtaccccagctggtaaatccagcagattatttcattgatttatcaagcgtagactctagatctgataaagaagaagctgccacgcaaagtcggctaaattcattgattgatcattggcatgattatgagagaactcatttgcaactacaggcagaatcttatataagcaacgcaacggaaattcaaattcagaatatgactaccagactgccattttggaagcaagttacggtgctaacaaggcgaaatttcaaattaaatttttcagattacgttactttaatatctacttttgcagaaccgttgattattggtactgtttgcggttggatttactataaacctgacaaaagcagtataggtggtttaaggacaacaaccgcatgtctttacgcgtccacaattttgcaatgttacttgtatttgctttttgatacttatcgactttgtgagcaggatattgcgttatatgacagagaaagagcagagggctcggtaacacctttggcattcatcgtagctagaaaaatttcacttttcctctctgacgatttcgcgatgaccatgatttttgtcagtataacatattttatgtttggattggaagcagatgcaaggaagtttttttatcagtttgctgttgtatttttatgtcagctatcatgttccggtttatctatgttatcggtggcggtatcgagagatttttctaaagcttcattagtaggaaatatgacatttacggtattatcgatgggatgtggttttttcgttaatgctaaagtaatgcccgtgtatgttcgttggattaaatatattgcctttacgtggtattcattcggtactctcatgtcaagcacctttacgaattcgtactgtactacagataatctcgatgagtgcttgggtaaccagatattggaagtttacgggtttcctaggaattggataaccgtacctgccgttgtcttactttgctggtctgtgggatattttgtagtaggtgcaattattttatatttgcacaagattgatataactttacaaaatgaagtgaaatcgaagcaaaaaaaaatcaaaaagaaatccccaacaggaatgaaacccgagattcagctgctagatgacgtgtatcatcagaaagatttggaagcggagaaaggaaaaaatatacatattactataaaattagaagatatagacttacgagtcattttttctgcccctttctcaaactggaaagaaggcaacttccaccatgaaacaaaagaaattctacaatcagttaatgccattttcaaacctggaatgattaatgcaattatggggccatcagggtctggaaagtcttctctgttaaacctaatctccggaagattaaaatcttcggtctttgccaaatttgacacttcaggttcaataatgttcaatgatattcaagtttcagagcttatgtttaaaaatgtatgctcgtatgtctcgcaggatgatgaccaccttttggcagctttaaccgttaaagaaaccctgaaatatgccgctgcattaagattgcatcatctgactgaggcagaacgaatggagagaactgacaacctaataaggtctttgggtttaaagcattgtgaaaacaatatcattggtaatgaatttgttaaaggtataagcggtggtgaaaaaagaagagtaactatgggtgtgcaattattaaacgatcctccgatattattgctagatgaaccaacttcagggttagatagcttcacatccgctactatactggaaattttggagaagttatgtagggaacagggcaagacgatcatcattaccattcatcaaccaaggtcagaattattcaagagatttggtaatgttttgctattagctaaatcgggtagaactgctttcaatggatcaccagatgaaatgattgcttatttcactgaattgggatataactgtccttcgtttacgaacgtggcagatttctttcttgatttaatttcagttaatacccagaacgaacagaatgaaataagctcaagggcacgagtagaaaagatacttagtgcatggaaagctaatatggataacgaaagcctttcaccaaccccaatttctgaaaaacaacaatactctcaggagtcatttttcacagaatacagcgagtttgtaagaaaaccagctaatttggttttggcgtacatagtgaacgttaaaaggcaatttactacgacaaggagaagttttgactctttgatggcgcgtattgcacaaattccaggattaggtgttattttcgcattattctttgccccagtcaagcataattatacaagtattagcaatcgtctaggattggcacaagaatctacagcactatattttgtgggcatgctggggaacttggcatgttatccaactgaaagagattacttttacgaagaatataatgataatgtttatggtatagcaccttttttcttagcttatatgacattagagttgccgctatccgcattagcttcagtgttatacgcggtatttacagtactggcatgtgggttaccaagaactgcaggcaacttctttgcaaccgtctactgttcctttattgttacctgttgtggcgaacgtcttggtataatgacaaatacatttttcgaaaggccaggcttcgtcgttaactgcatttccattattttatccattggtactcagatgtcagggttaatgtcactaggcatgtcgagagtattaaagggttttaactatttgaaccctgtagggtatacatctatgatcatcattaatttcgcattcccaggtaatttgaaattaacctgcgaagatggcgggaaaaattcagacggtacttgtgaatttgcgaatggccatgatgtgttggtttcttatggtttagtcagaaatacgcaaaagtacctgggaatcattgtgtgcgtagccataatttatcgccttattgcattttttattttaaaagcaaaattggagtggataaaatggtga

SEQ ID NO: 25713 - DNA, 2086 bp, Schizosaccharomyces pombe
atgtatgtcaactatattggactctttgctttcgttcaaatttcgttgacgttagcttatcctcccggtcgtgtggagatttctgaaatatatgattttgaagaatctagttcgtataaaggacaagatattgatacatccgtactttacactttgtctaaaaggaaacctgcgctcgtaaaacgaagtaccgacgcttcgtatgcccctttcaatgtgacctgttcaaacgacaatctgttgaggccggcttctgaaggtttaaatgagggcgaacagagctatatcaacaaacgtatttctaaggttaacagtgaactccgatcatttatttctaagacaggtttgaatgttgacttggataaggtggttaacagctcggatggtccacgtttaggaattgcattctcaggtggtgggttacgggcgatggttaatggaggtggtgcattcaatgcttttgactcaagattcgagagtgactctccactttctggtctgctgcaatccgcgatgtatatcagcggtctttctggtggttcatggcttgttggatcagtggctattaataattttacgaatataacatacttacgtgataatgtctggaatttggaacatagcgtttttgctcctcatggggataatgtcattgaaaatttgaattattataatgacttgcgcaaagaaattgatcaaaagaaacatgcgggctttgactgttctttgacggatttatggggacgtgctttgtcccgtaaacttgttgatgctgaaaggggaggaccaggcattacatattccagtatgagaaatcaaagctggtttcaaaatgctgattatccttatcccatcatcgttgcggatagccgattagaagaagaaacggccatccctgccaataccagtatctttgagttcacggcgtatgaatttggtacatgggacaatggaattaaagcattcattccaatggaatatgtgggaactcacttgttggatggggttccacccgataagtcttgcattcataactatgataatgcaggttttgttatgggcacttcagctactttattcaactcttttcttcttgactggaatgaaaatgtcaaaaagaatgatacctattacgatattcttcatgcgattcttgaagatctttctaagcatcaagatgatattgctccttatcccaatccttaccaaaattatactacttccaatacctctgtagtgaatgcgttcgaaccgtatgatactattgatctagttgatggtggtgaggatagggaaaacattcccctttggcctttgttacacccacaacgatttgtggacgttgtatttgcgattgattcgacttataatgatccttatggttggccccttggatcttccattgttgctacatatgagagagttgtaacctttaatgcgaacaagagtgttgatgtgcgtggatttccatatattccggacgaaaacactattatctctttgggactaaacactcgtcctacgttttttggatgtgacggtaaaaatactacagcaggaaatcatgatgtagacaataataccccacctctccttgtatactttccaaattacccttggacttattattccaatatatcgacatttactatgagcatggacgacaagatggctaatggaattcttgagaatgcatttatgtcgactacgcaaaacaataatgaatcttttgcagtttgcttagcatgcgctataattcaacgctctttggaacgcaagaaattgagtactcctacccagtgctcttcttgtttccaagaatactgttgggacggaactcttgcaactagtacggcttctgtatatgatcctaccgtaatgtctgctgcgacaacatctcgtgcaccgtcaggcacaacctcgggtacagcctctagtacaacatcttcatctgtatgttctcaaaaattcacgttgattaaactattttttttttcatcgctaacttttgttctaggtagcatcagccactcccactcataaacattggtgggactcgattttcgaagcgaaagaaaatccgtaa

SEQ ID NO: 25714 - DNA, 1782 bp, Schizosaccharomyces pombe
atgactaaggacgctgaatctactatgaccgttggtacctatctcgcccagagattggtcgaaatcggtatcaagaaccactttgttgttcctggtgactacaaccttcgtcttttggacttcttggagtactatcccggtttgtctgagattggttgctgtaacgagttgaactgtgccttcgctgctgagggttacgctcgttctaacggtattgcttgcgccgtcgtcacctactccgtcggtgccttgaccgctttcgatggtattggaggtgcctacgctgagaaccttcccgtcattttggtctctggttcccccaacaccaatgaccttagctctggtcatttgttgcaccacactcttggtactcatgactttgaataccaaatggagattgccaagaagctcacttgtgccgctgttgccatcaagagagctgaggatgctcccgttatgattgaccatgccatccgtcaagctatcctccaacacaagcctgtctacattgaaatccccaccaacatggctaaccaaccttgccctgtccccggtcccattagcgctgtcatctcccctgagatcagtgataaggagtcccttgagaaggccactgacattgctgctgaattaatcagcaagaaggagaaacccattcttttagctggtcccaagctccgtgctgctggtgccgaatctgccttcgttaagttggccgaagctttgaactgtgccgctttcatcatgcccgctgctaagggtttctactctgaggagcacaagaactatgctggtgtctactggggtgaagttagcagctccgagaccaccaaggctgtttatgagagctccgaccttgtcatcggtgctggtgtccttttcaacgattacagcactgtcggttggagagctgctcccaaccccaacatcttgttgaactctgactacactagcgtttccatccctggttacgttttctcccgtgtctacatggccgaattcttggagcttcttgccaagaaggtttccaagaagcccgctactcttgaggcttacaacaaggctcgccctcaaaccgttgttcccaaggctgccgagcctaaggctgctttgaaccgtgttgaggttatgcgtcaaatccaaggtttggtcgatagcaacaccactttgtatgctgagactggtgactcctggttcaacggtcttcaaatgaagttacccgctggtgccaagtttgaggttgagatgcaatggggtcacattggttggtctgttccttctgctatgggttatgctgtcgctgcccctgagagaagaaccattgtcatggttggtgacggttctttccaacttactggtcaagagatctctcaaatgatccgccacaagctccccgttctcattttcttgcttaacaaccgtggttacaccattgagattcaaatccacgatggtccttacaaccgtatccaaaactgggacttcgctgctttctgcgagtctttgaacggtgaaaccggtaaggctaagggtcttcatgctaagactggtgaagagcttaccagcgccatcaaggttgctcttcaaaacaaggagggtcctactttgattgagtgtgccatcgacaccgatgactgcacccaagagttggttgactggggtaaggctgttgctccgccaacgcccgtcctcctaccgctgataactagattaaaacggacgttgtttggtaagaatatgttacatttagattacaagaattatttggatattagaaataca

SEQ ID NO: 25715 - DNA, 1668 bp, Schizosaccharomyces pombe
atgaataggtttattacatcaattctcgtggtgtttatctcaatgtccggatggttgcaaggcgccgatactggttccattagcggcatcttgggcatgcgagattttcaatctcgttttgctgatcgttacaatcccatttcaaattcctacagttactcagcatggagacaagctttgttgactggtacaatcaatgctggctgtttatttggtgctatgctttcttcgccgtttaccgaaagaattggtaagaaatactctatttgctttttcagcggggtatatattattgcagagcttcttttagtcacagcagtcccttcttggattcaagtattggttggtaaaatccttgctggtgttggtatcggagctttgtcagtcttgagtcctggataccaatctgaagtagcaccaccacaaattcgtggtgcagttgttgcaacctatcaaattttctcgacaggtgctgctttagttgcagcctgtatcaatatgggaactcataaactgcgtaagactgcatcatggagaacttcttttggcataaatatgctttggggaatcctgttaatggttggtgtactctttttgcctgaatcaccgcgttatcttatttacaaaggacgagatgaagaagctcttcgaattatgtgcaatatggcggaactaagtcctgaaagtgaaattattcaaactaattttaataccattaagagtgatattgaaatagaaatggctggaggtaaagcaagatggatagaaattttcggtaaggatattcgataccgtacctgcttaggatttcttgtcatgttgttcagagagttgattggtaacaattattatttctattatgctacacaagttttcaagggaactggtatgacggatatattcttaccagccgttattttaggtgctattaattttggtacaacgtttggtgctttatacacaattgataacttaggacgtcgtaacccactaatttttggagctgctttccaatcgatatgcttctttatatatgccgctgtaggcgatcgaaagctcatatataagaatggtactagtgatcacagagcaggatctgtaatgattgtgttttcttgtttgtttcttttctcttactgctgttcttggggcccaatgggctgggtaattgtgggtgaaacttttcccattcgttatcgcagtaaatgcgcttctgtagccacatcgggaaactggctgggtaatttcatgatttctttttttactcctttcattaacaatgcgatcggattcaagcttggttacatttacgcctgcattaatttgtttagttcatttatgattttctttttggctaaagaaactaaaggtcttactttggaggaagtcaatgacttatacatgtccaacattaagccatgggaatcttacaaatatgtaagagaaattgaatctcatcgtatacactttagtaaagaagaagaaaagcgtgaaagagagaaatcgaaaggtattcgcggccaagaagaagaattcattgaaaatgctgatgaagacaataacgatagtagttcttcttcaggatctgtcgtgtctgctgtcaagccacggagatccgctgtttccaacgatcgcttttcagaggattcacaccctacgtatatctaa

SEQ ID NO: 25716 - DNA, 1182 bp, Schizosaccharomyces pombe
atggctcttcaaagcctttttttgattcttctcgcgggtgctgctcaattggctcaagcgcacccaaagatctttgagcaatctcgtgcaaatgcagttgaaacctttgacgatgcttttccaggagatggtgaaacacaagctgattccgttttttcgggaatcgcaacttttggtcgtcttccttattggaaatgtctaaacgacaaaagtcaatctttcgacattgccttccttggagcaccattcgacactggtactagttaccgtcctggtgctagatttggtccaagcggtatccgtgaaggatctcgtcgtctcaatctttatggtggttacaacgttccaatggagaccaaccctttcaacaattgggctaaaattgtggactgtggtgatattcctttgacgagttatgacaatgcagttgctattaaacaaatcgagaatggccatttcgaattattaactcgcaagcctacatcttattctgagaaagatggttatgcattagatggaagcgttttgcctagagttatcaccctcggtggtgaccacacaattgtccttccaattcttcgatcggtctctcgtgcatatggacctgtctctatcattcatttcgatagtcatttggacagctggaagcccaaggtttttggaggcggcaaatcaagtgttggtagcattaaccatggtacttatttctaccatgctagtcaagaaggattagtttctaacgattcaaacattcatgctggtattcgtacaactctctccggtctctctgactacgataatgatgctgattgtggttttgagattattgaagctcgtgaaattgacacaattggaattgatgctattataaagaggatccgtgacagagttggagatggtatagcttacttgtctattgacatcgacgttcttgatcccgcttatgctcccgccaccggtacccctgagagtgcaggttggaccaccagagaattacgtaccattctccgcggcttggatgggatcaaactcgtcggtgcagacattgtagaggttgcacctgcttatgattttgctgaagttactacattagctgctgctgatatcttgtttgaagttatgtctatcatggtaaagactcctgtgtacaaagaacaggctaaacaacaaagtcgtttctat

SEQ ID NO: 25717 - DNA, 1494 bp, Schizosaccharomyces pombe
atgtcagatcaatcggaatataaaatctcaaaagacgatgagcatagcatttatgcttcagaaataaataaggagaaactccagaatacagcgtcgccagatgtggattatggagatacagcctcgttaaaaatcgacccaaaggttgaaaagaaactacttttgaaaatggaccttgtaatcagtcccattattgggttcctttatttaatggcatttttggatcgctcaaatattggtaatgctgctgttgctggtatgactgaggcattgagtctttatggagaacgtttaaatgttgctgttagtattttttatgtattgtatattttggttgagactcctagtgtcgttttggttaaacgaattaaagcctcgcggatgttggcatttatatcttttgcatggagcatgactgttctgttttctggatttatgtcaagctatggaggtttgattgctacacgcttaattcttggtttgttggaaggttgcttatttcctgcgcttaacttgtatctgacaactcattacacccgcaaagaacaatgccagcgtctttcctacttgtttgcttcggctggtttagcaggtgcttttggaggtctttttgcttatgctcttgagcaagttcatgctggtaacaaagaaggttggcaatggatatacatcgtagaaggtctcgtttcctttattggtgttccactttgtttatttgctcttccggataagatggaaaatgcttggttccttacccgtgaagaaagggaggttgctattattcgtagagatattaacgcccgttatcatggtgagcaacattttgaatggtcagaagttaggaaggcctttaaggatcccaaagtttacgtttctgctacgtctcaattttgtgccgatatggtgttgtatggattttcatctttcttgcctgtcattattaagggtcttggttttgtaggccttcaaactaactatatgactattccagtatatattgctggtgtgatatcatttttatttgttgcatggctctctgatcgcactcagctacgagctgtatatttaatttcagcttcaaccgttgttgcagttggatatataataatgttagcaagcgattctaatgctgcaaagtatactgcaacttatattattgccataggatgttacatcggtcctggtttaaatctcgggtggttgaacaataacgttgcgggtcattacaaaagagcaactgcgataggaattcagcagactcttgcgaacagttcgggcattgttgctggtcagatttatcggtctaaaaatgctccaaaatacattttgggtaatgctttcacattaggctgtgttatagttggcggactcgcctacgttgtcatgttcttttcacttcgttacgtgaacaaaaagcgagatgagcgatgtgctcgtggtgaatttgatccatctgccattggtgactttgctgacgacttccgatattatctg

SEQ ID NO: 25718 - DNA, 1266 bp, Schizosaccharomyces pombe
atgtccattcttcgttctccatttcgtttaattcgatcgcctgctcgattctttccgtcactctttcattcctcttgtaatcaatcttttactaatggcttaaagcatcaatcaacctcttcgaaagccatgcctgttagcgcattctacataccttctttcaaccttttcggtaaaggttgtcttgctgaagccgccaagcaaattaagatgagcggcttcaaaaacaccttaattgttaccgatcctggtattattaaggtcggtttgtatgacaaagttaaggctctgttggaagaacaaagcatcactgttcacctttacgatggtgttcaacctaatcccaccgttggaaatgtcaaccaaggtctcgaaatcgttaagaaggaaaactgtgattctatggtatcaattggtggtggttctgctcacgattgtgccaaaggtattgctttgttagctactaatggcggtaaaattgcggattatgaaggtgttgataaatcctccaaacctcaacttcccttgattgcaatcaatacgactgcaggaactgcttctgaaatgactcgtttcgcaattatcaccgaagagacccgtcatattaaaatggctattatcgataagcatactatgcctatcctttccgttaacgatcctgaaacaatgtatggattacctccttccttgaccgctgctactggtatggacgctttgactcatgctgttgaagcttacgtctctactgctgctaatcccatcaccgatgcttgtgctgtcaaatgcatcgaactcgttaataagtatttgaagcgtgctgtcgacaacggcaaggacgaagaggctagagacaatatggcttatgccgaattccttggtggtatggcatttaacaacgcatctttgggttatgttcatgctatggctcatcaacttggtggtttctacggtattccacatggcgtctgtaacgctgttcttcttgcccatgtacagaaatttaattctagggatccaagagcaaatgctcgccttggtgatattgcttttcacttgggttgtgaagagcatactgccgaagcagctcttgaccgcatcagtcaacttgttcttgaagttaaaattcgtcctcatctagttgatctaggtgtcaaggaaaaagattttgatgtcttggttgaccacgctatgaaggatgcttgtggtgctactaaccctattcagcctacacatgacgaggtaaaggctattttcaaatcggctatg

SEQ ID NO: 25719 - DNA, 3210 bp, Schizosaccharomyces pombe
atgaaaagaaaggtacaaaaaattatagatgaagcccctttagaagaaaattctcctcctcgattttttgattcagatgttgaagctgactctaaaccgaatgatttaactgctgcgaattccatcgtagacttaaaaacaaattctcaacatgaaaatgctaacgcagcaggcaaggaatatggagatagtggagtttcagagtcatgggttttagactttttatctgtcactggtgaaaaaacaatttcggaatttttagctcaaaaaatttggaaaacctcgaatggagatttgaatgtcgccgttgatatgtattttgatgaatcctttaatataaagaattcgaatcctgacagtgaaagtcagaaagacactgatgcctcgttgacccagatggaccaattatctaatactgtatccgttaaggatcttagtattaataggaacacaaataaaaaagccttaaatgctgttagcccttcattgaatttgtcatctaacagttctgttcaagatgtatctattgataaagaagaaatgatgaagaagcaatcacggaatgctcttactccgctggactttattatgaagaagaatgagttgatgaagtatatcggatgctttggtgtggaggcttattcaactgcatcaggtactcgaacactccaggctggcgaaaggatctatttagaacgtcaaaaactttccataaaatcacaatcgagaaattctaggaaaaaatcaaaattgctaagcattaattcttcatgctatagcaatatcgttagattttgtaattcagatcatcatgaaattggtaaattacctactgaagtcgcttctgttatttcaacgttgatggagcaaggtttttggtcatttgaagccatatgcatttactccgacaatataattagatttgggagtaatgtcactttacaagtttattgttttatcaatgtcaatcatccgtccttgaaccgatctccattcactttggcaactaattctatgcaagaagaggaagaacatttaaaagcctcttttgctcaaaataaacgtgatcatttacttcgtttgtttacttggatagctttggaaccagaccttgaagactgcaacactaaagagagtattcatattgatgatatattgaaaacaagttcattgcctgaagcgagggacgagagtaactcagatctaaccccatcctcaactgaagacgaggaagatgttgttagcgaccaacttgctatattatatgacaaagttaaaacttctggagctgaattgccgtctgctccaaagccatcaacgtttgctcttgatcttcgtgagtatcaaaaacaggctttgtattggatgtgttgtaaagaagagggcgtacaaagtgatggtagtgcacctaagcttcatcctttgtggagtcgatttcgatttccaaaggactcagaattccctgaattctttaaatgttctagtgatgatgacaacacacatttttacgttaacttatatactggcgaaactacaatgttgtttccgaattcaatgccttatcatcggggtggaattttagcagacgaaatgggcttaggcaaaacgattgaagtattatcacttattcattctagaccttgcttttcaaccgatgaaataccagaagcctttagacattctaaacccagccttcctgtcgccagtaggacgactttggtagtagcacctatgtcattgttagatcaatggcactccgaagcttgtaaggtgtctcaaggcaccaaattcagaagcatgatttattatggttctgaaaagcctttggatctgaagtcttgtgttattgatacatccacagctcccttgatcatcataactagttatggtgtgttactttcagaatttagtcagcaatctcattcttcgggattgttttctgtgcattggttccgtgttgtccttgatgaaggacataacattagaaatagggaaagcaaaaccgcgaaagcgtgtcatagtatttcgtcccagaatcgttgggtgattacaggtacgccaatagtcaataaactggatgacttgtatagcttgattaaatttatgcgatatgagccgtggtgtaattacacttattggcaaacctttgtgagtctgccatatcagtcaaaagatgtcttaaaggcgttgaatgttgttcaatcaattttggagtttttagttttgagaagaaccaaagaaactaaagatagaaacggaaactcaattgttacgttacctccaaaaaccgtaaaaattgaatatttggacttttctgactcagaaaggaaaatttatgactctctctataccaaagcaaaaagtaccgttaatgcaaacatagttgccggaacgctgttcagaaactatacaacgatcctcggattacttttaagattaagacaggcgtgttgtgaccctgtgcttctttccaatatgaccattaacagtgaaacgtttgatgattttgagttttcggttgagcaatttaattctttaattaatcaatttgttgtcactggaaagcccattccttcagatattttaaaaattgatacactgaagtcttttgaagcattgataacggaatgtcccatatgttgtaatgaaccaattcaaaatcccttgttattgaactgcaagcatgcttgttgcggagattgtttgtcagaacatattcagtatcaaaaaagaagaaacataattcctccgctttgtcatacatgtcgtcaacccttcaatgagcaagatgtctataaacctttttttgtcaaaaataacggaacacagtctacgcttttagtcggtgaggaagtaaaatggaaatattggaataggctacaatcagtgaaacttaatggccttttaggacaattgcgtcaattaactcatagttctgaacctgaaaaggtcgttatcttttcacagtttaccacattcctggatattatcgcagacgttctcgagtcagagaagatggggtatgctagattcgatggtaccatgtcacaacaaatgaggtcgacggctttagagacatttcgaaatgatcctgatgttaacgtgctgattatctctttaaaggcaggcggggttggtttaaaccttacttgtgccaaccatgtttttattatggatccatggtggagctggtcagtggaagcacaggcc

SEQ ID NO: 25720 - DNA, 1605 bp, Schizosaccharomyces pombe
atgtctacactctaccaggtaaacaaaataaaagaaattttaatcagatttttggaaacaatcataattaatggaatgaattctttttcatctacggtatatggtcaaaatgcagaacgttctaatactcctacgttgattgatccttccaacaaagaaactgcaaacgtatgtccgatctcaaaaaatttatttcagtcttatcccaagggctcctacagaaacagccaaaggttgacttctcgtaatggattggatagatttatccccatgacatctaataaagataccatttctctgggccgtcatagttcgctttctcgcaacttagtaaacaaaaccaaaaatgcatcagagacttatcagcagttattggaatacgcattagaagtagaaagagatgataatgttttcacttacgcaaaacttcaaaagtctgacatgacacaaaaatgcccaacaatggtagcaagcgaaaaagataataaagggaaactgaatgagaaaaagaacagatcaccggaaaatttgttaccgttccgtattttagatgccccggaattacgagacgatttttacacttctttattgtcttggtcaccaaaaggagatttggcaattggtcttgcagaaaacatttatctttggtctaaagaattgggtcctactcgtgtgttagaagaaagtatatacgatgttagtagcgtagcctattcttacaatggtgacattcttgctgttggacgtgtagatggtaccttgcagttttggcaagacaatgaaagagttccaagaatttccattcatcatccaggagatatcggagtccttgcttggaaacctgtattggaaacaaatcgacttttggttggcaaaggaaatggaaacatatttgtctatgacattatatggagtgaatctacttcgaaagctgttttggtagccactattacaaacgcacatgacgaacaagtatgtggactaacatggaatcatgatggctcacagtttgccagtggaggcaatgacaaccgggtatgtttgttcaaaggttcagatttaagacaaccactttatgtttggcaacaaaatgctgctgtcaaagctctgtctttttgtccatggcaaagatctttactggcaacaggagctggctctcatgataagcacattaggttttacaattgcttcaatggtaagaaaatagacgagctttattgtggtgctcaaattacatcgatacattggtctccaaagtatcgagagttttccgttacttttggatactctctcgaaacagttcaacatagattcgcagtttatagttggccacagttggaatgtctggtctctgtattaccaagtgttcctgatattcgatgtgtgcattctgtccttacatcccaattaaatgaaacaactggccgctgcgaaatgactgactctatcattattgccagtagtaatgaaaccattaagttttttgacttatcagaagaaagctcttggcataacagtcgcgtcctaacttggcatggaatatttgatagccaaatccttgaaatgcttgaaggaatcgacggtaaaatagattctcatctccgt

SEQ ID NO: 25721 - DNA, 1137 bp, Schizosaccharomyces pombe
actgcgttagctgcagctgtatcgttacggagttactgtaaattacagacgactaataacaatgaaatagtaattgtgatgagtgatatagggaccgaacgccgatggaatcttcaatcgctaccttggcagcatgtaacagtggaaaacgttcagcacccggcatcatctcccaatctggaccttttacaaggattaggagagctattaaaaaatgaagaaaacggacttattcactcagcaatgctttgtaccctttacttgttcacgtctttgtcttctccttctcagggttgtactttaactattagctcccaagtacctttgggtgctggattaggtagtagtgctactatatcagttgttgtcgctacaagtttactactagcttttggtaatattgaacctcctagctcaaattctcttcaaaacaacaaagcacttgcgttgatagaggcttggtcttttctaggtgaatgctgtattcatggaacaccaagtggtattgataatgcagtagcaacaaatggaggacttatcgcttttcgtaaagctacagctcatcagagtgccatgaaagaattcttaaagcctaaagataccttatctgttatgatcactgataccaaacaaccaaaaagtactaaaaaacttgtacaaggagtttttgaactgaaggaaagactaccaactgtgattgactcaataatagatgcaatcgatggcatatcaaagtctgccgtcctcgcattgacttcggagagcgataaaaactcctccgctaaaaagttaggagagtttattgttcttaatcaaaaactcttagaatgcttgggtgtatcccattattccattgatcgcgttttacaagccactaagtcaattggatggacgaagcttacaggtgccggtggtggaggttgtacgattactttattaacacctgagtgcaaagaagaggaatttaagttatgtaaagaatcactattagcccataaaaattctatttacgatgttcaattaggtggacctggtgtttcagtggtaaccgactcagattcatttttccctcaatatgagtctgactttgattttaaaaaattgaatttactcagcaaatttaataaatattatatt

SEQ ID NO: 25722 - DNA, 2626 bp, Schizosaccharomyces pombe
atgagaaggtggttcaaaaaaacgctaccacgccctcctgatgaggaggaatcagctggattaacaaataaagatattgttgaaaccaatcacttatatcctacaatcaccaatttgtcattaaacagtgatacttcgtccattttatttgataaaaataaaaaacctctaaaaccgaaaatcattattcctgataaagaatttgatctcgattattatttaaaagatgaaacggaaagtattcaatctccatttgaaggttttactgctcaaccaaatttttcaaacttcaataagcaaggaaatactatgaaccgagaggcaaatttccaaagaacaaatgaaaaaattcaaagaaataaaagtattaaacgagttaaattatttcatggcaatctcatcctcgattgtccaattcctaagaagttattggttacacttccacagcaaacagagcgagaatttgcttacatgcgctacagtgctgctacatgtgatccacaagacttttcgaaaagcctattcactttaaggcagcccctattctttcagccgagaaaaactgaaatttgtattgctataactatgtacaatgaagatgaagttctgttcgctcgtaccatgcatagtgtcatgaagaatatttcacatttatgtacaagaaaaaattctcaagtttgggggaaggacgcttggaagaaagtcgttgtgtgtataatctctgacggtcgcaccaagatacatccaagaacacttgcttatttagctgcaatcggagtttatcaagacggaattgctaaaaatcaggtcaatgataaggaagtaaaagcacatatatacgaatatactacacagctgtctattgaccctaatttaaagttcaaaggatctgatagaggtattgttcctgttcagatgatattttgtttaaaggagaaaaatcaaaaaaaactaaactcccatttgtggttttttcaagcgttttgcccaatcctaaagccagaggtgtgcattcttttagatgctggaacacgtccgggggaccaatccatttatcatttatggaaatcatttgatttgaatcctcaagttgctggcgcttgtggtgaaattgtcgttatgaaaggaaaattgggttccggtttaataaatccattggtagctactcagaattttgaatataaaatgagcaatatactcgacaaaccagtagaaagcgtgtttgggtttatcagcgtactaccaggagccttcagtgcatacagatttgaagctttacagaatgattctcagggaaatggtcctttggctagttactttaaaggagaacttcaaaataccggaaaatcggggatttttgaagcaaatatgtatcttgcagaagacagaatactgtgttttgagctagtttcaaaaaagaatgaagcatggatcttgcattatgtaaagtctgcatatgccgatacggatgttccagatcgaatcccagaattcgtgctacagcgaagaagatggcttaatgggagtttttttgctgccgcttatgctatctgtcactactacaggttttttaggacttcacatactatttcgcgaaaatttatgttatctattgagtttatttaccaattggcaactatagtttttggttggtttaacattggaaacttcttcataattttttatattttgacatccagcctcgcatcaacaagtgctaattttctacctggagaaattctatttagaattgcaatttggatttacgcatctttattggtgacatgctttgtattagctttaggaaatcgacctcatggctcgccgaacttttatttatccatggtaataatgtactctatattaatgggatatcttttgttttgctccggttggattgcttaccgtgctataagtgatgctatacataacgcaagcagcacctcttcatcttatacttctgcattgttgaatagtaatgtctttataaatattgtgatatcactctcttccacctatggaatgtatcttgtggtatccattatctcttttgatccatggcatatgttcacttcgtttgtgcaatacatttttctttcaataatgtatacgaatgtattaaatgtttatgcgttttgcaacacacatgacgtttcttggggtaccaaaggagatcactttaccaacaatgatctaggtgttgcaagactccttcaaaaaggagctgatgtagaaatagcaattcctacaaatcaatcagacattgatgcaaagtatgaggatgctgttaaactgctggcatctccttcattagaattcaacagtcccatcattaatcacggagagcaagaggatttttacaaaaattttcgaacgtatgttgtgcttacctggattctctcaaacctatttttggtaggaattgttctaagtataccaaaaattaacgggatctctatttcaaacaatgaaacaagcgcttatttgtcgtttctgtacgttgatttcaagactgttttatcagttgactaactataatagactttggagcgtcgttgctttctcggtttttcggtttattggttgtattttttatttatttattagactttgtacgggagaataa

SEQ ID NO: 25723 - DNA, 1047 bp, Schizosaccharomyces pombe
atggcagaatttattcgtacacaaatattcggtacatgttttgaaattaccactagatatagcgacttacagccgattggcatgggcgcctttggcctcgtttgttcagcgaaggatcagctaactggaatgaatgtcgctgttaagaaaattatgaaaccctttagtactccggtactggcaaaacgtacctatcgggaattaaaactattaaagcatttaaggcatgagaatattattagcttgagcgatatttttatttctccctttgaagatatttattttgtcacggagcttctgggaacagatcttcatagactacttacatcgcgacctttagagacgcaatttatacaatacttcttataccaaatcttgcgagggctcaagtttgttcattctgccggtgttattcaccgtgatctgaaacccagtaacatcttaattaacgaaaattgcgatttaaaaatctgcgatttcggtttggctcgtattcaagaccctcaaatgacgggctatgtttctactcgttattaccgtgcacctgagattatgttaacttggcaaaagtacaacgtcgaagttgatatttggagtgcgggttgtatttttgctgagatgattgaaggaaaacccttgtttcccggccgagaccacgttaaccagttttctataatcacggaattgttgggaacgccgcctatggaagtaattgagacgatttgcagtaaaaacacacttcgctttgttcaatcattgcctcaaaaggagaaagttccttttgctgaaaagttcaaaaacgccgatccagatgctattgatctgttagaaaaaatgcttgtctttgatcctcgtaagcgtattagtgctgctgatgctttggctcataactatcttgctccataccatgatcctactgatgagcctgttgctgatgaagtttttgactggtcattccaagataatgatttacctgtggagacttggaaggtcatgatgtactccgaggttttgtcgtttcacaacatggataatgaactgcaatcc

SEQ ID NO: 25724 - DNA, 1170 bp, Schizosaccharomyces pombe
atgcaattccgttcaccccttaggcgttttgatgcctttcaaaaaactgtcgaagatgctcgcataaaaactgctagtggcggtcttataacactcgtttccggacttattgtcatttttattgttctcatggaatggatcaattacaggcgagtcatcgcagtccatgaaatcatcgtcaatccctcacatggcgatcgaatggaaatcaattttaacatcaccttcccccgtatcccttgtcaaatacttactgtcgatgtcttggatgtcagtggtgaattccagcgtgacatccaccataccgtttctaaaacgaggttgagcccttcgggcgaaattataagcgttgatgatttggatattggaaatcaacaatctatttctgacgacggagccgctgaatgtggtgattgttatggggcagccgactttgctcctgaagataccccaggttgttgcaatacctgtgatgccgttcgagatgcgtacggtaaggcacactggcgaattggtgacgttgatgcctttaaacagtgtaaagatgaaaactttaaggagctttatgaagctcaaaaggtcgaaggttgtaacttggctggtcagctctccgtcaatcgaatggccggtaatttccacattgctcctggacgatctactcaaaacggaaatcagcatgttcatgatacacgtgactacattaatgaactcgatttgcatgacatgagtcactccatccatcatcttagtttcggccctcctttagatgcgtctgtccactattccaatcctttagatggaacagtgaaaaaggtaagcactgccgattatcgctacgaatattttattaagtgcgtttcctaccaattcatgcctttgtctaagagcacacttcccatagacacaaacaaatatgctgtcacacagcatgaacgttctattcgtggcggtcgtgaagaaaaagtccctacccatgttaactttcatggcggaatccctggtgtatggtttcaatttgatattagtcctatgcgtgttattgaacgtcaagtacgtggcaatacctttggtggatttttgagtaatgttttagctttgcttgggggctgcgttacacttgcttcgtttgttgatagaggctattatgaggttcaaaagttaaagaaaaat

SEQ ID NO: 25725 - DNA, 2796 bp, Schizosaccharomyces pombe
atgaaagattcacatagctctcggaggaagtatgagaaggaaaagttggtattcgcaacgaataatggaaaaagaacagagggtaccccagcttttttaaaaagcggtaacacagcttcttcatcctcccctactcttcaatttcgtcctacatcgagatatccgacattgagccatgaaccagtgtatacgaatgttttggacctgtcttcaaggattgacgcgaacagggctagtataatgagcgctacaatgggtactccaccttcagcattgaaattctccaagaaaaaaatatcccggcctgttgttagtgaagataccttcaaagacaaattgccgcgtgcaaccataccggtcaagccggagccacagccacagtataaaattccagctgcacctgctcctacaagcaaacgtgtagttaaccgtgggttaaagctgaacactaatttgagacaggcttctcctattttgccttcacctagtttaaagttggatcggcaagatgccccaatacaaataaatcatgagcagaaagaagattttttggtttctattccgcgaccaacgccaatgaccaatttagatgatggaaaggatgagattggacaaccggatcctcatagaaaatatatggcacctccacgtgttaattctataagtcgtgtacagcgtcgtatgagttacataccatacggtgggtttgatgacttcttagataactattacaaggatgacgatactgtacttgaagacaatcagcttaagagtaactctcgaatagaaactttggaggaagaagatggagcagaaagtgactccatcacaaatacagtttctaatgcttcgtcagatgcagaacctgctcatcgtcatttgggaccagtttatgaaaactctggacacctcccttcaaaaagtcacttttcatcaaccgactcgaatacagattcattcgggttagaaagcgatgaacgttcgcttccttcagtttctaatgacttaaaatcatccgaaactttgaaaaatcctcgaaatgatgatttgcttacacttcaacaaccacctcgttatccacattctcaaatggtaatgctaccagctcgttctccagttgaggttcctgctcctacatttgatcgtagaaatgtttcgaggaactcgaataataactctcccgaaggttatgataataatcgcacaaacccaactgttaataatttaccttcatatcctacaaaccttgcacgtcctaaggcaattaaaccaatgcctacttctatacacggtcaaacaagtcctttatcgccaattcctccggtacacacaacccatgggttagtttctgacattcgtcctctcccttctgtttcttccccgataatgcgtgctgatagcacaccgatttcacataacttagctgtgacaccttcgttttcccctattccacagcaaagtaataagtctattggtaatcacaaaaatacatcggttgctaatgtatcatccaaggttgctaattccaagtttgaaaggaatatatctatgatgtctaacagtaatgcttcttcacccgctatttttgaagtgggtgcagaagcaaaagaaaagacgaaggatgcgattccttgtcatcctgatgataagttgatgattccgtcaccaaaaattgtgacgcacggagacgctatgcaagaagaacagcgtcttcgccaaaaatctcaaatcacacctgatgacgaagttgagttggcaaaagtttatttgaatgcattagaaactttagaaaacaagccgagcttagctcccgaccaggctagttataatactcgaatcaatgtttatcgaaccagagctgttgaacttttaaaaaagaatgcttatcctagcaaaacccagaatactgtacccgaagctctgtttttaataggacaatttcacagtcagggggtattaggatttagacgcgatttgggaaaagcatttgagttgtacagccttgcagctaaaaaaggacatcctttgagtaattacagagttgctgtttgtcttcaaactggtaccggggttaagccggacactagtaagtgcgttgccatctataaaaaggcagctgaaatggatgtagtcgaagctatgtttcgtatcgctctgatttacttaaatggtttgttagggcaaaaacgcaatatatctctcggtgtgcaatggctcgaacgtgcatgtaagtctaaggggcccgaatcagttagagctatgtatgaacttgcaaagatttatgagcaaccggatcgttacggagtatctgcaacccctgaaagaaagtttgaactttacaaacaatcagctgtctatggctacgctgccgcccagtgtaaacttggggagtgctatgaacacggtttattagggtgtttagcagaacctcgacgcagtattttttggtacacgcgtgctgccgaacaagactatggcgaggcagaactaggactttccggttggtatttaacgggttcagagggtattttgcctaagaatggagaagaagctttactttgggcgcataaagcggcttgcaaaggtttggctaaagctcagtatgctgttggctttatgatggaacaaggcattggtgttgctgctgatccatcctctgctcataattggtacattcgtgcagcaaagcaaggattccctaaggccaaaaagcgccttgaagaacaagccttatctagtaagcaaacacattcaaaggcacctaaaaaaaagcagcaagagcagtgtgtcgtaatg

SEQ ID NO: 25726 - DNA, 1821 bp, Schizosaccharomyces pombe
atgaatcgtgttaatgatatgtcaccagttgaaggtgatttaggacttcagctaagttctgaagcagataagaaatttgatgcatatatgaagcgacatggtctttttgaacccggcaacttgtcgaataatgataaagaaaggaatttggaggatcaatttaatagtatgaagctttccccagtggcatcttcgaaggaaaattatcctgacaatcatatgcattcaaaacacattagtaagttaccgattgcaagccctattccgcgtggtcttgatagatctggcgagttgagctacaaggataataatcattggtcagatagaagttcaacgggttcaccaagatgggaaaatggatctatgaacttgtcagttgaagaaatggagaaagtggtccaacctaaggtaaagagaatggcaaccatttgtcaaatgttctttttagaccattactttgagcagcttcattatctttatacccgcaagcaaagagcccgtctttttgaagagcagttgcttaaagagcctgattcacgaagagacgagctagtgaagcgatacaatggacgtgaacgagtatatctaaggaaaaggaggacacgcattagtcacggagatttccagaccatcactcaagtcggacaaggtggatatggctctgtttggttggctaggaagcgtgacaccaaagagattgttgctttgaaaatcatgaataaatcggttttgcataaaatggatgagatcaggcatgttcttactgagcgtgatatccttacgacagccaactcggaatggttagttcgtctactttatgcttttcaggatacttcaaacatttatctcgctatggaatttgttcctggtggtgatttccgtactttgcttagcaacagtggtgttttaagggatcatcatgccaagttttatgctacagaaatgttcctagctattgatgctttgcatcaacttggttacatccatcgtgaccttaagccagaaaactttttggttggagctagcggccatattaaattgacggactttggtttaagttctggaataatcagcaaaaagaagattgaaagtatgaagattcgtcttcaagaagtcaacaatgtcgttgttcccgaaaggagcatgagggaaaggcgacaagtgtttcgaactcttttatctcaggatcctgtatacgctcattcagtagttggctctcctgattatatggccccagaggttttacgaggtgaaaactacaaccactctgtagactattggtctcttggctgcatcatgtatgaatgtctttctggttttcctccattttctggctccaatgttaatgaaacctggtctaacttgaagaattggcgcaagtgttttcaacgccctcactatgatgatccccgcgatttggaattcaactggagagatgatgcatgggattttgtatgtcactgcattactgatcccaaggatcgcttttgttctcttaagcaagtcatgcaacatccttacttctcaaagattgattggaaaaatgttcgtacagcatatcgtcctccgtttgtacccgaccttaattctgagattgacgcaggatattttgatgatttcactaatgaaaatgatatgtctaaatataaggaagttcatgagaaacaagctgcaattgctaatatggttaacacatttaataagcctaaacgcaatgcttttatcggcttcacttttaggcatcaaaaaaatagtcatcctactagctctagtagcgcattatctagtcccctctctgctccttctttcgggactctatta

SEQ ID NO: 25727 - DNA, 4288 bp, Schizosaccharomyces pombe
atggaaagtgttgaggaaaaatcaaagcaaaggcgctggcttcccaattttaaggctttacggctcaaagtctaccgtttagctgatcgtctgaatattcctcttgctgatgccgctagagtagagttagaagaatatgatggctcagatccacaatctttaagaggccttcaaaagcttccaaggactctttactttggattaccattaccagattcggagcttgacgatactggtgaagccaagcgttggtttcctcgtaacaaaattcgtactgctaagtacacccccattgactttattccaaaaaatatttttttacaatttcagaatgttgcaaatctttttttcttgtttttagttattttacaggtatgctttcttattctcatcacgattgaaatcaccaattatcttggttcatttttttctttactaacgttttatgtagtctatttccatattcggtgaacaagtaaatcctggattggctgctgttcctttaattgttgttgtcggtattaccgctgttaaagacgctattgaagattttcgccgaaccatgcttgatattcatttaaataacacccctacccttcgtttaagccattatcaaaacccaaacattcgtactgaatacatcagctactttagacgattcaaaaaacggatctccgctctttttcgcgtatttctagcaaagcaggaggaaaagaagagagcaaagcgtttgaatgacgctgtacctttggaagatatggcaggttctgaatcaagacctagttatgattctattttcagagagtcttttgaggcaaaacgatcgtttgaagattcaaagggcaaagtccccttaagtgctttagatgggactgcaactattctccaatcgcgtcccatggatattattgattatgaagccgaagctactggcgagtgccatttcaaaaaaacatactggaaggatgtccgtgtaggtgattttgtaaaagttatggataatgatgaaattcccgcagatatagtcatcattaattcatccgaccctgaaggtatttgttacattgaaaccaagaatcttgatggtgaaaccaacttaaaaatgcgtcacgctctaacgtgcggaaagaatgtagttgacgaggcctcatgcgagagatgtcgtttttggatagagagtgaaccaccacacgctaacctttatgagtataatggagcatgtaagtcctttgtccattctgaagcaggtggctctgatacctcccaaactgtttcagagcccatcagtctggactcaatgctattgcgtggttgtgtccttaggaatacaaaatgggtgattggagttgtcgtatttactggcgatgataccaagattatgctgaactctggtgctccgccattaaagcgtagtcgcattactagaaatcttaattggaatgtttatcttaatttcattatccttttctccatgtgttttgtttgcgcagttgtcgaaggaatcgcctggcgtggtcattctcgctcctcgtattactttgagtttggttccattggtggttctcctgccaaagatggtgtcgtcacgtttttcactggtgttattctttttcaaaacttggtgcccatttcgctttatatttcaattgaaatcgttaagaccatccaggcaatttttatatatttcgacaaagacatgtattataagaagctaaagtatgcttgtactccaaaatcttggaatatttctgacgatcttggacaagtggaatatatcttttctgataaaacaggtactcttactcaaaatgttatggaatttaaaaaatgtacgatcaacggagttgcgtatggtgaggcatttaccgaagcaatggcgggaatggcaaaacgcgagggaaaggatactgaagaattgactcttcaaaagcaaagtttcattgaacgtgaccgaatgcaaatgatttctcaaatgcgaaatatgcacgacaacaaataccttgtggatgataacctcacgttcatctcgtcgcagtttgttcatgaccttgctggcaaagctggtgaagaacagtcacttgcatgctatgagtttttcttggcattggccctttgtcatagcgtagttgcagacagagttggtgaccggattgtctataaagcacaatcgccagatgaagctgcactcgtgggtaccgcccgcgacgttggctttgtttttttggaccagcggagagacattatggttactcgtgctcttggagaaacccaaagattcaaattgatggatactattgaattcagctcagcgaggaagagaatgagtgtgatcgttaaaggacccgataaccgttatgtgcttatttgcaaaggtgctgatagcattattttcgaacgtttggaaccaaatgaacaagttgaattacgtaaaaccacttctgagcatctcagaatttttgcattggaaggtttacgaacactttgtatcgcaaaaagagagcttactgaagaggaatattacgaatggaaagaaaagtatgacatcgccgcatctgcaattgaaaaccgtgaggagcaaatagaggaagttgccgatttgattgaatctcatcttactttgctcggtggaacagctattgaggatcgattacaagaaggagtacctgattcaattgcattattggctcaagccggtatcaaattgtgggttctgaccggagacaaaatggagactgctattaatattggtttttcttgcaatttattggacgctggcatggacatgattaagtttgatgtggaccaagaagtgtcaacaccagagttggaagttattttagctgactacttatatcgttattttggtttgtctggatcagttgaagaacttgaagctgctaagaaggatcatgacactccctctggctctcatgcgttagttattgatggatcagtacttaaacgagttttagatggtccaatgagaaccaagtttctgctactttgtaaaagatgcaaggctgtcttgtgttgccgtgttagtccggctcaaaaagcagatgttgttcaattggtacgcgaaagccttgaagtaatgacgttagccattggagatggtgcgaatgatgttgcaatgattcaaaaagctgatattggtgttggtattgttggtgaagaaggccgtgctgcagctatgtctgcggattatgcaatcggtcaattccgatttttgagcaagctggttcttgttcatggccgttgggattataatcgtgttgctgaaatggtaaacaactttttctacaagagtgttgtatggacatttactttattctggtatcagatttacaacaatttcgacgcaaattaccttttcgattatacttatgttatgctgtttaacttgattttttcatcgttacctgtcattgtcatgggtgtctatgatcaagatgttaatgctgatttgtcgcttcggatccctcagctttacaagcgtggtattttgcaattaaattcagccaggaaaatctttattggatatatgcttgatgggttttatcagtctgtaatctgtttctttttctcttttcttgtgattaacaatgtgaccacagctgctcagaatggtcgtgatactatggctgtacaagatttaggtgtttacgttgctgcgccaactattatggttgtcgacacgtatgttattctgaatcaatcaaattgggatgtgttttcaattggtttatgggcgctcagttgtttgacattttggttttggactggcgtctactctcaaagcctttatacatatgaattttataaatctgcttcgcgtatattcagaactccaaatttttgggctgttttatgtggaacgattgtaagttgtcttttcccgaagtttttgtttatgacaacgcaaaagttattttggccatatgatgtggatatcattcgcgaaagttaccgcactaaacgccttcatgaattggatgaagaagaggagattgagaatgccgaacaatctccagattgggcatcttctactttacaggtccctttcaacgcatcttcgtcaagtttggcgacacccaagaaagaacctttacgtttggacacaaattcgcttacactcacatcaagtatgccaagaagctttaccccgtcatatactccaagtttcttggagggctctcctgtgttctctgatgaaatacttaacagaggcgaatacatgcctcatcgtggttccatttcttcttctgaacagccgttacggccttaa

SEQ ID NO: 25728 - DNA, 1008 bp, Schizosaccharomyces pombe
atgccatcctgtacttcattccccattggaactcgcaagtcaaaacttgctgtaattcaatcagaaattattcgtgaagagctcgaaaaacactacccccatcttgagtttccaatcattagcagagatactattggcgatgaaattctctcaaaggctttgtttgaatttaagcgtcaactagcaaaatctttgtggacgcgagaacttgaagctttgctcgtcactaaccaatgtcgtattctcgtacattctttgaaagatttgccctctgaaatgccagatggtatggtgatagcctgtatacccaaacgtagctgtcctttggatgccatcgtcttcaaggctggctcccactataaaactgtagccgatctccctcctggtagtgttgttggaaccagcagcattagacgtcgtgctcttctcgctagaaatttccctcatcttcgtttcgttgacattcgtggaaacgttggaaccagacttgctaaacttgatgctcccgactctcaattcgattgtttagtccttgctgccgctggtctatttcgtttgggtttaaaagaccgtattgctcaaatgcttactgctccttttgtgtattatgccgttggacagggtgctttggctgttgaagttcgtgctgatgataaagagatgattgagatgttgaagccgttgcagcatcaagaaactttatatgcttgtttggctgaacgtgctttgatgaagcgcttacaaggtggttgtgctatcccaatcggcgtacaaactgacgttctcgctatttccaattcatcatatcgcatctcattacttggtacggtcctttctgctgatggtcttagagccgcttttggcaatgctgaagctgtcgtttcgtcagaagaggaagccgaggaactgggaattacggttgcgctcgcacttctcaaaaatggcgctggtcccattttagaagagcatcaacggagcagtgatagtgaagaatctttaaaaaattat

SEQ ID NO: 25729 - DNA, 453 bp, Schizosaccharomyces pombe
atgtcgacagaacaaacttttatcgctgtgaaaccggacgcagttcagcgaggactgattggatacatcatctcaaaatttgagttgaagggctacaaactacgtgctctaaaatttttagttcctagtcgtgatcttgtggaagaacattatgccgaacataaaggaaagcctttttatgagaaactcgttggtttcatggcatcaggccctgtatgtgccatgatatgggaaggtaaacaagccgtgaaaactggtcgcttaatgttgggcgccagtaaccctctggattctgcccctggcactattcgcggtgattatggtatcgaccttggtagaaacgtttgccatggttctgattccatagaaagcgctaatcgtgaaattaaactttggttccagccttcggaaatccaagtttacgatcgtacaattgaaccttggatttacgaa

SEQ ID NO: 25730 - DNA, 1023 bp, Schizosaccharomyces pombe
tcatggttaaattccctggcagatgccacattcggaaagcggccatcttcctttgaatttatcgtaaacaaaacccgcttttcgtccgccccggtcgttgcaaccatcatcatatcttactatcttttaattcttgtcggaggtagaattatgcgtaataggcaacctatccgtcttcaaaagattttccaatattataatttgactttttccatcgcttcagctatccttgcacttttgatttttgaacaagtagcccctgctatttacaagcacggttttttcttttctatctgcaatgagaaagcatggactcaaccgctggtatttttatactactgtgcttatatttcaaaattcgtacgtctccatcgttttttgaccatacttttttcattctaacatacgttttagcttgaattgacagatacttttttccttgtcctccgcaaaaaaccccttcaattccttcattgctaccatcatggtgccactgccgttcttgtatatactcaaattgttggcagaacttccatcagttggttgatcattgaaatcaatttattggttcatgttactatgtattattactactatcttgtagccaaaggtattcgggttccttggaagaaatgggtcacccgctttcagatcgttcagttctttgctgatttaggttttatttatttcgcagtatacacggaggttgcgtatcggttgaagttttacaaagcctgtatgggccattgctcaggacatcctttagcggcgttctgtggtctcgcaacaatctcttcataccttgttttgtttatcgtcttttaccataacacttacaagaaaaatgctgctctcaaaatgaaagctaaggctgcagctgcaacaaaaggtaactcatcagaatcttctaaaaatgcggacttaaagcgtctctcaaaaagtaacgcttctattgccgaggttaaatgcaataatatagttactaatctgtatcctatttcttcaggtttaaacaatgaaaaa

SEQ ID NO: 25731 - DNA, 453 bp, Schizosaccharomyces pombe; identical to SEQ ID NO: 25729

SEQ ID NO: 25732 - DNA, 1023 bp, Schizosaccharomyces pombe; identical to SEQ ID NO: 25730

SEQ ID NO: 25733 - DNA, 5523 bp, Schizosaccharomyces pombe
atgcgaaattcgtcaaagggacaggaccctaatttttcttatgactctattctgtctactccaactccatcagccagaagaactattgggccaagggctcctaagtccaaaacaacgtaccataaacctccatcatccatagaatcagtatcgacgttaatccagcctaataagtcccaatcagttacttctccgtatgtaaagcaatttaccttttcatcgaaagagtacaattctcataataaacatgctttgcaaaattcccagcttcctttacctaaaacacccgagaaatctactgtccatcgacccaaagcgaataaagttgaagtcactgatctaccatcttcgtcttccgttgaacatttgcacacttctaaacatctcaagggtcctaggttgcccaaaaacattattaaaagttctgaggatgtccaaattgctccagtgacaccccctgtacattctcgctcttttgatcctttgccgaaacctcctgttccctcagttccagtatctaagacaaaaaggcgaactaagcataaacttgctcctgttgttgaagtccctgagattaccaacgaggtttccccaaaattcacttctactaatgatgaacaagtttatcgactacgttcaattcgagctgggagccctaattcggtatgctcgtttcagtttgaaattccgagtactcgaccaccttcattggatcagctaatacatctattcaacgattttttaagacaccctgtatttgattttgacgaaaacgccattgaaatgcttcaaagttgtactccagatgaaaagtggtgttttattcgttctaacttcgccgggtttgatgatccttctttccaaattccagaattagctgccgtccatagacctgtttcctggttcgtaatccaactatggaataaaacaattagtaatttacaacttatcacactttcttctttattatcaactcaatccgatcgatggatatctctttttcttgaactgcagggacttcgagctttgcataatctacttacatattttaattcgtctgccgtagtgcagcctcagcaagctgaagttcctcgttgcatgcttactcttttgaagaaaaaacctactctggttacttccaattcttatatatttcaagcaataacagtgacccttatatccccaaatttgcttccgaggaaagtagccgcagatttattgacatgggttctgtctttaaaggaacctcttgtggtctccatattggaaactggatttaaagaaataaatgccgaatatgaaaaggaggttccgctattctttggatggataaaatctttcaaagacataatcttggaaaaagaattagcacgaacccctccatcttctcctgctcgaaattctgcttccagctcaccttcaaacatagcgtttcttgagtattgtacttccactatggaatttatcaatcagctaattgttgcttgcgaagaattggagcaaggatttgaccttgatatattggattcccttcgtgaatcaggtatacacgaagttatacaacttctacgtaactttcctgaccaacaacttgagaaacaactaaacatatatgaatcagaagaagagaggaggactataagtcagaccacgcatgaagatgtcgattcctttatgtcaaatgaatcctcaattttaagtagcttcaatgaatttgcatcaaatgaagttggccgtttacttgaatcaactattcaaaacatactacttgccaaaggtactgaaaagcaaaaggtgaaacttatcaaggtttttaactctttacttcaaagaatactgctcaattcaaaagtatccaatgaaagttttgaagatagtttacaggcatctttaaatatgctaaccgaaagattctattcggatgacacagccagaaatgctttgaaggaagcaaaggcgtcacgtgcaatggctgagaaaatggttattgaaagagatgcaatggctgcgcaagtaaatctgggtgccgaagacttaattgcgaagttaaacaaagaagtagaggatcagaaagacgttattctttctcagaaaagaacgaatgagactctaaaaacagaaattgatgctctccaaaagtctcatgttactcaaatccaaaggagcgaagtggaattacgagaattgtatcttcttatcaattcggattcttttcagggctcaactaattccaaggaaaggattatagaatatttgttggataagcttgacttgaggaaaaaggaaattgctgcagagtcaacactttggtcaaacgatggaattgatgacaaacttcgggatctaagggagcaaatgtctcgacagtccagccagccctcaactgtgtcaactattttacaaattcctgataaaaaatttcatcgtccattccctcgtcatttacatcgatatgttggtcgttcagcttctgaatcgttaaccagtgaaaaggatgagtccatcaaaagtatgaaaggaattgatgactttgcgaacttggagattccgggaaagggtattgagtcaaacgtcgtaataaaggatatttcaaatcaaacgcatgagattaatagcgttgagaacaaagcagaaacagttagcaacaatagtaaaattacgaactttgatattcctaatgatgcaacttctttaccaacgataattacacatccaactccaccaccacctcctcctcttcctgttaaaactagtttaaataccttttcccatcctgattctgtgaacatcgttgctaatgatacatcggttgctggggttatgcctgcttttccaccaccaccaccacctcctcctcccttagtaagtgcagctggaggtaaattcgtatccccagctgtttcaaataatatatcaaaagatgatttgcataagactactggtttgactcgtcgaccaactcgtcgtttgaagcaaatgcattgggagaagttgaattctgggctggaatttacattttggacgggaccttctgacgaggccaacaaaattttggaaaccttgcatacatcaggggtcttagatgaattagatgaaagttttgcgatgaaggaagcaaaaacattggtcaaaaaaacatgtgctagaactgattacatgagtagtgaacttcagaagctttttggtattcactttcacaagctgtctcacaaaaatccgaatgagatcattcgcatgattttacattgtgatgatagcatgaacgagtgtgttgaatttttatcaagtgacaaagtactaaatcaacctaaattaaaagcagatttggagccttatcgtattgactgggcaaatggtggtgatctagttaatagcgaaaaggatgcttcagagcttagtcgttgggactatctttatgtgagacttatagttgatcttgggggttattggaaccaaagaatgaatgcactaaaagttaaaaacataatcgaaaccaattatgagaaccttgttcgtcaaacaaaacttatagggcgggctgctcttgagcttcgggacagcaaagtttttaaaggtttgctatatttaattctatatttaggaaactatatgaacgattatgtgcgccaagctaaaggatttgccattggttcacttcaaagacttccattgataaaaaatgccaataacactaaaagtttacttcatatacttgatataactattaggaagcattttcctcagtttgacaacttttcccctgaactatcaaccgtcactgaagcagccaaactgaatattgaagcgattgaacaagagtgctccgagttaattcgtggttgtcagaatttacaaatagactgtgattctggggctctttccgaccctacggtatttcatcctgatgataaaatcctttcagttatattaccctggttaatggaaggcaccaaaaaaatggattttttgaaagagcatttacgtacaatgaatactaccctgaacaatgctatgagatattttggtgaacagcctaatgaccctaattccaagaacctgttctttaaacgtgttgattctttcataattgactactctaaggctagatctgacaacttgaaatcggaagaagaagaagcttcacagcatagacgtttgaatcttgtcaacaatcataaagaacacgtgcttgaacgtgcaatgtctgaaaataacaaaatggataatgaagcaatggatggtttccttgataaattgagaaacgtcaaattagaaagtcaccataaaccacgaaatagatccgccattactatgggtaaagaacatttaatagaagctcctaacacttctactaaatctagtcctgcaaaaaacgaattatttgttcctaagagatcttcggtaaaaagtgacttggcaaaagttaggccaaggtatcctaagggtagtgaatcaaccgatggattatctgacgcattaaatattactccaacgaaaaaaggagaagtatctagcaaagctaaaaagggatacaactacgaaaagcgtcgttcgggccgtcaggtatctgatagctatgtccttaacaaaaattcgaagaataaaagtaataagggtcgctccgcttcttacactttttctgatccaagcagtttggaagattctaataggcaaaaaccctttaatggtgagaaatttcgaaggtttagttcaaaatcaagaagaggttcacaaaaccgggattctaagaagacgggtaaagctcgaaaggataaaggtataaacaataaccagacaagccctcagaataaaccgtctaaagaatctctaaaatctgatactatttcaaacgagaagaaagtatttcctcaaaaggcttctaaagttaatttgcttacgccgacaatttcaaatggtactagggcaagtaaacatgctaacgaaaaggagaatacttttcctcgtggtgtcgaaaataatctggttgctcccatgattcctaataacaccgaacttaatgaagataccagcgctgtctctcggaacttagaaaatgccaccaatgacttgaaggaaacttttccgactacaactacgatttcaacagccagagctaaacctggtaacaatgatattaacactattttacgaagaaacaatagccgtggccgtcgacgcatgttgcagcaaatgagtcctttgaaaagcaataaattttcgggaactaatgatttgaattttcaacaagctactaaaccagacggcagcaataagtcctcatatatggaacgtctggaaaaattgaaacaaaactctgaacgacatcttcaatcagtaggaggtaagaaggtttattcttctgaagaaacgcccgtcaacaaaatattagtatcgccttccgtttctattttggatcataaccgaatcttaagtcaaagtactcctatcaaatcaccacaacgagcacaagaaatgcttgcaggtttattatctggaaaattggcgcctaaggagaatgagaaa

SEQ ID NO: 25734 - DNA, 2544 bp, Schizosaccharomyces pombe
atgaagcgctccgtgctcacaattattttatttttttcctgtcaattttggcatgcttttgcttcatcagtattagcaattgattacggcacagaatggactaaagcggccctcattaagcctggaattcctcttgaaattgtattgacgaaagacactagacgtaaggaacaaagtgccgttgcttttaaaggcaatgaacgtatttttggtgttgatgcttccaacttggctaccaggtttcctgctcattccattcgtaatgttaaggagcttcttgatacagctggtcttgaatctgtcttagtacagaaatatcaaagttcttatcctgcaattcaattagtcgagaatgaagaaactacttctggtatatcctttgtaatctctgacgaggaaaattactctttggaagaaattattgccatgaccatggaacattatatatcactggctgaagaaatggcacatgaaaaaattactgatttggtgttgactgttccacctcatttcaatgaacttcaacgctcaattcttcttgaagcggcacgtattctcaacaaacatgttttggccctcattgatgataatgtggctgttgccatagagtattcactctctcgtagtttttcgactgatcccacttacaacatcatttacgactcaggctctggctccacttcagcaacggtaatatcttttgatacggtagagggatcttcactaggtaaaaagcaaaacatcacacgtattcgtgctttggcaagtggatttacgttgaagctttctgggaatgaaatcaatagaaagctgattggttttatgaaaaattcattttatcagaaacatggcatagatttatctcacaatcatcgtgctctagcacgccttgagaaagaagcattgcgcgttaagcatatattatctgctaattcagaggccattgcttctattgaagagttagctgacggtatcgattttcgactgaaaataactcgatcagtcttagaatcgctttgtaaggatatggaagatgcagctgtagagcctattaataaagcacttaaaaaagcaaatctcacattttccgaaattaactctattatcttgtttggaggagcctctcgtattccatttatccaatctactcttgctgattatgtttcttctgataaaatatcaaagaacgtgaatgctgacgaagcgtctgtgaaaggagctgcattctatggtgcttctttaactaaaagcttccgtgtaaagcctttaattgttcaagatatcattaactacccataccttttatcactcggtacatctgagtacatagtagctttgccggattctacaccctatggcatgcaacacaatgtcactattcacaatgtttcaacaataggcaaacacccttcgttccctctttcaaacaatggagaacttattggtgaatttacgttatcaaatatcactgatgttgagaaagtctgcgcctgtagtaacaagaatatccaaatttcattttctagtgaccgtactaaaggtattttagtacctttgtcggcaattatgacttgtgaacatggtgagttgtcttctaagcacaaattgggtgacagggttaagagcctatttggttcccacgatgaaagtggtttacgaaataacgaatcttatcctataggtttcacatacaagaaatatggtgaaatgtcggataatgctcttaggttagcctctgcgaaacttgaacgtagattgcaaattgataaaagtaaagctgctcatgataatgcactaaatgaactagaaacattattgtatagagctcaggcgatggtggacgatgatgaattcttagaatttgcaaaccctgaagaaaccaagatcctaaagaatgattctgtcgaaagttacgattggcttatagaatatggcagtcaatcacctacctctgaagtcacagatcgttacaaaaagcttgatgatacccttaaatcaatttcgtttcggtttgaccaggcgaagcaattcaatactagtttagagaattttaaaaatgctctggaacgcgcagaatcccttcttactaattttgacgtgccagattaccctttaaatgtttatgatgaaaaggatgttaagagagtaaattccctcagaggtacttcttataagaaactgggaaaccagtattataatgacactcaatggcttaaggataatttagactctcatttgtcgcatactttatctgaagatccgctcattaaagtagaggaattagaagaaaaagccaaaaggttacaagaattaacatacgagtatcttcgtcgttcgctccagcaacccaaattgaaggctaaaaaaggcgcgtcctcaagtagcactgcagaatccaaagtcgaagatgaaacatttacgaacgatattgaaccaactactgcactaaattcaacttctacacaagagactgaaaaatctcgggcttcagtaacgcaacgcccatctagtctccaacaagagattgatgacagtgatgagctt

SEQ ID NO: 25735 - DNA, 1470 bp, Schizosaccharomyces pombe
atgtcaattgcaatttgtggaggaggtatagctggtcttagtacagcattttatcttgctagattgattccaaaatgtactattgatttgtacgaaaaaggtcctcgtttaggtggatggcttcagtcggtcaaaatcccgtgtgcagattctccaacaggaacggttttgtttgagcaaggtcctagaactcttcgtcctgctggggttgctggcttagcaaacttagatttaattagcaagttgggcatcgaagacaagttgttaaggatttcgagcaattctcccagcgcaaaaaaccgatatatttattacccagatcgcttaaatgaaattccttcaagcattttagggagtataaagtcgattatgcagcctgctttgcgtccgatgcctttggctatgatgcttgagccctttcgtaaaagtaagcgagattcgacagatgaaagcgtgggttcatttatgagaagaagatttggtaaaaacgttacggatagagttatgagtgcaatgataaatggtatttatgctggtgatttgaatgatttgtctatgcattctagcatgtttggatttttagcgaagattgaaaaaaagtatggaaacattactttgggattaattagagctcttcttgcacgtgaaatattatctcctgctgagaaagctttgaaagcagcactactcgcagagccaaaaacagcagagctgtcaaacagtatgaaatcgacaagtatgtttgctttcaaggaagggattgagactattacattgtcaatagcagatgaattaaaaaaaatgccgaatgtcaagatacatctaaacaaaccggccaaaactttggttccacataaaactcagtctcttgtagacgtcaatggtcaagcttacgagtatgttgtgtttgcaaactcttctcgcaatttagagaatctaatatcttgtcctaaaatggaaactccgacgtcgagtgtttatgtcgtcaacgtttattataaggaccctaatgttcttccaatccgtggttttgggcttttgattccatcatgcactccaaataatccgaatcatgttcttggtatcgtttttgatagtgagcaaaacaaccctgaaaatggaagcaaggtcactgtcatgatgggagggtctgcttatacaaaaaatacttctttgattccaaccaaccccgaagaagccgttaacaatgctctcaaagctttgcagcatactttaaaaatatccagtaagccaacactcacgaatgcaacattacaacaaaattgcatccctcaatatcgtgttgggcatcaagataatcttaattctttgaaatcttggattgagaaaaatatgggagggcgaattcttctaactggaagttggtataatggtgttagtattggggattgtattatgaatggacattcaacagctcgaaaactagcatcattgatgaattcttcttct

SEQ ID NO: 25736 - DNA, 1767 bp, Schizosaccharomyces pombe
atgcttttaagtgtaagaggcgtgccggttgaaattccatctctcaaagatacaaagaaaagcaagggaatcattcgatcaggatgggttatgctgaaggaagataaaatgaagtatctcccttggactaaaaagtggctagtactttctagcaattctctgtcgatatataaaggaagcaagtctgaaagtgctcaggttacgttgctgttgaaggatattcaaaaagtagagcgttcaaagtctaggacattctgctttaaattgaggttcaaaagtagtaccaaaaattttgagattcaagcttgtgaattgtccgtggccgataatatggaatgttatgagtggatggatttaatatcttctcgtgcgcttgctagcaaagtttcaagtccgatgaatcctaaacaccaagtgcatgtgggaattgataatgaaggaaattatgtcggattacccaaggagtggatattgctacttcagagtagttcgattaccaaacaagaatgcatggaggagccgaaagcagttattcaagctttggatttttatagtaagcagttggatacaacaagcgaaactaaagatagtttttcattttgcaaagagacactgccacgatcctctactacatcgtattctattcgcgatgctgacaaacatcataaactcacgacatctggagttactaaaatgaatattactgaaagatgcaagccgaagacaaccatacagacggataaaaagcatatcataaggccttttattgaagacaaaagtcatgtagaatctatcatgaccggaaaagtaaccaaagtaccggtcaaagcagattcaaagaacacgttgagtagaagaatgactgatagacaggctttagccatgttaaaagactcagttacttctcatgatcctgtcgaatattttaatgttaagcataaacttggccagggtgcatcgggatctgtttacttagccaaagtcgtcggaggaaaacaattaggtatttttgactcagttgcaataaaaagtattgatttgcagtgccaaacaagaaaggaactaatcttaaacgaaatcactgtcatgagagaatcgattcatcctaacatagtgacatatttagattcatttcttgttcgagaaaggcatttatgggttgtgatggagtacatgaacgctggatctttgactgatattattgaaaaaagtaagcttacagaagcacaaattgctcgtatttgtctagaaacgtgcaagggaattcagcatctgcacgccagaaatattattcacagagatattaaaagtgacaatgttttactcgacaactctggaaatattaaaattactgactttggattttgtgctcgattgtctaaccgtactaataaacgagttacgatggttggaacaccatattggatggcccctgaagtagtaaagcaaaacgaatatgggaccaaagttgatatatggagtcttggaattatgattatagagatgattgaaaacgaaccgccttatctcagagaggatccaattcgtgcattgtatctgatagcaaaaaatggaactccaactcttaaaaaacctaatttagtttctaaaaacttaaaatctttcttaaattcctgtcttacaatcgataccatttttagagctactgctgctgagttgctgacacattcatttcttaaccaagcatgtccgactgaagatctaaaatctatcattttctctcgcaaagcgaatacccatattaat

SEQ ID NO: 25737 - DNA, 1304 bp, Schizosaccharomyces pombe
atggcggacgaaataatggagaacgtggagcttacgacatcggaagatgtgaatgctgtatcctcttgtaagtaaattatatttttttataatatgaatacttactgtgaatgatgctaacattgttttgcagttgaggaaatgaatcttaaaggttagttaatgaattgataaaaatttccataattttgttctaacaacatgcagaggatttacttcgtggaatctatgcgtatggctatgagactccgagtgctgtgcaaagccgggcgattattcaaatctgtaaagggagagacgttatcgcacaagctcaatctggtacagggaaaacagcaactttttctattggtattcttcagtcgatcgatttatcagtccgagatactcaagctttaatactttctcctacgagagaattggcagttcaaatccagaatgttgtacttgcattgggtgaccatatgaacgttcaatgtcatgcttgtataggcggcacatccgttggaaatgacatcaaaaaattggattatggacaacacgttgtttctggcactcctgggcgcgtaacggacatgattcgtagacgaaatttgcgaactcgcaatgttaagatgcttattcttgatgaagcggatgagctcttaaatcaaggctttaaggaacaaatttatgacatttatagatatttaccccctggtacacaggtggtagttgtgagtgctaccttgcctcaagacgtgttagaaatgactaacaagtttaccactaaccctgttcgaatattggtcaagcgcgatgaacttactcttgaaggcttaaaacagtactttatagcagttgaaaaagaggaatggaagtttgatactctgtgtgatttatatgatactttaaccattacacaagctgtgatattttgcaattctcgtaggaaggttgattggttgacggagaaaatgcgagaagctaactttaccgttaccagtatgcacggtgagatgccgcaaaaagaaagagacgctatcatgcaagattttcgacaaggaaatagtagggttctcatatgcacagacatatgggcaagaggaattgatgttcagcaagtttcattagtgatcaattacgatcttcctgcaaatcgagaaaactatatacatcgcattggtcgcagtggacgatttggtcgtaaaggtgtagctattaattttgttacaaatgaagatgtacgcattcttcgggatattgaacaatactattctactgttatagatgaaatgcctatgaatataggagatatggtttaa

SEQ ID NO: 25738 - DNA, 779 bp, Schizosaccharomyces pombe
atgggaaaatcacaatcaaaattgtctcaagatcaactccaagacttagttcgttctacaaggtgtacgttttgtaaaactagtcaatactaacaaatccaagttgataaaaaggaattgcaacaatggtataaaggtatgacagctatcctaaaaaaattgattttacatccgcatcatggttctgcaatttgaataagattcttaattgctgctaaattgaatgtttaacgctgaatctaacaagtatgcagggttttttaaagactgcccttctggccatttgaataagtctgaatttcagaaaatctataaacaatttttcccattcggtgatccgagtgctttcgctgaatatgtatttaatgtttttgatgctgacaaaaatggatacattgattttaaagaattcatttgtgctttaagtgtgacttcgagaggtgaactgaatgataaacttatatgggcatttcaattatacgatcttgataataatggattgatttcttacgacgaaatgctacgaattgttgatgctatctacaaaatggttggtagcatggtcaagttaccggaggatgaagatactcctgaaaaggtttgaatatttagtatgttgagcataatgtctaataattttttagcgcgtcaacaagattttcaatatgatggataaaaacaaagatgggcaactgacacttgaggaattctgcgaagggtccaaacgtgatccgactatcgtgtcagccctttctttatacgatggattggtttagctt

SEQ ID NO: 25739 - DNA, 869 bp, Schizosaccharomyces pombe
atgtcaacgaccgcaagaagacgtctcatgcgagattttaaggtacggcagttgtggatccgagaagacttatattaaccaattcttagaggatgcagcaagatcctcctgctggagtttcagcttcccctgtctctgacaatgtaatgctttggtaagtgtttacctatgtcaattcatttttctcttattgttatgcaacgtaatggtgaatatatgtgctatatattgaatgccttttttgccatatatttaggaaggagatcgtttcaaaattcttacaagaagcgatctttttatgcttgttggtttctggattgattgcttttgttttttattattgatgttggactaaccatttgagcaggaatgctgttatcattggcccagcagacactccatttgaagatggaacttttaagttggttctttcttttgatgaacaatatcctaataaacctcctcttgtaaaattcgtctccacaatggtatgcttagtcattgtatttagacaagtcttaaattagattatttgatttgttgtaatttacttttttcttggttttttttgtttacttacttattggctttagttccatccaaatgtgtacgcaaatggcgaactttgcttggacattctgcaaaacaggtggtctccaacttacgatgtggcagcaattcttacctctattcaaaggtttgcttttcagaaatattacttaaatttctcataactaacttttagcttacttaatgatccaaataatgcgtcccctgcaaatgccgaagctgctcagctgcatcgtgaaaacaagaaggagtatgtgcgtcgagtacgaaaaactgtagaagactcctgggaaagttga

SEQ ID NO: 25740 - DNA, 1746 bp, Schizosaccharomyces pombe
atggtgagcttcctttcttccagtgtatctcgtctacctttaagaattgctggtcgtcgaatccccggcagatttgccgtccctcaagttcgtacatatgctaaagacttaaaatttggtgttgatgctcgcgcatctttactcaccggtgtcgatactcttgctcgtgccgtatctgtaactttgggaccaaagggccgtaatgtcttgattgaccaaccttttggttcccctaaaatcactaaggacggtgtaactgtcgcccgtagtgtaagtttgaaagataaattcgaaaaccttggtgcaagactagttcaggatgttgcaagcaagactaatgaagttgctggtgatggtaccactactgctactgttttaactcgtgccatcttttctgagactgttcgtaacgtggctgccggttgcaaccctatggaccttcgccggggaattcaacttgctgttgataacgtcgtcgaatttttgcaagccaataagcgtgatattactacttctgaagagatttcccaagtcgctaccatctctgctaacggtgacactcatatcggtgagcttcttgctaaagccatggaacgtgttggtaaagaaggcgttatcaccgtcaaagaagggcgcacaataagcgacgaattagaggttactgagggtatgaagtttgatcgtggttacatttctccttactttattaccgatgtcaaatcacaaaaggttgaatttgaaaatcctcttattcttctttctgaaaagaaagtgtctgctgtccaagacattcttccctctttggagcttgccgctcagcagcgtcgtcccttagttatcatcgcagaggacgttgatggtgaagctttggctgcttgtatcttaaacaagcttcgtgggcaattacaagttgttgctattaaagcccctggctttggtgacaaccgtcgtaatatgcttggagatttagccgtcttgactgatagtgccgtgttcaatgatgaaattgatgtttccatcgaaaaggctcaaccccatcatttgggtagctgtggctctgtaactgtcaccaaggaagacactatcattatgaaaggtgctggtgaccatgttaaagttaacgaccgttgtgaacagattcgtggtgtcatggccgaccctaatctcactgaatacgaaaaagaaaagcttcaagagagattggccaaattgagcggtggtattgctgttattaaggttggaggctccagtgaagttgaagtcaacgagaagaaagaccgtattgttgatgcattgaatgctgttaaggctgctgtttccgagggtgttctcccaggtgctggtacctcttttgttaaggctagtcttcgcttaggagacattcctacaaataactttgatcaaaagcttggcgtcgaaattgttcgcaaagctatcactcgtcccgctcaaaccattcttgaaaatgctggattagagggtaacttgattgttggtaaacttaaggagctttatggcaaggaatttaacatcggttatgatattgctaaggatcgttttgttgatttaaatgaaattggtgttttggatcccctaaaggtcgtacgtaccggtttagttgatgctagtggagtcgcctcattaatgggtaccaccgaatgtgccatcgtcgatgctcctgaagagtccaaggcccctgctggtcctcccggaatgggtggcatgggtggaatgcccggtatgatg

SEQ ID NO: 25741 - DNA, 489 bp, Schizosaccharomyces pombe
atgagttctccaggaataagtgatgaatctataaaaggacctaaggacgttcgtctgattcatctaatacttagctctctgggtgttccatcatactctcaaacagtgcctttgcagttgttaacatttgcacatagatatacacagcagttaatccaggattcacaggtttatgcggaacattcacgtgggcaaaatgctccaatttctgtagaagatgtacgtttagctgttgcttctcaaatcaatcactccttcactggacctccaccaaaagaatttttactagagcttgctatggagagaaatcgaaaacctttaccccaaattcagccgtcttatgggtttcgtcttccaccggagaagtactgtttaactcaacccaactggattgtcagtaatgaaacccaacagaatcaaccaaaggaagagaactcctcggattcacgaatggaggaggataaacttgacttctctgtgaagtctgaa

SEQ ID NO: 25742 - DNA, 1848 bp, Schizosaccharomyces pombe
atggttgaaattggaagtaaaaaatcacgtaatgataatgattcagaaggaatacgtgataaaggtggagtagaaatttcaaacaaaaacgatccatatattcaatttggaaaagccgatccattagagccgctggaaaaacctgatttaccagaggaagcaataaaacgtggtgaacctaccattcttttaggtataccaaaaagagaaggtagaaaaactaaccctgtacacgacaaggctgtcgaaaataattctgattttatcaagttcgattggaacagcgatgaagacgaggatagtgttagtaatgataaaagcaagaataatgagtccttaaaaaagtcttctaaaaatgagatccctggctttatgcgtcaacgaggccgattttttcatgaagcaaatgaaaaatcggattctaaccgtaaacgaaaacgccaagcgtatgagcttgattctcaatcatgcccttggcaccgtcagtataaggtagagcgagaagtctctagaatttttcaccaagacattcttcactttattgactatattactccgactcctgaagagcatgcggttcggaagacgcttgtttctcgtataaatcaagctgtcttgcaaaaatggccagatgtatcactttatgtttttggaagttttgaaaccaaattatatttacctacttcagaccttgatcttgtaataatatcacctgagcatcattatcggggtacaaaaaaagatatgtttgttcttgctcatcatctaaagaagctaaaacttgcttctgaagtccaggtcattactactgctaacgttccaatcatcaagttcgttgatccgttaaccaaagttcatgttgacatatcttttaatcaacctggaggtttgaagacatgtctggtagtgaacggtttcatgaaaaaataccctgctcttaggccgttagtaataattattaaacattttttgaacatgcgagcgctaaacgaagtcttcttgggcggattaagtagctatgcgattgtttgtttggttgtttcttttcttcaattacaccctagacttagtacaggttctatgcgtgaagaagacaattttggtgttttgctgctagagtttttggagttgtacggaaaacaattttattatgatgctgtcggtatcgctgttcacaatggtggtttttatttttcaaaaaagaagatgggttggctgaagccaaaccagccttatttgctttcaatccaagatccggtagatttccaaaatgatgtttctaaatctagtcgtggattattacgcgtaaaggctacatttgcaaatggctttgatttgctaactagtaaattatacgcactcgcatctcgtatagaaagagagggtgtcaatcgagtcaaagatttccctagtatcctaagtaccatattatcagttgatgaaggggttcgtcaacatcgtgagcatatgttaaaatgttataagaataatccagttcctttagaacctttagtggaagtggatgctttagcaagtattgatgtcgacaagcttccattgcaagacgttggtttgcaatatgttgaggatgaatccgattcagacgaaacagatgctgcaaaggatgatttgtttaaagtaaatgaatcaattgaaaccaacggccatgaaaattttcagaagcaagctttgacatctacgggagagcagtcctcctctaattctcgagctaatcccagtaaattatttaacataagcagtgacgattcggaagacgaagtacctattattgaggacaccactgcttcagatgaagaatctcgagcgaaaaaaatacgcaaacgtttt

SEQ ID NO: 25743 - DNA, 1266 bp, Schizosaccharomyces pombe
atgaaagtaggtcgttttttagtcataattgctttttgtttttatgttctttatctcgagaaaattattcatacaaggccacataaaaagtgcgattggcggtcttgggagcaatgggagagtactgggaatccagtaaggattgcattggttgcggatcctcaattagttgacgatttgacttatgattatcctcgacctttaattggaatcgttaaatggatttccgaccagtttcttcgtcggcattggcgttatcttcataaatcactgaagccagatattactttcataatgggcgatttgatggacacaggtagagaattcgcaactgaagaatttaaaaaagattatttcagaatgatgaacgtccttgacccaaaattcaccaataaattggaaatctaccctggcaatcatgatattggatttggtaatcacgctattgttaaggatattcaaagatttgaatctctttttggtccaacatctcgatcaatagacgttggcaatcatacactggttattgtagatggaattcgtttatcaaacaacgtcaatccccaagtttatcaaccggctagagacttcttaaaaagctttgaaacaaataaggacaactcgagacctaggatccttctatctcacgttcctttgtttcgccctgccatcaattcttgcggggagcttcgtgaaaaagatgatgttatcaaatatggtttgggatatcagtatcaaaacttgcttttgccagaactttccgagtctattttaaaagctgttgaaccaattgccgcatttgctggagacgatcacgattattgcgaagttgtgcataattaccaggtggatactcgagaagcagccaccacggaatataatgtgaaggcattttctatgaccagcggcatactatatccgggatatcaacttctctcattgaactatccttatgacaaccctaaagccgatcaaaaaagttcttatcagacaaagttatgcattcttcctaaccaaattcaaatttatgtttggtatggtgcttctatatccatcttttttgctcttatattattgaggactgctatctttttttttggaactgaccgttatagcctcccactttacaaaactcatgcacgccgattttcattgtcaacaacaattcatttgtttaaaaaaattgtgcgcataaccctttctacattcatctcatatacatggataccgtttcttttattcatcttccttaacatcttcattatc

SEQ ID NO: 25744 - DNA, 582 bp, Schizosaccharomyces pombe
atggaatcactactggcagttcagggtcaggattttgtactcactgcttcatcatcatcagcagttcgtggaattactgttttgaaacctgacgatgacaaaagtcagattttaaattcgcataatcttatgttatactgtggtgaagctggcgatactactaattttgctgaatacattgcagcaaatatatctctttacactttaagacataatttaaatttaagccctgaagctaccgcttcctttacgagaaagcaacttgctacttcacttcgttcgagaaaaccatatcaagtcaatattttattagctggttatgaaacgaatttaggaaagcctgagcttttttggctagattatttagccacttgtgttcgtgtaccttatgcctgccaaggatacagttctttttattgtttgtctatctttgatcgatattacaaaccagacctcaccattgatgaagccgtgcgaattatgaaattatgttttgatgaacttaaaaagcgtatgcctattgactttaaaggtttcatttgtaaagtggttgataaagatggaattcgcgaaatcaatatt

SEQ ID NO: 25745 - DNA, 2647 bp, Schizosaccharomyces pombe
atgtccggattccagacgtccgacgaggtcgatatatcaaattctttaaaagcttttcctgttgatattgctactgataatcaaaaagataagcacgaaaatgttggtgaaaatgtgagcgatgaagatgatggtaattatattgcctcgaagcttttggagtctaacaggaggacgaagggaaaaaaggggaatggaaaggcttctaatttccaatcgatgggtatgttaacttcgtgattacttgccataaggtcactttgcattatgcttcaagacactgtaatctaaattactttgatatttttctaacttaattataggattgaatcaaactttacttcgagcaatatttaagaagggttttaaagctcctacgccgattcagcgcaaaacgattccccttttattggaaggtcgtgatgttgtaggtatggcacgtactggatcaggtaaaactgcagcttttgttatacctatgattgagcatttgaagtccactctagcaaactctaatactcgcgccttaattctctcgccaaatcgagaacttgctcttcagactgtgaaagtcgtcaaagacttttctaaaggtacggatcttcgatctgtcgctatcgtcggtggcgtcagtctagaggagcaatttagtttgctatccggaaaacccgatattgtggtcgcaactcctggaagatttctacatttaaaggtggaaatgaaattggagttgagttcaatcgagtatgtcgttttcgatgaggccgatagactttttgaaatgggttttgctgctcaattgacagagattttacatgctttgccgacttctcgtcaaactcttctcttctctgccacacttccacgtactcttgttgattttgcaaaggctggacttcaagacccggttcttgtacgccttgatgtagaatccaaggtttccgcggatctacaaagtgcctttttttctgttaaaaccgctgaacgcgaagctgctctcttatgtatactacaagatatcattaagcttcctctaaaagataacgtgcgcccaagagaaataggaaatgtcaataatccgaagaaaagaaaacgtgcattagaattagcgcttaaaggaagtgaatctggatcaccagattctactctagtatttgttcctacaaaacatcatgtcgagtatgtttctgagttacttgttcaagcaggatattcggtttcaaaaatttacgggtctttggaccaagaagcgcgtctcaatgaaattaataattttcgacttggaaaaacaaatttactagtcgttacagacgtagcttctcgtggtattgacatcccattacttgctaatgttattaattatgatttccctcctcaaccaaaagtttttgttcaccgtgtaggacgtacagctcgagcaggacgcactggctgggcgtattcattggttagagcagaagatgctggttatttattagacttacaactatttttaaaccgacctttagttacatcctcgaagcaggttaaaactgactcggattgtgattttacaaaacagattgttttgggatcattaccccaagaacttgttgctgagctactagaatgggtacaaagaatagtttcgagagacgttgagctacagcaactttccaacgttgctgcaaggggtgagaaactatattttcgcacaagagctacttgtagtgctgagagtgctaaaagagctaaggaattggttgatagcaagggctggagttccaacaatccattatttggagatgtatcggtaattgaggccgaggagaaatatgctgaattgctttcaaaagtttcttcttatcggccatcagaaacagtatttgaaatcggtcagcgtggtcacttaaagacagaagctgcagaaatcatgcggaaaagaagaaacaaagtaaaaccaaaaggaataaaatctgaagttgcatctgataaaatcactgacagttctcctggtaatatgtcagaagcttcagagtcagagcttgaagaggtatttaaaaatcctaaggagttatcaaaaaagaagacaactgattttaaagataaagagtattatatgtctcattacgctccaaaggaatctattcaagaaactggctatgctataaattctggtgaaaattttactaccgcagctcgtcatgctattctcgatttaacaaatgacgaaggaattgaacaatcaaggaaggggggacaacgttgggatccaaagaaaaagaaatttgttaatataattaacgacgaagacgggtccaaagggtctcccaagataattcgtggcgaaagcggcgtgaaattgcctgcaacatatcgtagtggtcgttttgatgaatggaaagcatctaaagcattcggtgccaacgattctcctatacgggaaaataagcgatataaacataataagttacagactccaaaaccagctgataagttccgtgataactatcacaaacaaaataaacgtaatagagaggctaaagaaagaggaataggtattaaggtgaacagtgagcttaaatcagctgttgaaattagaaaggcgcgtgagctcaaagagaaacgacttgccaaaaacaatcggccgtcaaaaaagcatcgataa

SEQ ID NO: 25746 - DNA, 744 bp, Schizosaccharomyces pombe
atgtcaagaagctacgattctcgcacgactattttttcacctgaaggtcgtttataccaggttgaatatgcattggaagcgatcaaccatgctggcgttgctttagggattgtagctaaagatggaattgttttagctgctgaaaagaaggttaccagcaaactattagaacaagaagaatccgcagaaaagttatatcatataggagacaatatgttatgtgctgtggcagggcttaccgcagatgcaaacatcctaattaactacgctagaagggttgggcaacaatacttgcagacttttaatgaagagatgccttgtgagcaattagttcgtcgcgtttgtgacctcaaacaaggttatacacagtatggtgggctacgtccattcggtgtttcattcttatatgctggatgggatcatattcgtggatatcagctattccaatctaatccatctggaaattacggaagctggcaagcaaatagtatcggaggaaatagtactagtgttcaaagcttaatgcgacaggagtataaggatgatataaacttagatgaggcttctgctatggccgtgaaatttttgagtaaaacgttggacagtaactccctaactcatgaaaaaattgaatttgcaacaataacaaaggataccacgaaaaacaaaatggtttgcaaaatatggaagtcagatgaaataaatgaagtgctcaataagtaccaagagacccagcggcaatct

SEQ ID NO: 25747 - DNA, 2159 bp, Schizosaccharomyces pombe
atgccaaatgacccctcagatatgaataatgaacttcataatgaaaatactattagaatcttaatatcttctgacccacatgtgggatatggggagaaagatcctgttcgtggtaacgattcctttgttagtttcaacgaaattttagaaattgctcgtgaaagagatgtaggcataatatgatagctattcacgttaatttattaactttcataggtggatatgattttgttaggcggtgatatatttcatgacaacaaaccgtcaagaaaggctttgtatcaagcacttcgctcactcagattaaactgtttaggagacaaaccatgtgaacttgagctattaagtgacacatccttaaccactggggatacggctgtttgcaatattaattacttagatccgaacatcaacgtggctataccagttttctcaattcatggtaatcacgatgacccttctggtgatggtcgttatagtgctttggatattcttcaagtaactggcttagtgaactactttggtcgtgttccagagaatgataacattgtggtgagtccaatattgctgcaaaaaggtttcacaaaacttgcattatacggaatttcaaatgttcgagatgaaagactttatcactcttttcgtgaaaataaggttaaatttttacgtcctgatctatatcgggatgaatggttcaacttattgaccgtacatcaaaatcagtaagtctgaaaaaactttatatatttttttcttttcaccattaagtatattttttactaatgctttaagctctgcccatacaccaacgagctatttacctgaaagcttcatccaagatttctatgacttcgtgttatggggacacgaacacgagtgtctgatagatggcagctataatcctacacaaaaatttacagtggtacaaccaggatcaactattgcaacttctttaagtcctggtgaaactgcacccaagcattgtggtatcttaaatattactgggaaagattttcatttagagaagattcgtttgcgaacggttcggccatttataatgaaggacattattctctcagaggtttcttccatccccccaatggtggaaaataaaaaggaagtattaacgtatttaatctcaaaagttgaagaggcaattactgaagcaaatgcacaatggtacgaagctcaaggaaccgttccagtggttgaaaacgaaaagccacctcttcctttaattcggttacgtgtcgattatacaggtggataccaaacggaaaatccccagcggttttctaatagatttgttggcagggttgcaaatgcaacagatgttgtccaattttatcttaaaaaaaaatacactagtaagaaaattttgattaccgaatatttgctaacgaactttagggtctaaaagaaacgacggcctatatacttccgcagtagaagatatcaaaattaactctcttcgagttgagtcattggtaaacgaatacttaaaaacaaataggctagaatgtcttcctgaagatagtcttggtgaagcggtggttaactttgttgaaaaagacgacagagatgctattaaagagtgagtttaattcttttcatcgtacgtactaaccgattacattagatgcgtcgaaacacagcttaataaacaaatcaacttattggttaaaaaacgagttacggaggaaaatcttgaacaagaaataagctctatcatcaatgatcttccaaaaatttcaactacaaaacggaaagattacgaagagttaccagaggaggtatcagaaacttctataaatattgctgagcacacacctgtacttaaacataccagctcactgttggatcatcattcaccgttagcgacttcttcgagtgagcatgaaatggaagcaacaccttctccagcacttttgaaaaaaactaataagcgacgagaattaccgtcttctttaacgaagaaaaataccagaacaccacaaagaagcaaagaagtgaaaaaagtaccagctcgtaaattgtcacaatcaacgaaaaagagtgacaaaaatacacaatctacgcttctattttacgacccatccagcaccacagaagcgcagtacttggataacgaggatgacgaaattttagatgattgattg

SEQ ID NO: 25748 - DNA, 2665 bp, Schizosaccharomyces pombe
atgcagcggtcagcgaagttaaaaattcgagcgccacgaaaagtaagtgtacctgatgcatgctgtccttattattttcctcacatactgacatttagttttctgctaaccaagtagactttgctacacattgggaagtcttgcagcgagctattggggatatatttcagaaaagcacatctcaattatcgtttgaagagttgtatagaaatgcatatatacttgttctacataagtatggagaaaagctttataatcatgtacaggatgttattagatcgaggcttaaagaagaaactgttccagctatttacaaaaactatgacgcttccttattagggaatgctctattggatattagaaaaaatgattcctattctacttcatggtcgagatcattggaagcggctcatagatttttatcgtctttagttaattcctggaaggatcacattgtttcaatgcaaatgatatctagtgtattaaaatatttggacaaggtttattcaaaatctgcagacaaagttcctgttaatgaaaacggaatatatatctttcgtgaagttgttttgttaaatagttttgaaattggagagaaatgtgtcgaaactattctaattctggtttatcttgaacgtaaagggaatacaataaatcgacccttaataaatgactgcttagatatgctaaactctttgccttcagaaaacaaaaaggaaactctttatgatgttttatttgctccaaagtttttatcttacacaagaaatttctatgaaatagaatcatcaacagtcatcggcgtatttggagttgtggagtatctgaaaaaagcagagaaaagatttgaggaagaaaaggagaggtccaagaattacctgttcacaaaaatagctagcccccttctatccgttgttgaagatgagcttttgagtaaacatttggacgatttgcttgaaaatcaatcaactggctttttctcgatgatcgactcttcaaacttcgagggtcttcaattggtttacgaaagcttttctagagtggaacttggcgtgaagtctttaaaaaaatacttggcgaaatatgtagcgcatcatggaaaattaatcaatgaaactactagccaagcgcttgaaggaaagatggctgttggtcgtctatcatctaatgctacaatggcaacattatgggttcaaaaagttttggccttatgggatagactaaatacaattataagtactactatggatgctgatcggtctatcttgaactctttatcagatgcttttgttacgttcgtagacggatatacccgagcccccgagtacatttcactattcattgatgacaatctgaaaaaagatgctagaaaagcaatagaaggctctattgaagcaacacttcaaaattctgttacgttatttcggtttatttcagaaaaagatgtttttgaaaaatattacaaaacacaccttgcaaaaaggtatgctttaattgtttttactgtctttaacacttttaggttgttgaataatcgatcaatatcttccgatgcagagctcggaatgatcagtaggctgaaacaagaagctggtaatgtttttactcaaaagctcgaaggaatgtttaatggtaagtattcagactttagcaagtttttttgcgttcccttattaatgcttagatatgaatctttcacaagaattgttacaggagtacaaacataattctgcgttacagtcggccaaggttagtggaaatttttattgataatcctttatactaacagttagcctgctttggacttaaacgtttcaattttggcttctacattttggcccatcgatttatcgcctcacaaaattaaatgtaactttccgaaagttctcctggctcagatagatcaatttacggatttttatttatcgaaacatacggggagaaaattattgtggtatccttctatggtatagtaaacttttatttgcttgttgcgtcacactaacaatcctatttagggaagtgctgatgtccgtgttaatttcaaagacagaaaatatgacttgaatgtatcgactattgcatctgttattctattgcttttccaagacctaaaagaaaatcagtgtttaatttttgaggagattttggaaaaaaccaatatagaagttggggatttgaagcgcaatcttcagtcccttgcttgtgcaaaatacaagattttgctaaaggatccaaaaggaagggaggtgaatgcaggtgacaagttttatttcaatgagaactttgtttcaaatctcgcccggattaaaatatcgacagttgctcagactcgtgttgaggatgatagtgagagaaaacgtacattagagaaggtagacgagtcaaggaagcatcaagcagatgcctgtattgttagagtgatgaagtatgtctttttccttttttttttttttcaaacatttttactaacagtaaattaagggatcgcaaagtgtgcgaacacaatcagctgatggcagaggttacaagacagttaaaccctcgtttccaccctagtccgatgatgattaagcgacgaattgaagctttaatagagcgggagtacctacaaagacaagccgataatggtcgcatttatgaatatttagcatagcagccttaa

SEQ ID NO: 25749 - DNA, 1452 bp, Schizosaccharomyces pombe
atgtccttgcacgacgcttaccattggccttctcgtacacctagtcgtaagggttcaaatatcaaattgaacaaaactttacaagatcatttggatgaactggaagaacaattcaccattcccactgaacttttacatcgcgttaccgatcgctttgtttctgagctttacaagggcttaaccacgaacccgggtgatgttccaatggtccccacatggatcattggtactcctgatggcaatgagcatggctcttatttggcattagatttaggtggtactaacttgcgtgtttgtgcagttgaggttcaaggcaacggtaaattcgacattactcaaagcaaataccgtctacctcaagaactcaaagttggcactcgtgaggccctctttgattacattgccgactgtatcaagaaatttgtggaagaggttcacccaggtaaaagccaaaatttggaaattggtttcaccttttcttacccctgtgttcaacgctccattaacgatgcttcattagttgcctggactaagggctttgatattgatggcgttgagggtgaaagtgtaggtcctcttttatcagcagccttgaagcgtgttgggtgtaacaacgttagactcaatgccattttgagtgatactactggtacattggttgcttccaactatgccagcccaggtactgagattggtgtcatctttggaactggatgtaatgcttgttacattgaaaagttctcagaaattcctaagcttcataagtatgacttccctgaagatatgaacatgatcatcaactgtgaatggtgcgattttgacaaccagcatgttgtccttcctcgtaccaaatacgatgttgctattgatgaagagtctcccagacccggtcttcaaacgtacgagaaaatgattgctggatgctatttgggtgatatcttgcgtcgtattcttcttgacctttatgaacagggagctctctttaacggtcaggacgttaccaagattcgtgaccccttggccatggatacctctgtgctcagcgctattgaagttgacccctttgagaaccttgatgaaactcaaaccctatttgaggaaacctatggtctcaagaccaccgaagaagagcgtcaattcattcgtcgtgcatgcgaattgattggaactcgttctgcccgtctttctgcgtgtggtgtatgcgcccttgttcgtaaaatgaataagccatctatgattgtaggtactgatggtagtgtctacaacttataccctcgttttaaggatcgtcttgctcaagcatttaaggatatccttggtgaggaaattggcagcaaagttgttaccatccccgccgaagacggtagtggcgtaggtgctgcattggtcagtgctcttgaagccaaaggcaaggccctcacttctgatattcttgccgagcatcttaagaat

SEQ ID NO: 25750 - DNA, 1104 bp, Schizosaccharomyces pombe
atggacaagcacactcctcttcttcctggcgacagtgttttttcacgttgtaaaactgaagatagtcgtatcaaaggctatgatccagtaatttcacctgctttaattcaatcagaattagcagcctctgatgaaacacttgcttttgtgtcggatcaaagacgccaagccgccgatatcattgcgggacgtgatgatagacttcttctaatcgttggaccctgttctttacacgatcctgttgccgccaaggagtatgccattcgcttgcaaaaggaggctattaagcacaagaaggacttgcatattattatgcgcgcctatcttgaaaagcctcgtacaactgttggatggaaagggttgattaatgatcccgatttggatggatcttataacattaataagggtattcgtgtcgctcgacgcatttttctggagcttctggaaactggtgtcggtatagcgtcagagatgctggacactataagtccccaatatttagctgatctaatttgctggggcgctattggtgctcgtaccactgagtcccaattgcatcgagaacttgcttcagggctttcttttccaataggttttaagaatgctactgacggtaacattggtattgctatagatgctatgaattcttctgccaaccctcatcatttcttgtctgtcacaaagcagggtgttgtagccattgttactactacaggtaaccctgatacacacattattttgcgtggtggtaaaagtgggactaacttcgatgctgattcagtggctggtgccaaggctaaactcgaagaatgcaacaagctacctagtatcatgatcgactgttctcatggaaactcatctaaaaaccataagaatcaacccaaggttgctgcttgtattgctgagcaggtggcaaacggtcagaaagcaattactggtgtcatgatcgaatctcaccttaacgaaggtaagcaagctatacctgaggatgatttgtcaagtatgaaatatggagtcagtgtcaccgatgcttgcattggttgggacgacactaccgccgtttttgaacagttggctgctgccgtccgttctcgtcgttctcat

SEQ ID NO: 25751 - DNA, 1104 bp, Schizosaccharomyces pombe; identical to SEQ ID NO: 25750

SEQ ID NO: 25752 - DNA, 1926 bp, Schizosaccharomyces pombe
atgggttcattatttttagccgctagtcagggagaacttgacacagttaaaaatttgatatcttctgaaaagatagatgttaatgctacagatgaaggtggagcaactgcattacactgggcagctctgaaccagcaaattccaatatgtaaatttttgttagaacatggcgccgatgtgaatgcaataggcggagatttacaggccgctccaatacattgggctgctaaacgtggctctgtgaagactgttcactacttagttcagcatggtgcggacccattactcaaagataaacaaggtttcaattgtttgcatttggcagtccacgctgcaagtcctttactagtagtatatttgttgcatctcgatatttctgtcgatttacgtgatgatcagcagcacacacctctgatgtgggcttcataccatgggaatgagcctataacaaactgtcttttgcgatggggtgcagatgtattggctacagatgaagataaaatgacccctttacattggtccattgtaggtggaaatctaaaatgcatgaaactgattttaaaagagggaggcattccctgtactgcagttaccgctaatttaagtggacagctgaaaaccccttgggctctagcgtcagaacttcgcgtctctcacttatttaaacaggcattaatttcaaatggattaaaagttaaagaaacctctgaagaacctgaaaaatgggtcgttgttcctagtaaatttcaattttcgcaaaaaacatttattattttttgctttttatcgtcctttataattactggcgtctttttttttattatgtcaatttgcccaatggtcatctccttgataatcgctcctttgtggatttactttacgttcaaatatattacaacatgcattcatgcgaatattgacatagtacatttctatcttgaaactccattcttggctggcatattttcctcaattttcttctgggtatggtgtcattctttgttatatatagtacctaagacgttacccataaaacctctctcttctcttttatttgttttgatttcatttacttgtattggattatatgttcgtacagcttttcaaaatcctggatatgtagacaaaattggtgccgtcgttcaacgtcgtgaagaaattagcaaattattggacaaggatctttttaatcaatctcattattgtttaaaatgctttcaagttaagcctcctcgttcttatcattgtggagcttgtaaaaggtgtattaatcgttatgatcaccattgtccttggactggaaattgcgtaggggcacggaaccatagaacattccttctttttgtcttcacattgtctactttaattcctatttatttttacgttgcattttattatttacagaatatccccattcaaaaaaaatacgagtcgtataggtgcctttttatttctggtaccatatgccagtggtctttaaaagacatgtttgtgttagttgcttctctaactttgtttgtgaattggtgttgggtagttgttttagcttttacccagatttgtcaagttgctcacaacgtgaccacagccgaattccgactatttaaacgatatggaactctcgttcctcctacaaagcaaaattcatctccaaaaaatggtcacggaattcatggaagctttctacgtacagtatgtggtatcctgggattggatcagtgtatattgttaattagagaatcaaattgctttgtgagatgtttcccatcgagagctgagttaggttcccaaaattctacctctttgtctcgtaatctttccacagtcaatccatatgatgagggtagcataattaagaactgtaagacattttggaagcaaaactttcttaacgatggtcggcaagatgaggcaacaagacatgtt

SEQ ID NO: 25753 - DNA, 4107 bp, Schizosaccharomyces pombe
atgacaattcatcaaggtggaaattcagtgattgataatgtaccttattcgttaaacacaaatgtaaatgatagcatctactctgaaaaggggacaggacggaaagatgcagaagatcacacaccatccaaaattacagatcttgaaaaaaacgtcgaccattctattccatcgtttcctgagaatgatccaaaaaactactctgaatttgttaatttaaatcctccaaaacggcccgatttggaacacacccgggggtcttcttggcatacagcctctgaaaacgttaacgatcttgctgcgaatgatagtacaagagtgcaaactccagaatttatcacacagacaatggaggatgagaacgttgaagttcctcctttagagagagacgaacgtgatgcagctgctgcccatacaagtaaggcaaaccgtaattctgccagacaaatgtgggcacaattaatggcttctgttcgcaaatttaaaagggaagatgaaaagcctatattaaaggagaacttgcctgctattaatcttttcgaagcaggcatacctgcatctttacctatagccaagcattttattcgagataaatctgggcagccggtattgcctattattaccgacctaataaaggtctcagtgcttgatgtggagcctaaacataatcgcatacacagtactttcacaattcaagttgaatatggtactgggccacatgctatccgttggttgatttacagacagttgcgcgatttcataaatcttcattcacactttcttttttttgaatttcaacatcgattttccggaagacgcatgaaattgcctaaatttccaaaagaagtgctcccttacttggtgaaactccggggttatcaaaaaatactgtattccaatcccagtgaccaacttattgatgaaacacatagcatttctgacatatcatgggagtcacattcgcaagatggtgatcggacgactggtcaaccaaggcatgccaataatggtagaaaaaaacacggaaatttttggaccattcaaggtaatactcttggtgtatacttacaagaaatgatccataatttacaattttttcccgaagtgaatgtgctttattcatttttagagtttagttcattaggattgtacttagctggagccggaacttttcatggcaaagaaggattcgcgaccttgaaacgaaattattctcctactcaatatatgttgtgctgtaatactactatgatgaaaactaggagtcaaccgttttggataatcgtttctgaaagttgtataatattgtgtgataatatgctttcaatgcagccagcagatgtatttatatgggatgtcgactttgaaattacgcgtaaaaactttcgaaaggcacattcaaaagacactaatgaaaaaattcgtctttcccatcactcttttaaaattaaaaatcggcagaaagtaatgaaattatcagtgcgaagtggtcgttggttgcaacaatttatcaacagcgttcaagttgctcaaggattaactgcttggtgtgaaatacataggttcgacagctttgcacctgttagaactaacgttgctgttcaatggatggtagatgcaagggatcatatgtggaatgttagcagggctataaagaatgcaaagcgctgtattatgattcatggatggtggttaagtcctgaattgcaaatgcgacgaccttatagtatggctcacaagtggagaattgatcgtatccttaatgaaaaggcacatgaaggagtcatggtgtacataatgatctatcgcaatattgacgctaccatacccatagactcattccatactaaggaacatcttcaatctctacatccgaatatttatgttatccgctctccttctcactttcgccaaaacgcactcttttgggctcatcatgagaagcttgtggtagtggatgatgctataacttttattggtggtattgatctttgtttcggcaggtatgatactcctcaacatattctgtatgatgacaagcctgttgctgataaaactggtttatgcgagcaaacttggaggggaaaagattattcaaatgctcgcgttcatgatttttttgaccttactgaaccttacaaagatatgtatgaccgattggcggtacctcgtatgggttggcatgatgtctctatgtgcatcattggtcaacctgctcgagatgctgcgcgacactttgttcagcgatggaattatcttattcaatgcaagaagcctgcccggaaaacacctttgctaattcctcctcctgattttaccacagaccaattaactgatagccaattgaccggtacctgcgaagtacaagtcctgagatctgccggactatggtctttaggtttagttgatactgttgagcaaagtattcagaatgcttatgttacgtgcatagaaaagagcgaacattttatttatattgaaaatcaatttttcgtaacctctaccacttgtgaaggtacgacgatagaaaatcgtgttggagatgctttagttgagaggattataagggctcacaaaaataatgaaaaatggcgtggtgttataatgattccgttgcttcccggttttgaaggtcagatagatttacaagagggcggtagtcttaggttgattgtggaatgtcaatatcgcagcatttgccatggtgaacattcaatatttggaaggttaaatgccaagggtattgatggcagcaagtacttgcgtttttatggtttgcgcggttgggcccatttgggagaaaaccatgaacttgtgactgaaatgatctatgttcatgctaaaattcttattgcagacgatcgagttgcggtcattggttccgcaaacattaatgaacgttctttgcttggtaaccgcgattctgaaattgctgcggtaattagagatactctaaccattgactccaagatggacggtaagccctataaagttggaaaatttgcacacactcttcggaaacgacttatgagggagcacttaggtttagagaccgatgtgcttgaacaacgagaatacaacatggatggcttggatcgcgatacagagtggaaacgtgtagaagtctggactcctgatgaaggcaatgccattaatggttctgcttacactgctgaagagttgaaaatgaaatatcgttctcagagtcaatttaccactactccagacatcttacgaaaagctgaaaagagtatgaagaaactagatcaacgtgtcagtttaattccttcttcgattgaattcaatattaaaactcaaaaggacaaggtcgagtttgaaaagaactacgagaagtctaaaaaagggcctgatgttatagccaacgccctagtaggcggcatccccttatcactgaaaacaaaggaggactcattatatgaactttccaagttctctcaatgtggggaggatcaacgtccaatggtacttaaagaccctgatcatctagtgcctgaacccagtcgtccacactgtggaaatggacttgtgttttatgatgatataccattgcttgaggtgaatcctattagtggagaaacaattcctaaatttgacgcttcaagctttgaggaccccgtctgcgatgaattttttgaagacatatggtctaaagtggcttcaaacaatactactatttatcggcacatatttcgatgtgtaccggatgacgagatgctaacgtgggaatcatataatgagtggaaaaaatatggaaaacgctttaaagaagagcaagcccgctggcgtcaggaggagttgtcaaatctacacgaaactcatgaaaagtcagagaatgatccaaaaaatccaaaggctggttcccaaggtagtggtaacacgagtgcaagtgaagattcgaagacagagaaaccaaaaacccgtactaataatggtttacaagttcctgacaaacgtgtagtttacgacttactacgtggcattcggggacagttggtagaacttccattaaaatggatgtctaccgaatcaaacgcaagaaattggctcagtagtattgacaaaatccctccgttagaaatttatgat

SEQ ID NO: 25754 - DNA, 1674 bp, Schizosaccharomyces pombe
atgcctggggatgtagaaggttgccagcatcttaaacttaaaccggcggatgttgaaaactatcaaaagatctgtacccagatattcagttgtcatgtaaggcttgtgaacaacacttcatacagttcaattttctttttccattcgattccttttaacatttctttcatttagtttgtcccacgtcgctgcagtacttgcaaacgcatcaacaagcggagtattcgatgcttgagttgtcattctgtgggatgtctttggggacatcatggtgaagaacacgcaatggagcacactcatatgatcggtacgtttagttgaaaacatagctattgatttagcaacgaaacctttttgcgaatatcgagttaggatgcaattcccgaataccaattactaattcttaggcgtggatgtaaaaaatggccatacctactgctttggctgtcaagactacgtttatcagaccgagttggaaacccttcgttttaagatcaagaatatcaaggcatggcaaagtgatcacaagagacttcccgagaagtacaatcaaatggtttgcttagaagcctatcgaaaataccctccagtttgcgcaacagcaggcttgagggggatccagaacttgggtgctacttgtttcatgagcgtcattttacaaagtattttgcataatccattggttcgaaacttgtttttcagtgggtttcatacttctactgattgtaagcgacctacttgcatgacttgtgccattgacgatatgttttcatctatttataattctaaaaacaaatctactttttacggtcccactgctgtcttaaatcttatgtggaaactcagcaaatctttatgtggttactcccagcaagatggccacgaattttttgtatacttgctggaccaaatgcatacggaaagcggaggaggaacatcaatgccgtgcacttgtcctattcatcgtatttttagtggatctctgaaaaacgttgttacatgcctagattgcaagaaggagcgggtggctgtggatcctttgatggacattagtttagacatcaatgagccaacacttcaaggatgtttggaaaggtaaaatttgctcgtttttagattttttaacaaatattattttaggtttgtttccaaagagaaagttcaatatagctgtcatagttgcgggtcaaaaaatgctattaaacaattggtctttgacaaactacctccaactatttgcatgcaattgaaacgatttgaacaaaataactttgccatgtcaactaaaatagataagcaagtatcttatccagcatttttaagaatgcgctacaactttaatcaagatgatgtggattatcaattatactcagttgtgtgtcataaaggaactctcgacacagggcactatattgcctatacatactaccaaaatcaagtatattaaattttttttgaattttttatggaaatttttactaatttttgtagtggtttttgctggatgacaccacaattgtggaagtaaaggaatcggaggtcttaaattctcaagcgtaggctctttgctgttatttttttacatactaaccagattatagttacctattattttaccatgagcgtcaaatcctatacagtgatgaaatgactgttaaaacggaaaattgagtt

SEQ ID NO: 25755 - DNA, 1380 bp, Schizosaccharomyces pombe
actggagctttgcttcatcatactttaggagatggagactttcgcactttcatggatatgtttaagaaagtttctgcctacagtataatgatcgataacggaaacgatgcagctgaaaagatcgatgaagccttgtcgatttgttataaaaaggctaggcctgtttacattggtattccttctgatgctggctacttcaaagcatcttcatcaaatcttgggaaaagactaaagctcgaggaggatactaacgatccagcagttgagcaagaagtcatcaatcatatctcggaaatggttgtcaatgcaaagaaaccagtgattttaattgacgcttgtgctgtaagacatcgtgtcgttccagaagtacatgagctgattaaattgacccatttccctacatatgtaactcccatgggtaaatctgcaattgacgaaacttcgcaattttttgacggcgtttatgttggttcaatttcagatcctgaagttaaagacagaattgaatccactgatctgttgctatccatcggtgctctcaaatcagactttaacacgggttccttctcttaccacctcagccaaaagaatgccgttgagtttcattcagaccacatgcgcattcgatatgctctttatccaaatgtagccatgaagtatattcttcgcaaactgttgaaagtacttgatgcttctatgtgtcattccaaggctgctcctaccattggctacaacatcaagcctaagcatgcggaaggatattcttccaacgagattactcattgctggttttggcctaaatttagtgaatttttgaagccccgagatgttttgatcaccgagactggaactgcaaactttggtgtccttgattgcaggtttccaaaggatgtaacagccatttcccaggtattatggggatctattggatactccgttggtgcaatgtttggtgctgttttggccgtccacgattctaaagagcccgatcgtcgtaccattcttgtagtaggtgatggatccttacaactgacgattacagagatttcaacctgcattcgccataacctcaaaccaattattttcataattaacaacgacggttacaccattgagcgtttaattcatggtttgcatgctagctataacgaaattaacactaaatggggctaccaacagattcccaagtttttcggagctgctgaaaaccacttccgcacttactgtgttaaaactcctactgacgttgaaaagttgtttagcgacaaggagtttgcaaatgcagatgtcattcaagtagttgagcttgtaatgcctatgttggatgcacctcgtgtcctagttgagcaagccaagttgacgtctaagatcaataagcaa

SEQ ID NO: 25756 - DNA, 3348 bp, Schizosaccharomyces pombe
atggctgccgatatcggatcgcagtcatcaggctctttggaagaacggtttgaacagtctcttcatcttcagaatgtcgataagcaagattggtcacttaacagtgtacttcagtttttaaaactatacaaatttaacaaagaatgggaagacgtttttattaaaagtcgaatcgaaatggatttatttatcaatttggccgatcaatcaaaagccgaggaattcgcctttaaaaataaattgagcaaggagtctgccatccaattgagtagctgtattcgcaaaacacttttagcaccttcttcgactcgcgtacctagcaaaaactcgtcttacgaaacattaacttacagcgccaaagatagttcggatgacgtttttacagaaactaactctggtttccgctcttcaaatcaaaattcgtccctcaaaagctttcagagtgttcctgatagcaatgtgaacgtgtttggtggcttcggtggatcagtagtcgacaacaatgagctattgagcacaggaaaaaactcccatcaaacaacctctttaaatttggaaggctctcctataaacttacacgcttacaaaggaactgtcacttcaataattaacgatgacagcagaaacattaataaaaaaacattgtcgaaacaacctgtatccgaacataaagaaaaacaaactagctttctccgtcgtttccgggtacctgggttttctcgtgacaaggataaaactaaagattgcccttcttcaaattcgaacccattccatttagcttcttcaaatgtgaaaacattagacgcgtctttggatcaaggtgagtgggtacctcgtattcatcgtttagaaagtcaaattggtttaatatccaaaaagaagtcatttgttcttgctactatggatgatatgaaattcacagtagtggatattaccaacgtccaaaatgctactcagctacgtaagctaatagctaagagtatgtatttagacatttcaattgaccagtttgatttgtttctcacggaagtcggcggggctcaatacatagaaatattagatgatagaaagcttgatattgcaaggctttattctgatgaatttggaactattaaatttttcgtaaagccatcacaaaatgaagaatcgggtatggatagtgatacttatttatcttttggcacaaaatcaagttcaacttataaagctgatgatgactcaatatatcatcgcaaggaagattttaaaaagcaaccaagttaccctgtgcttacttcggattttgaaattactgatgcaggacctaatttatcattatcagggcatcaacctgataataaatactacaaaggttttagttcggcaccgaatttggcagttgttccagaattaccatctcgacgttttcgagggtttgaaaaaatccgtggtgctaaaggagaaatggctacaaaaattttggatgccactgaagcccaaagtgaaaaaaacaaatttaccgtttgtagacctcacaagaaggtcacattgaaaatgccacttaattccggctcttccgctccccaaagtccttcatctaatacttctgcttctgttttaactagaaattttgtggcacatagagatcctccacccccacccacagagacatctagtttacgtcgaaaaaatacattgactcgtagaccaagtattcgtcacgctcggtcctctccttacattgataccggacataacgaagctagcaaattttcacatacgtcttttgaccccaaagcatctagtaaatcttctaattcattaaaggaaagtgtggaagctttatcagaaataccttttgaagatgcgcctgcactagacgaatcggatctttctggggatcccttttgggctatacagcccaaacaatcttcctcccaagtacctaaagaaaatcatcacaacattcaatccaaactttccattaacacagaggctgctacggatttgaaagcaaatgaactatcttcgcctaaaactcctgaatactgtagaggtgatgacagatccattagtttatcaccgttatcttatcgtttaagaaagtccaaacatattcgtgaatccccaccgtcttcaaaggttatcaattctggtaactgggaagttcgtccatctgctgatgatctttatgaggatgttgatcgattttttccccgttatgatttggataaagtacttgtagtggaccaaagccgcatggtttcttccccttcaaaggtatcgatacgtccgaaaatgaagtctgtacgattattagcccgcgaagcatctgaagctcggaaagaaatacgacataacgcgagacgcaataaatctggaaatcttctacgtcgatcaagtacgaaactttggggctctaggattgtagaactaaaaccagatactactataacttctggatcagttgtttcacaaaatgccacgttcaaatggatgaaaggagaattgattggaaatggtacttatggtaaggtatttttggctatgaacattaatacgggtgaattgattgcagtaaagcaagttgaaataccacaaactattaatggccgtcatgaccaattacgcaaagatatcgtggattccattaatgcagaaatttctatgattgccgatttggatcacttaaatatagtgcaatatctgggtttcgaaaagacggaaacggatataagtatattcctggaatatgtttcaggtggttcaattggtcgatgtttgcggaattatggtcctttcgaagagcaactggtccgttttgtatcacgccaggtgctctacgggttgtcttacttacattctaaaggtattatacatcgagatttaaaggctgacaatttgctcattgattttgatggagtttgcaaaatttcagactttggaatatctaagcatagtgataatgtgtatgacaatgacgcaaacctgtccatgcaaggatccatcttttggatggcacctgaagtaattcataatgatcatcaaggatatagtgctaaggtcgacgtctggtccttgggatgtgtagtgttggaaatgttagctggtcgtagaccgtggtctacagatgaggctatccaagctatgttcaagttaggtaccgagaaaaaggcgcctcctattcctagtgaattggtgtctcaggtatcacccgaagcgattcaatttttgaatgcatgctttactgtgaatgctgatgtaaggccaaccgcagaggaattattaaatcacccgtttatgaaatgtgacgaagaattcaactttaaggacacgaatctttacgacatgctttgtaaaagaaagagc

SEQ ID NO: 25757 - DNA, 5871 bp, Schizosaccharomyces pombe
atgtcgaatcagtcgtcttctggttcgaatacttctgatttggatgaagaatcagcgagtagtcttgtgagctctgctgcatcaccatttattgattctgatctcgaaacaccaagacccaatatttcaagagcttcaacaggacaacttgcagaagacggtgacacatcaagtcaacatgaagattcctcagaggagttaaagcgtcaagaagtaaggggaatgcgtaggcacagtgacctttcaattgatgcgaaattaggctcttctgaaggctcaactgcttcttcagcattacctttgacacctcgttctccttctaatgccagctggctattagtccgcggtggtttacttgatagtccgattctcgacattaactcagtaactcaaaaatccaaccttttaaatgagttgaagcaagtgcggtccaaactggctgcccttgaacatgaaaacggaattctctccttgcaattgtcatcttcgaataaaaaggataagaatacctcaagtgtaaccacgttaacatcagaggaagacgtgtcatattttcaaaaaaagctcactaacatggagtcaaatttttctgctaaacaatctgaagcgtacgatttatcgcgacagttattaacggttacggaaaaattagataaaaaagaaaaggattacgaaaaaataaaagaagatgtttcttctatcaaggcctctttagcagaagagcaagcttctaacaagtccctgcgtggtgagcaagagcgattagaaaaacttcttgtaagctccaataaaactgttagtaccttaagacaaacagaaaactcattgcgcgccgaatgtaaaaccttgcaagaaaagttggagaaatgcgccatcaatgaggaagattccaaattgctggaagaacttaagcataatgtcgccaattattcagatgccatagtacacaaggataagttaattgaagatttaagtaccagaataagcgagtttgataatttaaaatctgaacgggacacgttgtcaataaaaaacgagaagctagaaaagttactacgtaatacgattggcagcctaaaagactcacgaacctccaattctcaattggaagaggaaatggttgagttgaaagaatccaatcgtactatccattcgcaattgactgatgctgaatctaagctttcttcttttgaacaggaaaataaatcactgaaaggatctattgacgagtaccaaaataatctttcttcgaaggataaaatggttaaacaagtttcttcccaattggaagaagctcgttcttcccttgcccacgcgactggtaaattagcagagataaattccgagcgagattttcaaaataaaaaaataaaagattttgaaaagatagagcaggacttgcgtgcttgtttgaattcctcatccaatgaactgaaggaaaaatcagcgttgattgacaaaaaagatcaagagttaaataatttgagggagcagattaaagaacagaaaaaagtttctgaaagtactcaatcaagccttcagtctttgcaacgtgatattttaaatgaaaagaaaaaacatgaagtttatgaaagtcaattaaacgaactgaagggtgaattacaaacggaaatttcaaattctgaacacctatcctcccaactctcaactttggcggctgagaaagaggcagctgtggctaccaataatgaactttccgaaagtaaaaactcacttcagacattgtgcaatgcttttcaagaaaagcttgcaaaatcggttatgcaattgaaagagaatgagcaaaacttttcttccctggatacttcatttaaaaaactcaatgaaagtcaccaagaattagaaaataaccaccagaccataaccaagcagctgaaagatacttcttcaaaacttcaacagctacaattagagcgagccaatttcgaacaaaaagaatcaaccttgagcgacgaaaataatgatctgcgaactaaattattaaagctcgaggagtccaacaaatcgttaattaagaaacaggaagacgtggattctttagagaaaaatattcaaacattgaaggaagacttgcggaagtcggaggaagccctccgattttccaaattggaggctaaaaatttgagagaagtgatagacaatttgaaaggaaagcatgagacattggaagcacagagaaatgatttgcattcttctctttctgatgctaaaaatacgaatgcaatattgtcgagtgaacttaccaaatcatctgaagatgtcaagaggttgactgccaacgttgaaactcttacacaagatagcaaagctatgaagcaaagttttacaagccttgtcaattcttatcagtcaatctcaaacttgtaccacgaacttcgtgatgaccatgtgaatatgcaatctcaaaataatacattgcttgaatctgaatcaaaattgaagacagactgtgaaaatctcactcaacagaacatgacactcattgacaatgttcagaaactcatgcataaacatgtaaatcaagaatccaaagtttctgaactaaaagaggtgaatggaaagttatcattagatttgaagaatctaagatccagtttaaatgttgctatttctgacaatgatcaaatccttacccaacttgctgaacttagtaaaaattacgatagtttggagcaagagtctgctcagttaaattccggtctgaaatcattggaagctgaaaagcaattgctacatacagaaaatgaggagctacatattcgtttggataagttaactggcaagttaaaaattgaagaatcgaaatccagtgatcttggtaaaaaattaactgcacggcaagaagaaatttcaaacttgaaagaagaaaacatgtcgcaaagtcaagccataacttctgtgaaatctaaacttgatgaaactttgtcaaagtctagcaagcttgaagcagatattgaacacctgaaaaataaggtttccgaggttgaagttgaaaggaatgctcttctagcttcaaatgaacgtttaatggacgatttgaaaaataatggtgaaaatatcgcaagtttacaaacagaaattgaaaagaaacgtgccgaaaatgatgatttgcagtcaaaactttctgttgtaagctcggaatacgaaaatttgctgttgatttcatcccaaacaaacaaatctcttgaagacaaaactaaccaattgaagtatattgaaaagaacgttcaaaagttattggatgaaaaggatcaaaggaatgtcgagttggaagaactaacctccaaatatggcaaacttggcgaagaaaatgcccaaattaaggatgagttacttgccttgaggaaaaagagcaagaaacagcatgatctttgtgcaaattttgttgatgacctaaaggaaaagagtgatgctctcgagcaattgactaacgaaaaaaatgagttaattgtaagccttgagcaatccaattctaataatgaagcactcgttgaagaaaggagtgacttagctaatcgtttgtcagacatgaaaaaatccttgagtgattcagataatgttatatctgttatacgttctgatcttgtacgtgtaaatgacgagttggatactcttaagaaggataaagattctttgagtactcaatattccgaagtttgtcaagatcgtgatgatttgctagactctctgaagggttgtgaagagagtttcaacaagtatgctgtttctcttcgtgagttatgtaccaagtctgaaattgatgttccggtatctgaaattttggacgataattttgtctttaatgctggaaactttagtgaattaagtcgcttgactgttctgtctttggaaaactatttggacgctttcaatcaagtaaacttcaagaaaatggaattggataatcgattgactactaccgacgctgaattcaccaaggttgttgctgatttggagaaattgcaacatgaacatgacgattggttaattcaaagaggagatcttgaaaaggcactgaaggatagtgaaaagaatttcttacggaaagaagccgagatgactgaaaatatacatagcttagaagaaggcaaagaggaaaccaaaaaagaaatagctgaattgtcctcaaggcttgaagacaaccaacttgctacaaataagctgaaaaatcaacttgatcatttaaatcaagaaattcgcctgaaagaagacgttttaaaggagaaagaaagtttaatcatttcattggaagaaagtttaagtaaccaaagacagaaagaaagctctttgctggatgctaaaaacgagttggaacatatgctggacgatacgtcgcgtaagaattcttcattaatggaaaagattgaatcgattaattcttctttggatgataagagttttgagctcgcttcggctgttgagaagcttggtgccctgcaaaagcttcacagtgagtctctttctttaatggaaaacatcaagtcacagctacaagaggcaaaggaaaagattcaagtagatgaatcaactattcaagagctcgatcatgaaattactgcttctaaaaataattatgaaggaaaactaaatgataaagattcaattattagagatttatctgagaatattgaacaattgaataacttgcttgcagaggaaaagtctgctgtaaaaaggctgtctaccgaaaaagaatcagaaattttgcagttcaacagccgcttggcagatttggagtaccataaatctcaagttgagtcagaattaggtcgtagtaaattgaagctggcttcaacaacggaagaattgcaattggctgaaaacgaacgattatccttaaccacccgaatgttagatcttcaaaaccaagtcaaagacctttctaatataaaagacagtctaagcgaggatctaagaacgttacgatcgttagaagattctgtagcaagtttacaaaaagaatgcaagataaaatctaatacggttgaatcattgcaagatgtattaacaagcgtacaagcccgtaacgccgaattggaagatgaagtttctcgttcagtggataaaataagaagaagggatgatcgatgtgagcatttaagtggaaaacttaaaaaactgcattctcagttagaggaacagcatgaaactttctttagagctgaacagcagcgtatgacacaattagggtttctcaaagaaacagtgaaaaagcaagagaagcttttgaaaaaactaaacttaaggcaagaacagttaattcctcgctcttcaattttagtttacgaatcgtatattcgtgacattgaaaaagaaattatagtcttacaagaacgtctaaatggcattgagctttcgcaacaacttccgaagggctactttgggtatttcttcaaaactaatcgcgtcgaaatggaagtgttggatagtttcaaacaacaagtcgctaaattacagttccttgcgggtgcggaattcattgtcaaatttaaagaggatcttgaaaaatgcgctgcagaagaaaaggaaaaacaagctacatttgacaattattctgagaaggttgaaaatcttgggaaatcgattgaagctttgtattttgcactaaatcgagaaattagtttccgaaagtctttagcgttgtctaaatcagcatatcacaatcttttggttcgagattctcccaagtttaacccagattcccaaattacttatagtataccggttaccaataccaagcagtcattgttacgttctgcaatattatgtgtcatatcactgcaacgtttgagattattaggtcaaagacattctttttgtgaagaggttatcgagaacctctcttgtgtt

SEQ ID NO: 25758 - DNA, 2286 bp, Schizosaccharomyces pombe
atgcaagtaagaactttgcttacattgggaaaaaaaaaagtaattggaaataggcagtgcattcttagtctttatcgaaaatattctaatgttcaaagtcgcaaagcggaagaccaattgttgcgtcaaatttttgatgatcagaatatagctgtgaaccagataacgaaaagaaatggaattcagggagtaggattgtttcgtaatcacttcctttccgacaaagataccggcttcctaaggctcgcggaaactgcatctgaaaaatgtaaggccgtgattgaggatcttttgctcgaggatactgaagacgggtcaattgtagtcagcaaatttgacaggatttctaacttactatgcagtgtcattgacctttttgagtttgtgcgctgcgcccatcctgacaagatggtggtaatgaaagcagaagaagcttacagttatctatttgagctgatgaacactttaaacactcatcaaggtctttacgaaaaattaaagtgttctttacaacagactcctacgttgaaagatacagatcctgaagcatatactgttggaagagtattcctccaagattttgaaaaatcgggcgtaaatttagagagctcgaaaagaaactcctttgttaaaaagtcctctgaatctgcaactcttggaagagcattttttaataatagcatgaatcgtcctcagcgttatttaactatttctaagcaacgtctggctggttcggacccatattttgtacgctcactctctaagaatgacaaaaactttattatgattccaactgttggatacgaaggtacacaggccttgattagtgtagcaaatcccgacgtcaggaaagaaatttacatggaaggtcataaaggaacagttgaagaagtcgaattgctaaattcctatttgaggtctaaagcggaagttgcgaaactagtgggaaaaagtagttttgcagatttacaacttatagataaaatggctaatgctcctaaacatgttgttgaatttttagagaacttatcattaaaaaattcttccgtgttaaaaaagattttaaacaatctcgcgttaatgaagaaaaaagagttaaacttgaattttcttccatcatttgatgtttgggacagggaatattatactgctcgctataaacaatctcttataaatcaaaagccttctttaaacccttctataacgaattatcggcgttttttttctgttggtacagttattcaaggtctatctagactatttagttctttatatgggcttcgttttgttccagcggacatttcccctggtgaggtatggcatcctgatgtaaataaggtcaatgtttacaatgaaaatgatcatgtaatgggtgtaatttatttcgatctatttgctcgaacaggaaaaacagatggagctgctcattttacaattcgttcttctcgggaattagacttgacaagctttgacgattctataagtcttggatttgatgatgctactaatataagggtcaaggataacaaacggtatcaaatacctgtcatttcgttattgtgtaatttcgtacgttctagtggaatggatcctacctttttagatttgtgggatgtgaaaacactttttcacgagatggggcatgccatgcattccattctaggtcatactaaatatcagaacttagccggaactcgttgtgcaaccgactttgttgaacttccttcaattattatggagttttttatgtcaaatccagccgtattaccgctttatgctcgctacgaaggaactgagattccattacctgtacaagttttgaaccatcataacatggttgaaaatagttcagcacccttagatttacaatctcaaatttgtatggctatggtggatcaattgtttcactcgaaggttgtcttagatccgtcatttaattctatcgatgaagttactaatgtaaccagaaagttcagtgggtttgagtctgctccacctgctgcttggtatcttcagtttagtcatctttatggatatagcgctacttattattcatacatttttgatacggtattggcttcgctaatctttagtaaactttttgctggaaatccattaagccgtgaggctggtgagaaatttcgtaaagccatcctacgatggggtggcagtagaagcccatgggaatgtgttgcagaagcccttgaacaacctatattagcaacgggcggcgaagaggccatgcgtcgaataggaagtgaaggtattaaagcgacgtccaccttt

SEQ ID NO: 25759 - DNA, 1628 bp, Schizosaccharomyces pombe
tctttaaatcctcatcagatttttaacgaaagtggcatccaagagcggggtgaaaatgcccgtctttcatcgtttgtgggtgcaattgctgtgggcgatttggtaaaaagcactttaggtcctaagggaatggtaaggtcaaatctacatagaaaaaatttttaattaacgatttataggacaaaattttacaatcaaactcttcgggtgatattgttgtgacaaatgacggtgctaccattcttaagtctatagctttggataatgcagctgctaaagttttagtgaatatctcaaaagtccaagatgatgaagttggcgacggtactaccagtgtgtgtgtcttcgctgctgaacttcttcgtcaagcagaaattatggtcaatgcaaaaatacatcctcaagtgattatcgatggttatcgtattgctactaaaactgctatcgatgctcttcgtgcttcctctattgataattctagtgatcctgctaaatttcgtagtgacctcgagaatattgccagaactactctgtcttccaaaatcttatctcagaataaaaaccattttgctcagctggctgttgatgcagtgcttcgcttgaaaggtagcacgaacttggataacattcaaattattaagatccttggtggtaaacttgatgactccttccttgatgagggatttattctcaataaaactattggtgttaactgtcccaaagttatggaaaatgctaacattttaattgctaatacggctatggatacggataaagtgaaagtttttggtgctagggttcgtgtagacacaactggcaagcttgccgaacttgaacgcgctgagcgcgagaaaatgaaggctaaagttgaaaaaatcaaaagtcataatattaattgcttcattaaccgtcaactcatttacaattggccagagcagctgttcgctgacgctggtattatgtccattgaacatgcagacttcgatggaattgagcggctgtctttggtcactggtggtgaaattgcttcaacttttgaccatcctgaacttgtcaaattaggtcactgtaagaaaattgaggagatcattatcggtgaagataaaatgatcaagttttctggcgttgaagccggagaagcctgcaccattgttttacgtggtgccactcatcagttactggatgaatctgaacgagccattcatgatgcattagctgttctttcccaaacagtcgctgaatctcgagtcactttaggaggaggttgtgctgaaatgctaatggccaaggcagtggaagaagctgctacccatgagcctggtaagaaggcagttgctgtttctgcttttgcaaaagcattatcacaattaccaactatattggctgataatgctggctttgactctagtgagctagtagctcagttaaaggcagctcattatgatggcaacgatacaatgggtcttgatatggatgaaggagagattgctgatatgagagccaagggtatactcgaggcattgaaattaaaacaagctgtagtttcaagtggatctgaaggtgctcaacttttgttacgcgttgatactatattaaaggctgcaccaagaccccgtgaacgaatgtaa

SEQ ID NO: 25760 - DNA, 1093 bp, Schizosaccharomyces pombe
atgaaatcagtcggtcatttcgttccgtggctcactgatataaggcacctgacggatggcactattagtgaagtgttcgtgggtgaaagaaagaatagcaaaaaactatatgttattaaagttcaaggtttagtatttaaaaggccacctcacgatgccatgagaggcaagcttattttagagtcaataggccatccacacattgaaaggatagtggactctttcatagacaatgaagcaggatccgtttaccttataacgagttttaaatcgtttgttctatcagatgtgatggatgaaatttcaattgatacaaaatgcaagatcgtattgcaaataagtagcgcccttgaatacctagaaaagcatgggattctgcatcgtgatattcatccaaataatatactattggattcaatgaatggccccgcttatctatctgatttcagtattgcttggtccaaacagcatccaggagaagaagtgcaggaactcattccccaagtatgttaaagagagttttatattttgccgaacctgcaagatttctaacgttttttttagattggaactggtcattatagagcaattgaaaccttgttcggctgtcattcttatggtcatgaagtcgatcgttggacatttggcattctgatcgctgaactattttccaatcaagctttgtttgacgatggatcttctgaaggatggcctagtgaattaaggttaacaagcagtattattcaaactttgggtactccaaatccaagcatgtggcctgtaagtttcaaatctttaacattatatctgagcctttgaacaaaaacaaaacattttagactttttttttaaataatagggtttcatgcagattttgctaactgtttttaaggaactttcgactttcccagattggaataaatttatatttcatgaatatccacccaaaccttggtcagaaattttaccatctgttgatacttcaattcagtatatagtttcgcatcttgtcacatactcaaatcgggcttcaccatccttcgtgattgagtcattccctaaagtatctgctaggctttcacaatatgcataa

SEQ ID NO: 25761 - DNA, 672 bp, Schizosaccharomyces pombe
attctgactctttgtttaggttttactagggtttttttggtacttatttcgttgtactttatgtcatggcacccaaattattgtactattgtgtatttatactcaagtttacttgacgcttttgatggttgggcggcgcgcaaattgcatcaagccaccaatttcggtgcaattttggatatggtcacagaccgatgcgccacctcgtgcttgctttgctttttatgtgctgcttatccaaaatatgctataatttttcaactgttagttagcttggaccttgccagccattatatgcatatgtacagcactcttcatcaaggtgcttcctcacacaaaacggtaacaaagaagcataactggatgctgagactttactatggaaacaataaagttttattcatcttttgcgctgctaatgagatgtttttcgttgctctttatttactatcttttaccccacgtactcctcccaaacttggctacttaccagttccttccttcatttattcgactggagagctccctctttcctatccgacccttctagccgttttatgtggtcctatttgccttgccaaacaaattattaacgttgttcagctggtgaatgctgccaatgccttggttaaaatggatgttgagcaaagaagggctgcaaagaagcttcaa

SEQ ID NO: 25762 - DNA, 2316 bp, Schizosaccharomyces pombe
atgaagttctatattgacgatctacctattctgtttccttatccacgcatctatcccgagcagtatcagtatatgtgtgatttgaaacattctttggatgcgggaggcattgcgctcttagaaatgccttcgggtactggaaagaccatttctcttttgtcccttattgtttcatatcaacaacattatcctgagcatcgcaagctcatctattgttcacgtaccatgtcggaaattgataaagcattagctgaattgaagcgtttaatggcgtatcggacttcacagttaggatatgaagaaccatttttgggtctcggactaaccagtcgcaaaaatttatgtttacacccttctgttcgtcgtgaaaaaaatgggaatgtggtagatgcccgttgtcgctcacttacggcgggttttgtgcgggagcaaagattggctggtatggatgttcctacttgtgagttccacgacaatttggaagatcttgagccacacagccttatatctaacggtgtttggacccttgatgatatcacagaatacggcgaaaaaactacacgatgcccctattttactgtacgtcgtatgctaccgttttgtaatgttattatttattcgtatcattatttactagaccccaaaattgctgaacgagtttctcgagaactcagtaaagattgcattgttgtttttgatgaagcacacaatattgacaatgtgtgtattgagtctttaagtattgatttgacagaatcttctttgagaaaagcttcgaagagcattttgtctcttgagcaaaaagtcaacgaagtaaaacagtctgactcaaaaaaacttcaggatgaataccaaaagcttgttcggggccttcaagatgctaatgccgcaaatgacgaagaccagtttatggcgaatcccgttttgcctgaggatgttttaaaggaagctgttcctggaaatattcgacgagccgaacattttattgcatttttgaagcgttttgtagaatatttaaaaacaaggatgaaagttttgcacgttattgctgaaacaccaacttcttttttgcaacatgttaaagacattacatttatagacaaaaagccgcttcggttttgcgctgagcgactcactagtcttgttcgtgccttacaaatttcactagttgaagattttcattctttgcagcaagtagtagcttttgcgacccttgttgctacttatgagcgtggatttatcctaattttggaaccctttgaaacagaaaatgctacagttcccaatccaatattgcggttttcctgtcttgacgcctcaatagctattaaaccagttttcgaaagatttaggtctgtgattatcacgagtggtactttatcccccctcgatatgtaccccaagatgttgcagtttaatactgttatgcaggaatcgtatggaatgtcacttgcacgaaactgtttccttcctatggtagttactcggggtagcgatcaagtagctatttcttcaaaatttgaagcccgtaatgatcctagtgttgttcgcaattacggtaatatactggttgagttttcgaaaattacacctgatggcttagtcgcattttttccaagttatctctaccttgaaagtattgtttctagttggcaaagtatgggtattctagatgaagtctggaagtataagttgattttggtggaaacaccagatcctcatgaaacaactctcgccttagagacttaccgggctgcttgcagcaatggccgtggagcagtattgctgtcagtcgctagaggaaaagtctcagaaggagtggattttgatcatcattatggtagagcagtaatcatgtttggtattccgtatcagtatactgagagtcgtgttttaaaagcacggttagaatttctgagggatacgtatcaaattcgggaagcagatttcttaacatttgatgccatgcggcatgctgcccaatgtttaggtcgcgttttgcgtggaaaagatgatcatggaattatggtgttagcagataaacgatatggtcggtctgataagcgtacaaaattacctaaatggattcaacagtatataaccgaaggcgctacaaatttaagcactgatatgtccctcgctttggcgaaaaaatttttacgaactatggcacagcctttcactgcgtctgatcaggaagggatttcttggtggagtcttgatgatttgttgattcatcagaagaaagcattgaagtctgcggctatagaacaatccaaacatgaggatgagatggatattgatgtggttgaaact

SEQ ID NO: 25763 - DNA, 1020 bp, Schizosaccharomyces pombe
atgtttaaacgacgtcgaaatccaaaaggtcttgtgttgaatcctaacgcctctgttaaaagctctgataatgatcataaggaagagttaattaacaatcaaaaaagctttgaatccaatgtcgaagcatttatggagcaatgtgcgcatatgaatcgacgcccagcttggatatctgatttggacaatagcagtttggaagtagtgaggcatttgggagagggaaatggtggggctgtttcattggtaaagcatagaaatatttttatggctaggaaaacagtttatgttgggtcagactctaaacttcagaagcagattttgcgagagttaggtgttctacaccactgtcgttcaccctacatagtcggtttttatggagcttttcagtataaaaacaacatttcattatgtatggaatacatggattgcggatcgcttgatgcaattcttcgggagggaggtcctattccgttagatattctaggaaaaattataaattctatggtgaagggtctcatttatttatacaacgttttacatatcattcacagggatttaaagcctagcaacgttgtcgtcaactctcgtggtgaaataaagttatgcgattttggagtttcaggtgaactagttaactcggttgctcaaacgtttgtggggacttcaacttatatgtctcctgaacgaattagaggtggaaaatatacagtcaaaagtgatatttggtctctaggaatcagcattattgaacttgccacccaagaattaccttggtcgttttcgaatatcgatgattcaatagggatcctagatttgcttcattgtattgttcaagaagaaccacctagacttccatcttcgtttcctgaagacctcagacttttcgttgatgcctgtttacataaagaccctacacttcgcgcctctccacaacaactctgtgcgatgccatattttcaacaggctcttatgattaatgttgaccttgcttcttgggcctccaactttagatcctcg

SEQ ID NO: 25764 - DNA, 3064 bp, Schizosaccharomyces pombe
atgaaacgaagagctacttttcaatgtccattaattgaatctaccataaaacatcaatctactaattataccaaaacagaaacagcaactacctcacacgaagtatctgaaaatgcaaatgaacataaaggaaaatcaaatatcgacataaacaaaattgcttattacaatgttgtatggtatggtagcacaatctcttttttgacttcatgactaaacgcgtcaggagaaaaattactatgaagaaacataaaacatgggaaggggatggctttctcgttagagaagactcaaatttgactctttataattcagattttacaaggtattcctacatgtcgaacttactaaaaatgaagtcgcaaacaatatagcatcttttattgagagatattttttattaatatatgttaaagactcggatcctgtcattcgagggtgccacaaatcaaagaaggagaattgcttcgcatttccgggaaagaaatatctgtaagatatacatgtaagcgaatgtttctcatcatctttagattgagaaggaaatctctgcagaaagttatgaagcaggcacacatatagatgattctctccgagacgttcatatgcctgaaatgaagcgtaaattcaagccacctttgagacctaacacaatgtaccagacaatatcagcactacccaaaccgaggcatgatcctactgtgcttggagctttggtgatgagcaggcccaagacttgggatccaaggtatggtaaaagtgaatgcttgatctaacattacaggacgcatgtagatgttgttattgatcctttcctttcaaagcatctttattctcatcagcgggaaggagtttcctttctttacgactgtttattaggaatggaaggaaaatgtggatatagtgcaattttggctgatgaaatgggcttaggaaaaacgttgcaaactataacagttgtctggactttattgagtatgagacttagggttttttttaactttcattctctaatcttattatttagagcagtcttattacgccaatcgttcttcgactataaacaatgcaatggtcgtagcacctgtcactcttttgaaggtaagaagtttcaaaacttcattactaatggctagaattgggaaaatgagttttataattggctcggtcacgagcgtattcatgtttatatagctagatgcgctgaagatttccaagaatttacgtcgaacaaaacttattcgattatcattacaggatatgaaacggtaattcctttatttattcttttttctaattgctaaaggtttgtacgtacttgagaaactatggatgcgggattgatattgatcttctaatttgcgacgaaggtattgatttgttcataaatagtttattaatcttagctcaccgcttgaagtccatgagtagtcagacttggattacgctgaataagctaaaaactagaaagaggcttcttctcactggtacgcctttacaaaacggtatgaatcagtgaatgctatttaattttaaccgctcagatttgtcagaatatttctctatggttaactttataattcctggatctctggggaccccaaattcttttaaagctcagtatgagcggcctatattaaggagtagatcaatgaatgcttcctctagggacatatcattgggagctgcaagacttcaaagggtttgtttactaaagataaattttatactgatttttagctttttgaatttacaagcaatttcacgttaaggaggaaagccaatatactggctaaacatttaccgccaagaagtatgcaaatattaaaatcagtattaacataatagccgacattgttttattcataaaaccaacacatcaacaagagaatgtttatggacatgttctcgatggtttcaagtcaagcgttgatcagaagggctattatcttaaaattttgactcgcttgagcaagatatgcaatagcaccattttattgagaaatgaaaaggaaaattttttgtcaacggagttgcaagataagcatgtattcgagcaagagaatatgttgctctcctctagcaaactgcaaatattggctgcgctacttaaaagtttccaaaggggttgccaaaaagctgttattgtgtcccaatataaagaaactctcgagttgattgaattgtttttatcaattttgcatgtccgtttctgtaaattgcttggaagtactcctttctctgagcgtgatttaatagtacacaatttcaatacttccagcttcaaagaatttagtgtgcttttactttcaagcaaagctggtggctgcggtttaaatcttaccggatccactaggttaataatttacgaaccaagttggaaccctgcccaagatttgcaagcattgtcaaggatatatagaagcgggcaaaagcggccagtctgtatatacacatttttaaggtacgaccgcttttacgaataacatattaagttatgcagcagtggaatgctagatgagcgcatttttattcgccaaaatactaagcaagggctttcaagttcgttcatagtatgtgatttattataaaattttatactgacttgattgtaggattccgatgcaagccaaaagaagaatttttttacgggtgaagacatcaagacacttttttcatattcaaaaactgaaacttgcttgacatatgaattagcatttgattctgatgaaattgattcattaacaaagaaaaaagatccgttaactaaaattgaccatacgattgattccccaaatacgaaggaaaaagataaagaaatcagttcttggaaaaaggcttctgaatatatggatactaatttggtaagttgtattttcatcctaatattaatggccaggggaaaaagtgtccagagaacgcatttcaaggatggacttggcaatttccgaatgacctaagtattatgaatggcgtagaagattatatccctcttgagcctttacctatcaactgtctaatgcataaaaagttcgaatagatctatttcggacttttaaggagg

SEQ ID NO: 25765 - DNA, 736 bp, Schizosaccharomyces pombe
atgggattattgactattttgagacagcaaaagctaaaggaacgagaagtcagggttttgttactgtaagatgattcaaatatatacagagtgaaatctaatgactttagggggttggataatgcaggtaaaacgacaattttgaagtgcctgttgaacgaggatgtaagtatcttttaaggctccataatttatcgattgataggtaaatgaagtttcgcctacctttggctttcaaattcgaacgcttgaagtagaaggactccgattcacgatatgtacgtagcttgcaattttcgaaatgaacagtcttaagcttactaattcaaggggacattggggggcagaaaacgctaagaaatttttggaaaaattactttgaatcaaccgaagcaattatttgggttgttgacagcttggatgatttacgtttagaagaatgcagaaatacattacaagaattgttggtagaagaggtaggctgaaaatgtgaattatcttaacatgcatatagaaacttttgtttacttcaattttggttctcgctaataagtctgacgtttccggcgcactttcatccgaagaaattagcaaagtcagtttacaatttatgaatccaagctaacaacaagtcaagatattaaatatttctaaatataaatcatcgcattggcggattttttcggtttcagcattaacgggccttaatatcaaagacgcgataagctggcttgct

SEQ ID NO: 25766 - DNA, 3201 bp, Schizosaccharomyces pombe
atgattacacgtttatcgggcgcttgcttgaggcgatcaggtgctaaaagaaattggcctcgtgaacatttggttcatcggtctttgcttgctagtttttccactacacagagggttttaaaatgctcagtcggaccttttcgtacttcaaatgttgttttcaaaagtaaagaaccaaaagataacaaaccactggataacaaaaacgatcccaaaaagacacataatgaagatgagtcacataccaacgaatctttgccatctacggataaaaagaaaaaaaaggataatgacgattttaagcaaaatttgaaatcttcttcaaataagactgaggaaaagtattctgctacacaagcttctaagtctaaaaatgacgaatttgaattaggtggtgaagaaaatgaggatgaaatgcctttaaatggggaatttaataaaaatgttccggccaaatattcggttcctgatgtgtatcctcaattacttgcgttacccattgcgcgacgacctcttttccctggtttttataaagccatagttaccaaaaatccctctgtttcagaggccattaaagaactgattaaaaagagacaaccttatatcggcgcgtttttgttgaaggatgaaaacactgataccgatgttataacgaacattgatcaggtttacccggtcggtgttttcgctcaaatcaccagtatttttccagcaaaaagtggtagtgaacctgcattgactgctgttttataccctcaccgtaggatacgaataactgaactgatacctccaaaagaggatgctgatagcgctgcttcttcagacgcagcagaacttgaaaccgataaaagctctaatctttcttccaatggagaagttaagtctgatctcaaacaagacaatgggaaagaggaacctgaaaaggaagttgaaagcacaccctcaattcttcaaaactttaaagtctctcttgttaatgtcgaaaacgttcctaatgaaccttttaaacgacaggatcctgtaattaaggcggtaacgtctgagattatgaatgttttcaaagatattgcaaacgttagtcccctctttcgtgaacaaattgccaatttttcaatatcgcaaacgtctggcaatgtttttgatgaacctgctaaattggcagattttgctgccgctgtttcggctgcagatcatcgcgaattacaggaggttttagaagctacaaatataggagatcgtttgcaaaaggctttgtatgtactaaaaaaggaactattgaatgcccaacttcagcataaaattaacaaggaaattgagcagaagataactcaacgccataaagaatatcttttaaccgaacagctaaagcaaattaaaagagaacttggacaagaacttgatagcaaagaagcattagtaactgagttcaagaaacgaactgaaagcttgagtatgcctgatcacgtgaaaaaggttttcaatgatgaactgtccaaatttcagcatttagaaccaatggctgctgaatttaacattactcgtaattatttggactggataacccaacttccttggggaaagaggtctgttgaaaatttcgatttagatcatgcaaaggaagtccttgatcgagatcattatgggcttaaagatgttaaggatcgtgttcttgagttagtagctgtaggtaagctaagaggaactatgcaaggaaagattatgtgtttagttggtccgccaggtgtcggtaagacttctgttggaaaatctattgcatctgccttaaacagggaattctttcgcttcagtgtgggcggtctgactgatgtcgctgaaatcaaaggacatcgtcgtacctatatcggagcaatgcctggaaaaattgtgcaagctttgaaaaaggtgcaaactgagaaccctttgattcttattgatgaaatagacaaagtgggcaaaagtcatcaaggggatcctgcgagtgcacttttagagcttttagattcagaacagaactcagctttcctagattactatatggatattccactcgatgtttcatctgttttatttgtctgcacggcgaacaccattgatactattcctccacctttgttggatcgtatggaggttattgaactatctggatatgtttcagctgaaaaagttaacattgctaaaggttatcttataccccaagccaaagctgcttgtggtttaaaggatgctaatgtgaatatcagtgatgacgctattaagggtttaattagttactatgctcatgaaagcggtgtacgaaatttgaaaaaatctattgagaaaatatttcgtaaaacatcttttagtattgttaaagaaattgacgatgaattaaattctaaagagaagtctacgggtaagtcgggaaagaaaacatctcctcaatcatcagaagatgcagcaaacaaagaagcatcatctgttccgttaaaagttcccgataaagttaatatcgagattgaagaaaaggacttgactaaatatttgggtccccccatttatacttctcagcgactttatgacactactcctcctggtgttgtcatgggacttggttggacacccatgggaggtgtttcgatgtatgtagaaactattgttaaaaacattttatcatccaattctactccctctttggaaaggacggggcaactgggagatgtgatgaaagagtcatctgaaatttcgtattccttttcaaaaagctttttgtctaagcattttccaaataataaattttttgaacatgcgcgtttgcatatgcattgtcccgaaggctccatttctaaggatggcccatcagcaggtatcacaatggctacatctttactttctttagcattggatactccggtaccagcgactactgccatgactggtgagctaaccttgaccggtaaaattttacgcattggtggcttacgagaaaagacggttgctgccaaattatctggtatgaaagaaatactatttccaaaaagtaacttagccgattgggaacaacttcctgattatgttaaagaaggtttaactggtgtccctgttgcatggtatgatgatgtttttaaacgggttttttcaaacattgatgccgaaaaatgcaacaatctttggccaaatttaataaagtcatcctccaagcagcatcaaatttcacccagtcat

SEQ ID NO: 25767 - DNA, 1443 bp, Schizosaccharomyces pombe
atggatgcgttgaaacttttgacaactaatgtcaaatttaagaataaagtacctcaaccttctataaaagaaaaagaagcaaaaaaattacaaggtattactaagggaaaagctaaagttactggtaataatcctgttgatccaattgaagagtttccggaaggaatactttgtgaaaacttaaaaaaacaaaacataacagaatgtaccacaattcaaagatatgccattccaacgataggttctaaacgagacctattggcatgtgcaccaactggttctggaaaaactattgcatatctattcccaattttgcaaaaacttcagttacatgttccgggtggatatagagcgattatcgtagcgccgactagagaactgtgcgagcaaatatatagacaggcagaaaagctgtcttttggaacttcattgaagataattgaattaagtaaatctaatgaaaaaattcaagaaaaagcgcccaagctccgggaaaagtatgacatgtgcataggcaccccgatgagattagtacaagcaatacaaaccggattgtcctttgaaaaagtagaattctttgttatggatgaagctgatagactttttgagcctggctttattgaacaaactgatcatattctaagtgcatgcaccagctctaatatttgtaaaagccttttttccgctactattccatcacgcgtcgaagagttagctaaagtcgtaacggttgatccgattcgaatcatcgttggtttgaaagatgcagccacggatagcatcgatcagagactcttgtttgttggttcggatacttccaaaattgtgattttgcgtcaaatgatttcaaatggagagttaaagcctcgagtcgtaatatttgttcaagatatagaaagagcgaaagcattgtacacagaactcttatttgatgaaattcacgttggtgtcattcatggagaattaccacaagccaagcgcgaagaagcacttgcgaaatttcggaagggtgaaatttgggttttaatagcaacagatcttcttgctcgtggtatcgattttcatggtgtaaagatggtcatcaactttgactttcctcaaagtgttcatagttatattcatcgtatcggtcgaactgggcgtgcaggaaatacaggacaggccgttactttttttacaaaggaagatggtgaatatatcaagcttattgctggtgtaatgcgttcatcaggttgcgaggttccaaactgggttatggcacttcctaaacctagtaaagaaatgaaaaagaagttgaagaagagtcctcctaaaagaaagaggattactactagagcttcttacgacagacaaaaggaacagcgtaagaaggagtatattaagaaggtaaaaaaagaagcctctatcaaaaagcataatgaagctactggagacagtggacaa

SEQ ID NO: 25768 - DNA, 2138 bp, Schizosaccharomyces pombe
atggctccacgttcttccgcagtacatgttgccgtttattctggggttgaagtctatgaatgctttattaaaggtgtctctgtgatgcgcagacgccgcgattcctggttgaatgctacacaaatcttgaaagtggctgactttgacaaaccacaaaggacaagggttttagaaagacaagtacagattggtgcgcatgaaaaagtacaaggtggatatggaaaatatcagggtaagttgtctactgttacgcgttgtgacatgatttgctatctttgaacaacgcgaacaattgagtgtttactaagccaaatcgaggtattttaatacctttttgtattaaatatctctatggacgcgtcctctaaatgattgacggtattaaccaaactataggaacttgggttccatttcagcgtggggtcgacctggccacaaagtataaggttgacggaataatgagcccaatattgagtcttgacattgatgagggaaaagcaattgctccaaagaagaagcagaccaagcagaaaaagccttctgtacgtggccgtagaggccgtaaaccgtcgtcactttctagtagcactttgcattccgtcaatgaaaaacaaccgaattcttctatatcaccaacaattgagtcatctatgaataaagtgaatttgcctggtgcagaggagcaagtttctgcaacacctctgccagcgtctcctaatgcactgctatcaccaaatgataacactataaaacctgttgaagagttaggcatgttggaggcaccgcttgacaaatatgaagagtcactacttgacttctttcttcacccagaagagggacgcattccttccttcctgtattcgccgcccccggattttcaagttaacagtgttattgatgatgatggccacacttctcttcattgggcatgctcaatgggacatatagagatgattaagttattactgagagccaatgctgacattggcgtgtgtaacagactgagtcaaacaccattgatgaggagtgttatctttaccaataattatgactgccaaacttttggacaagtgcttgagcttctccagtctactatttatgctgttgacaccaatggtcagtcaatttttcatcatattgtgcaatcaacctcaactccttcaaaagttgcagcggccaaatactatttggattgcatattagagaaactaatatcgattcaaccatttgaaaatgttgtgagattggtaaatctacaagattcaaatggagatacctctctattaattgctgctcgaaatggagccatggattgtgtaaactctttattaagttataacgccaatccttctattcctaaccgacaaagacgtacagcttccgagtatcttttggaagctgacaaaaagccacattcattgttacagtcaaactcaaatgcttcgcatagtgctttttcattttccggaataagccctgctattatctcgccatcatgctcatcgcatgcttttgttaaggcaattccttcaatatcttcgaaattttctcaattagcagaggagtatgaatctcagcttcgagaaaaagaagaagatttgattagagcgaatcgtctcaagcaagacacgcttaatgaaatttccagaacttatcaggaattgacctttctgcagaaaaataaccccacttatagtcaatctatggaaaacttgattcgagaggcccaagaaacttaccagcagctttcgaagaggttactaatatggttggaagcacgacaaatctttgatttagagagaagcctcaagccacatacttcattatctattagttttccttccgactttttaaaaaaggaagacggactttcgttaaataacgattttaaaaagccggcttgcaacaacgtgaccaattctgatgaatatgagcaattaattaataagttaacttctctccaagcttcccgcaaaaaagatactttgtatattagaaaattgtatgaagaactaggaattgatgatacagttaatagttaccgtcgtcttattgcaatgagttgtggcatcaaccctgaagatttgagtttggaaatactcgatgctgtggaagaagcattaacccgagaaaaatga

SEQ ID NO: 25769 - DNA, 1929 bp, Schizosaccharomyces pombe
ctttagcaatttttgcacatgtatgatacttatatatctaaaaagcaagatgttctactttggggggacgaaattgaatgtatagttgtgtctatggatgataagagtaaaaaggcgcgagtgagtctccgtcaggaagatattttgaacgccctcggtaaatatgaggagacatttaggcatgtagattttggacctgtatatgccgctttgaggaatgaaacctgcccaaagaaaatagacgccattttatctgaagtggctaaaaacccggctgattatgtcgaacgcataggaggaaattcaaacaaagatactatagaaattacgagttccaccaaaccacatgcgcagaacgcggtccctactttccatccagaatatggtcgttatatgttggaaagtacaccaggtgcgccttatggttccactttaaaggattttacttttgtagagtacaatatgcgattaagaagaaaaattattgaaaaccatttactacccaatgagctacctttaacaattactaatttctttcgtcttggaacaccaggctttacggatccagaagtcgaagccaatggtgcaatttcgcgatcttttttcttaccggacgatgttatcaacacacatgttcgtttcccgaccttgactgctaatattcgtcaaaggcgcgggagaaaagtggccatgaatgttccgattttcttcgataaaaatacaattaaaccatttcacgatcctaccgttccttgggatagaaatttgtttcctgaagatgcaaatgcacgagatggtgcagcgttagacaatcatatttacatggacagtatgggtttcggtatgggatgctgttgtctacaaattacattccaagctaaaagttgtgatgaagctagacttttatacgatcagttgactcctattacccccttgatgctggcattatctgccggaactccagcatttcgaggctatttggctgatcaagattgtagatggaatgtgattgctggtgctgtcgatgatcgaaccgaggaagaaatgaaaactgtgccaaaatcaaggtatgattctgttgacttatatatctcgaatgacaagcgcaatttaccggaatataatgacgtcccggtcgttataaatcaagattgctacgataagctaataaaagattgcattgatgaaagattggctaagcacatggctcacatattctctcgtgatcctttggttattttcagtgacagcattttacaagacaacagtgtatccaatgctcattttgagaacctaaactcaactaactggcaatctatgcgctttaaacctcctccaccaggtagtgatattggttggcgtgtagaatttagatcaatggaaattcaaataactgattttgaaaatgcggcatattcaatttttgttgtgatgctttctcgtgcaattctatccttcaatttgaatctgtacatgccgatatcgctagtggatgaaaacatgaaagctgctcatgctcgtgatgccattcatcgtaaaaagttttggttccgttgcaatccatttcctgacgcaagtactgatgatgaatctggtcagttccgtcaacttacaattgacgagttatttaatggtgagcaccgtgaaaacggattcccaggtttaattaccattgttcgaagctatttatactcttgtaatcctgatgccaaaactatttgcctaattgaacgttatattcgcctaatttctcaaagagcaaatggccaatgcttgactgctgcttcgtggatacgcaatttcattacaactcatccttcttataagcaagacagcgtggtcaacgacgaaattaattatgatttaattagaagaatagcaaaaattgtagatggcgactacgacgatacgttacttggaaaatgctca

SEQ ID NO: 25770 - DNA, 1521 bp, Schizosaccharomyces pombe
atgctgtctttatttttgaaatctctttttgctattataataattgaattgactatcattcacgctttaccaacttacactgtacattggaaatgcagtatacaacaagccaacacgagttctgcttcctcgaatcagactgttcaacctagacaacacgctgctccttcttcggatcgaattaaatcacttcctgaatttaagggatcattaccggaattatattctggatacttggaagcgaattccgataaatcacttttttatacatatgcccctgctgttgttgattcggaaactttcatagtatggcttcaaggaggacctggatgcgctggaacattaggctttttcagtgaaaatggacccattgaaatatcccaaagtagcccctcaccatcccttaatcctgaatcttggacaaacttcgccaacatgttatggttagatcagccatttggtacggggtactcccaaggacaggcggcatatacaactacgattgaagaagcttcttcagattttgtaaatgccctgaaatcattttaccaaaagtttccccacttaatgaagaaaaagctctaccttgtcggcgaaagctacggtagcatatggagcgccaattttgcagaggcattactttctgaaccatctttgaatataaattttatgggcgtgggaatcgtcagtggacttacggcggactacgaaactcaagaacaaattactgcttctatttgggtggaacatatcagcaaacttggatactattttaataatacttcttccacaatatctgaagagtttaaaaagcgcaataaagaatgtcaatatgattcagttttgaacagattgacgtttcctactgaacaatacccaatatggagaccagagtacaactttagcacatctacttctctaaggaagcgggaagctctcgatggtgaagacattgggaatgtatttaattcaatttctggatgtgacttgtattccctttctaactttttactttatctagagaacagctgtgtcataacttatgatgttagccttgattgtagtttcaatgagtataatgatcccttaatcacatacctgaacagagaagatgttcgctcttctttacatgctacgaaagcttcaactgcgttgacaagcggcgagggtgtcttcgcagacggatgcaattttgacttatacaaaaagattgtgagtaacaacgtagaatcagttctcgttgaaataattccacgcttaacagaaaaatacaaagtgtctttcttagctggggcattggatcttcaaattctttggaccggaactcttttggcattgcaaaatacaacatggaatggatggcagggattcactcaatctcctggaagtttagagacaactaatggatttactttggatgaacgtaacttagcctttacattgtccaactcggttgggcacatggctccatctaaagaccctcaaatggttagagaatggcttgaaaatacgttgctttat

SEQ ID NO: 25771 - DNA, 6732 bp, Schizosaccharomyces pombe
atgtccggattgctaccttcattgtcttcatcatttccactcgtccagagtgaagctctggggatgccaaggactcatggtcctaaaccatctgaaaatgatcctaaagagcccacctgctctccatctcctgccttctactctgtgaatggcgagatgaaagattataagctaatggccttggaattggaagataaaagtgttttacaaggttattcattcggagctgatcactctgtctccggtgaattagtttttcagactggtatggtcggttatcctgagtctttgaccgacccttcttatcgtggtcagattttggtctttacatttcccacagtgggtaattatggtgtgcccgatcgtcgtattctagacgagatatctggcttacccaagtatttcgaatccaatcaaattcatgttgctgctattattatttcatcttattctcaaaattattctcattttcttgctcattcttctttaggagaatggcttaaggaacagggcattcctggtatttttggtattgatacccgtgctcttactaaaaaaattcgcgaccaaggttctatgttaggtcgtttacttattcaaaaagacgaatcccccatcaatccttcttcaattactggtctcggaaaagactggagtactgcttttgaagatataccatggaaaaatcctaatactgaaaatttaacgtctcaagtttccattaaagaacccaaactttatgaaccccatcctactacagctatcaaaaaagcagatggaaaaatcatccgtatccttgttattgatgttggtatgaaatataaccaaattcgttgttttttgaatcgtggtgttgaattattggttgttccttgggattatgattttaccaaagagacttatgatggtctatttattagcaatggacctggtgatccttccctcatggacttggttgttgatcgggtaaaacgggtgcttgagtcaaagactgtccccgttttcggtatttgttttggacatcaaattatggctcgagctgccggcgccagtaccaccaaaatgaaatttggtaaccgtggccacaatatcccttgcacttgcatgatctcgggtagatgttacattacttcccaaaatcatggttatgcggttgatgcgtctagtttatcaaatggctggaaagaactttttgtcaatgctaacgatggttcaaatgaaggtatctataatactgagtatccatttttctctgtgcaatttcacccagagtctactcctggtccccgcgatactgaatttctctttgatgtattcattgacgttgtcaagcgttcagctgatgcaaagtctttgcagccattcaagcttcctggaggaacaattgaagaaaacagatcccgtcatccacttgtggatgctaagcgtgttctgattttgggtagtggaggattgagtattggtcaagctggtgagtttgattattctggtagtcaagctattaaggctcttcgtgaagaaggaatttacaccattttgattaatcccaacattgccactattcagacatctaagggtcttgctgataaagtgtacttcttacctgttaatgctgactttgttcgtaaggtgatcaaacaagagcgccccgattcgatatatgttacctttggtggtcaaacagccctgaatgttggtattgagctgaaagatgagttcgaacaactcggcgttaaagttttaggtacgcctattgataccattattaccactgaggaccgtgaactttttgctcgtgcaatggatgaaattaacgagaaatgtgcaaaatcagctagtgcttcatctattgaagaagctataaaagtatcgaaggatatttcttttccagttattgtccgtgctgcttatgcgcttggtggacttggttcaggttttgctgataacgaggcggaactcattgatttatgtacgcttgcttttgctaccagccctcaagtcttgattgaacgcagtatgaagggatggaaagaaattgagtacgaagttgttcgcgatgcttttgataactgcattaccgtctgtaacatggaaaactttgatcctctcggtattcacactggtgactctattgttgttgctccatctcaaactttaaccgatgaagattacaacatgcttcgtacgacagctgttaatgttattcgtcacctcggtgtggtgggtgaatgcaatattcagtatgctttgaacccttttacaaaagagtattgcatcattgaagttaatgctcgtttgtctcgttcatctgctttagcgtcaaaggctaccggttatcctctagctttcacagcagcaaaactaggtcttaacattccacttaacgaagtcaaaaactcagtgacaaaggttacgtgcgcatgctttgaaccaagtcttgattatgttgtcgtgaagattccccgttgggacttgaagaagtttactcgcgttagcactcagctgagctcagcaatgaagtcagttggtgaagtgatgagtattggacgtacatttgaggaagcaatccaaaaggccatcagggctatcgattatagcaatactggtttcaacgttaaggatgctttaatgtctatagatacggaattgcaaacaccttcggaccaacgtctgtttgctattgccaacgctatggcttctggttattcagtggaccgtatttgggagcttactcgtatcgataagtggtttcttgaaaagcttatgggattaattcgtacatcccaattgatttccaagcatgatatatctagtcttcctatttctcttctaaagactgccaagcaattaggatttgcggacgtccaaattgctgcttttatgaattctactgaattagccgttagacgtatccgtactgaagctggtatcagaccatttgtaaaacaaattgatacagtggctgcggagttcccagctttcaccaactacctttataccacttataatgctgtagagcatgacatccatttcaatgataagggtgtgatggttcttggctcaggtgtatatcgaattggctcatcagttgagtttgactggtgcgcagttcgcgcagttcgtacgcttcgtgatcggggagttaaaactattatggttaattataacccagaaactgtttctactgattatgatgaagccgatagattgtatttcgaaaatatcggtcttgaaactgtcttggatatttacgagcaagaatcatcttctggtatcattatagctatgggtggtcaaaccgctaataacatagccttgccattacatcgtgaaaatgttaaaattctcggtacttctcctgaaatgattgatggcgccgagaatagatttaaattctctagaatgctggatgacataggtgttgatcagcctaagtggaaggaattaactagtttcgacgaggccgataaattttgcgatacagttggttatcctgtgttagttcgtccttcttatgttctttctggtgccgcaatgaatacagtctattctcagtcagacctgcatagctatttgcaacaagctgttgcaattaacaaagatcatcctgttgttatttctaaatatattgaaaatgctaaggaaatcgaattagatgctgttgctcgtgaaggaaagatggttatgcacgtcatttccgaacatgtagaaaacgctggtgtgcactctggtgacgctactttggttttaccacctcaagatttggctccaacgactatagaaagaattgttgacgccgctgctaagattggagaagctttgaatattactggtccttataacattcaatttattgcgaaggacaacgaaattaaagtaattgaatgcaatgttcgtgcatcgcgttcattcccttttgtttctaaggttataggtgttgatatgatttcaatggcgacagatgtcattatgggtaatcctattcaaccctaccccgatgttgatcttcctcgcgattacgttgctgtcaaagtacctcaattcagtttcagcagactgtccggtgctgaccccgtccttggtgtcgaaatggcgtctactggtgaagttgcttgttttggtcacaataaatttgaagcctatcttaaagctatgatttccaccggctttagactcccgaaaaagaatattcttatatctattggttcatataaagaaaaggcggagcttttaccttacgtcaagaagttgtatgaaaacaattacaacattttcgcaacagccggtacctcagactactttatggaaagtggtgttccttgcaagtaccttgcagatcttcctgctgaagaagcaaataatgagtattcactttccgctcatttagccaacaacatgattgacatgtatatcaatttgccctccaacaatcgttatcgtcgtcctgctaattatattagcagtggttataaaagtcgtcgtcttgccattgattattcagtccctttggttacaaatgtcaaatgtgcaaagcttatgattgaggcaatttgcagaaacttggatttcagcttgagtacagtagatttccagagcagtttccaaactgctaatctaccaggtttgattaacatatctgctttccttcctgaatttacttctgaagccgtttctgactatacaaaagaatgtattgcatctggttttactatggctcgatttttaccatttagtacgtcttctactttagcagacaaggattcgttgtctgctgttaaaaagttagctttagaccatgctcattgcgattacaacttttcagtcattgcctcctcaactaatgaagttactatctctgaactcacatctgaatctggctgtttgtttttccattttgagaaagacgattctggtatcgatcatgttactgcagttgcctctcattttaacgtatggcctgatacgcagactgtgatgacagatgccaaatcgacaactttagcttcgttattgttattggcaagtcttcataaccgtaggattcatattacaaatgtatcttctaaggacgatttgaatttgattgtacttgctaagcaaagaagtcttcctgtcacatttgatgtttcagtttatagtcttttcttgaaccaaaatgattatcccggagcgacatttttacctactgctgatgatcaggttgagatatggaataagctctcatacattgattgtttttctattggtagtattccttctcgtcttgctaagttcgtgggtaatacggcttttactggctttggagttcgcgaggcaattccacttttgttaacagctgttaatgaaggtagacttactttaaaggatgttgttgatcgcttctattcgaaccctaaagccattttccgtttgcatgatcaagacgattctggcgttcaattggaagttgatcgttctgttagctggtcttccaaagactggacccctttcaatggcaagaaactttatggtagcatccaatctgttcagtttgacggtcatgatgtattctttgatggtgaactgaatttcgaacatacttatggtcgtgactattcttcggctagtttggctgacaaatctaaggcaactagaaaggttagtgcgttgatgagtcctggtcttccccatgctgccccttctcttgccgaagcattcggtcaagcaccagagaacaaagcgcatcctgatattagcttgaacatgactcctaatttcaagccttctcatgaactggtacaattgatcaactcttcgcccttctatcgcaagcatatcatttcggtgcaccaagttactcgttctgatttgcatgtactatttgctattgctcatcaaatgagaatcatagttgaaagacaaggtgtgattgacttgtgctatggaaaacttctttgtactatgttctttgaaccatcaactcgtacttcatcgtcttttgatgctgcaatgcaacgtttaggaggaaaagtagtcgctgttacagctagtgcttctagtgtcaataaaggtgagagcttggctgataccattcgtacacttggatgttatggtgatgctattgtcttgcgccatccttcaattgaaagcgcacgcattgctgctaacttttctcccgttcctatcatcaatggtggtaatggctcgaaggagcatcccacacaagctttcttggatctttataccattcgtgaagagttaggtagtgtcaatggacttacaattacgtttattggtgatcttaaatacggacgtaccgttcattcattagctcgtttgcttgcgttttggcatgtcgaattgcatcttgtatcacctgaacaattggcacttcctgacgacgtgaaagacgatattcgtgcgaatggattgaatttcattgagcaccgtgagttgactaaagaagttgttgcacaatctgatgtactttactgtaccagagtacagaaagaacgttttgctagtgttgatgaatatgagaaattaaaggattcttttatcgttgacaacagtgttctagcctctgccaaatcccactgtatcgttatgcatcctttgcctcgtaatcgtgaaatcagtgaagaggttgattttgatcaaagacgtgctgcttacttccgacaaatgcgttatggtctctatattcgtatggctttactcgcttgtgttatgggtgctactgaagtagcaaat

SEQ ID NO: 25772 - DNA, 1698 bp, Schizosaccharomyces pombe
atgaatgaacttcatgatggtgagagctctgaggaaggaaggatcaatgttgaagatcacctagaagaagctaagaaagatgacacaggacactggaaacattccggcactgccaagccatccaagtttcgagccttcataaggctgcattttaaggatagcagaaagtttgctttttctcgaaagaaggaaaaagaattgacgtcggaagatagcgatgctgcaaatcaatcaccttctggtgcacctgagtcgcagaccgaggaagagtctgatcgcaaaattgatggcactggtagttccgcagaaggtggtgacgggagtggtactgattcaatttccgtaataaaaaaatcgttttttaaaagtgggaggaagaagaaagatgttcccaagtcgcgaaatgtttctcgtagtaatggtgctgatacctcagttcagcgagaaaagttaaaagatattttcagtcctcatgggaaggaaaaagaattggctcatattaagaaaactgttgcaacgagagcgagaacatattcttccaactctatcaagatatgtgatgttgaggttggtccatctagctttgaaaaggtttttctacttggcaagggagatgtcggtcgagtttatcttgttagagaaaaaaagtctggcaaattttatgccatgaaagttttgagtaagcaagaaatgattaaacgcaacaaaagcaaacgagcttttgcagaacagcacattcttgcgacaagtaaccacccattcattgttacactttatcattcttttcaatctgatgaatacctttatttatgtatggagtattgtatgggaggtgagttttttcgagctttgcaacgacgtcctggccgttgtttatcagaaaacgaggccaaattttacattgcagaagttaccgctgcattagaatacctccacttgatgggatttatttatagagatttgaagcctgaaaatattttgttgcatgagtcaggacatattatgctttctgattttgatttatctaaacaatcaaactctgccggtgcaccaacggtaattcaggccaggaatgcaccatccgctcaaaatgcttacgcattggatacaaaatcatgtatcgcagattttcgcacaaattcatttgtcggcacagaagagtatattgctccagaagttatcaagggttgtggtcatacaagcgctgttgactggtggactttgggtattttattttatgaaatgctatatgccacgactcctttcaaaggtaaaaatagaaacatgactttttcgaatattttacacaaggatgttatattccctgaatatgcggatgctccttcaatttccagcctttgcaagaatttgattagaaaattattagtgaaagatgaaaatgatcgccttgggtcacaggctggtgctgcagacgtgaagcttcatcctttttttaaaaatgtccaatgggctctattaaggcacactgagcctccgattattccaaagcttgcccctattgatgaaaaaggcaatcctaatatttcccatctaaaggaaagtaaaagtttggatattactcattctccccaaaacacacaaacagttgaagttcccctatctaatttatcgggtgcagatcatggagatgatcccttcgaatcgtttaattcagttactgtgcatcatgagtgggat

SEQ ID NO: 25773 - DNA, 954 bp, Schizosaccharomyces pombe
ttgataaaaagtgcaggtgctgttgcaagtcggcttctgtgtcacccaattgatacaatcactgttcataagcaaacaattggaaaattctcttttaagacaatgcctttaaaggcttattacagagggttacctatatctttgactttaattactccggctacttgtctctatctttctacttatgttgaagcaaagcgacgatttaaaccaagcgtcggcgaaggtgccattttatactctatatgcggtatgacagctgaagtagtcagcagttttgtttggactccactggaagtcattaaggcgcgaactcagatatctcaaaaaggaagtgttataaatacaatatccacgcttgctcggtcagaaggtttaaaggggttttatcgaggctattggatggtatgtgaatcttttttatttatttattaaattttctttaaatgagaatctaaacaatctaaagctttacggcctttgggggaaattaaaaaacaaaaatagacttaatcaaatttttgattaatcttttgttaattctctttctaacttaaattatagggagtcgcaatttatctgcctaccaccgttagttggtgggtatgctatgaagaatcgaaaaagtacttacaaaagcaatccaattgggatatctcagtaattgctccaatatgttcagctttaggtactgttgtagctactactatctcaacccctcttgacattgttaaaactcgataccaagtggctacttcatcagctatgcgtaaagctgaatacggcctccaagctgaaaaggaactggggattttggaaatagccaaacttctgttctcaaaacatggagttaaaggctttactcgtgggctttttacgcgaatgtgttatattatgccatcaggcatgatctctatgtctgtatttgaatctttcaaaagtaaagacatcgac

SEQ ID NO: 25774 - DNA, 2775 bp, Schizosaccharomyces pombe
atgtctttagggctacaacctaataatgatatttcatctttagttagttcaaaaaatatgacttctgaaaatggactagagcatcaatttgaagaattattagtcgaaaaacaatattctgaagaacactgtgcctattgccacataaagaatccaaattctatattgaaatgtttgcattgtaataaatggttttgtaatgtaagagggaaatctggagcttcgcatatcattagtcacctagttcgtgctcgacataagcaggttgctttacatagccattcttctctttcagacacagtacttgagtgttataattgtggaacgagaaatgtgtttctattaggatttataccagcaaaagctaagacagtggttgttttattatgccgacaaccttgtgctagagctagcatagctaaggatatgaactgggacttgactcaatggcaacccattatttcagatcgtcagtttcttccatggttgataactcctccatccgaagaggaacaaaagcttgcaatcccaatcacttcacagcaaatggttaggcttgaagaactttggcgtaaagaccctaatgctaacctcgaagacttggataagcccattgaggatgattcattaccttcagtagaacttcgatataaagatgctcacgcgtatcaagcagttctttctccgctcattcaagcggaggctgactatgataaacgactcaaagaatcgcagactcaaaaagatgttgtggttcggtgggatcaagctatcaataaacgatatactgcttggtttctccttcccaaacttgaatctggtgaaattcggttggccataggagatgaaatgaagcttacatatgaaggagaactaagagcaccctggagctccacaggatatgttattaaaattcctaacaacgtttcagatgaggtaggtttagaactgaagcgttcagataaagtacctatcgaatgtactcataatttttccgtcgattatgtttggaaatctacttcatttgatcgaatgcagactgctttgaggttatttgctacagacggatcacgtctttcaagctttttgtatcataaattgctaggacacgatatccctccttccttcctgaaaccaaaattaccgtctgatttatcggtgcctaatctgccaaaattgaatgctagtcagagcgaagctgttcgtgcagtattaagtaagccactctcgttaattcaagggccgccaggtactggaaaaactgtcacctcagcatctgtagtctatcacctggccacgatgcaatcacgcaagcgtaaatcccattctcccgtattagtttgtgcaccttcgaatgttgctgttgaccaacttgctgaaaaaatacatcgtacaggacttcgtgtcgttcgagttgccgcaaagtctagagaagacatagaatcatcggtttcctttttatctcttcatgagcaaattaaaaactataagtttaatccagagttacaacgtttattgaagctacgaagtgaaaataacgaattatctattcaggatgaaaaaaaactgcgtattttggttgctgctgccgaaaaagaactattacgtgcggctcatgtcatttgttgtacttgtgttggtgctggtgatagaaggatttccaagtacaaatttcgttcagtacttattgacgaagctacacaggcttcagaacctgaatgcatgattcctttagttttaggcgccaaacaagtagtacttgttggtgatcaccaacaactgggaccggttgttatgaataaaaaggttgcattagctagcctttcccaatcactttttgagcgactgattatattaggaaactctcctttcagattagttgtgcaatatcgtatgcatccctgtctttcagaatttccatcgaacactttttatgaaggtactcttcaaaatggtgtcactacttctgagcgtattgctagacatgttgattttccatggatacaacctgattcgccattaatgttttatgcaaatttcggtcaggaagagctgtcggctagcggtacatcatttttaaacagaacggaagcctcaacgtgtgaaaaaattgttaccacatttttaagaagcaacgtgcttcctgagcaaattggtattgttactccatatgatggtcagcgttcctatattgttcagtacatgcaaaataacggatcaatgcagaaggatctttataaagctgttgaagtagcatcggtggatgcgttccaaggaagagaaaaggacttcattattttgtcgtgtgtacgttctagtgaacaccaaggtattggttttgttaacgatccaagaaggttgaacgttgcattgactcgagcaaagtatggtgtaattgttctcggtaatccaaaagtccttgctaaacatgctttatggtatcattttgtcctccattgcaaggaaaaaggatatttagttgaaggcactttgaacagcttacaaaagttttccttaacccttactcctcctcagaaacctcaaaaatttaaaagagacctcaatgtacaaagatcactatctcctatacagaatgccggttctgccatgttaccttcgttttctaatcttccgaacttatactcttcctcgtatcttgaagaatggaatgtctttgctcaatacaaacgaagagaaagcaacgctaccgactttgaagactttagaagtcaggttggtgatgatgaaagcaagttcgacgaacctactaggttc

SEQ ID NO: 25775 - DNA, 1629 bp, Schizosaccharomyces pombe
gatcatcaaaaagatctcaactttagtccatataaaagtattcctttaaataataggccttattctcctatgtcagaaattgttggtttttctggttctacaactcctctggacacttatggtaacagaccaagtggtaagaagtttaacaaaaattcgaaatttcgccctccaggttcaacaatttctagttattcatccgcttctacgttacgtagacttccgagggctcccggttcaaaagttcatgcagaaagacaaaattcaacattcaattcagggatttctctaagagctttaaggaaagaaatgggtaatacagctcctgtttctagcaatcagttattgaaagatgcagatttggttatggaaaatttgagtactaggaacaccgaaaaagtcttgcgtgaagtcaatattcttaaacggcttcgtgaaagttgtgtagctattactgctaaatcctacgacactcttgatgaacggaaaattcgaagtttgacaacctttgaatacttagaaatcaaaaactttcagaaaatttattttactggctctgaaaattgtcaaaagctgagcaaacaaatccctctcgacgaatgcaatgaagctttatttgatgatgataatggagattacaaagctattcaaggtgatcatttgctttatcgctatgaaattattgataccgtgggaaaagggagctttggtcaagtactgaagtgcatcgatcacaaacgcggtcaagttgtcgctataaaggttattaaaaatcgtcaaaagtttcacggacagactttagtagaagtcggcattttaaagcgactttgtgaagctgaccccgccgacaaaaacaacgttattcgatacctatctcattttgattttaggggtcatttgtgtattgttactgaattattgggtagcaatctttttgatgttatccgtgaaaacaattacaaaggactgcctcttattgttgttaagagttttgctcttcaaggacttcaagctttaaggctattgcaagggcaaaacattatacattgtgaccttaaaccagaaaatctccttctttcacatcctcttaaagcaagaattaaactaattgacttcggaagcagttgtttttataacgaaaaggtttacacttacttgcagtctcgattttatcgagctccagaaataatattaggtttagagtatggaaaagagattgatatttggagcttcggctgcattttagcagaactttttactggtgttcctcttttcccagggggtaatgaaactgaacaattaggttatattatggaagtattgggccctcctccaatggcattgattaggaattcaacaaggtcgaaggcttattttgactcggaaggaaaaccacatccaattacggatagtcataatcggttactagttccatctactagaacatttagtcagcttctaaacacaaagcaggcttctttccttgattttctttcaaaatgtttgaaatgggatccaaaagataggattactgttgattcagcacttcaacatgagtttatattgggaaaaacatctcaaaaacccatggtatcaaagggttcacatcccttaccagacctcccagtt

SEQ ID NO: 25776 - DNA, 1453 bp, Schizosaccharomyces pombe
ctgtagaaagcaatttcattagtaaaaactgctattgataatgacaatgccgagcaatatcctgatgcttacaaatattatcaaagtgcactagattattttatgatggccctaaaatgtaagttactcaatagtttgaattagggtgaggatatattgtcgcaatgattcataaggaaatttatatttggatctacattttcaagttattgtttgctaatatttcagatgaaaaaaatgaaaaatctaaagaaataattcgttcaaaagttatcgaatatctagatagagcggagaagctcaaggtttatttacaggagaaaaacaatcaaatttcttcaaaaagtagagtctctaatggaaatgtagaggggagcaattctccaaccgctaatgaagcgttagactctgatgcaaaaaagttaagaagtgcattgactagtgcaattttagtagaaaaaccaaacgttcgttgggatgatatagcgggactagaaaacgcaaaagaagctttgaaagagacagttttgctacctattaagctgccgcaattattttcacacggtagaaagccttggtcaggaatattgctctatggtcctcctggtactggtaaatcgtaccttgcaaaagcagtcgctactgaagctggttctactttcttttcgattagctcctcagatttagttagtaaatggatgggtgaaagcgaaaggtttgttattctacgttaaaactatttactctttaatatttacatgactaacattataggcttgttcgtcaactttttgaaatggcgcgtgaacaaaaaccatctatcattttcattgatgaaatcgattcactgtgcggaagcagaagcgaaggtgagagtgaatcttctcgaaggattaagacagaatttttggtacaaatgaatggagttggaaaggatgaaagtggagttctggttctgggtgccacgaatattccttggactcttgattctgctattcgccgacgtttcgaaaagcgtatttacattcccctgcctaatgctcatgcccgcgctcggatgttcgagcttaatgtcggtaaaataccttcggaactgacctcacaagatttcaaagaacttgctaaaatgaccgatggctactcgggttcagatatttctattgttgttcgtgatgcaataatggagcctgtaagacgaattcacacagctacccatttcaaagaggtatatgataacaagtctaataggacccttgtaactccttgttctcctggtgatcctgatgcatttgaatctagttggctagaggtgaatcctgaagacattatggaaccaaaacttactgttcgagatttctacagtgcagttcgtaaagtcaagcctacgcttaatgctggtgatatagaaaagcacacacaatttacaaaggactttggagcagagggatagtaa

SEQ ID NO: 25777 - DNA, 1539 bp, Schizosaccharomyces pombe
atgggtcagacattatcagagccagtcaccgagaagcactcggtgaacgggagcaatgagttcgtcctttatggactttcaagcatgcaaggatggcgtatctcaatggaagatgctcattctgctatactttcaatggagtgctctgcagtaaaagacccggtcgacttttttgcggtttatgacggccacggtggagacaaagtcgcgaaatggtgtggaagcaatcttcctcagattcttgaaaagaatcctgattttcagaaaggcgattttgttaatgctttgaaatcttcatttttaaatgctgataaagctattttggatggtaagtttgttgttaacaatgataaagttgttttcattgatatcataaccattttaaagtcgccaaaaaattgatgaattttgtgtttgaaatttttatagattttttgttcttttgtctagttaatgcttagaaaaattgttaccaagataatagaaatgtttacctcttgatgttgaaaagttgttacatttagtttggtttcagaaaaaaaatttgtcatttcactacattgcattttgctaactattttgacagatgatcaatttcatacggatccatcaggttgcacggccactgttgttcttcgtgttggaaataaactttattgtgtaagtcttggaagttgtttagtcttactaattgtgtaggctaatgccggtgactcaagaactgtccttggcagtaagggaattgcaaaacctctatcagcagaccataagccttcaaatgaagccgaaaaagcccgtatttgtgcggctggtggctttgtagactttggccgtgtaaatggaaatttggctttgtcaagagctatcggtgattttgagttcaaaaacagtaatttagaaccagaaaaacaaatagttactgccttaccggatgttgttgtacatgagattactgacgatgatgaattcgtcgtactcgcttgtgatggtatttgggattgcaagacttcgcagcaagtgatcgagtttgttagacgtggcatagttgctggaacctctcttgagaagattgctgaaaatttaatggataactgcatagccagtgacaccgaaactaccggccttggttgtgacaacatgactgtttgtatagttgccttattgcaagaaaacgataaatcagcatggtataagaagattgcagatagagttgccgctaacgacggaccctgcgctcctcctgagtatgccgaaaatcatggcccaggatggcgtagtggcgataacaataagaaagttattgtcccacctaattttcatcaagtaaagttaaatggatctgatggatatgacaaagatgcgaatgaaaattctaaggaagatgattccaccaacggatcccttgcagctgggttcagatggaaagaacactttttccctcataaagccgaggaggaaaattcttcaagtgaaaccgatatcgtaaattctaacaaagatgttgcggatgatcataaggaggctgtgtctgcagcagat

SEQ ID NO: 25778 - DNA, 2375 bp, Schizosaccharomyces pombe
atggtaaaagtcagtggaaaattgagaaatggcggttcaattacaaaacaaaacttaactgatgggttggttgggggccaacggattaaagctccaaataaaaaaaagaacaggaaagcttcgaaaaacacaacaaaaaaatcaacagtttcggttgtaaactttttagaacaagatacagattttggagcgaacgaggtagtcggttcagacaatagttcacctgaaaaacgatctgaaaactcgccttcaaaaagaaaagatatcttggaacaaaggaaaaacttaccaatttgggaggcacatgatactttgtgccagcaaattcaagacaatcgagttattgtggtagtcggagagactggctcaggaaaatctactcagattccgcaattcctaaacgaatgtccttatgcccaagaaggatgtgttgctataactcagccaagacgtgttgctgctgtcaatttggccaagcgcgtagctgcggaacaaggctgtcgtttaggtgaacaggtgggttattcaattaggtttgatgatactaccagtaaaaaaacaaggataaaatacttaacagatggtatgcttttgcgggagcttattaatgatccaatactttctcaataccacacgttgattcttgacgaagctcatgaacgcacgttaatgactgacatgctacttggctttgtcaaaaaaattattaaaaagagacctgcattgagggtaatcatcatgagtgctactttaaatgcggaaaggttttccgagttttttgatggcgccgagatttgttacattagtggccgccagtaccctgtgcaaattcactatacttacactcctgaacccgactatcttgatgcttgcttacgtacaattttccaacttcatactaagttgcctcctggcgatattctagtttttttaactggccaggatgagattgaggcattggaagcgttaattaaaagttattctaaacagttaccatccaatcttccacaaattcaagcttgtccattgtttgccagccttccacaggagcaacagcttcaagtgttcttgcctgctttagctaatcatagaaaggttgtattgtctactaatattgctgaaacttctgttacaatatccggaatccgttatgttattgatacgggcttggcgaaaattaaacaatttaatagtaagcttggcctcgaaagtttaactgttcagcctatctcccaatcagctgctatgcaacgttctggacgtgctggtcgtgaagctgctggtcaatgttataggatttataccgaagctgattttgataaacttcctaaggagactattcccgaaattaagcgcatagacctttctcaggctgtccttaccttaaaggctcgcggccaaaacgatgtaataaatttccattatatggatccaccttccaaagaaggtctgcttcgtgctttggaacatctctattcgataggtgcattagatgacaatggtcatattaatgatttgggttatcaaatgtctttaattccccttcttccttcattagcacgggcagtacttgctgcacgagagcataattgcttatccgaagtaatagacgtagtttcatgtctttctacggattccatgtttctattccctcaagaaaagcgagacgaagccattgaggctagacttaaatttttgcattctgaaggggatcttcttacttgtttaaatgcattgaggcaatatctggaatccagtcacgattcacgcaagcaatggtgctctcaaaactttatcaatcgacgtgctttaaaaactattttggatattcgtaagcaattacgcgagcattgtttaaaggatgggtgggagcttaattcttctcccgaagtcaactccgaaaatctccttctctctttcttgtcagggtacattacaaatacagctttactacatcctgacggttcttatcgaactattataggcaatcaggtaagttttctctttaatgacatacaaatacatgttgcatgtatatgtaattaatcctgccaaacctttctaatccaaattagaccatttcaattcacccctcttcttccttgttcggaaagaaagttgaggcaataatgtaccacgaattggtaagtgtcattgtttcaaattttttttaatctaatcattcaggtatttactacgaaatcttatgttcgtggagttagttctattcggagtaactggcttaatgcggttgctcctcactaccttgcccgccggtccacttaacatttcagttgcttaaaaaaataaaaaaagcgcatatattaagtcactacattttagtaaatctggaaactacaatattttaatttttt

SEQ ID NO: 25779 - DNA, 3068 bp, Schizosaccharomyces pombe
atgtcttttgatggtcttatagttgaaaatgaaaatacgaaatctggatacaatgatggaaatgtaggtattttgaaatctataatcttaaactaacgaatgtaggacctgacagatttatttaagcaaaatggtacagacatgtctgtaataaattctcttttaggagatacaaacaatccagggatgaatgagtccccaaaaattttagattctagttttgaaaattccaaccctcaggatggaccaaattatgaagattttgactttatgggttcaattcataaggaatttggtaataacataaatgaaatggatgatatggaagatgtaagtgatgataatctaccagaggaagaacaagctgtaaattacaccggggataaggatgatgaagattttggaaagcttttagctaaagaaatgggtgaagaggctgctggtcaggtcctcagcggagtaggcttttcaattccatcgggattagttccaccttccgaaccttcgaaaactgtttcttctactacagaagaattacaaaacgaagctcaaattagggagagcattgtcaaaactttttttccgacctttgaacgtggtgttttgttgaacttttcagaactttttaagccgaaacctgttaagcttgctcctccaaagaaaaagaccccaaaaggtatgaattgattattgttgtatttttttactgatctgacatgttaagtttgcgtacctggtcgtttaacgttagaagtcgatacagattacgcaataatattcaatagcaagaagtctttaccattaaagcgaaatgttgtgtctccaatatctacgcatacaaaaaagcgaagaagaacagctaatacatcacaggtatggtttgatttagaatagctttcactaaccgaaagaggaatgacggcttggatctcaacaccgtttttactactaatgattgggaaaaaaatattatttacgatgagagtgatgttaacaaaactaatcaatcatcattttttattgacaaatcactagttgatattgattttgcatttgatgaaaacatttttgacggagacactggtacctcgaaagtagtattaaatttaaatgaccccaaacttttgttacaacctcaattgccgaagaaagaggattcccaaagatcttttgcagacacccatcaaaggaattccctggcttggaagtttaatatatccaacgatcctgcctatgagatgttaaaacaaaatcatcagtcaaaagttcgtaataccttgtcccagttagcaattgagcatgctgcctttgccgaaaagctcacatttccttactataaaacaagacttagtaagcgtgctgttcgaagttaccatcgaccaaccatgtcgttcaaacctaatgcagctattgtcttttcacctttaatagtaaggaaaagaagtaaagataaacataagtctgaacgagaattaattcctactactaaggagataacaatgggtgataccacacatgcaatactcgttgagttctcagaagaacatcctgcagtgctgtccaatgcaggtatggccagcaggatcgttaattattatcgaaagaaaaatgaacaggatgaatcacgtcccaagctcgaagttggtgaaagccacgttttagatgttcaggatcggagccctttttggaattttggatctgttgaacctggagaaattactcccactttgtataataaaatgattagagctccgttatttaagcatgaggtaccacctactgacttcattctaatacggaattctagtagctatggctcaaaatattacttaaaaaacattaatcatatgttcgtgagtggtcaaacttttcctgttactgacgtgcctgggccccattcccgtaaagtgaccacagcaagtaaaaatcgattaaaaatgcttgttttccggcttattaggcgttcaccaaatggaggattgttcattcgacaattatcaaagcacttctccgatcagaatgagatgcaaattagacagcgtcttaaagaatttatggaatacaaaaagaaaggtgatggtccaggttactggaaattaaaatcgaatgaagttgtccccgatgaagcaggtacacggtcaatggtttcacctgaaacagtgtgcttactagagagtatgcaagtgggtgtgcggcagcttgaagatgctgggtatgggaaaacaatggatgagatcaatgatgatgaagatgaagaacaaccagcagagcaactgttagcgccttggattactacgagaaactttataaatgctacccaagggaaggccatgcttacactgtttggtgagggtgaccctacaggaattggcgaaggttatagttttattcgtacgagcatgaagggtggtttcaaacccgctggcgaaaccgccgacgataagccagaaccgcaaactaagaatgctcacgcctataatgttgcaaagcaacaaagggcttatgaagaagaaataaataggatttggaatgctcagaaaagaggtttaagtataaataatctggaagaattggctaaaaaatatggcatcaattctatacatgatgattacgttgaatctaatgaggagactacgagagaagaaactccatcttctgataaagttttacgaattgttcgactttatcgtgacaaaaatggaaatttggaacgtaaacaggaaaccattcatgacccgatagtcatccatgcctatctgaagaagaggcgtgagattgacgaacaatcaactgctcttgatgccgtcgtaccaactggagacgaagcaattgatagacgcaaccgaaggcgtcttgaacaagaacttgccaagagtcagaagaattgggagcgacgaagagctcgacatgctgccaaagaaggaatcaacttgaacggagaaggacgaaaacccactactcgcaaatgtagtaactgtggtcaagtgggccacatgaagaccaacaaaatatgtcccttatttggtagacctgaaggaggtttggctactatgctcgacaaaaactaa

SEQ ID NO: 25780 - DNA, 805 bp, Schizosaccharomyces pombe
aatgtgttgccgggaggtgaagcagctgtgttgaacgatcaaagcttccctgtgagggaatggtctataaaattggtctgcttaaatcctcagggagaagaaactgacgcttcctttgttgatcgtgtcacctataagctacatccaacatttcaaaatcctacacgcagtatgtattatgtgatgaaaggaagattagcagaataacgttaactaatttttttagctatcagaaaacctcctttccaaataaaagagcaaggatggggtgagtttgaaatggagatcataatatactatgcggacaaaggtggtgaacatcggttccttcactatttacattttcagcaggagcattatcatgaggatatcgaattggtatgtgttttaagtattttaacatttactagactctgattttatggtgctaactgagtcttagaatatcaatgctactaggccaggtttattaaaggcactgacagccactggagaagtacctggctacagtgatgaaggtgaagaagctcgtaaggataaaagaaaaaacgaatcagaagttggtgctgggaagaaaaaggcgaaagctaaacctgttgacatggataaacttgcagagggtttgcaaaaacttcaggaggatgacttgttacaagttgtgcagatggtgaatgagaacaaaacaccagacatgtatgtccgaaacgacattgaagggggtgaattccatattgacttatatactctgccggacaatcttctgctcttattatacagtttctgtgctaaacgcgtcactatgtaa

SEQ ID NO: 25781 - DNA, 1230 bp, Schizosaccharomyces pombe
atgagtaatgcagtatcatcatcagtatttggagagaaaaataactctgtagcttatgagctgccatggtatgtatatattatgagcaattaaaacgtcctttatgaaggttttagtgttcagctattacgattgcttcttggtgactcaggcatcttttcataatttaaaggttcaatataatatagtatgctgatctataaacttatagggtcgaaaagtatcgtccaatcgtcctggatgacattgttggtaacgaggagacgattgaccgacttaaagttattgccaaggaagggaatatgcctcatctagttatttcggtaacctatttttttttaattattatttatactacatgctgacttatatttatagggaatgcctggtatcggaaaaacgacgtctattctttgtttagcacatgcattacttggcccagcatataaggaaggtgtattagaattaaatgcttcagatgaacgaggtatcgatgtagtgagaaatagaattaaagcattcgcacagaaaaaagtcatactgccacctggaaggcataagatcattattttagacgaagcagatagtatgacggctggagctcaacaagctttgcgtagaactatggaaatctacagtaatacaacgcgttttgcacttgcttgcaatcaatccaacaaaattattgaacctattcaatcgcggtgtgcaattctccgatactcacgtcttacggatcaacaggttttacagcgtttattgaatatatgtaaagcggaaaaagtcaattatacagatgatggtttggctgcccttatcatgacagcagaaggtgatatgcgtcaagcagtgaacaatctacagagcactgttgctggattcggtcttgtgaacggtgaaaacgttttccgggtcgccgatcagccttcacctgtagcgatacatgccatgctaactgcttgtcaatctggaaacatcgacgtcgcccttgaaaaacttcagggaatatgggatttggggttcagtgctgtggacattgtcactaatatgtttagagtagtaaagacaatggacagtattccggaattttcaagattagaaatgcttaaggaaattggccaaactcatatgattattttagagggtgtgcaaaccttgttgcagttaagtggtttagtatgtcgccttgctaagtcacagatgaagccggagtcttttattatttagttt

SEQ ID NO: 25782 - DNA, 1074 bp, Schizosaccharomyces pombe
atgaataatcaactcgaaaatgtttttagatttgatgaagaaaaagagagggctaaaattcgtgaatcgccgtggaaacatgagtaagttaagatttcattggtttttagctatattataccagtctctgaatttttttccctacgttaatttattaaaattataaatcctgtaatgctaacaataacagcccagagtttttccgttctgtcaaaatctcagcagtagctttgttgaaaatgttacggcatgtatctcaaggcatgccattagaggtaatgggctatgttcaggggaaggttgaaggggcctccttgattattttagattcttttgcgttaccagttgaaggtactgagactcgtgtcaatgcacatgaagaagcacaagaatacagtgtacaatatcatactctttgcaagtctgtttacagacatgaaaatgtcataggatggtaccattcacatcctaactatggttgctggctttcaggtgtagatgttgaaactcagcgccaaaatcaaaaatatcaggatccatttgttgccgttgtgttggacccgaagcgatccttggaatctccatatgtaaacattggagcatttcgaacctatcctgtcggtaatgatggctctatccgcacaaaatctcgtcatcacccgtctgtcttatttaaaaatttaccttcttccaaaatcgaagatgccggagcccacgcagaagcgtactacagtctccctataacttactttcattccaaagctgaaaaaaaggttacggagtttttaaggaatagaaactggtctaggtcaatcaccgagtgttctattttacaagtaagattcatattctaataaagtttcttaacgagtctgcaagtttttctaacaagcaatatagaacaatgaatttttacatgacagcgaaaaattaatcgatcatcttattcatgaaacagggaataatgaattacctgttgcatctgcctacgaacaatccaaagcttgttgtaacgaattatctacttttctgtctcaaattgatgtccaagataaattatttaaagaatgaata

SEQ ID NO: 25783 - DNA, 900 bp, Schizosaccharomyces pombe
atggactacctactcaactatgctgaccaatatgcgctggattcgatatacaatgctgtatatccattagctcgcgacaatatcgttagacagtcgatcagtttgttttttttaacttggtttggcggtatgttcttgtatttaacatttgcgtcgctttcctaccaatttgtgtttgataaaagtctgatggatcacccaaagttcttaaaaaaccaggtgttcatggaagttctaacggctttacaaaacttacctggtatggcgttattgacggttccgtggtttttggctgagttgcatgggtacagctacttatacgacaacatcagtgattacggtttaaaatacttcttatgttccttacctctttttgtcatgttctcagattttggcatttactgggctcatcgtttccttcatcaccgttatgtataccctcgtcttcacaaactccatcataagtggattatctgcactccatatgcatcccatgctttcaaatccgctgatggcttcttacaatctcttccttaccatcttttcccctttttctttccccttcacaagttgacctacttggctcttttcacctttgtcaacttctggtccatcatgattcacgatggtaaatacatctccaacaaccccatcatcaatggtgctgctcaccataatggccatcacatttatttcaactacaattacggccaattcaccaccctctttgatcgcctcggcaactctttccgggcccccgatgaggcatggtttgacaaagatcttcgccaaaacgaggatgttcttcgtgtcgaattgatggagtacgaggctattcgtaatgaagttgaaggtgatgatgatagagaatacatcgctaactctgctaagaagaaccat

SEQ ID NO: 25784 - DNA, 1619 bp, Schizosaccharomyces pombe
  unsure (1)..(1619): unsure at all n locations
atgctaaagaaacaggccctgagcgggatccgccggttttctttggcaacaaaacagtcttttgtaaagactagttataagttacctcggaagtcatggttgaataccgctaaatttaacactataagatatgcttcgacggaagcagcaaaacataataaaggatcgattaaacaagttattggtgcagttgtcgattgtcagtttgaagatgccgattcattacctagcattttgaacgctttggaagttaagcttcccgataacaaacgccttgttttggaagtagcccaacacgtcggtgaaaatactgttcgtactattgctatggatggtactgagggtcttgttcgtggaacagccgttatcgatactgggtcacccatcagcattcctgttggcccgggtacattaggccgtattatgaacgttattggtgaacccgtagatgaacgcggtcccattaaagccgttaaatactccccaatccacgctgatgctccttctttcgaagaacaatcaacaaccccagaaatcttggagaccggtattaaagttgtagatttgcnttgccccatatgctcgtggtggtaagattggtctattcggtggtgcaggtgttggtaaaacagtttttatccaggaattgattaacaacattgccaaagctcatggtggttactctgtctttactggtgtcggtgaacgtacccgtgagggtaacgatttataccgggaaatgcaagaaaccggtgtcattaaattagaaggcgagtctaaggctngctcttgtctttggtcaaatgaatgagcctccaggntgctcgtgcacgtgttgctctcactggtttgactgttgctgaatatttccgcgatattgaaggacaagacgttttgcttttcattgataacattttccgttttactcaagcaggttctgaagtatcagctttgcttggtcgtattccctctgccgtcggttaccnaacccacgttagccactgatatgggtgctatgcaagaacgtattaccactactaagnaaaggttctattacctcagtccaagctgtctatgttccagctgacgatttaactgatcctgctcctgccactacctttgcccatttggacgctactactgtgttatctcgtagtatttccgagttgggtatttatcctgctgtcgatcctcttgactccaagtctcgtatgatggatcnctcgtattcttggtgaggagncactataaccttgcaggttctgttcaacaaatgcttcaagaatacaaatcactacaagatatcattgccattcttggtantggatgaattgtctgaagcntgataaattgacagtntgagcgtgctcgtaaggtacaacgtttcttgtcccaaccatttgcagttgccgaagtgtttactggtattgaaggacgccttgtttccttgaaagatactatccgctcttttaaggaaattcttgaaggcaagcacgattcattacctgaatctgctttctatatggttggtagcattgacgacgctgttaagnaaggctgagaagattgcacaagaattggctgcataaatcaatttgctaagactttttgantgtttt

SEQ ID NO: 25785 - DNA, 952 bp, Schizosaccharomyces pombe
  unsure (1)..(952): unsure at all n locations
atgtctgacattacggttgagcctattggcaagcagatggagaagcttattctcgatagttcagcaagaaattgttgctggtctcgaagctgtcgatggacaaaaattcttccaagacaagtggaccaagggagaaggtggttatggtatcagttgtgttattcaagatggcaacgtttttgaaaagggtggtgtcaacacaagtattgttcaaggaaaattgaatcaagacgctgtccaaagaatgcgtgctaatcatgaaggtattgatcgtactgccaaagagcttccattctttgctgctggtatcagtatggttattcaccctcgcaaccccatggcccctactactcacttgaactatcgttactttgaacttgtaaacagtgatggtaagaagatttggtggtttggtggtggagccgatttgactcctagcattctctttgaagaagatggcaagcatttccacaaattgcataaagaagcttgcgatcgccatgaccccactttctatcctcgcttcaagaaatgggctgatgaatacttcctcatcaagcacagaaaggagactcgtggcattggcggtattttctttgatgatctttctgagaaagatcctcaagagttatttgctttcgtcaaggattgtgncccataccttccttcctgcctatgtccctattatggaaaagagaaagaacatggaattcactgaagatgataaggaattccaactcattcgtcgtggatactatgccgagtttaacgttatgtatgacagaggtacttggtttggtcttcaagctcctgaanccccgtgttgaatctattcttatgacccttccattacatgcttcctggcgttnacaagtatgagcctaaacaagagcgtcacaaggctctccttaaagtaacgcatacccctattgaatggtgctagaaaganttc

SEQ ID NO: 25786 - DNA, 984 bp, Schizosaccharomyces pombe
  unsure (1)..(984): unsure at all n locations
atgcagcaagacgaggtgatttggcaggttgtaggtcatgaattttgttcatataggatcaagtaagttgatttcgcacttttagtattacattataacctaacacaatttttagaggggaggcacaaaatttttgcagaaatgaatacaatgtcactgggttgtgcaatagacaatcatgtccattggctaactccagatatgccacagtacgggaggataatggaaagctgtatctttacatgaaaactatagaacgtgcgcattttccatcgaaactttggcaacggataaagttatcaaaaaattacgctaaagcgttggagcaaattgatcaacagttattgtattggcctggtcgtcaaatccaccgctgtaagcaaagactaacccgcctcactcagtacctattgaaggctagacgattggcattaaaacaccaaccagcattaattcccattaagccntaaacaagcgcatcgtgaagcttctcgtgaaagaaaagcacttattgccgccaaattagagaaaaatattgaaaaagaattggttaagcgnacttaaaagtggtgtttatggtgatcaacctttgaatgttaatgaagaaatatggaacanaggtactagccgcacgtgagggtttanattgatgaaggcgaggaagaggaggaacgagaagaagctgaattagaatttgttagtgatgatgaagatgaagaagatatctctgatttggaagattggctcggctncagatcagtccatggaaacttcagagtctgaagaggaggaaagctcagagtctgaatccgatgaggatgaggatgaggataacaaaggaaaaatcaggaaacgtaagaccgacgatgcaaagaaatccaggaagaagcgcgctcctcatattcatattngagtatgagcaagaacgtgaaaatgaaaaaatancctgctgttcaacattcnttggtaanaaaaaaaaaaaag

SEQ ID NO: 25787 - DNA, 1282 bp, Schizosaccharomyces pombe
atggaagttccttctgcagttaccctaaataattatgtgggtatgaaaacaaaagaatgttgataaagagtcaaaactaatgtttatagggttcgattctatcacttcgcaaattaaccgcaagttaattcgtcgtggttttcaatttaatgtaatggtggttggtacgtattatttttattacagattttcaattataatgatgttaacagtttcaaataggaccgtcaggtagcggaaaaagcactttgattaatactttattctctgcgcacttgatggacagtaagggtcgtctggattaccaagctccttatcgccagacaactgaaatccatgttacaagccaaggtatgttgatttttttatagttaggttttcatctttgattgaactcattgagctggcttcaatgagtcagcaatccttatatttattatggttacattgctaaccacatagtcgttcgcgagaaccgtgttcaattacaattaaatttaatcgacactcctggatatggagatcaaattaataacgataaatggtaagtttgatcagtggaaatggaaatttctattcctgcacagcaatttctaactataatagctgggagcctataattaagtacattagggaccaacactcttcctatcttcgtcgtgaattaaattcacatcgcgagaaacgtctacaagacacaagagtacattgttgtttattctttattcgcccaactggacattctttgcgccctattgatattgctgtcctcaaacgcttaacagaagtcgtaaatgttgtgcctgttatcgctaagtctgattcattgactcttgaagaaagagcagcatttaagcagcaaatccgtgaagaatttgttaaacacgacatcaatttgtatccttatgattctgatgacgccgatgaggaggaaattaatctaaatgctgccgtccgaaatcttattccttttgccgtggtcggttccgaaaaagccattatcgtagatggaaggcctattcgtggtcgtcaaaacagatggggggttgtcaatgtggatgatgaaaaccactgcgagtttgtttttcttcgtaactttttgatgcgaactcatcttcaagatttaattgaaacgacctcatactatcattacgagaaattccgctttaagcaattgagcagcttaaaagaacagtcttccctcgcaactagaatgggaagtcccgcacctgtgtacccttctgaaccacatctccatacagccaccgctcaatagtcttct

SEQ ID NO: 25788 - DNA, 1464 bp, Schizosaccharomyces pombe
atggagatagcaggtaattcttcaaccatatcgcctacattttcaacacccacaaagaaaaggaacttagtcttccctaacagccctataactcccctgcatcagcaggcacttttaggccgtaacggtcgttcttccaagcgttgctcccctaaatcttcttttatcagaaactcaccaaaaatcgatgtagtaaatacagattggtctattccactatgcggatcaccacgaaacaaaagtcgtcctgccagtcgaagtgaccgctttattccttctcgtccaaacactgctaatgcttttgtaaattctatcagcagtgacgttccttttgattatagtgaatcagttgctgaagcatgcggttttgatttaaacacgcgtgttctcgcctttaaattggatgctcctgaggccaaaaagcctgtagacttgcgcactcaacacaatcggcctcaaagacctgtggttacaccggctaaacgacgctttaacactactcctgaacgagttttagatgctcctggtatcattgatgattactacttgaatttgctggattggtcaaacttaaacgtcgttgctgttgctttggagcgcaatgtgtatgtttggaatgctgatagtggttcggttagcgctttggcagaaaccgatgaatcaacctatgttgctagtgtaaaatggtctcacgatggttcatttttatccgtcggtcttggaaacgggctcgttgatatatatgatgttgaatcacagacaaaacttcgaacaatggcaggccatcaagctagagttggttgtctctcctggaatcgtcacgttctgtcgagtggtagccgttctggcgctattcatcatcatgatgtgcgtatcgctaatcatcagattgggactcttcagggacactctagtgaagtctgtggtttggcgtggcgttcagacggtcttcagttggcctctggcggtaatgacaacgttgttcaaatttgggatgccagatcttcgattcccaaatttaccaaaaccaaccataacgctgctgtaaaggcagttgcttggtgcccttggcaaagtaatctattggcgacaggcggtggcacaatggataaacagattcacttttggaatgctgccactggtgcaagagttaacaccgtggatgcgggtagtcaggtcacttcactgatttggagccctcattctaaagaaatcatgtctactcatggctttccagataacaatttgtctatatggtcttatagtagcagcggattaaccaaacaagttgatattcctgcacatgatacccgagttttgtattcagctttatcgcctgatggaagaattctttcaactgcagccagtgatgagaatctgaaattttggcgagtttatgatggggaccacgttaaaaggcccattccaattaccaaaaccccgtccagcagcataacaatccgt

SEQ ID NO: 25789 - DNA, 1353 bp, Schizosaccharomyces pombe
atgtctcttgaagagaatgtaaaggaagcgaaaaacgcttttaacattttacagacattatcagtggaagaccgtgatgatgcattggataaaatagttgaagaactgcgcataaaaaagtcagaggttctagctgcaaatgctgaagatatgaaagcagctaagctcttggctgaatcaggaaaactaagttcatcgatggttaaaagattggatctgtcttcatctgataaatacgattccatggtacagggtgttttagatgttaaaagtttgcctgatccccttggtcgtgttacttatgctcgtagtcttgacgatggtttggacctttataaagtctcttgccctgtaggtttattgctagtcatttttgaagctagacctgaagtaatcattaatattacttccctggctatcaaatctggtaatgctgttgtacttaaaggaggcacggaatcagcaaagtctttcgctgcactttctaatgttgttcgctctgccttgggcaaaagtaaggttccacaggctgctgtgcagcttgttcagagtcgcgaggaggtatcacaattattaaaattggatgagtacatagatttggttattccccgcggcagcactaatcttgtacgccatataaaagataacacaaaaattcctgttttaggtcatgctgcaggactatgctccatgtacgtccatgaggatgctgatatggaattggctagtaaacttgttctggatggaaaaactgattatccagcagcatgtaatgcaattgaaactttgttaattaacgaagctgttttatcttctcatcttcctaaaattgctgaaactttaactgaagcaaaagttacattaaaatgtgatcccgcttctcttaaggttttaaaggatatgccaaaagttagtgctctagttgaaccatctgtcgatcaagattacaacactgaattctctgatttgattcttgctattaagactgtaccttccttacagtccgcaatgcagcatataaatacacatggttctaaacacacggattgcattatcacttctagtgaagcagctgctaacagattcatggctggaattgatgcttctggtgtgtattggaatgcttcaaccagatttgccgatggttttcgttatggttacggtaccgaagttggcatcagcaccaacaaaattcatgctcgaggaccaatgggtcttgatgggttaactatttacaagtaccaacttagaggaaatggtcaagttgcaagtagttatggagttggacctggcaaacgcgcatttaaacatacccctattaatatagacaatatttctcaggtttcgaaaaaa

SEQ ID NO: 25790 - DNA, 1719 bp, Schizosaccharomyces pombe
atggataagaatgattacttacactttgaacggaacccttcattatttccgaaatcaactttagacaaagtccaaaagacaaagaaatatattgaacattattacaaggtggcagttgatcatgctgtagagcgcaaccaaaggtacgagtagcattactattcagggttctagcattgtttcacattcctcaattagtattcccatcttatacgttgatcggataagtatcaaagacgatgcttttattaattctttctccgttctcaacttcgcgtgttgcagtaaatgcataatctcgaatgtttataaaatcttagacagcttactcatcttgtttcgaaaatgttaattaataatgctagcttccgtttaatttacttttaggtataaatactaattctctttagacgtatcaatttggagcaacgattagcaaccgaaaggggttctgaggagagaaagaataggcagttaagagcatctggtgaaaaagagtctcaatttcttcgatttcgtcgtacacggctttctttagaagatttttctaccatcaaagttattgggaaaggtgcatttggcgaggtacgtttgcataattgtttatgtttttggtatctaattaaataggttcggttggttcagaaactcgatacgggtaaaatctatgccatgaaatctttgcttaaaactgaaatgttcaaacgtgaccagctggctcatgtcaaagcagaacgcgacttattagttgaatctgactccccatgggtggtgtcattgtattatgcttttcaagattcactgtatctttacttgattatggagtttttaccaggcggtgatttgatgaccatgctaataaattatgatactttttcagaagacgttactcgcttctacatggctgagtgcgttttggctatagctgatgttcatcgaatgggttatattcatcgggatataaaaccggataacatactgattgaccgggatggccatataaaactttctgatttcggactttccactggtttttacaagcaagatcagagtgcctcttacatgaaacctcgcacaggaaatactgtcaaacgtggtcaaatggtagatgctatctggcttacaatgtcttccaaggacaaaatggctacttggaaaaagaaccgtagggtgatggcctatagcactgtgggtactcctgattatatcgctccagaaattttcttgcaacaagggtatggtcaagattgtgattggtggagtttaggcgctatcatgttcgagtgcttaattggatggcctcccttttgcagtgaaaactctcatgaaacttatcgaaaaatcatcaattggcgtgagactctgactttcccaaatgatatacatttaagcatagaagctcgtgatttgatggaccgacttatgacagattcagaacacagattaggtcgtggcggtgctattgaaataatgcaacatcctttctttactggaatcgattgggatcatatacgagaaactgcagctccatttattccgaatttgaaatctattaccgatacacattatttccctgttgatgagcttgaacaagttcctgaacaacctgtcacacaacaacctgcttctgttgaccctcagacgttggaacaaaccaatctggcattccttgggtacacttacaaaaaattcaattatttaacgatgaaaggagcattg

SEQ ID NO: 25791 - DNA, 1532 bp, Schizosaccharomyces pombe
  unsure (1)..(1532): unsure at all n locations
atggcccctcaattcaaacgccctgagctctttggctttgataagtctcatgctcaatcttttgttcaaggaaaatggatttncttctcctaacaacaaaacttttgaggttgataacccagctactggtgaaataatcggtaaagtggccgatgtctcagtagaggaaacaaaaaaagccatcagtgccgctaacgaggccttcaaaacttataaaaattttactcatgtccaacgtagtcagttattggaacgctgggcagangncttattatggagaacaaagacgacttggtcaagatgcttaccnttagaaaacnggcaagcctttgagccaagctgagatggaggtncaccacatgtagcggatatcttaaatggtatgctgctgaagccgttcgtacctnttggcgatgtagctccttccagcttacaaagtcaaaactttcntcatctccatcnaaacagccagttggtgtcagtgccttngattactccttggaacttccccgccgccatgattgctcgtaaaggtnggtgccgctttggctgctnggttgtaccgctattttncttgcctgctttccgcnactccctacgtttgcttaggtttagtcanggttggncgcaagaggccggtttccctgacggtgtcttaaatgtgatcacttcttctgatgcatctgctcatggtaaagaactganctaccaaccctatcgttcgtaaggtttccttnncactggtagtactaatgtcggtaaaattcttatgggacaaagtgccagcacaatcaagaacgtttcaatggagttaggnaggtaatgcccctttcattgtattccctgacttccccattgatcaggctgtcgaatctttctgcactatcaagtttaactcttgtggtcaagtttgtgtctgccctaacagagtttacgttcacaagaatgtttacgacgaattcgtcagcaagcttaccgaaaaagtcaagaccattagagtaggagatggatttgactcttcttctgctgttggccctttgatttctcaagatggatgcagaaaggtcagcaagcacattgaagatgctgtctcaaagggtgnccaaaatcactgttggtggaaaggagatttcctcaagcaaaggttatttttttgaaccaaccgtgctctccggtgtaactcaagacatgttggttgctagcgaggaaacattcggcccactcgcctctgtcttcaagttcgacgacaccgaagaggtgatcgaatgggnctaacgacagtgatgtntggcnttggccggttacgtctttaccaataacttgtccacnaatgatccacgttgccaaagaactagaggtgggtcttgtagngtgccaatatcgaaatggttgacngaaccatttatttcctttggcgngcatcaaacagagcggttttgngcaaggaagccggtcgtttgggcgnttcaaaaatttatnggtggttaaggnaannatcaatctcaagacntctttaaggattttcgctttag

SEQ ID NO: 25792 - DNA, 537 bp, Schizosaccharomyces pombe
  unsure (1)..(537): unsure at all n locations
tttccgtntatctaacaccntaaaaatagatttgaaaanctacattcatgnatatctttngtcgatgganaacagtatagaacntgtctctantgggatacagctggtcaagaagagtatgatcaactgcgttcgttatcatattcagatacacatgttattatgatctgctttgccgtggattcacgagactncattagaaaatgtaatcacaaaatggcttccggaagntctctagtaattgnccctggtgttaaattggttctntgttgcntctaaaatgtgatttacgtggagctgatgaggagcaagttgatcacagtaaaattattganttacgaggaaggactggcagcggcaaaaaaaatcaacgctgtacgatatttagaatgcagcgctaaattaaatcgtggcgtaaatgaagctttcacggaagctgcacgcgtntngcccttgccgcgcaaccaagaggtacaaaggatggtgctgatgaatcccatggtacncggatgtatcattgcttgaaagcactttctt

SEQ ID NO: 25793 - DNA, 1589 bp, Schizosaccharomyces pombe
  unsure (1)..(1589): unsure at all n locations
ttgttgacattanagattggtaatnaaatatcgtataggtagaaaaattggttctggctcnctttggtcaaatttacctgggattaaatacggtaaatggagnaacaagttgctgtgaaattggagncctttaaaggctcgtcatcatcagttagaatatgagtaagtagtgctttaatatttttttacttaagtnataagttggattntctttcggaanctccaatttcttctttatatctatcaaccgtagctcgatgttttacaaccaaaaaggaaaagcaaaagttactccantttggttatttttcttttttctttctaacatttaggtttcgtgtgtataatattcttaaaggaaatattggcatacccacaattcgctggttcnggtgtnaaccaatagntntataatgcntatggtcatggatttanttaggncccttctctgganangnatttattctgctanttgtggaagaaagtnttactcttaaaacggttcttttacttgctgatcaactcatcagtcgcattgaatatgttcactccaagnntcattcttacatcgagacattaagcctgataattttttaatgaagaagcacagcaatgttgttacgatngattgacttcggattggcgaaaaaatacagggattttaaaactcatgnttcatattccatatcgagnantaataagaatcttacgggaacggctcgatatgctagtattaancacccatnattggtattgaacaatctcgccgtgatgacctcgaatcgttaggttatgnttttactttatttttgtcgcggcagtttgccctnggcaaggcttacaagctgantacaaaggagcaaaagtatcaacggatnacgtgataccaagatntggcactcctttggaagtcctttgcaaagngtcnttcccgaagagtttatcacttacatgtgttacanctcgtcagctttcgtttaccgagnaagccaaactatgcttatttgagaaagctgtttcgtgatttacttattcgtaaaggataccagtatgactatgtttttgactggatgatattaaaatacgtaagttttgnaaaagaaaatgataaggtngatacgttagtttaaccttaacaaatgattgaaanattcgattgactaactattattagcaaaagcgagctgctgctgctgccgccgcttctgctacagcacctccacaggttacatnctcctatggtgtcacaaactcaaccggttaantcccattacntcctaattattcatccattcccttacctgctgagcggaatccaaagactccacaatctttctccactnaatattgttcaatgtgcttctccctcacctcttcctctctncctttcgttctcctgttcccaacaaangnattatgaatacattccatncnttcgttgcaacctcaatancagtgctcaactngaggncgtgttttagatgaagaanccagctccttgattttttgactttacttttcatcaattcctctcttacactacgtcttttagtcttaaattccaaaccatctgttgacgttttaaagtt

SEQ ID NO: 25794 - DNA, 513 bp, Schizosaccharomyces pombe
aaaaactttttccgttatctaacacctaaaaatagatttgaaaactacattcatgatatctttgtcgatggaaacagtatagaactgtctctatgggatacagctggtcaagaagagtatgatcaactgcgttcgttatcatattcagatacacatgttattatgatctgctttgccgtggattcacgagactcattagaaaatgtaatcacaaaatggcttccggaagtctctagtaattgccctggtgttaaattggttcttgttgctctaaaatgtgatttacgtggagctgatgaggagcaagttgatcacagtaaaattattgattacgaggaaggactggcagcggcaaaaaaaatcaacgctgtacgatatttagaatgcagcgctaaattaaatcgtggcgtaaatgaagctttcacggaagctgcacgcgttgcccttgccgcgcaaccaagaggtacaaaggatggtgctgatgaatcccatggtaccggatgtatcattgct

SEQ ID NO: 25795 - DNA, 1458 bp, Schizosaccharomyces pombe
atgacggttgttgacattaagattggtaataaatatcgtataggtagaaaaattggttctggctcctttggtcaaatttacctgggattaaatacggtaaatggagaacaagttgctgtgaaattggagcctttaaaggctcgtcatcatcagttagaatatgagtaagtagtgctttaatatttttttacttaagtataagttggatttctttcggaactccaatttcttctttatatctatcaaccgtagctcgatgttttacaaccaaaaaggaaaagcaaaagttactccatttggttatttttcttttttctttctaacatttaggtttcgtgtgtataatattcttaaaggaaatattggcatacccacaattcgctggttcggtgtaaccaatagttataatgctatggtcatggatttattaggcccttctctggaagatttattctgctattgtggaagaaagtttactcttaaaacggttcttttacttgctgatcaactcatcagtcgcattgaatatgttcactccaagtcattcttacatcgagacattaagcctgataattttttaatgaagaagcacagcaatgttgttacgatgattgacttcggattggcgaaaaaatacagggattttaaaactcatgttcatattccatatcgagataataagaatcttacgggaacggctcgatatgctagtattaacacccatattggtattgaacaatctcgccgtgatgacctcgaatcgttaggttatgttttactttatttttgtcgcggcagtttgccctggcaaggcttacaagctgatacaaaggagcaaaagtatcaacggatacgtgataccaagattggcactcctttggaagtcctttgcaaaggtcttcccgaagagtttatcacttacatgtgttacactcgtcagctttcgtttaccgagaagccaaactatgcttatttgagaaagctgtttcgtgatttacttattcgtaaaggataccagtatgactatgtttttgactggatgatattaaaatacgtaagttttgaaaagaaaatgataaggtgatacgttagtttaaccttaacaaatgattgaaaattcgattgactaactattattagcaaaagcgagctgctgctgctgccgccgcttctgctacagcacctccacaggttacatctcctatggtgtcacaaactcaaccggttaatcccattactcctaattattcatccattcccttacctgctgagcggaatccaaagactccacaatctttctccactaatattgttcaatgtgcttctccctcacctcttcctctctcctttcgttctcctgttcccaacaaagattatgaatacattccatcttcgttgcaacctcaatacagtgctcaactgaggcgtgttttagatgaagaaccagctccttgattt

SEQ ID NO: 25796 - DNA, 1872 bp, Schizosaccharomyces pombe
atgagaccgggcatgcatgacacgcctctttcattaatgcaaaaacgagaggctttggcgatttcgctttccaagcgcgacagtgttggatcatacgcgccttataatgtaacttgtcctagtgactatatgctacgacctgcttctgacggaataagttcaggcgagcaaagtttcattgataaacgtatccccaaaatcaatacacaaatgaggtcctttatttccaacactggtttggacgtagatgtaaactctgtgattaatgattcagatggccctcgtttaggacttgcattttctggcggtggactccgcgctatggtccacggaggaggtgttttaaatgctttcgattctcgaaatggcaatggttcttcacttgctggaattcttcaatccgccatgtatatcgctggtctttctggtggttcatggctggtcggttccgtagctgttaataactttgccaatattacttatctacgtgacaacgtttggaatttggaacatagtgtctttgctcctcatggtgacaatgttgtcgaaaatcttgcttattatgacgacctggatgatgagattgatcaaaagaaagatgcaggattcgatacttctttgaccgatctttggggacgcgctttatctcgtaagcttgtcgatgctacccaaggtggtccaaatatcacattttctagcattagaaaccaaacttggttccaaaatgccgactatccttatcccatcattatatctgacagtcgtttggaagaggaaaaagctatccctgccaacaccagtatattcgaatttactccatacgagtttggtacttgggacaatggtattaaagcttttctccctatggaatacgtcggtacccatttaaagaatggtgttccaccagaccataagtgcattcgtaactatgataatgccggttttgttatgggtacttcagctacattgttcaacacgtttctgttagaatggagtcaggaagtaacgtcaaatagtactctctatgatattattcataaagtatttgaaaaactttctgaggatcaaaatgacatcgctccttaccccaatccttatcagaatttcacgactacaaacaccaccgtcaaaaacccttttgagcgattcgatactattgatttagtagatggtggtgaagacgatgagaacattcctatttggcctttgttacatcctcaaagatttgttgacgttatatttgctgttgacgcaacttatgatgattctaatggttggcctgatggctcttctattgttactacatatgaaaggattataacttataacgccaataaaagtgttgatgttcgaggtttcccgtatatccctgatgaggacacaatcatttccttgggactgaacactcatccaacattctttggatgtgacggcagaaacactactgcaggtaatcataccgtagataacaatacacctcctcttcttgtttatttccccaattatccttgggtttactattccaatatttccacgtttaccatgtctatgaatgacactttgtccagtggcattcttgaaaatgctgctctatcggctactcaaaacaacagcgattcatttgcagtctgtttggcatgcgccatgatacaacgttccttggagcgcaaaaatatgtctactcctagtcaatgctcttcttgttttgaacaatactgctggaatggaacaaccgtgaacaaccctagtgccgtttcaaactatgctcctactgtgttatctgcatcaaccacttctggtacctcttctgtacgagccaaacctatagtattttatttatttgcttcgcttctaacagtttcgttactatta

SEQ ID NO: 25797 - DNA, 1839 bp, Schizosaccharomyces pombe
atgcttttccgcggattaagcctgtggatgctctttttggcatcctgcctttctgcccttgctcttcccgctgctgaagacgatggttctgtcaaggtcttcaagcgtgccaagaagcatagcactaagcaagagggacccagttacgctccttattatgtggactgtccctctgataacattgtcgagagtctctccagcaatgagattcctagcgccgagtctgaatacttgagcactcgttctactattaccaacactgccatgaaggacttccttcgtaacgccaacttgcctggtttgaatgccgatactctttctggctctgaaggtccttctatcggtattgccttgtccggtggtggtttacgtgccatgattttgggttctggtgccctctctgccatggatgctcgtcacgacaaccacactgttttgactggtctccttcaagcctctgactatctcgttggtactgatggtagtgcctggactgttggtggcattgctctcaacaatttcagtaccattaacgactttagcaaactttgggctttcaaccaccctttgatgtatcccaagagtgctattgttttcaacgctcatttctacagttctattatgaatgaagttgccgaaaaggccaatgctggctttaacatcagtctttccgattactggggacgtgtgatttctcgtacccttggtgacactacttatggtttccctaatgtctctttgtctagtattacttcccaagaatggtaccgcaatgccaacttcccttaccccatcattacctttgctacccaaaactatggtgaggatattagcaatgttaacactactttctttgaagcttcccccaacgttttcggtacctttgaccatggaatcaactcctttattcctaccgaatacttgggtactaccttaaacaatggtgctagcagcaatggttcttgcgttatcaactatgacaactttggtttcatgatgggtgcttcttctacttacttcaacaagataatgcgtaacttcaatgactcttctaccaagaacggtcgtatcatccaacaatacttgaaaggtaacttttctgaaaacggtcaacaaatcatctccattcccaaccccttccaaggtgttgagagtgctaattctgatgctgccaacaacttgggttccagctcttcccttaacttagttgataccttccttactggtgagaagattcctttgtggcctttgttgcaaaagggtcgtgatgtcgatgttatcgttgccgttgacaatggtgatgacagtgaatggctctggcccaacggtaactctcttgtccaaacttatgagcgtgtcgttgctgcccaagctgccggaaacaccaatgttaagggtttcccctacgttcctagccaacaatcctttgtcagtcttcacttcaacgatcgccctgtcttctttggttgtgatggtcgtaacaccactgctggtaaccacactgttacccgtgacactcctcctttggttatctatcttcccaacgttccttacaactacttcactaacatttccactgatcgcacctactacactgaagacatgattcaacaacttcttaccaacggccttatttcctctaccgttgacaatgacacctactttggtcaatgttttgcctgtgccgttgttaagcgtactttggagcgtaacaacatcactgctagccccgagtgccaacaatgctactataactactgctggagcggtctttatgatgacagcgctgctaatgatgatattgtctacaatcctacttgccgtcttggtgaaggcatt

SEQ ID NO: 25798 - DNA, 1152 bp, Schizosaccharomyces pombe
atgttgctgttcaagtttaatttcactacagcttttttatttacgatcctcgcttttgctcaagcccgctctcactcttcctcctcctcttccacctccaagtcgagtgcaagtcatcattcaagtattaattccacctcggcaacctctgtctatgatttctcctccttaactacgcccatcgttccaacaaatggcgtcgctcaagaacccacattatatgagtcttcccgagggttgtcttgcccgggttatcaagcccgaaacatctctgaatactcgtacggtgtcttggcaattttggagctggctggagatgcttgctacgcatacggtactgattacccctatttattattgaacgtttcctatgatactgaagaacgcgttcacatatcaatttccgacttaaaccaaacgcaattccagctcagtaatcgccgggatgtttgggatgctcccttattctatcgtagttccaatttttctggaaatctgcaatacaatttttcattcaacacagacccctttgaattttggattacaaggattgcggacgatcaagtcttgttcgatactcgtggaaaccctttgatttttgaggaccaatacattgaattgactactaatatggttgaggattataatgtgtatggtctctctggaagtcaacagtctttccgtttaggaaataacttgactaaaactttttgggcaacaggttatagcgattcaccagaggctaatatgtatggctcacatcctttctatatggagcaacgctatattcccataggaactaccaatacctatacttctgcctctcatggagtccttatgctaagttcaaatggaatggaggtacttttgagaagtacttacattaaatatagaatgattgggggcatcattgatttatttgtatactcaggaagtacggttagcccaaaatatactattcaacagtacgttcaatcgattggtactccaactatgcagccctactggtccttgggttttcaaatgtcccgatggggctacaaaacgctatcggatcttattaatatgcgcagctaccttaatgcttctaatattcctaccgaaggcttttggaatgatatagattacatgagtgaatttcggacttttact

SEQ ID NO: 25799 - DNA, 2359 bp, Schizosaccharomyces pombe
atgctttggaatacgcagtactttcgaattgaggggatgatttccttgggatggccaaggttagcgaaaacatcaattttgaaatttgtgccaattgcacaaaatcaccggattaggaaaatgaaagtccaagatgatttcatcctcactattgatgactctgaagatgatattcattacgacgattacgatgccgatgccgtagatgaagaaatgccttccaatgtggagttgaaaaaaaaatcgaaaaaggccaccccggcaaaggattccgatttcaatggagaatttctattcgaagctgatgtcaacaaagatttatcctcagcgactgatatgaattgggattttgacatgggtagtaaaacagaatcaaaccgtgcttctaatacagtggatctcgatgccattatatctcgaaaccgtaaaccagacgatgatgaattcccttcttcttttccctctgaagaggaacttcaagagcctgagcaggaaaatatcgattcagatgatgaagacttagcaattgatggattcggtgcaggcgcaattgctgaaaatgaagacgagtcttcccaagatgaaagtgaaagcgaagaggaagatgatattactgagcctgttccttcttttgccaatatttctactcaggatttcaattccgattctgctgctggttcctccgacagcgaagaagatgaagaggaaattgctaagaaaaatgctttctttgctgaaggtgataaagaaaaatctatgatgaccactacacattcgtctttccaatctatgaatttgtcacgccctatcttaaagggcctttctaatcttggttttgaagtgccaactcagattcaagacaagacaataccacttgcacttttaggtaaagatatcgttggtgctgcagttactggtagtggtaagacagcggctttcattgttcctattttggagcgtttgctctaccgtcccaaaaaggtccctactacaagagtattgatcctttgtcctactcgtgagcttgctatgcaatgtcatagcgttgctacgaaaattgcctcttttactgacattatggtttgtctgtgtatcggtggtttgtccctcaagttacaagagcaggaacttcgtaaacgtcctgacattgtcatcgccaccccgggtcgttttattgatcatatgcgcaattcacaaggattcactgtggaaaacattgagattatggtaatggatgaagccgatcgtatgctggaagatggttttgctgatgaactgaatgaaattattcaagcttgtccaaagtctagacaaacgatgcttttttcggccactatgactgataaagtagatgatttaattcgtttatctttaaatcggccagtacgagtttttgtcgataataagaaaactaccgccaaacttttaactcaggaatttgtccgtgttcgaccacaacgtgagttacttcgcccagctatgcttatctatctctgcaaggaattatttcatagaagaactattatcttcttcaggagcaaagcttttgctcacaagatgcgagtcatatttggccttttatccttaaacgctaccgaaatccacggttcattgtcgcaagaacagcgtgtccgtgctttggaagactttcgtgatggaaaatgtaactatttgttggctacagatgttgcatctcgtggtattgatatcaaaggcattgaggtcgtaataaattacgaagctccagctactcacgaagtttatcttcatcgtgttggtcgtactgctcgtgctggcaggagtggtagagctattacattagccggtgagggcgatcgcaaagttcttaaaggtgtattcaaaaattcttcagcgcaaaacacaaaattggtcaaccgtaatctggattttaacaaagttgaaaagtttggtaaagaaattgaggaattggaacctgttgttcagaaagtgctagatgaagaaaaacaagaacgagaagtatgttgtttttataagtatataaattttttttctaacaaatgtagctaaaaattgccgaacgcgatttaaagaaaggcgaaaacattatgaaatatggtgatgaaattcgttctcgtccagcacgtacctggtttcaatccgaaaaagataaacaagcttctaaaggtatgtgacattgaaataaaaaaatatgtttgctaacattatagcctccgaagcgaaagataaaaagtctttagctaaaagaaaaaagcaaatggaaaaggaagaggtgccccgagcatacaagaagacaaagaatgatagacttagcaacaaaaagtctacaaaaaaatcgaaatctaagcgcaaataggtg

SEQ ID NO: 25800 - DNA, 1065 bp, Schizosaccharomyces pombe
atgagtaaagactacggaactcctcctgagaactggagggaggtttacgatgaaatttgtaaaatgaaagccaaggtcgtagcgcctgtagacgttcagggttgtcatacattaggagaacgtaatgatccaaaaaaatttcgatttcaaacactggtggcattgatgctttctagccaaacaaaagatatagtactgggtcctaccatgcgaaacttaaaagaaaaattagctggaggactttgtttagaagatatccaaaatattgatgaagtttctctaaataaactaatcgagaaagttggttttcataaccgaaaaaccatttatttgaaacaaatggcacgtattttatcagaaaagttccaaggagatattccggacaccgtagaagacctaatgactctcccaggtgtggggcctaaaatgggatatctatgtatgagtattgcatggaataaaactgttggaattggagtagatgttcacgtacatcgtatatgtaatcttcttcattggtgtaatacgaaaactgaagaacagactagagctgctttgcaaagctggctgcctaaggaattatggtttgagctgaaccatacacttgtcggttttgggcaaacaatctgtttaccaagaggaaggcgctgtgatatgtgtactttatcttctaagggcttgtgtcctagcgcctttaaagaaaaaagtggcatcacaataactaagagaaaagtcaaaacgattaaaagagtcaaaaaaagacctgcttctgagtcacctcctctatctccactctcccttcctacagatgatttgtattaccaaagcatcgaagataaatcacttataaaacttgaggacttggaccctgttgatagtatatcacacatgaatgaacctttgaaaaaagaaccagccgctgatattgatgtagatcagaagccacctgtcgcattccattcaactacaaaagaaactaggtcactgcgcaggtcaaagcgagttgcaaaaaaatcatcccagtatttctcccaacaaagtttacaagatattgaagatctggtt

SEQ ID NO: 25801 - DNA, 903 bp, Schizosaccharomyces pombe
atgtcatctctttgtaaaacgcgtttgcaagaagaaaggaaacaatggagaagagatcatccatttgtatgtaaattttagtaaacttgaagaaatcactaacaacttctcttacttagggattctatgcaaaaccttgtaaatcatctgatggaggactcgatttaatgaattggaaggttggaattcccggaaaaccgaaaacgtcttgggaaggcggtttatacaaactcacaatggcttttcctgaaggtatgtattccaaatgaatatcagatatttttcttcaaagcctttaatttgcgctccttagcttggaattttgtttagacattcactacttttttgttcaaactgaattttagctttatcctcacgataaaacatgtcgatatgcatttccttttagctaatcaaaagttcacggcttttcgttttattatttacaaaacatttactaactgcaatcacagaatatccaactcgtccccccaaatgtaagcatataactacgattttttgctaatgcttttgtacaggtaggtttactccaccgttatttcatccaaacgtttatccttctggcaccgtttgtctctcaatacttaatgaagaagaaggctggaaaccggcaattacaattaagcaggtaagaattcaaatcaatttcttaatctccaggttttaaccatttctagattttgctgggtattcaggatcttttagatgatcctaatattgcctctcccgctcaaacagaagcatatacaatgttcaagtaagtatcataactactgtttccacaaccatcaaatataattaacctcgtttagaaaggataaagtcgagtacgaaaaacgagttcgtgctcaggctcgtgaaaatgctccataaactgactgg

SEQ ID NO: 25802 - DNA, 1926 bp, Schizosaccharomyces pombe
gatcttattaatatgcgcagctaccttaatgcttctaatattcctaccgaaggcttttggaatgatatagattacatgagtgaatttcggacttttactgttaacagtaccgcattcccacctaaccagactttagatttctttcgctctttagatgaatctcatcagcattatgtaccagtccttgatcctgcaatatatgcagcaaatcctaataaatctgctgatagaacttactatccttattatagtggttttgaagacaatatttttataaaaaatcctaatgggtctgcttatgttggtatggcttggccaggctttgttgtatatcccgattttacgaatccggcggttcttcaatactggaagcaaggaatacttaatttatctactgcttttggctctaattattcatatgacttaccatttagcggcctttgtttagacatgaatgaaccaacttctttttgtatcggttcatgtgggtccgaccttttgaaactgaatccagttcatccaccattttctctgccaggagatgttgataataaagtttacagttatcccgaggattttaatgctaccaatacgactgagtacaagtctgtttctcgggcttcacagagtcaatataaagccactgcaacttctgaaaaatcacatgaaacaccttcaagtgaatctcttattaacggaaagccggagtttagtatcaactatcctccttatgccttagacacagatactgagactcacgacttggctcaatttggcgttagtcctaatgcaacaatgcacggcaatacattaagatataatttgttcaacacatatggctactcagaaagcaagatctcttttgaggcacttaattcaattcagccaaacattaggcctttccttttgagccgctcaacctttgttggttctggacgatatgccgcacattggcttggtgataataaatcacaatggtccgatatggtttcctctatttcgagtatacttacttttaatttattgggaataccaatggttggagcagatgtttgtgggtataatggtaataccgatgaagagctttgtgcgcgttggatggctttaggagcttttcttccattttatagaaatcataatagtctaggttccattccacaagagccgttcagatgggcttctgtcgctgaggcatctagaagcgctatcgaaatacgctacagtttattgccgtattggtacactttaatgcatacagcttctgtcgatggtacacctatggtgcgtcctttgttctttgaattcccaaaacaaatctcactagcaagtgtggataagcagtttatgattggaactgcattgctgatatccccagcgttagaaccaaacacgacatatattcaaggtatcattcctggagataatgatactatttggtacgattggtataatcattcggtaataaaccatgattacgatgaaaatattactatgagtgcaccacttgggtatgtcaatattgccgttcgtggaggaaatatcattcccttacagcaacccggttatactacatatgagtcgcgcaataatccttatagcttgcttatagctatggataataatgggtttgctagtggtagtttatatattgatgacggaatttcgatgcaaacaaactcatctctctctgtcaaactaaattctaattcaaatacgattacgtgcgtagtatcaggaaccatggtttcgtccccatctttggccaacattacaatccttggtctttcaaacccaccaaatactatactatttaatggtcagcaattaagcgattatcaatattcagaccagactctttcgttaacaaatctactagatttgacagtcgacggtgccttttctaaaaactggactgtaacatggtca

SEQ ID NO: 25803 - DNA, 3237 bp, Schizosaccharomyces pombe
atggggaaaaagggaaaaaaatctggatacgctgattgggaagatgatttaggtgaagatatcagcggtcaaaacgaatacttggacaatacgtctcaagattctcctcaaaatgatgaattggctgagaagtctgaaaacttggctgtttcctcagagaaaaccacgtcaaagaaaaagaaagggaaaaagaacaaaggaaacaaaaaccaggtttctgatgacgagtcccaagagctcgaatctcctcaaggtcccaaagaattaacggcggtgactgaattggatgatgatgagtttgactacaaacccaagaaaggcaaaaaaggaaagaagtcaaagaaggttgaggaagatgatgaacctcaggaaattgaatctcctcaaggacctaaagagctgacggcggtaactgaattggatgatgatgagtttgactacaaacccaagaaaggcaaaaaaggtaaaaaggctcaaaacaataatgagtcggaagctgctgctcctcctgaaattcctgaagttcgtgtaaaaactaaaaaggaaaaggaacgtgagaaaaaagagcgcgaaaaacttcgtaaaaaacagcaacaggctaagaagaaaggtagtacgggcgaggatactttggcttcttctgaagttagctctgaggtcgatatttctacgccggcagaaaatgattcgtctgccaaaggaaaacaggcagctggatcgaagcgtaaaggacctaatgtaacagctctgcaaaagatgttggaggaaaaaagggccagagaggaggaagaacagagaatacgtgaagaagaggcacggatagcagaggaagaaaaacgacttgccgaagtggaagaagccagaaaggaagaagctagactcaaaaagaaagagaaggaaaggaaaaagaaagaagagatgaaggctcaaggaaaataccttagtaaaaagcagaaggaacaacaggctctggctcaacgtcgtcttcaacagatgttggaatctggtgttcgggttgcgggtctctcaaatggtgagaaaaagcaaaaacctgtttacactaataagaagaagtctaatagaagtggtacttcttccatctcttcatctggcatattagaatcctcccctgccacttcaatctcggttgatgaaccacaaaaggattctaaagatgattctgaaaaagtggaaaaagagacagaggttgaacgtaaagaggaaaatgaagctgaagctgaagctgtctttgatgattgggaagcagcattggaggaacctgaggttgcggaaaataatgaagtggtgaccgagaagaaagagacagatataaagtctgacgctgttgaacattctattaaggacaaggaggactccaaaaccgacaaggtagatgatattccacaagccgcacctgctgaatcgaatgtatctgagtctgatcttcgttcaccaatttgttgtattttgggtcatgttgatactggcaaaactaaattgcttgataatcttcgtcgtagtaatgtacaagagggcgaagctggtggtattactcaacaaattggtgccacttattttcctattgagtcaattaagcaaaaaacgaaagttgtcaataagaaaggcaaactacaatacaatatacctggtctgctcatcattgatacacctggtcacgaatcgtttaccaaccttcgttctcgtggtacttcactctgcaacattgccattttagtgattgatattatgcatggtttagagcctcaaacaatcgagtcaattcgactactacgcgatcaaaagacaccattcgttgttgctttgaataaagttgatcgtctttacggttggcattccataaaggacaacgcaatccaagattcactgtctaaacagaagaaggctatccagagggaattcagagatcgtgttgaaagtattatcttacaattaaacgaacaaggtttaaacgccgcattgtacttcgaaaataaaaatttgggtcgttacgtttctcttgttccaacttctgcacagagcggtgagggtgttcctgatttagttgctcttttaatttcgttaacgcagactcgtatgtcagaccgtatcaaatacattactactctcgaatgtaccgtgttggaggttaaagtcattgagggccttggtgctactattgatgttattttgtcaaacggtgtcctacacgaaggtgatcgaattgttctttgtggaatgggtggacctatcattacgaccgttcgagctcttctgacacctcaacctttaaaggaaatgagagttaaatcagcttatgttcatcataaagaaattaaagccgcaatgggtgtaaaaatttgtgctaatgaccttgaaaaggctgtagcaggatctcgtttgttagtcgtcggacctgatgacgatgaagaagatttggcagaagagatcatggaagaccttgaaaatcttctgggaagaattgatacatctggtattggtgtttctgttcaagcttcaacattaggatccttagaagcactacttgagttcctcaaacaaatgaaaattcccgttgcttcagtcaacattggtccagtgtacaaaaaggatgtaatgcgctgtgctactatgctggagaaagctaaggaatatgcattgatgttatgctttgatgtaaaagtagaccgagatgctgaagacttggctgaacagcttggtgtcaaaatattttctgctaatgtcatctatcatttgtttgatgcgttcacggctcaccaaaagaagatccttgagcagaaacgtgaagaaagttctgatgttgcagtgtttccttgtgtattgaagacagttgctgctttcaacaaacgagaccctatcattcttggtgttgatgttgttgaaggtgttcttcgtataaatacccctattgttgctgtgaagcagcttcccaatggagaacctcaaatcatcgaactaggtcgtgtcgcaagccttgaaatgaatcataagcctgtagataaagttaagaaaggtcaagcaggtgcaggagtggcaatgaagcttgaatcgtctggctctcaaatactttttggccgtcaagttacagaaagtgatgctctttattctcacatcactcgtcaaagtatcgattctttgaaagaccctgctttcagagacgaggtttctcgcgatgaatggcaattgattattcaactgaagaaattatttggtattatt

SEQ ID NO: 25804 - DNA, 1809 bp, Schizosaccharomyces pombe
atgaaaataagtgacaaattacttcacccggattggaaggaaaaagttacttacagttatgaattttttcctccaaaaacgagcactggtgtccaaaatctttacaatcgtatagatcgcatgaagacttggggtcgtcccatgtttgtcgatgtgacttggggtgctggtggtacttcttcagaactgactcctggaatcgttaatgtaattcaaacagattttgaagtggatacttgcatgcatttgacttgtacgaacatgtccacagaaatgattgacgcagctttgaaacgggctcatgaaacagggtgtcgtaacatattggcccttagaggtgatcctgttaaagatacagactggactgaaggcgaaagtggattccggtatgcttcagacttagttagatatattcgcacacattataatgatgaattctgtattggtgtagctggctatccagaaggatattcaccagatgatgacattgatgaaagcataaagcatctgaaattaaaagtcgatgaaggtgctgattttatcgttactcaaatgttttatgatgtagacaattttatcgcatgggtcgataaagtgcgtgcagcaggaataaatatccctatatttccgggcattatgcctattcaggcatgggattcctttattcggagagcgaaatggagcggtgttaaaattccccagcattttatggatactctagtcccagttaaagacgatgatgaaggagtccgtgagcgtggtgttgagctcatagtcgaaatgtgccgtaagcttatagctagtggcattacgagacttcatttttacactatgaatttagaaaaggccgttaaaatgattattgaacgattaggtttattagatgaaaacttggctcctatagtggatactaataacgtcgagttaaccaatgcttccagtcaagatcgtcggataaatgaaggtgtacggcccattttctggcgcactcgtaatgaaagttatgtctcgcgtactgatcagtgggacgaattaccgcatggtcgttggggtgactctcgtagccctgcttttggcgaatttgatgctattagatatggtcttcgtatgtctcccaaggagatcacaacatcgtgggggtctcctaaatcttactcggaaatcggcgatttgtttgccaggtactgtgaaaaaaagattagctccctcccttggagtgatcttcccatatccgatgaagccgacttgattcgggatcaacttctaagtatgaatagaaacgctttccttactataaattctcaacctgctcttaacggcgaaaagagttcacatcctgtttttggatggggaccacctaatggttatgttttccaaaaaccatacgttgagtttttcgttcacccctcactcttgaatgaactcaaagaaaccgttaaaaagcttaattcagtttcctactttgttacaaacaagaatggagacttggataccaactcacaatatgagattccaaatgcggttacatggggtgttttccctaatcgtgagattatccaacctactattgtcgagtcaacctcttttcttgcttggaaagatgaagcctattcattgggcatggaatgggctaatgcatatagccctgattcaatttctcgtaaacttttggtttctatgatgaaggaatggttcctttgtgtcatagttgataacgattttcaaaatgggcaatctttgtttgatgtttttaacaaaatgagatctttaaaagacatccatcctgagctatattatgcaaatgcatca

SEQ ID NO: 25805 - DNA, 327 bp, Schizosaccharomyces pombe
atgcagttttgtcctacttgtggaaatcacttaattgtcgcggttgacgaggaaggaaggaatgcgttcgactgtagaacatgtccttatcattttccaatttctacttttctctacagtcgtcacgaatttgcccaaaaggaagttgacgatgtattaggtggagaagaagcttttgaatctaatcagcaaaccgaagtcacttgtgaaaacacaaaatgtgacaataatcgtgcttacttcttccaacttcaaattcgtagtgcagatgaacctatgagtaccttttatcgttgtaccaaatgcaaatttcaatggcgtgagaat

SEQ ID NO: 25806 - DNA, 1211 bp, Schizosaccharomyces pombe
atgcagttaaaccggaagcagttaaagaatcttcataactataaatatagtgcgattgataactcacttctttcaaaatatattttgaagccgtactggtggaatcaacttttgaaggtgattcccatgtctatggcgtatgatctacacccgtttgcttgcttattcttactaactctttacttagacctaatttgattactttgatcgggcttggattcgttgttatcaatatccttactatgcttgtgtacaagtatcattatgagatggatgctttcccatcatgggtgtatgcttcttgggcgattggcctttttctttaccaaagttttgacgctattgatggctcgcaagcgcgtcgtactggcacatcatctccattaggtcaattatttgaccatggagtagacgccatcaatacgagctttgaagttttactgacgattgaactgctgcaactagatatgtttagctcaatccttactcaatttgccagcttattatacttttacatctctacttgggaagaataccatacgggtactttgtacctttcatacttctcgggtcctgtcgaaggaattgtaatggttattggactatttgcccttacagctattaagggtgattctttctggctcaagctacatcccactcccgagtcatggggatttgtacgttcctttctgccatactacacatatggatcatgcttgtacaactttatggcatttgccctgctattgaatgtcttacaaagtttacgaaatgctcttcaagccgtccaaaagaacaacggaagtgtgattaaagcattgagtggtatccttccctatttcctccaatggatggctgtcttttcactctatgccaagtatcctgctttctttgaacatcatttcctcactattttttgcttgaacgcttttatctttgcttattcggttggagtggtaattgtttctcacattaccgaatctcccttcccatactggaatgtgcttattcttccattcttggtggatgccgtggacgcctatacttttggcgtattaaaaaacgttcagacggaatactttttttgctacgttggaatttgcattggtgtttacggcaactttgttgcacatgtcattgccatgattacggaagagtacggcattaaatgtttgactattccatccaaaccagagtccaagaagaattga

SEQ ID NO: 25807 - DNA, 1740 bp, Schizosaccharomyces pombe
atggataagcactttatcaacgatcctgaagtcctcgtccttgatggccttaaatccttggccgacatgaacaaaactttaactgttcatgaagagggaaaattcatctatttccatgactacaacaaaaagaatgtcagtgtcatttccggcggtggtgctggtcatgaacccactcattcttcgttcgtgggcaagggtatgcttactgccgccgtctcaggctccatttttgcttctccttcgtcaaagcaaatttataccggtattaagcaagtcgaatctgaggctggcaccttggtaatttgcaaaaactacaccggtgacatccttcactttggtatggccttggagaagcaaagaacggctggtaagaaggctgaacttattgccgttgcagatgacgtatcagtaggtcgtaagaagagcggtaaggtcggacgtcgtggtttgtctggtactgttcttgttcacaaaatcgctggtgcagctgccgccagagggttacctttggaagccgttacgaccattgctaaggctgctattgacaatttggttagtatcggtgcttcactcgctcacgttcacgtccctggtcatgagccaattgcaaaagaagatgaaatgaaacatgatgaaatggaacttggaatgggtattcacaatgaacctggatgcaagcgtatttcccctattccctctattgatgacctaatcgctcagatgcttaagcaaatgttggatcaatccgacaaggaccgtgcctatgtaaagattgagggtgacgatgaagtagtcttacttatgaataaccttggtggtctttccatgcttgaattcagtgccattagccacaaggtgaaggaagcattggctaaagaatacaaaatcaaccccgttcgcatctttgccggtccatttaccaccagtttgaatggcttgggtttcggtatcactttgctccgtaccactgaccgcgtcaaagtcgagggcgaagaatactctttggttgatttgattgaccaacctgttgaagctatcggatggcctttgtgtcaaccctctgacttgaagtccaaaaacaagattggcaatgtcagcatcgaggagggtcagaaggatgtcaagtctcccgttactgtcgataaggagaaggttcgtcaggcgattgtcaattcgatggagaatctcatcaaagcagagcctaaaattacaaagttcgatacgatggctggtgatggtgactgtggtactactttgaagcgtggtgctgaaggtgttttgaagtttgttaaatccgacaaattctctgacgatcctattcgtattgttcgtgatatcgcagatgttattgaagacaatatggatggtacatctggtgctttgtacgccattttcttccatggctttgcgaagggcatgaaagacaccttggagaagagcaaggacatttcatctaagacatgggctgctggtttgaaggttgctcttgatactcttttcaagtatactcccgctcgtcctggtgacagcactatgtgtgatgctcttgttccatttgtcgaaacatttgttaaaactaatgatcttaatgctgccgtagaggaggctcgtaaaggtgctgatgctactgcagatatgcaagccaaacttggacgtgctgtctacgttggtgatgatgttaaagttcccgatgccggcgctcttggtgtcgttgcaattgtcgaaggatttacgaaa

SEQ ID NO: 25808 - DNA, 1989 bp, Schizosaccharomyces pombe
atgaagaagttccagctatttagcattttaagctactttgtagctttattcctcctacctatggcttttgctagtggtgatgataactctacagaatcatatggaacagttattggtattgatcttggtacaacatactcttgcgttgccgttatgaaaaatggtcgtgtagaaattattgccaacgatcagggtaatcgtattacaccctcatatgtggcctttactgaagacgaacgtttggttggtgaggccgctaagaaccaagctccttccaatcctgaaaacaccatttttgacatcaagcgtcttattggacgtaagtttgacgaaaagacaatggccaaggatattaaatcttttcctttccatattgtaaatgacaagaaccgtcctttggttgaggttaatgtaggtggtaagaagaaaaagtttacccctgaagaaatttcagccatgattcttagtaaaatgaagcaaactgctgaagcttacctcggaaagcctgtcactcacgctgttgttactgtccccgcctacttcaatgacgctcagcgtcaggctaccaaggatgctggtactattgccggcttgaatgttattcgtatcgtcaatgagcctactgcggctgctattgcctacggattagacaaaactgatacagagaagcatattgttgtttatgatttaggtggtggtacttttgacgtttctcttttgtctattgacaatggtgttttcgaagttttggctacttcaggtgatacccatctcggtggtgaggactttgacaaccgtgttatcaactacttagcccgtacttacaaccgcaagaacaatgtcgatgttactaaggatcttaaggctatgggaaaactcaagcgtgaagttgaaaaagccaagcgtactttgtcctcccaaaagtctgttcgtatcgagattgaatctttctttaacggtcaagacttttctgaaactttatcccgtgctaagttcgaggagattaacatggatctcttcaagaagactttgaagcctgttgagcaagtattaaaggactccaacctcaagaaatccgagattgatgatatcgttcttgtcggtggttctactcgtatccctaaggttcaagaacttttggagagcttctttggtaagaaggcttctaagggtatcaatcccgatgaggctgttgcctatggtgctgctgttcaagccggcgttttatctggcgaggaaggaagtgataacattgtcctcttggacgttatccctcttactttaggtattgagactaccggtggtgttatgactaaacttatcggtcgtaacactcctattcctactcgtaagtcgcaaattttctctactgcggttgacaatcaaaatactgttttaattcaagtctatgaaggtgaacgtactcttactaaggacaacaaccttcttggaaaatttgaccttcgtggtattcctcctgcccctcgtggtgttccccaaattgaagtcacgtttgaagtcgatgccaatggtgttttgactgtttcagccgtcgacaagtctggtaagggtaagcctgagaagcttgttatcaagaatgacaaaggtcgtttgtctgaggaagatatcgagcgcatggttaaggaggccgaagaattcgctgaagaagataagattttgaaggagcgtattgaagctcgtaatactcttgaaaactacgcctattctttgaaaggtcaatttgacgatgatgagcaattaggtggtaaggttgatcccgaagataagcaagctgttttggacgctgtcgaagatgttgctgaatggcttgaaatccacggagaagatgccagcaaggaagaatttgaagatcagcgtcaaaaactcgatgccgttgttcatcctattacccaaaagttgtattccgaaggagctggtgatgctgatgaagaggatgatgattacttcgatgatgaggccgatgaactt

SEQ ID NO: 25809 - DNA, 1452 bp, Schizosaccharomyces pombe
tatgatggtaaggctgttttggcctattggttgaacagatcgcctagcatctcgaaagaggaatataagactgtttctgccactcctgcggtgcaacttgctcaaattcagtttcctctccctaccttggtgatccctgcagaatctactacttacagagaagttgtcgaagacgttttcgccaaggtagagcaagaacacccttgggtcaaggaaaccaagttggttgctaaacctgatcaacttattaaacgtcgtggtaaaagcggtcttttgaagttgaatgccacttgggatgaagccaaggaatggatcagagaacgtgcaggaaaaaatcaaaaagttcagcatgctgtaggatatttaactactttcctggttgagccttttgttccccatcctcccaacactgagtattatatcaatattaactcagttcgtgaaggtgattggatattgttttgcaacgaaggtggtgttgatgttggcgacgttgacgctaaggctaggaagctattggtacctgttcgccttagcgagttcccatctcgtgcaaccattgcttccactcttctatctgatattcccgttgaacaacatgaatcccttgttgatttcatcattcgcctttattcagtgtatgtggattgccagtttacctacttggaaatcaatcccttggttgttatccccactgccaaaggtgccgatgtcttttacttggatttggccgccaagcttgatcaaaccgcagagtttgagtgtggtgccaaatgggcagtcgctcgtgctcctgagtctctcggcattaaaacatctggtgaagaatctggagctattaatgctgatcatggacctccaatggtcttccctgctccatttggtcgtgaactgagtaaagaagaagcttatgtacaaggacttgatgccaagactggtgcttctcttaagctcactatcttgaatgccgaaggccgtgtttggaacttggtggctggtggtggtgcctcagttgtttatgctgatgctgttgctgttaatggtgctgccgatgagttggctaactacggtgaatatagtggtgctcctactgacggccaaacttatgaatatgccaagactgtgctcgacttgatgactcgtggtgaacctcgcgctgatggtaaagtattgttcattggtggtggtattgccaactttacctcacctgctgtcacattccgtgccattgctcgcgccttgggtgactacaaagacaaattgcacgcacataaagtctccatctgggttcgtcgtgccggacctaattatcaagaaggtcttcgtgtgatccgcgaggctggcaaaaagttcgatcttccattgaaggtgtacggaccagagtgccacatcagtggtattgtacctatgggtttgggtaaggcacctgtggaagctgaatggcagatggct

SEQ ID NO: 25810 - DNA, 783 bp, Schizosaccharomyces pombe
atggtcgctcctgctcataattacgagtctcgcaatatcttagatctcctttcattaaagggaaaaaatgctgtcgtctttggcggtgcccgtggtattggtcacgctatctgctcagtgtttgctgaagctggcgccaatgcctttatcgtctataacaccactcctggcgaaaaggctgcaaaggaaattgcccaggctaatggtgtcaagacttatacatgcaagtgcgatgtcactattcctaaagaggtagaacatgcctttgctgagattcaaaaggtctttgatactattgatatcgttgtgcccaacaacggtatttgcactggcaagtccgccattgacatgacttacgaagaatttgctaatgaaataaacgtcaacttgctcggtgtcttcaacgtcgctcacaatgctggccccatcttccaaaagcaaggccatggcagccttgtagctactgcttccatgtctggtgttgttgttaacgttcctcaacaacaatgtgcttacaacacttccaaggccggtgtcattcaactcatcaagagtttggcagtcgaatggcgcaaatttgctcgcgtcaactgcgtttctcccggttacactactagtgacatgactggtggtaagttccacaaggaatgggagccttatactcctttcgagcgtaatggtttggctaaagagattgcttccgcttatctttatcttgctagtgatgctgcttcatacgcttccggtaccaacttaatcgttgatggtggatataccagcatc

SEQ ID NO: 25811 - DNA, 1072 bp, Schizosaccharomyces pombe
atggctgctaaacacgtaaaatacatggcttgtctattcgatatggatgtatgtttatttttcacaccacattacctcttatgaaagcttttgcattaacaatcactctttttacagggtctacttgtcgacagtgaaactatttatacaaagacgaccagtatgtaaataatatatctgtgcttatatttagcacaaaactacaatgttttctaatctttattttttttatagatcttatattggacaggtatggcaaggatcctcttcctatttctgttaaggctcaaatgatgggtatgttatataaagctagcgaagagatattttaaaatgctttcaaaattgcaggtctaacttgcgatacgtagggagaccgggttccgcagctgccaaggttgttatagattggtccaacattcctatgactcctcaacaattcgttgatgaacaacaggttattcgggtacgtacttatacgctacatttatttccatttcaactaactttctgaaaggcaaagttttggtcgtctttgaagcctatgcctggggctgaatctttgattaataacctctccaatcatggaattgatatcggggtatgtactcatccctacgctataataaaagtgtgctaacagcatcaccagcttgctacttcctctaataccgcaaattataatatgaagacagcccatcttaaacatatttttgagaaatttggtaaaaatgttattacaggtgataatcctagtattgcacctggtcgtggcaaaccttttccagacatttggctgaaggtgttgaatttaataaatgaaagtaggaagcagcgaggtttgaaggcacttacaccaagccaatgcattgcctttgaagacagtattcccggtgtcaaaagtgcaaaggctgcaggaatgcatgtcatttgggttccagatgctgccatcaaaaacttggtaggggatcagctgaatgagattgttgattctcaatgtgagacgttaccgagtctttcagagtttgatataaacaaatatcttaacataaattcaaagcaggcctagagg

SEQ ID NO: 25812 - DNA, 846 bp, Schizosaccharomyces pombe
atgtcagaaaattactcgttttctttgcgtaaatttaagttggtttttctcggtgagcagtcagttggcaaaacatcgttaattacacgatttatgtacgatcagtttgataatacttatcaagtaagtaactataattaaaacttctttactaacagggtccaaggctactattggtatagactttctaagcaagactatgtatttggaagatcgaacggttcgtcttcaactatgggatactgctggtcaagaacgtttccgttctttaattccttcgtatattagggattcttctgttgctattattgtttacgatatcactagtaagtaatagtggcacagtaattttgccatatatttttactcagactttattttcgaatatctgctaactacttatagaccataactcttttgtaaatactgagaaatggattgaagatgttcgtgctgagcggggagacgacgttataattgttctcgttggtaataaaacggacttggctgataaaaggtatgacactccagctaacagagattcagcatttacaatgcgacatctcttcattcataattccaaagctatattttggtttttgatggttcttatgctaacggtggtttaggcaagtgactcaagaagaaggagaaaaaaaggcaaaagaattaaaaataatgcacatggaaactagtgctaaagcgggtcacaatgtaaaactgttgtttaggaaaattgcacaaatgttaccaggcatggagaatgtggaaacacaaagcactcaaatgattgacgttagcattcagcctaacgagaatgaaagcagctgcaattgctagtgtatc

SEQ ID NO: 25813 - DNA, 2154 bp, Schizosaccharomyces pombe
aagtgtaagattatggccatggatgatttccctatcgaggagttaggcaatgagaagaatgtcgtagtcttggttagtacagctggtcaaggtgagtttcctcaaaatggacgtgagttttgggaagcaatcaaaggtgcagatcttaacttgagcgaattgaagtatggtgtatttggttttggcgattatgaatattggcctcgtaaggaagataaaatttattataaccgcccaggtaagcaattagatgctcgctttgttgaattgggtgctgctccattggtaaccttaggacttggtaatgaccaggatccagatggatgggaaacagcatataacctttgggagcctgagctttggaaagctcttggattggacaatgtcgaaattgatattgatgaacctaagcctatcactaatgaagacattaaacaagcttcgaactttttgcgtggtaccatttttgaaggattggccgatgaaagtactggtgctttggccgaaagtgactgtcaacttaccaaattccatggtatttatatgcaagatgatcgtgacattcgtgatgagcgtaaaaaacaaggtttggaacctgcttatggtttcatgattcgcgccagaatgcctgctggtgtctgtacaccagaacaatggattgctatggatgatatttctacgaaatggggtaatcacacccttaagattacgactcgtcaaacgttccaatggcatggtgttttgaagaagaatttgcgtaataccattcgtaacatcgttaaagttttccttactactcttggtgcttgtggtgatgttgctcgtaatgtcacttgttcgtcgactcccaacaatgaaacaattcacgatcaactgtttgctgtatctaagcaaatcagtaatgaattgcttcctactacatcctcttatcatgaaatttggatcgaggaccccgaaactgtcgaaaagagaaaggttgccggtgaggccgttcaggatgtcgagcctttatatggtcctacatatctgcccagaaaattcaaggttggtgtggctgctcccccttacaatgatgtcgatgtttataccaatgatgttgctttaatcgccatcattgaaaatgacaaagtcctaggtttcaatgttggtattggtggtggtatgggcacaacccataacaacaagaaaacatatcctcgtttggctacagttgttggctatgttctaactgataagattatggaggtggttaaagctattttgattgtccagcgtgataacggtgatcgtgaaaatcgtaagcacgctcgtcttaagtataccgttgatactcttggtgtttctaccttcgtcgagaaggtcgaggaggttttgggttacaaatttgaagaggcacgtgatcatccccaattcattaaaaaccacgatgacttcgaaggctggcacaagacagagaaaaacaaatactggcgttctatatttgttgaaaacggtcgtattgagaacaatggtattttacagtttaagaccggtttgcgtgaactcgcagaacgtctatatactgaaaaatctgaggctgaattccgtttgactgccaaccagcatgtcatcttatttaatgttgctgaaaatgagctcggttggattaatgagcatatggccaaatataaacttgataataatgcattctctggcttacgtctttcttctgcagcctgcgttgctctccctacttgtggtttagccatggctgaaagtgaacgttatcttcccaagttgattacgaaagtagaagaaattgtttacgaagctggtcttcagaaagatagtattgttatgcgtatgactggttgtccaaatggatgctctcgtccatgggttgctgaaattgcgtgtgtcggtaaggcaccaaatacttacaatctaatgcttggtggaggattttacggtcagagattaaacaagctatatcgctcttccgttcaagaaaaagaaatcctcaatttgttgcgtccgcttatcaagcgttacgccttggagcgtgaagatggtgaacactttggtgattgggttattcgtgcaggtatcattacagctgttgaaaatggaggagctaatggtgctgttcatgaaggggtatcacctgaagcgttt

SEQ ID NO: 25814 - DNA, 3560 bp, Schizosaccharomyces pombe
atggacgatctgaaagaattggagtatttatccttggtatctaaagttgcctctgaaattcgaaatcatactggtaagtagtaggctttaatactcatttttttataaataattaaccaaatctaggaattgacgataatactcttgcagaatttattattaatttgcatgatcagtctaagaattacgatgagtttaaaaataatgtcctttcatgtggaggagaattcaccgacagtttccttcaaaacataagtcgattaattaaggaaattaagcctaaagatgacattcccactgataatgtaaataatggtagtaactcggtcaatggagcttcgcatgatttagatagcaaagatgttgacaaacaacaccaaagaaagatgtttcctggcttaagcatcccaaatagcacgaataatttaagggatagaccagcgcttatggataatgctatggacgagctggaagaactttcgacgttggccaaaacaaggagaaacgatagggattctaggagggatgagcggcattacctcaatggaataagggaacgtagagagagatcaattagtcccagtttttcgcatcattcacgtacctcaatttctggtcaatcacattctagtcgatcatcgcgtggtccattgctaaatgctccaacattgtatggaatttattctggtgttgtctcaggtattaaggactttggtgcctttgtaactttggacggctttagaaagagaactgatggtttggttcatatctcaaatatccaattaaatgggagattggatcatccttcagaggctgttagctatggacaacctgtatttgtaaaagttattagaattgatgaatcagcaaagcgaatcagcctgtcaatgaaggaggtgaatcaagttacaggtgaggatttgaatccggatcaagtttcacgttctacaaagaagggtagtggagcaaacgctattccattatcagcccaaaattctgaaattggacatgtgaatccacttgaaacgttcacttcaaacggtcggaagcgtttaacatcacctgaaatatgggagttacagcaacttgctgcatccggtgcaatttccgctacggatattcctgaactcaacgatggattcaatactaataatgctgcggaaattaatcccgaagatgatgaagacgtagaaatcgaacttcgtgaagaagaacctggatttctcgcaggacaaaccaaagtttcattaaagctatctcctataaaagttgtaaaggccccggatggttcattgtccagagcagcaatgcaagggcagattttagcaaatgatagacgagaaataagacaaaaggaggcaaaattaaagagtgaacaagaaatggaaaagcaagacttatccctctcatggcaagacactatgtcgaatcctcaggatcggaaatttgcccaagatgtgcgagactcagctgctcgtcaacttacttctgaaactcccagctggcgtcaagcaacacgaaatgcaaatatatcctacggtaaaagaacaacactgagcatgaaagagcaaagagagggtcttccagtttttaaacttcgtaaacagtttctcgaggctgtctcaaaaaaccaaattttggttctactcggtgaaaccggttccggtaagaccactcaaatcactcaatatcttgctgaagaaggttataccagtgatagcaaaatgataggttgtactcaacctaggcgtgtagctgcaatgtctgttgccaaacgtgtagcagaagaagtgggatgtcgtgttggtgaagaggttggttacactattcgtttcgaagataagaccagtagaatgacccaaattaaatatatgactgatggtatgcttcaacgagaatgtttagttgatcctcttttgtccaaatattctgtaattattttagatgaagcacatgaaagaaccgttgcaactgatgtactttttggactgttaaagggaactgttttgaaacggccagatttaaagctaattgttacttcagccacgctagatgctgagcggttttcgtcttatttctataaatgcccaatttttacgattcctgggcgttcatatcccgtcgaaatcatgtatacaaaacaaccagaagccgactatcttgatgctgctttgatgactgttatgcaaatccacttgagcgaaggacctggtgatatattagtatttctgacaggtcaagaagaaattgatactagttgtgaaatattatatgaaagaagtaaaatgctaggagattcgattcctgagctagttattttacctgtttattcagcgcttccttcggaaatacaaagtcgtatttttgaacctgctcccccaggaggtcgtaaggtagtaattgcaaccaacattgctgaaactagtttaacaattgatggaatttattatgtggtggaccctgggtttgtcaagcagagctgctttgatccaaaactaggcatggattctctaatagttacgccaatttctcaagcacaagctaggcaaagaagtggtcgtgcagggcgtacaggacccggaaaatgttatcgtctgtatactgaaagcgcttaccgaaacgaaatgttgccttccccgattcctgagatacaacgccaaaatttgtcgcatactattttgatgttaaaggcaatgggaattaacgaccttttgaattttgattttatggatcctccacctgctcaaaccatgatagccgccttgcaaaatctgtatgcactgtcggccttggacgatgagggattgctgactcctcttgggcgaaaaatggcagatttcccgatggagcctcaattgtcaaaagtattgattactagcgtagaattaggttgctctgaagaaatgttgagtattattgccatgcttagcgtacctaacatttggagccgaccaagggagaagcagcaagaagctgatcgacaacgagcacaatttgcaaatcctgagagtgatcacttaaccttacttaatgtgtatacgacttggaaaatgaatcgttgctcagataattggtgttatgaacattatatccaagcccgtggtatgcgtcgagctgaagatgtacgcaaacagcttattcgcctaatggatcggtatcgacacccagttgtttcatgtggaagaaagagagaacttattttacgggctttgtgttctggctactttaccaatgttgccaagcgagactctcacgagggatgttacaaaacgatcgtggagaatgctcctgtatacatgcatcctagtggagttttatttggaaaagctgcagagtgggtgatataccatgaactgattcaaacgtcaaaagaatacatgcacacggtaagcacagtgaatccaaaatggcttgtggaagttgcaccaacattctttaaatttgccaatgcaaatcaagtttccaaaaccaagaaaaatctcaaggtgctaccattgtacaatcgatttgaaaaacccgatgagtggaggatttcaaagcaacgaaagggaggtcgttaa

SEQ ID NO: 25815 - DNA, 3570 bp, Schizosaccharomyces pombe
aagattgttattcaagggtttaaatcttataaagattatactgtaatagagcctttaagccctcaccacaatgtaattgtgggacgaaatggatctggtaaaagcaatttttttgctgcaattcgattcgtattaagtgatgcgtatacacatttaagccgtgaagaaagacaagctttgctgcatgaaggccctggtgcaactgtcatgagcgcatacgttgaagttacgttcgctaatgctgataatcgatttcccaccggtaaaagcgaagttgtcttgcgtcgtacaattggattgaaaaaagacgaatactctttggataagaaaactgtaagcaagacagaggttattaatcttctcgagtctgctgggttttcaagatccaatccttactacattgttcctcaaggaagggtcacatccctaaccaatgcaaaggattcagagcgtttagaacttttaaaagaggttgcaggtactcaaatttatgagaacagaagagctgaatccaataaaattatggacgagacaattcaaaaatcggagaaaattgatgaacttttgcaatacattgaagaacggttgcgtgagttagaagaggagaaaaacgatcttgcagtttatcacaaaaaagacaacgaaagaagatgcttggaatatgctatttattctcgcgagcatgatgagattaactccgtattggatgccttagaacaagaccggatagctgcacttgagcgtaatgatgatgattcgggtgctttcattcaaagagaggaacgcattgaacgaattaaggctgaaattacagagctcaaccactcgcttgagcttttacgtgttgaaaaacagcaaaacgatgaggattataccaatattatgaaaagtaaagtcgcattggaattacagtcttctcaattatcacgtcaaattgaattttcgaagaaagatgagagctcaaagctcaacatactttctgaattagagtcaaaaatctctgagaaagaaaatgagctttcagaaattcttccaaagtataacgctatagtatctgaagctgatgatcttaataaaagaatcatgctgctcaaaaatcagaagcaatcacttttggacaagcaatcgaggacttctcaattcactaccaaaaaagaacgtgatgaatggatcagaaatcagctcttacagatcaaccgtaacattaattctacaaaggagaacagtgattacttgaagactgagtatgacgaaatggaaaatgaactcaaagcaaaattatctcgtaaaaaggaaattgaaatttcccttgaatctcaaggtgatcgaatgtcgcaactacttgctaacattacttcaattaatgaaaggaaagaaaatttgacggacaaaaggaaatctctgtggagagaagaagccaaacttaagtcgtctatcgaaaatgttaaggacgatctttctcgttctgagaaggctttggggactacaatggatcggaatacaagtaatggtattagagctgtcaaagacattgctgaacgtctgaaactcgaaggttactatggtccactttgtgagcttttcaaggttgataaccgtttcaaggtcgctgttgaggctactgctgggaacagtctatttcatatcgtggtagataacgatgaaaccgcaactcaaattcttgacgttatatataaagaaaatgccggtagagttacgttcatgcctttgaacaagcttcgtccaaaggcggttacttatcctgatgccagtgatgctttacctttaattcaatatttagagttcgatcccaagtttgatgctgcgattaaacaagttttttcgaaaaccattgtttgtccatcgattgagaccgcctcccagtatgctcgatctcatcaattaaacggtattactttaagtggtgatcgatctgacaaaaaaggtgcattaactgccgggtatcgtgattatagaaattccaggctggatgctatcaaaaacgttaaaacataccagatcaaattctcggatttacaagaaagtttggagaaatgtcgttccgaaattgaatcttttgaccaaaaaattactgcatgcttagatgatttgcaaaaggctcaactaagtttaaagcaatttgaaagagatcatattcctcttaaagatgaactcgtaactattactggagaaacaacagatcttcaagaatcaatgcatcataaaagtcgtatgcttgagcttgttgttttggaactacatacacttgaacaacaagctaatgacttgaaatctgaattaagttcagaaatggatgaacttgatcccaaagatgtggaagcactaaagtctttgagtggtcaaattgaaaatctctctcatgagtttgatgccatcattaaagaacgagcacatatagaagcaagaaagacggctcttgaatatgaattaaatacaaacttatatttaagaaggaatccattgaaagctgaaattggttctgataacagaatagacgaatcagaattgaacagcgtaaagagatctctacttaagtatgaaaacaaattgcaaattattaaatcttcatcttctgggttggaggaacaaatgcaaagaatcaattctgaaataagcgataaacgaaatgaattggaatcgctagaagaattgcagcacgaagtggctacccgaattgaacaagatgcaaaaattaacgaaagaaacgcagcaaagagaagtttgcttctcgcacggaaaaaagaatgtaacgagaaaattaaatcattgggggttttgccggaagaagcatttattaaatatgtttcaactagctcaaatgctattgtgaagaaacttcataaaatcaacgaagcccttaaagattatggaagcgttaataagaaagcatatgagcaatttaataattttactaaacaacgcgattcattgttggctaggagagaagagttgcgtcgttctcaggagtcaattagtgagcttacgacagtacttgaccaaagaaaagatgaagcaattgagcgtacctttaaacaagttgctaaaagcttttctgaaatattcgttaaacttgttccggcaggtagaggtgaattggttatgaatagaagaagtgaattgagtcaaagcatcgaacaagacatctccatggacattgatacgccatcccagaaaagctcgatcgacaattatacaggtatcagcataagagtttcttttaacagtaaggatgatgaacaactgaatattaatcaattgagtggcggtcagaagtcactttgtgctttaactttaatttttgctatccaacgctgtgatcctgcgccttttaatatactcgatgaatgtgatgctaatttagatgcacaatatcgctcggccattgcagcgatggtcaaagagatgtcaaaaactagtcaatttatttgcactacttttcggcctgagatggtgaaagttgcggacaatttttacggagtaatgtttaatcacaaagtttcaacagttgagtcgatttctaaggaggaggctatggcattcgttgaagga

SEQ ID NO: 25816 - DNA, 1227 bp, Schizosaccharomyces pombe
atgtcagactacgggtttgcaaatattgaggaagctaaggcagatgcaatttttaaattaaatgctcaataccatcaggatgaagatcccaagaaggttaacatgagtgttggcgcctatcgtgacgatactggtaagccttggattttgcctgcagttaaaaaagcatctaaaatagtggaagaacaggcaagcttcaaccatgaatatttaccaattgctggattgcctcgtttcactaaggctgcggctgaagttcttttcagacccaatcctcatttattgtccgaggaccgtgttgcatctatgcagtcagtctctggtactggtgccaattttcttgctgctagtttcattgagactttctatgtaaagcacactggagcccatgtatacatctccaaccctacttggcctgtccatcgcactttgtgggaaaaattgggagtcactgtagatacatatccttattgggatgccaagaatagatcttttgattacgaaggcatgctaagtaccattaaatctgctcccgaaggaagtatatttttacttcatgcttgtgctcacaatcctactggtattgaccccactagggaacaatggctttctatattcgagagtctgctttctcgcaagcatctggtagtttttgacattgcttatcaaggttttgccagtggtgatctgaatcgtgactcttgggctctaaacgagtttgtcaaatataacaaggactttttcgtttgtcagtcatttgctaaaaatatgggtctttatggtgaacgtactggttgcatgcattacgttgcaaaggacgcttccactaaaaacaaggtcttatctcaattgtgtattgttcaacgtaacaccatttctaaccctcccgcttacggtgcacgtattgctgccgaaattcttaacagtcctcaattgtttgctgaatgggaacaagatttaaagactatgtcttctagaatcattgagatgaggaaacgtcttcgcgattctcttgttgcactcaaaacccccggttcttgggatcatattacacaacaaattggaatgttttcttttaccggtttaacgcctgcacaagtccaattttgccaggagcggtaccatctttatttcagtgcaaatggtcgtatttctatggctggtttgaacaattctaatgtagagcatgttgcacaggcatttaaccatgctgttcgcgagttgcct

SEQ ID NO: 25817 - DNA, 6723 bp, Schizosaccharomyces pombe
aaccatattttaggaggcaattccttagataaagcacctgcaggaaaggtgaaagattatattgcatcacacggaggacacactgttatcacgtctattcttattgctaataatggtattgcggccgtgaaagaaatccgaagcattcggaaatgggcttatgaaaccttcaataatgaaagagctatcaagtttactgttatggcaacgccagatgatttaaaagttaatgccgattatattcgtatggccgatcagtatgtcgaagtacctggcggctcaaataacaataattatgctaatgtcgaacttatcgttgacattgctgaacgtatgaacgtccatgctgtttgggctggttggggacacgcatctgaaaaccctaaattgcctgagatgctttctgccagtagtaagaaaatcgtttttattggtcctccaggtagcgcaatgcgtagtcttggtgacaaaattagttctacaatcgttgctcaaagtgctcgtgtaccttgtatgtcttggtccggtaatgaactcgaccaagtacgtattgatgaagagacaaacattgttactgttgacgatgatgtttatcaaaaagcctgtattcgctctgcagaagaaggtattgccgtcgccgagaagattggttatcccgtcatgattaaggcctctgaaggcggtggtggtaaaggtattcgtcaggttacttcaaccgaaaagtttgctcaagcattccaacaagtacttgatgaactccctggatctcccgtttttgttatgaaacttgctggacaagcacgccatttggaagttcaaattttagctgatcaatatggtaataatatttctctttttggtcgtgattgttccgttcaacgccgtcatcaaaaaattattgaggaggctcctgttaccatcgcacctgccgctaccttccatgaaatggagcgtgccgccgtgcgtttaggtgaattggtcggttacgcttctgctggtaccattgagtatctttatgagccagagaatgacaggttctatttccttgaactgaaccctcgtttacaggtcgagcatccaactaccgaaatggtttctggcgttaatttacccgctgcacaacttcaagttgctatgggtttgcctcttagtcgtattccacacattcgtgagctctatggcttaccacgtgatggtgactctgaaatcgattttttctttcaaaatcccgaatcttttaaagtacagaaggtccctactcctaaaggccattgtgttgcctgtcgtattacgtctgaagatcccggcgaaggatttaaaccatcgagcggtatgattaaagatctcaactttcgttcttctagcaatgtgtggggttatttctctgttggtactgctggtggaattcatgagtttgcggattcccaattcggtcatattttttcatttgcagaatctcgtgaatcctctcgcaaatcgatggtggttgcgttaaaagaattatctattcgtggtgattttagaactactgtcgaatatctcgtgcgtctccttgaaactaaggagttttctgaaaatgagtttaccacaggatggctagatcggcttattgcacaaaaagttacatctgctcgtcccgacaagatgcttgctgttgtatgtggtgctcttgtccgtgctcatgctactgccgatactcagtaccgtgctttcaaatcctaccttgaacgcggtcaagtaccgtcccgtgaatttttgaaaaatgtgtatgatattgaatttatttatgataacactcgctatcgttttaccgcatctcgttcttctccaggctcttatcatttgtttttaaatggttctcgttgtactgctggtgtccgttctttgactgatggtggattgttagttttgctaaacggacattcctatacagtatactatcgtgatgaggtaactggtactcgtatatctatcgataacctttcttgtatgctggaacaagaaaatgatcctactcaattaagaactccttcccctggcaagttggttcgtttcttggttgaaacaggtgagcatattaaagccggtgaagcgtatgcagaggtagaagttatgaaaatgattatgcctttagtagcaaccgaagatggtgttgttcaattgataaagcaacccggtgcatctttagacgccggtgatattcttggaatactcacgcttgatgatcctagccgtgtcacccatgcattaccatttgatggtcagcttcctaattggggtgagcctcaaattgcgggaaataagccttgtcaacgctatcatgctcttttgtgtattcttttggacattctaaagggatatgataaccaaatcattctcaacagtacctacaatgaatttgttgaagtccttcgtaatcatgaattgccctatagcgaatggagtgctcattattcagcattggttaatagaatctctcctgtacttgataagctttttgtatctataatcgaaaaagccagatctcgtaaagctgaatttcctgccaaacagcttgaggttgctattcagacttattgtgatggtcaaaatttggcgacgactcaacaattaaaggtccaaattgcacctctccttaaaatcatatctgactacaaagacggcctcaaagttcatgaatacaatgttattaaaggtttgctcgaagaatattataatgttgaaaagttgttctctggaattaataagcgagaagaagatgttattcttcgtctacgtgacgaaaataaagatgatgttgataaagttattgcgttggctttatctcattctcgtataggatctaagaataacttgttaattacaattcttgatctaatgaagtccgaaccatcaacttttgtttctctgtactttaatgacattttgaggaagcttacagatttggattcaagggttacttctaaagtgtctctaaaggctcgtgagttgttaattacatgtgctatgccttctcttaatgagcgattctctcaaatggagcacatattgaaatcgtctgtagttgaaagtcattatggtgatgctaaattctcacaccgtacaccatctttagacattctgaaagaattgattgattctaaatatacagtctttgatgttttacctgctttcttttgtcacaccgacccatgggtatctttagctgctcttgaggtatatgttagacgtgcttatcgtgcctactctgttcttgaaatcaactatcataccgaggccggaactccgtatgtactcacgtggcgttttcagcttcattcaagtggtgctccgggtttgggtgccaactcaactaatggttccaatttccctgcaagcactactccttcatacgaaaacagcaatcgacgcctgcagtctgttagtgatctttcttggtatgtcaataaaacagactctgagccattccgttttggtacaatgattgccgcagaaactttcgatgaattggaaaataaccttgcccttgcaatcgaccgtttaccactttctcgtaattactttaatgctggtttaacgttggatggcaattcttcttcagctaacgataacactcaagaattaactaatgtagtgaacgttgcgttaacctcaactggtgatttggatgattctgctattgttagcaagcttaaccaaatccttagtgatttccgtgatgatttgcttgagcataatgttagaagagtgacaattgttggtggcagaattaacaagtctgcttatccttcctactatacttatcgtgtttccgctgaacaaaaagacggcaatcttgtacactataacgaagatgagcgtattcgtcatattgaacctgcattggcattccaattagaattgggtcgtctatcgaacttcaatattgaacccgttttcaccgataatcataacattcatgtttatcgtgctaccgccaaaaatatggatacagataagcgattctttactcgtgcattagttagaccaggaagattacgtgacgagatacctactgctgagtatcttatatccgaaacccatcgtttaattaatgatattttggatgctttggaagttatcggtcatgaacaaacagacttgaatcatattttcattaactttacaccagcctttggtcttgctcctaagcaagttgaagctgccctcggcggatttttggaacgttttggccgtcgtttatggcgcttgagagtaactgcagctgaaattcgtattatttgcacggacccatcaactaacactttgtttcctcttcgtgtcattatttctaatgtttctggatttgttgtgaacgttgaaatttatgctgaagtcaagactgagaataattcttggatatttaagagtatcggacaacctggatccatgcatcttcgccccatcagtacaccttatcctaccaaagaatggcttcaacctcgtcgttacaaagctcaattaatgggcactactttcgtttatgacttcccagaattattccgtcgcgccttcaccgatagctggaaaaaggttccaaatgggcgatccaaagttactataccccagaatatgtttgaatgtaaggagcttgttgctgacgaacatggtgtattacaggaagtcaatagggagcctggaactaactcctgtggtatggtagcatggtgcattactgttaagacgcctgaatatcctaatggacgaaaaattatcgtagtggctaacgacatcactttccaaattggttcttttgggccccaagaggatgaatacttttataaagttactcaattggcacgtcaacgcggtattcctcgtatttacctcgctgccaattccggtgcacgtattggagttgctgatgaaatcgtccctcttttcaatattgcttgggtcgatcccgatagtccagaaaagggttttgattatatctatcttactccagaggcatatgagcgtcttcagaaagaaaatcccaatattctcaccactgaggaggttgttactgaaactggggaacttcgccataagattaccacaatcattggctcaagcgagggtcttggtgttgaatgtttgcgtggatccggtctgattgctggtgtcacatctcgcgcatacaatgacatttttacatgtactttggtcacttgtcgtgctgttggtattggcgcgtacttggttcgtctcggccaaagagctgtacaaatcgaaggccaaccaattattctaacaggtgcacccgcccttaacaaggttttaggccgtgaggtctatacctccaacttgcaattaggtggtactcaagttatgcatagaaatggtatatcccatcttactagtcaagatgattttgatggcatttcgaaaattgtaaactggatttcctatatccccgataaacgtaacaatccagtaccaatttcaccatcatcagatacatgggatcgtgatgtggagttctatccttctcaaaatggttacgatcctcgttggttaattgccggaaaggaagatgaagattctttcttgtatggtttatttgacaaaggatctttccaggaaactttgaatggctgggccaagactgttgttgttggtcgtgctagaatgggcggaattcctactggtgtgattgctgtcgagactcgtactattgaaaacactgtaccggctgatccagctaaccctgactctactgaacaagtattaatggaggctggtcaagtttggtatcccaactcagccttcaagactgctcaagcaatcaatgacttcaaccatggtgaacagttacctctttttattcttgctaattggcgtggattttctggtggtcaacgtgatatgtttaatgaggtactcaaatatggttcttatatcgtagatgctttggcttcttataaacaacctgtatttgtatacattcctccattcagtgaacttagaggtggctcttgggttgtagtagatccaaccatcaatgaggatcaaatggaaatgtacgcagatgaagagagtagagctggtgttttggaacctgaaggtatggtcagtattaaattcagacgtgaaaagttgctttctttgatgcgacgctgtgatcataaatatgcatcattgtgcaatgagcttaaaagagatgatttgagtgctgatgacctttcaactataaaggtcaagttgatggaacgcgaacagaagcttatgccaatttatcaacaaattagtattcattttgccgacttgcatgatcgtgttggtcgtatggttgcaaagaaggttgtccgtaaaccgttgaaatggacagaagctagacgtttcttttactggcgtctccgcagacgtttgaatgaacattatgctcttcaaaagattacccagctcattccttccttgactatccgtgaatctcgtgagtatctccagaaatggtatgaagagtggtgtggaaagcaagattgggatgaatctgataagtctgttgtttgttggattgaggaacataacgacgatttgagtaagagaactcaggaacttaagagtacttattacagtgagcgtctttctaaactccttcgttcagataggaagggaatgatagacagccttgcacaagttttgaccgagctcgacgaaaatgaaaagaaagaattggccggaaaactcgcgtcggttaat

SEQ ID NO: 25818 - DNA, 1296 bp, Schizosaccharomyces pombe
gatcgtgaagtcgatgttggtattcctgatcccaccggccgcttagagatccttcgtattcacacaaagaacatgaagcttgctgatgacgttgatcttgagcaaattgctgctgagactcatggttacgttggatctgatttggcatctttgtgttctgaagctgccatgcaacagattcgtgaaaagatggatatgattgacttggatgaagatgagattgatgccgaggttttagactctctaggtgttacaatggataacttcagatttgcccttggttccagcaatccttctgctttgcgtgaaaccgttgtggaagttcccaatgttcgttgggaagacattggtggattggaagaagttaagcgtgaattacgtgaaactgtccagatgcctgttatgtatgccgaaaagtttttgcgttttggtgtcactcccagcaaaggtgttttgtttttcggaccccctggtacaggtaagacattgttggcgaaagccattgccaacgaatgttctgccaactttatttcagtaaagggacccgaattgcttagcatgtggtttggtgagtctgaatcaaacgttcgtgatatatttgacaaggctcgtgctgcagctccttgtgtcgttttcttagatgagttggattctattgccaaagcacgtggcgcttctgctggtgactctggtggtggtgatcgtgttgtcaaccaacttcttactgagatggatggtgttaacagcaagaagaatgtatttgttattggtgctaccaaccgtcccgatcagattgatcctgccttgatgcgtcccggtcgtttggatcaattaatctacgttcccttacccgatgaagaagctcgcttcagcattttgcaaactcaattgagacatacgcctgttgctgaagatgttgacttgcgtgcagttgctaaggcgacccatggcttctcaggtgctgatttggagtttgttgtacaaagagctgttaaattggccatcaaggacagcattgaagaagacatcaagcgcgaaaatgagactggagaggctcctgctgacgatgttgttatggacgaagatgcatctgtgtctcaagttcagcgtcatcatgtggaggaggccatgaaaatggcacgccgctctgtcagtgatgcagaagtccgtcgttatgaagcttatgcccatcaactccttacctcgcgtggtcttacaggattccagtttgattcggctgatagtaatactaatggaccaagcttcggaaatgatggtgctgatgatttgtatgca

SEQ ID NO: 25819 - DNA, 615 bp, Schizosaccharomyces pombe
atgagtgttaacaatgaagtatccgctgatcaacataaccctgaactagaggatgatacatttgagcatggacctccggtttctctgggagaaaagaaatcacttaatgaatatatgaagatggatgccgaagatgaatcattgcagaaatggaaagcatctctgggtatcacgggaacaggttattcaccctcgaatgatcgtagaacagttgttattttaaagctgagtttacttgttgacggccgtgacccagttgatgttaacatggaagatgcagcaagtgtcgaacaaatccgcaagaaagggttcactattaaggaaggaagcgagtttaagattggtgttaaatttcgtgtacaacacgaagtaatttcaggcttaagatatgtccaaactgttcgcagacgtggctttgttgttgacaaaacatctaccatgattggctcctatggaccttctgaaacaccttatgattttacctctgaaccagatgaggcacctacaggtatgctggctcgcggacattatgaagccaatggaaagtttgttgatgatgataaagtggtccatcatgaatttgtttgggcttttgacgttgcaaaaagctggaag

SEQ ID NO: 25820 - DNA, 2135 bp, Schizosaccharomyces pombe
atgaaaggattaaggagtaaatttgtaaaagcactttcgttgaaggatgaacaagggtcacataaaaatggtcattcaaaaagccactatatctctaaaaatgggtcttacgtggaaactgacgacgtgaagcacacagacactcaccattcttcaaaacacgagcttaaaaaacttaagagtcatttcctaaaagatactttaaagcacaaacgaaatcatcatgccaactcaaataatgaaaaacatgaaaattctgataaaaaaatacatacgacggttctagcatctggacatgaggattctgattactctacgtttttgcccgtaattgaaacttctaaagttaaagacgccaaccatttcccacctaattatccagaaccaaaaaatgtaagtatacgtcggttagtttaatattttctaccaaaatgattattttcatactaacttacttgtaggattctgtatcgtctaacatagacgaatttcctaatgattccatatcttctgcctcatttttatctgtcccacaatccactcctccttatttagtttcacagccaactcccttaaataaatttttagcaggtgctgagaatgttgacattccgcatagtcttagaccagtacctcgacgcgaacactcctctcaatttcaagtatctgagaaaagaacattagttcggttgccttcatttgatggtacgtttagtaagattcttatatcttattttaataatgtacttttttttattcttgtgctaatataattagatgttcatacctctgaacgtgaagaactgtttataaagaagcttgaacaatgcaatattattttcgattttaatgatccatcttccgatttggctagcaaagaaataaaaagagaagccttattacaaatgatagattatgtgtctgaaaaccgcggtatttcttccgcatcgctttttccttatgttgtcaatacagtatgtttactcctctgctttttattactgtaaaaatctaatcactatagttttccctcaatgtatttcggcctatatcacctgctcttaatgattattcatcagatatgtttgctttagacgatgagccttttttggagccagcgtggcctcacttggaagaggtgtatttattatttattaagttcctagaatctcctgactttagagccagtaaagcaaaatcgctcgttgatcgtaggttttttaatcgcttgctagcactatttgacacagaagacccgcgtgagcgcgaacttctgaaaacaacattacataggatttacggaaaatttctgaaccttaggtcatacattagaaagtctatgaataatgtttttttgcaattcatttatgaacgagaaaaatttcatggaatcgctgaactactggagatacttggaaggtatgtttcattaatggttatagttcctaaattgatttacaaactaacttattagtattattaatggatttgctgtacctttaaaagaagaacataaaatatttttgtccaaagtgcttattcctttacatcaaactaaatctgtttttttataccatccccaacttacgtattgcattgttcagtttatcgataaagatccttctttaacgaaggcagtcttgactggcattcttaagtactggccacgaataaacagctttaaagaattactgtttttgaatgaaattgaagatatctttgaagttttggagccttccgaatttgttaatataatgtcccctttatttcagcaactagctcgctcaatatctagtatgcatttccaggtcgccgaacgtgccttatgtctgtggagcaatgagtacttcacaagtcttgtcagccaaaacgtagtaacccttctccctataatatatccttctctttacaaaactgctaatgagcattggaatagcactatacaagctattgcttgtaatgttttacaaatttttgtcgatatggatgcggacttttttaatggacttgttgaggattataaacaggccattataaagcaagaagaagttatgattattagaaaacagcaatggtgtcagattgaggcattagcggcggaaaacaaacccactgattatttaagataattcctt

SEQ ID NO: 25821 - DNA, 1249 bp, Schizosaccharomyces pombe
atgtctgcagttgataaaagagcaaaattcgaatctgctttgccagtttttgttgatgaaatcgtcaattatctcaaaactatcaatattcctgacgatgtcacagaatggtacaagaatgtatgtgagtgtagagttacaatattttccaatgtcaatgaatgtttctaaaacattgatctcttaaaaaaaaagtgttatactttgcgctgtttttattgcatcggcatcgtgtcatatcatctgtattttaattagatcacatcaattttttatttctttttgggaacctcgaataacacatgactaactgctgtttttgtagagtcttttccataacacattaggtggaaagtataatcgtggattatctgttattgacagttatgaaattcttcttggacatcctttggacgaagcagcgtacatgaaagcagctgttttgggatggatggtcgagttgcttcaatcttttttccttattgctgatgacattatggatgcttccaagactagaaggggtcaaccatgttggtatttaatgcctggcgttggtaatattgctattaatgacgcgtttatggtagaatctgctatttactttcttttgaaaaagcattttcgtcaagagtcatgctacgttgatctaattgaacttttccacgacgtaacttttcaaacggaattagggcagcaactcgatttacttactgctcccgaagactccgtcgatctttcgaagttttctcttcaaaagcattctttcattgtaatttacaagactgcattttattccttttatttgcctgtcgcattggcaatgcatctcgctggtgtagctactcctgagaacttgaaatgcgcccaagacatccttattatccttggtaaatacttccaagttcaagatgattatttagattgctatggtgatcctacggtaactggtaaaattgggactgatattttagacaacaaatgttcttggattatcaatcttgctctcgcaaagtgtactcctgaacaacgtgttattttggacgacaattatggacgtaaagatagcgaaagcgaaaagagagttaaagctgtttttgaggaactcaatatccgtggtgaattcgagaactatgaggaatcagaagtttctgaaatcaaaaagctaattgatggagttgatgaatcaaccggtttgaaaaaatccatatttaccactttcttaggaaagatttacaaaagaaataagtaa

SEQ ID NO: 25822 - DNA, 2031 bp, Schizosaccharomyces pombe
atgactgtgtcgctgaatacaatgatgggagttgatggactcgaagaccaagaacaactacgagagattcgtaattgtcttttaaagtgtatttctgaatgctctgaaagaggtttagtttacgctgtacgatggtatgcagaatgcaagaggagctttaattaaaaaatctataatttaagcatgaaattattgcagaaaactgttaattttcagtttatgattactgtaattttacttgtttgttatggatagcattatcctcattcaaaagtccaacggttttgttgctattagtttcgaaacctcatgtaattcaaagcaattcttcaagaaatgtttaactgaagttttctttattatctattgttgtgtgaaatcatccttccacttttagttagcttcctttactgacgcattttttagggcagctgaaatgctcaatggaatgaatcctattgaaatggaacatattccattttcatcgacccctactggagagttcgatttggatcctgatatggctaatgaaaagctactagaggttgaggagaaaaatatttatttgcttgcaaagtcttatttcgattgtaaagagtttgagagggcagcttatactttgcaaaactgcaaatcgtctaaatcgatattcctacgattgtatagtaagtacttggcaggtgaaaagaaaagtgaagaagaaaatgaaaccttattaaatacgaacctaacactatcatctacaaaccgagaattttattacatttctgaagttttggaaagtcttcattatcagggtaataaggatccttatttgttgtatttaagtggagttgtatatcgaaagagaaagcaggatagcaaagctatcgactttttaaaatcttgtgtcctcaaagctccatttttttggtctgcttggctagagttatcattaagcatagatagtttggaaacgttgacaacagttgtcagccagttaccttcaacccacattatgaccaaaattttttacgtctatgcatctcatgagcttcatcaagttaatagctctgcgtacgaaaaacttgctgaagcggaaatcatcttccctaatagtcgttatctaaagactcagcgagcactactcacatatgacagtagaggtatactattctaagtcttttatttactaactttacagactttgacgaagctgagtcgcttttcgagaacatactaacaaatgacccatatcgtttagatgacatggatacttactctaatgtgttgtttgttttagaaaacaagtcgaaactcgggtttttagcacaagtcgcttcttcaatagacaaatttcggcccgaaacttgctctattattggcaattactacagcttactttctgagcatgaaaaagctgtaacttattttaagcgggctttgcagttgaatagaaattatctatctgcctggacactaatgggacatgaatatgtagaattgaaaaatacacatgctgctatcgaatcttacaggttagcagttgatgttaatagaaaagattacagagcgtggtatggtttaggacaaacttatgaggttttagatatgcatttttatgcactttactactttcaacgagctactgctttacgcccttatgatcaaagaatgtggcaggctttgggaaactgttatgaaaaaattgatcgtccacaggaagcaataaaatcctataaacgtgctttattaggatcccaaactaacagttcaattctagtccgtttgggtaatctttatgaggaactacaagatttgaattctgccgcttctatgtataagcaatgtattaaaactgaagaaacggagatttctccagaaacaatcaaagcacgaatttggctcgcaaggtgggagcttggtaaaaaaaattacagagaagctgagctttatttaagcgaagtattaaatggagacttagagttggaggaagccaaagctttgcttcgcgaattgcgtagtaggatggagcattcatatgattaatat

SEQ ID NO: 25823 - DNA, 2128 bp, Schizosaccharomyces pombe
atggtcgttaaacgaacgcaaactgactctcgaatgcagtctactcctggtaatcataatcatccagatgcacatgcaaatgcagcttatatgacacctccttctatgggtgctttgaatgcgaataattccaattcacaattgtcaactttgacaataagtcccatgacttatttagctaataatacatcgacagatggatcctttttaaaagaaaggaatgctcaaaacacagattcattgtctagagaagattacttgagactgtggaggcatgatgcactgatgcaacaacagtataaatgtgctgcatttgtaggagaaaaggttttagacataactgggaatccaaatgatgcattttggcttgcacaggtatattgctgtactggagactatgccagggcaaaatgtcttttgactaaagaagacttgtataatcgaagctctgcttgtcgataccttgctgccttttgcttagtaaaactatatgactggcaaggagcacttaatcttttaggtgaaactaacccttttcgtaaagatgaaaagaatgctaataaactgctcatgcaagatggcggtataaaactagaagcttcgatgtgctatcttcgcggccaagtttacacaaacctgagcaactttgatcgagctaaggagtgttacaaagaagcgttaatggttgatgctaaatgttatgaagcttttgatcaattggtttctaaccatctccttactgctgatgaagagtgggatctcgttctaaaacttaactattccacttattctaaagaggacgcagcatttttgagatctctctatatgttaaaacttaataaaacttcacacgaagatgaacttcggagggccgaggattatctttcttctatcaatggactcgaaaaatcctctgatcttcttttatgcaaagcagacactctgtttgtgcggtctcgatttattgatgtattggccattaccacaaagattttagaaatagatccgtacaatttagatgtttatcccttacatttggcttcccttcacgaatcaggagaaaaaaataagctatatctaatttcaaatgatctggttgacaggcatcctgaaaaagctgtgacgtggttagcagtgggtatatattacctttgtgtaaacaaaatttctgaggctaggagatatttttctaaatcatctacgatggatccacaattcggtccagcatggattggatttgcacattcctttgctatagagggtgagcatgatcaagcaatttcagcttatacgacggcggcaagactatttcaaggcacacatcttccatatttatttctcggtatgcaacacatgcagctaggaaatattttattagcaaatgagtacctccaaagctcttatgcactttttcagtacgacccactcttgctgaatgaattgggtgtcgtagcttttaacaaatctgatatgcaaactgcaattaatcatttccaaaacgctttgctacttgtaaagaaaacgcaaagcaatgaaaaaccttgggctgctacttgggccaacttaggtcatgcttatcgtaaattaaagtgaggaatatataattttcaacttttttttacttttcactaacatcatttaggatgtatgacgctgcaatagatgcccttaaccaagggttactactttctacaaatgatgcaaatgttcatacagcgattgctttagtctatttgcataaaaaaatccctggtttagctattacccacttacacgaggtaagtttatatatatattgaaatatctgtttgatgttttatttaacattgattagagtctggctatatctcctaatgaaatcatggcttcggatttattgaaacgagcacttgaagaaaactccttaacttctggttttcttaattcaaaatatgtctttgaagatgaggtgagtgaatacatgcagcaatcaaaccttaatacaagtgataaatcaatgagcatggaagaccagtcaggcaaggtgactgaatccgtgaatgaccgtacacaggttctttatgcggattctcgatcagaaatgatgatggatgatattgaaggtaatgtctcagagcaacgataattg

SEQ ID NO: 25824 - DNA, 3351 bp, Schizosaccharomyces pombe
atgtttggtggtgagttagatgatgcttttggagtctttgaaggtaaagttccaaaaagcttaaaggaggaatctaaaaattcacaaaattcacaaaattcacaaaaaataaagcgtactttaacagataaaaatgcctctaaccaagagcaaggtacaaaaaagttggagtcttcagtaggggaacaagaatctgcaactaaaagagctaaaatcgaaaatctgaaggataaccaagaccttattcctaacaatgatgttaacggaattcatattaacaattctgcagtcgctgataccaaacataagccaaaaataggagacattgctgctgatgatatttccaatgaagtatctataaaaaacgaaggcgatactatacctgaggctacggtagctgattcttttgagcaggaagcatcattacaagttgctgggaaggttgggatgaccgaagctaaatcatctactgaagaagttgtagaacttcgtcatcaggtccgtcatcaagtctctattcctccaaattatgattatgtacctatctctaaacataaaagtcccataccccctgcgcgcacatatcccttcactttggatccttttcaagcagtgtctattgcctgtattgagcgtcaagaatcagttttggtcagtgctcatacatctgctggtaaaactgttgttgcagaatatgcagttgctcaatcgcttcgtgataaacagagagttatttatacaagtcctatcaaagctttaagtaatcaaaagtatcgagaacttcttgctgaatttggagatgtcggtcttatgactggtgatgttactattaatccagatgctacttgtttggttatgaccactgaaattctccgttcaatgttgtatcgtggttcagaggttatgcgtgaagttgcgtgggttatttttgatgagattcactacatgcgtgacaaagagcgcggtgttgtttgggaagagaccattatcttattacccgacaaatcacattttgtcttcctgtctgctacaattccaaatgctatgcaatttgctgaatggattacaaaaattcatcgtcagccttgtcatgtagtttatacagattttcgacctacgcctcttcaacattacctattccctagcggtagcgatggcattcatttagtggttgatgagaaaagtaatttccgagaagaaaactttcaaagagcaatgagtgcattgatggaaaaacaaggcgatgaccctgccgctatggctactaaaggtaatgcaaagaaaggaaagaccggaaaaggcggtgtcaaaggaccttctgatatttacaaaatcgtaaaaatgattatggtgaaaaattataacccggttattgtatttagctttagcaaaagagaatgtgaagctttggccttgcaaatgtcaaagttagacatgaacgaccaaactgagcgagatttggtcaccacgatttttaataatgcagtgaaccaattatcggagaaggatagagagttaccacaaatagagcatattttacctcttcttagacgtggtattggtattcatcattctggtttattgccaattttgaaagaagtcatcgagattttgtttcaggaaggccttttaaaggttttgttcgctacagaaacattttctattggactaaatatgcctgcaaaaactgtcgtatttacaaacgttcgaaaattcgatggtaaaacttttcgttggatatcaggtggtgaatacattcaaatgagcggtcgtgctggtcgtcgtggtttggatgaccgtggtattgtaattttaatgattgacgaaaaaatggatccgcctgttgcaaaaagtatgcttaaaggtgaagctgaccgattagattctgcattccacttaagctacaacatgattcttaacctattgcgagtagagggaatttcccccgagttcatgctggaaagatgtttcttccaatttcagaacagtttagaggttccaaaattggaggcaaagttagaggagtctcagcaacattatgattcttttacaatacttgatgagcgccccttggaagaatatcacacattaaaaactcaattggaaagatatcgaacagatgttcgtactgtcgtcaaccaccccaacttttgtctttcttttttgcaaggaggtcgccttgtgcgtgttaaagttggaaatgaagactttgattggggcgtcgtcgtaaatgtttctaagcgaccacttcctaaagggcagtcaaatgagtacttaccccaagaatcatatatagtacatactcttgtaatggtggctagcgacacagggccattgcgtattagaagtggtcatctgcctgaagtgcatccacctgctgcagaggacaaagggaaatttgaagttgttccctttttattgtcctctttagatggtattgcccatattcgcgtatttttacctaatgatttaaagtctcaaggtcaaaagcttacagtcgggaaagccttatcggaggtcaaaagacgctttcctgaaggaattactttactagatcctgtggaaaatatgaacattaaggaacctacttttattaagcttatgaagaaagtaaatattttagagtcaagattgttgtcaaatccattgcataatttttctgaattggaagaaaaatacgccgagtatttgagaaaattagccttactcgaagaggttaaagacctaaagaaaaaactttccaaagctcgctcgattatgcaattagatgagctcaatagtcgtaagcgtgttctacgtcgtctcggatttaccacttctgacgacgttattgaagttaagggccgtgtagcttgcgagataagttccggtgatggtttattattaactgagctgatcttcaacggtatgtttaacgatttgaccccagaacaatgtgctgctctcctaagttgcttggtgtttcaagaaaagagtgaagtagaaaaccaaagaatgaaagaagagcttgccggtcctttgaaaatcttgcaagagatggcacgtcggattgctaaagtttccaaggaaagtaagcaagaacttaatgaagaggaatatgttaatagttttaagccatctctaatggaggttgtttatgcttgggcacatggagcctcttttgctcaaatctgcaaaatgactgatgtttatgaaggttcactgatccgcatgttcagaaggcttgaagaacttatacgacaaatggttgatgctgcgaaggttataggtaatacttctttgcagcaaaaaatggaagacactatcgcatgcatacatcgggatattgtttttagtgcatcactatatttg

SEQ ID NO: 25825 - DNA, 1815 bp, Schizosaccharomyces pombe
atgactacaggttatgaatctgttcccacttccgaaccctctgataatcttgcaccacgagcagagctatggcaacgccatttactggaaaaaaaagaaggtgatcaatccatctccgtttcggcttttaatatttcttcaatgcataatgaattgtctggtttaagcgaaaaaagtcgtcaacgtgtcgaagctgtatgggctgctttttcagaggcttcttgcagcgaacgtaaactcgctttgcaaggcattttaaacaactgttcgtcctctcttctctcttttgcctccagcacattagattctctagtacgcttagattttctctctttgctccctgttgaaatttcgtttcgcattttatcttttttggatgctagaagcctttgccaagctgcacaagtcagtaaacattggaaagaacttgctgatgatgatgttatatggcatcggatgtgtgaacaacatattaatcgaaaatgtgaaaaatgcggctggggacttccgttactcgaaagaaataccttatacgcagcaaaggcttccatacaaaaacgttatgaacgacttacaaaaagaggcgtcgatcaggctcatgaatcttcacccgtcaaaaaagcaaagctggacgattatccgacgtcgagtaatgaagagactatttcttctgtcaaaccaccttctccgaactccgattccaaattctttcttccctttaaaaccagaccatggaaagaagtatatgctgaacgttgtagagttgaatgcaactggcggcatggtcgttgtcgccaggttgttctcagtggccactctgacggtgttatgtgtctacaacttgtaaggaacattcttgctagcggcagttatgatgccactatacgattatggaatcttgctacctttcaacaagttgctctattagaaggtcatagcagtggtgttacgtgccttcaattcgatcagtgtaaacttatcagcggttcaatggacaaaactattcgtatatggaactacagaacctctgaatgcatttctattttacatggtcatacggatagtgttttatgcttaacgtttgactctacgctacttgtttctggaagcgcagattgtacagttaagctgtggcacttttctggcggtaagcgtatcactttacgcggtcacacaggacctgtcaattctgtccgcataattagagatcgtggacttgttctttccggttccgacgattccaccatcaagatttggtctttggaaacaaacacgtgtcttcatactttcagtgctcatattggccctgtccagagtttagctcttgctgattcgcgattgttttcttgctcattggacggcacaataaagcaatgggacatcgagaagaaaaaatgtgttcatacattgtttggacacattgaaggtgtatgggaaattgcggcagatcaccttcgtttaatctcgggagctcatgatggtgttgttaaagtttgggaggcttgtgaatgtgttcacacgttgaagaatcactcggagcctgtaacctcggttgctcttggagactgtgaggtagtcagtgggtctgaagatgggaaaatatatttgtggcttttcaataatgctccaaatgaatctccagtatctacacaatctgttccgatatcttcccttaatggtcaaaggtcaaattcaagtgtgcaacgagctctttcttcagtacccaactactcatcctcgttatccaatatctcaaccagaaatttaaatatcccaccctctaatgccaataatgacgatgtgtcgattcaatcg

SEQ ID NO: 25826 - DNA, 1329 bp, Schizosaccharomyces pombe
atgtatcaacgatctttgtttcgcggtgtcgctcagggtttaaagcgctcctctgtacgttttcaatctaccagctctggctcttcaaatggcaatttctttctccgtcattggaagcttttgagtgttattggtagttttactgccggcgttgccatttacgacatgtccgatgttcgtagttttatccatggccgcattgaaatgcctctctttcatgctttcaccactcctgagttttctcatcgtgtcgccattctcgctgcctcttggggtataacaccgaaggatcgtgtagctgatgatccatctcttgccgttgaagtttggggtaagaaattttgcaatcccattggtctagctgctggtttcgataaacaagccgatgctatctcaggtttgttgaacttcgggttttcctatcttgaaattggctcggtcacacctaaacctcaacctggtaatcctaaaccacgctatttccgccttaagcctgatttgtctgtaatcaatcgttacggttttaattctatcggccatgatgccatccttgctaagattcaaaagcgcgttcgcaaatacattgctaagacatctcctcaactattaaaacagtttgatgcaaatcccgcttcttgcactgatcccgctgtccttggcgtacctcgtagtttaattcctaacaagttccttggtatcaatttaggcaagaataagaacggtaacgagattgaggattatgttgaaggtgttcgtacctttggtaacttcgctgacattcttgtcattaacgtttcctctcctaatacccctggtcttcgtaacctacaaaagaaatctgccctctcaactttattgactgctgttgtcagtgagcgcaataaattgaactctcctcatcctcccgtacttgtaaaaattgcacctgatttgaacgaagaagaactcacggacattgccgatgtcctcaaaaagtgcaagattgacggtgtgatcgttggtaatactaccgttcaacgccctaagaccctcaaatcaactagccatgttgaagagacgggtggtctttctggacctcctctcaaacctatcgcattaaatactcttcgcacacttcgtaagcatctttcttccgatattcccatcatcggctgtggtggtatttcttctggcaaagatgctattgagtatgctcgtgctggtgcaactatggttcaagtttatactgctttgggatatgatggtcctgtaattgctcacaagattaagcaagagattcttgccgagcttaagggcaaacgttgggttgacataattggcaaggaagaa

SEQ ID NO: 25827 - DNA, 1671 bp, Schizosaccharomyces pombe
atggatttcaacaatattccccttgcgaccattaagtccagcgatgataagggtaaagactttatcgtggaaatgaccactcgtccttctgaaaccaagaagaaggttcctttttctgaggacatgcgtgaaatcccttctttaccgaacgaggaagaagcgaatgcaacggatccacaagccaacgaggtcgctgatgaaaacggtgaaggatttgaagctgaaaaaatcagtagttggatttgggtgctgtcggctgttgcaggtatttctggtttgctgttcggttatgacactggtgttatttcaggcgctctcgctgtcctcggtagcgatcttggtcacgtccttagctctggccaaaaagaattgattacctctgccacttccttcgccgcccttatatctgcaaccacttcaggatggcttgctgattgggtcggtcgcaaacggcttttgctatgtgcagatgcaatttttgtcatcggatctgttattatggctgcttcgcggaatgttgcaatgatggttgttggtcgttttattgtaggttatggaattggtcttacttctcttattgtcccaatgtatattactgagttggctcctgctcgtttgcgcggacgacttgtcatcatttacgtggtcttcattaccggtgggcagctgattgcctactcacttaatgctgcttttgaacatgtacatcaaggttggagaattatgtttggaattggtgcggcccccgccttaggtcagcttatttcgcttttctggactccggagtctccaaggtatttgcttagacataaccatgttgaaaaagtctacaagattttgtctcgaatccatcccgaagcaaagccagctgaaattgcatataaagtctcattgattcaagagggcgtcaaagttgattttcctgaagggaataagtttcaacatttctttcattctttaaaagtacttttcacggttccttcaaatagaagatccctttttattggttgcttccttcaatggttccaacaattttctggcactaatgcaattcaatatttctctgcaatcattttccaaagtgttggatttaaaaattctatctctgtcagtattgttgtcggtgctactaactttgttttcacaatagtcgcattcatgtttattgaccgtattggaagaagacgaattttgctttgtacttcagccgtgatgattgcaggtttggcgctttgtgcaatcgcttatcattttcttcctgcagacaccacccaaaacacaaacagtggttggcaatatgtcgtattagcatccatcattattttccttgctagctatgcttctggaatcggaaatattccctggcaacaagccgaattgtttcctatggaagtcagagcccttggtgctggattctcaactgctatcaactgggttggaaatctcatcattagtgcttcctttttgacaatgatggagtctatcacaccaacgggtacatttgcattgtttgctggattttgttttgttggactcgtgacaagctactttacttatcccgaacttgcaggaatgtctattgaaaatatacacaagctgcttgaaaaaggtttttggcaagctgtaaaggaaagtactaaacgcgttagaaaaggaagaatagatgaagct

SEQ ID NO: 25828 - DNA, 3095 bp, Schizosaccharomyces pombe
atggaggttaatggagtctctcaatctgaagcggctccgtacgttaccaaatcttctgttaagttccgcgataatttctgggtatgtgtaaatttgctgtatttagtaaagcaaagttatgttaacaaaatcgttgcagggatctgaagatgcgggtatggatgctcttatgtcccgaacaaaatcttctctttccgtattagaatcaattgatgaattttacgcaaagcggtaagtatggttgcctcgtttggaagttgcagctctaccttaagcgctacgatgattcaagaaatatgtttttggtcgtttcattgtcatttaagatgttttacagataatcgtggattcttaagatagcttgtgtaatgaaccgaagggttcggtatgattattgattaaagtctgactaactaaattagtgcttctattgagcgtgagtacgcatctaaactgcaagagttagctgccagctcagcagacatcccagaagttggatcaactttaaataatattttatctatgagaactgaaacagggagtatggccaaagcgcatgaagaagtctcacaacagataaataccgaattgcgaaataaaattcgcgagtacattgatcagacggagcaacagaaagttgttgcagccaatgccattgaggaattatatcagaaaaaaacggctctcgaaatagacttatccgagaagaaggatgcctacgagtacagttgtaacaagctgaatagctacatgagacagacaaaaaagatgactggtcgtgaattagacaaatacaatttaaaaatccgtcaagcagcgctagcagtaaaaaaaatggatgcggaatacagagaaacaaacgaattacttcttacagttactcgggaatggattgatcgttggacagaggtctgtgatgcttttcaacatattgaggaatatcgtttagagtttctcaaaacaaacatgtgggcctatgcaaatataatatctactgcttgtgtaaaagatgatgaatcttgtgaaaagattcgactcacactcgaaaacactaacattgatgaagatattactcaaatgattcaaaacgaaggtaccggaactacaattccccctttacccgagtttaatgactatttcaaagaaaacggattaaattatgacatcgaccagctcatttctaaagctccttcttatccatactcctcttcgcgtccctcagcttctgcatctttggcaagttcgccaacacgtagcgcttttcgccccaaaactagtgaaacagtttcatcggaagttgtatcatcaccacctacttcaccattgcattcaccagttaagccagtgtctaatgaacaagttgaacaagttacagaggttgaactttctattcccgttccttctatacaagaagctgaatcccagaaaccagtacttacagggagctcaatgcgtcgaccttctgtaacatcaccaacttttgaagtagctgctcgtcctttgacttcaatggatgttagatcctctcataatgccgagactgaggtacaggctatacccgctgcaacagatatatcacccgaagttaaggaaggtaaaaatagtgagaatgctatcacgaaagataatgatgatattattttgagtagtcaacttcaacctactgctaccggaagtcggtcatctaggttgtctttctctcgacatggacacgggtctcaaactagtttgggatctatcaaacgaaaatcaataatggagcgtatggggagacccacttctcccttcatgggttctagtttctctaatatgggtagccgaagtacctcacctactaaagaaggatttgctagcaatcaacatgccacaggcgcgtctgtccagtctgatgagttagaagatattgaccccagagctaacgttgttttaaacgttggacccaacatgctttctgttggagaggcaccagtggaatccacatccaaagaagaagacaaagatgtacccgatcccatcgctaatgcaatggctgaattaagttcgtcaatgagaagacgccaatcgacatcagttgacgatgaagcgcctgtttctcttagtaagacgtcttcttctacaagattaaatggcttgggctatcactctcgaaatacttctatagctagtgatatagatggcgttcccaaaaagagtaccttaggagctcctccagccgcacacacttctgctcaaatgcaacgcatgagtaatagttttgcttcccaaacaaagcaggtgttcggagagcaacgaaccgaaaattcagctagagaatcccttcgtcatagtcgaagcaatatgagtagatctccttctccaatgttatcgagaagaagctccaccttgcgcccaagctttgagaggtctgcatcttctcttagtgtacgccaatctgatgtcgtttcgccagcaccttctacaagggctcgtgggcaatcagtgtctggtcaacaaaggccatcttcatctatgtcgttgtatggtgagtacaacaaatctcaacctcagttgtctatgcaacgttctgtttctcccaatccgttaggccctaatcgtagatcgtcatcagtcttacagtcacagaaatctacttcatctaacacatcaaaccgaaacaatggtggttatagtggatcgagaccaagttcagaaatgggtcacagatatgggtctatgagtggaaggtccatgaggcaagtttcccaaagatccaccagtcgcgcacggtcaccagagccgactaatagaaatagcgttcaatcaaagaatgtcgatccacgagctacttttacggctgaaggagagccaattttaggatatggtaagttcattaaagagaaactttaaaaatttttaattttactaattataattcagttatcgcactttatgattatcaagctcaaatacctgaagaaattagcttccaaaagggcgatacattaatggttcttcgcacacaagaagatggatggtgggatggtgaaattattaatgttccaaattcaaaacgtggtttattcccgtcgaactttgttcagacggtatagacactg

SEQ ID NO: 25829 - DNA, 6300 bp, Schizosaccharomyces pombe
atgaagagccaagaacaacaaacgccggagacacgagagaaatctagttcaacttctgaatctgggcatcctatatcactagattctaagacccctccaccaaacgattcaaaaattgaaagtattgttaaagcacaaatccttttcttattgtcgaccttacgggaagaccaatatgatacgaaacttgaacagattcgtcaacttatcaacaaaaatgcacccagagtataccaccattttcttcgccgtctaattcaaggaaattcataccgtatttttggtaccggtaaatcttctgatggactagctacttataaattactactagatgaattaaaatctctcacgaagtcttgggtcatggcgaaacgttttagtgatgctatttcaggttctgattctgaagtatttgaagatttcgatatagaggcatttttagaccatttccaattctccccgttagaaaggactaaccttttaattggacttaccacttctgttaaacctactttagcaaagaaagcttctgctttgcttaaaaacacattccaatctcttttaaaccaactatccgatcctactcagcaacaaagtattgataaaaacgatttggatttgctcagggaaggtttgtttaccaccgactatgacagaatacccttgattaaagttccaaagtttgatgctataattgagaaaaagttggcgaattcacgccctcttacagctttgtttggtccgatgaaagcttccaaagctacacttaagtctatgaaagaagcaattcttaaaaaatatcccccgggaacggctactgagactgatgttgcttatcttataaattcacttgtagctatacatgattatggtgcttgggacactgttttgatgggtaaagctatcgtttcctcttttgaaaacctaaattgggaagctatgctttctatgttcgataatcctaaatttatgataacgggtacacctagtcttgtactgttcttcacaatctttacaaatgcttacaagttaaggcaaactaattttacgttggactttctctgggttctttggagaaatcctttaccgcaactttccatcatttctcatattatcctatccccaacatcgatgtttgatataagagagttcaatgtcaatcctgtagtttctgttgatagcttaaaggattatagcgaagagcttgttaattatgcgaaaatatatgaaaaaagtaatttaaattgcattgaacttgtccaaatccttttacgcctgttatctgaggtagtcacctacgaaacttcactgttcttgaattttttggatgagaaagtttctgccgagcttttgcttttgggtacgctgcagctccctttggcatggaatcctgttcaagagtcattagcgtttcaatggtgttcagactttttttccaatttcaaagaacataaatttgtcttcgttaggattgaacgaacaaaccctcaatttttgttcgcctttttacgcagtttgtggctgaaggatagttcatctgtgaatcaggtagtagagtttattatcgaaaatgattttacatctcacatcggcaacattcaaccaaatcgatttgctttagagattgctgcacttgcagctgctcgcaaagcgttatcgtttcaggattggcttgacaaaaagatgctcgaatttgaggatgcagacggacttaatgttttcttggtagaggttttggattttttgatgagtcgagcggcattacaaaaaaatgagtctgaacaaaaggaagagtctgttgttctttccatcgatacggttaatgttctattgacaacgttgatggacaacgttagtatttcggaggaagtcagtgaacatataaaagatgtccaaattttgtgtcttcaagtttatccgcgtctcttcagtttgggtcatgatcgggatagcattgttattgctactaacacgactaattctttttcaccggatgtagaatcggaggtagaatcgtactttcaagctctgtatgaacgacgcatatcaattgggaagattgttttgacgcttcaaaattttaaaaaatcggaaaacccgcgtgaccttgatttgtttgcatgtttacagcatagtctttttgatgaatacaggtttttccctgactatcctttggaagcgttagctttgacagcagtcttgtttggaagtttgattcaatttgagcttctatcttttgttcccttaggtgttgctttgcgttacgtttatcaggcgctgcttatgcccaccgactccaaaatgtttagatttggtatgcaagccttggttcagtttcaagaaaagctaccaaaatatattaactactgtaatcttatattgggtataccttctcttcagctagtgcgccctgatatatatgactctatcagagaaatgattgcgtctaatgaaaatactgaagttgaaaaagataaactcgatagtttttctgctctcgctaatcctgcaagtccaaaagcgcctgagtatacattcgtttctatccatgttcctcctttaaatgtgccaaatgctgaaggtgaaattgaagagagcgtttgtgataacatcttatttgcaattaacaatctttctcagcttaattttaatgaaaagttaaaagacgttaaggataatttgactcccgcatatttgccttggttttcgcattatattgttacacaacgtgttagtcgtgaagccaatttcttgtctctgtatggaaagtttttagaggagttaaaatcaagtgatctctacaaaattgtttttcgggatactcttcaagcaatattggatataatgaacaataacgcagagacattatcaccttcagagaaaacaaaccttaagaacctaggttcgtggttaggaagtattactctattgcgcaacaagccaattacaacccttcaagtttcttttaaagatttactacttgaagggattgatagtggtcgaattgatagagttttaccatttgtgtgcaaagtgcttgagaaagcttcttcatctgtcatatttaaacctcctaacccttggttgatgggaattttgaagttactggttgagttgtatcagtttgctgattttaggcttaacttaaaatttgaaattgagttattacttaataacttgaatgtcaagatggacaacattgaaccttctgaaatgtatcgtaaccatcttgtccaaaaagccgatttagaaaaggagcttcctgaggacgtacttaacgctgagttccctgatggcaccgatgttataacccaatatatagtagctgcatcttcgcaaataacagtaacggatgcggtagctcaggtgtttggaaaacccaaacctgctataaaaaatattactcaattaataattcagcaatctgttttagaaataatttcagcagtagtgcgacgatctgttgggattgcagctattactaccaagagccttttacagaaggattttgcagctgaatcaaatccttcccgacttttattagccgctagacaaatggctaaaacccttgccggaaatttagcaatggttacttgtcgtgaacctttacaaatgcttatgatcaataattttaggacgatagctttacaggacgttgaaaacgttcatgctgctgtggcacaagcaattgatgagcttgttagtcaaaacttgttcgtcgctagctctgtaatagagagtgtggcatcggagacggctattgctgaaattgacgcggaaattgagcacatgatagtggagcgtgttcgacaccgtaagacaacaccaaatcttccatttgttgatccagctggagcggctaatttacacttgaaccttcctagcgtattgaaattatcgtcggagcttacgcctcaacaatttcaattatatgaaaattttgaccgcttgagcctatctaccataatgagtaacaattcttttaccagtcttaatggattacgtaccgacagtgccgacagtacggacgctttgaactccaatcttaataatacagtcgagaatgaagctaatcagacagcattgaactacgctagaaatttgctcataattattgggcagttatttcagctggctgcccaaatgccttataccagtatgcaggaggttccagctgatcatgaattacatgaactcgttaatcaatttttaactggcgttgcctctattaatcatcccattgcagatcacgtatttttgttatgcgctcaagaatgttgtcgcatacttctcaccgacagtaaatcacctttcattttggaagtgttttctgcaattttagagtatatttgtcaagcatccacaaaaactgcgataaatgtctctttgtattggaacttctctaatgatcttgaaaagcttaatcttcctattattttgagtttaattagatttggaattctcacgtctggtgaagttgattatcacgtagctagaggtgtccggtctgaacaaggatctggtcctgttaccgattttgcaatagagttattgaggacagcggtaggtggtgagaatccaatggctttacctggtaattttgtgaattctatcacttcactctacgagattagtgaatctttctctggtgagacgaaacaggcctatgagcaacttgttgaaacaatgaacaagagtgtatcacctgcatctgaaattttgtctgatctcgataataaacaacaacttaacgatcaaattataatcgtttttgtctcttgggttcatctgttgcgcaattcggcaaccaacgatgaaactaaagctgcatttgtataccaattgcataaacaaggaattctgtcagagcctgagttatgtattcagtttttcagatgtaatttagaggcagttttagttgcctttttggaagcagcttccgttaatgcccccgattattttaatgttgacgcttatgcctctctattggtaaacgttgttaagtacactgaaggtagtactgaaggaacggtatcttcaaaaagcgtgctttttagaaagatcattgctttgataatcggtgtgtttgccgaattgcataattccatggctgaatttgtccatcaaaaaacatttttcagattgttctctagtatactctccgagcttgatgatgctaaggatgtattggagtcctgcttcgtcgatatctatagtgttattttagaatgcttccttgctattcagccacgctctttcccagcgtttacatttgcctggcttagccttatttcacattcatacttactaccgaaggttcttcttgtcaataatgataaaattaatgatttatttagtgagatcctgatgtcctttttaaaatttttagatttgaaggatgatattgataaagcccaatttaaacttctttataatggcttcttgaggatcatacttgttcttcttcatgatttccctggctttttggctacccattgttaccaattgataccttatattccattagaatgcgtgcaacttcgtaatatggtattgagcgcgtttcctagtgatcttcatcttcctgatccatttgctcaaggtttgaaggtaggcagattacctgaggtaacccgcgcaccattaatttcaaattcagtttctgcttcacttgagaaatttgcgtcagcgttggatttagaagcttgtttctcttcttccaaaccagcggaagttgccaagctattgttagaagtgtactcaagtcaagatacccctactaaattaaacgaatgggcaaactattttatgctttgtttaatacgccacgctactcgtgattcccctgccaagcaagccccacaatttcaatcaaaatctcctgaatgtgtaattattagtactatgaatcgcagttgcgattcaaagtgccgctatttcttgttaactgcgattgctaatcagctgcgttaccctagcagccatacttactatgctagctgttgtttcttgtaccttttcaagagttcttctaacaaccctcaagaattgcttatcaaagaacagatgacaactgtacttttggaacgcataatttgcaatcgaccacatccttggggccttttaattacatttactgaattattaaaaaatgaagactataacttttggaaacacccttatataaagcgaaacgatgaaatctgtcgtttgtttgatagtctccatgaacatgtcatggcaccctcctcagctaataatgtctctaccgaagaggctacagaactgatgggtcaagtt

SEQ ID NO: 25830 - DNA, 657 bp, Schizosaccharomyces pombe
atgaaattgacaaagtttttaactgtgttcattccttttattgctggattgatttattatatacaaaaatatcatcttcgttccttctatcaatttgatccagcaaagttgcaggagctatctaagcagtctattgctttatacgcaaatgataccaaagctcttctttacgacttgagcgacagactcgttgctgaatacggagacttaattactcctgtgaatcaagatgaatgggttcacaacaatgctggtggtgctatgggtacaatgtttatcttgcatgcttccttttctgagtacttgattttctttggcacgcctatcggcaccgagggacattctggtgttcatatggctgacgattatttcactattttacgtggccgtcaacttgctgcttctgctaatgaccttgaggctcgtgtttatcttcctggtgaccaacatgttcatccttggggtcacactgctcagtatagcatgccgtctggtgaaccttgttttgctcttgaactagctcaaggatggattgtatcaatgcttccctttggatttatggatggtttattctccaccattgatttcggaactttatacaaaaccgtttatttcactgcgggaaggatgttgaaaagtgttttaatgggaaaattc

SEQ ID NO: 25831 - DNA, 3010 bp, Schizosaccharomyces pombe
atgaagagaaaagataataaagaattaatttgcataccaagctcttcacctccttcaactcctatacgcgaagaaaattattatttgcttacgagctctcccattgaatgtagtcctattcaacaattagacctgtcaggaagtttcaaaaattattcaactacctcctcaagggctaacgggaaaaaatttgggcagttggctatgcaatctcgtattttttttgacacaaccgatcataaaaagtatgttgagagcagctacgcggcgtacgatcctcacgatcagcctcctgaacgcgatgtgagtttaaaagaatcttcgaacaaaataaacccctcaaacttttttgacagcgaacaaattacgaaaattaatgctgtaaaaaaacgatttccagccttagattcagaaatgataattgcaacattagaaaaattcaactggagggaaaacataactatccataagcttacgtttcagaagttgctaggacgaggtaactcgacaatcaacaagtcagcccaaaagctgaacaaccagcccattgaaaagtcctcggtagacaaggagaacgcaaaaaggaaacgttatgtagaagaaggaactaaacaagggcaaaagaaaaagccgcttcgtgttattgaactttcagatgaagaaacgaatgaagatgacttgttaggccaatcacctacagcgtgtactacagatgctaacatcgataattctattcccgaaaattctgataaaatagaggaagtaagcatcgaaagttcaggaccttcagaagttgaggatgaaatgtctgaatatgatgttcgagttttaaactttttaaatgaatctacacttcaagaaatagtagaagtttccggttgtgaatcaaaagtggtggaatattttatttctaaacgaccatttccttctttagaaaaagcagaggcactatgccaacgaaatgcgcacgcagccacaggtaaacgaaagaaatcagatggccgcaacgttggaagaaaattagttaattcaacttatgaagtacttcagggattcgatgctgttgactctctgattgctaaatgcgaaaggtacggggctatgatatccaatactatgcgatcttggcacaatttgtttgatgataaaaaaatggaacagtttcttaatacttctacagggtctatcagttacgaatacaatagtcaacaaccatcttcaatcgcatctggtataactttgaaaagttatcagattgttggactcaattggttgtgtttgatgtacaaagcaaaattgtcagggattttagctgatgaaatgggtctaggaaaaacatgtcaagtgatttcatttctagcttcgttaaaggagaaaggtatacaaaatcgccacttggtagttgttccatcttctactctcggaaactggttgcgagaattcgaaaagttttgcccgtcgcttagagtagaaagctattcgggaactcagtcggaaaggatcaacaaaaggtactacttaatggatacggattttgatgttctagttactacttaccaacttgcatctggaagtcgagacgacagatcattcttaaggaaacagagatttgatgtaagcttatgttttttatcggtaaactaatcttttagatttctatatttgatgaagggcattatttaaaaaatagaatgtcagaacgatataaacacctgatgaatattccagcgaattttcggctactcatcactgggacaccgcttcaaaataatttaaaggagttaattgtatgtttgaataacttatttttactaatttttgctagtcccttttagcctttatgctacctaaagtatttgacaataatatgcaaggcttagacatcatttacaaaataaaaacgacttcagatggcgatattgagagagcttatctttctcaagaaagaatatctcgtgctaaaacaattatgaatccatttattttaagaaggagaaaagaaaatgtactttcagatttacctcctaaaatacagcatgtcgaatactgtcatatggaggaaactcaactctcattatacctatcagttttggaattaaaaaatttggttaatgctaatcgggaaaacattctaatgcaattacgaaaggccgctcttcaccagttgctctttcgttctcaatataatttggaaactctatcgttaatgtcaaaaagaattttacgggtaagattggtactttttttatgcttagcgctaactattacaggaggatgcttaccttgatgcgaatccgcaatatatttttgaagacatggaagtcatgtctgattttgagctgcataaacttgcagatcagtatcgacatctgcacccttttgctttaaaaggtaaaccttggatggattctgctaaagttaaaaaattgtgcagcttgctgaaaaagagtcgtccaaatgaaagaattttgatttttagtcagtttacccaagtgctggatatccttgaatacgtgcttaataccctggatcttgagtttttacgcttagatggtagtactcctgtagaaactaggcaacagttaatcgatgattttcatactaatgagaattacaaagtttttcttttgtctacaaaatcaggaggatttggaattaatttaacatgtgctaatattgtaattctttttgattgctccttcaatccatttgatgacatgcaggcagaagaccgagcacatagagtcggacaaacgcggccggtgcatgtttacaggctaattacgaaaaacactatagaagtatgaaaacagtcctttatttaattatttttgctaacgtggtataggaaaatattcggagattggctaatactaaacttactctcgagtctagcttaaccacagattctgaaaaaattcaaaaagaaatttctggagagctaatgaaatctctgcagatggatggacgggtggatactatggatgggtccgttgtttagaaatttatt

SEQ ID NO: 25832 - DNA, 3355 bp, Schizosaccharomyces pombe
gatgctttaaagaaactacgtattgatgaaccaaattcaacggtaaatcaacatcatcaacttaatttacagtatgaagcattgatgaatgatttgggaggtatcaatatattccttagcaagcctcctggcgatgagctaaggccactaattgtttcaattgatttttcagttcatcaacctattttcgggattacatttgttggtatcgatcctgtagatcatcgttatccacacgtgtttacaaacaattctataattccttacagcacttgttcatggcttccttgtgtcgatggcatttgggaacgatcgacttgggaatttgagatcacgttgccaaaaacactcagctcccttatgcatcgagaaaaaactcagccttccgacttgaacaatggtgcaaatggcgttgatggacatgatgataattacgagaataataggtttgaccaccagtttaacttaagtaatgaacccgatttacttgaagatcatgatattgaagttatttgttgtggcgatctgctggaccaggtcacccatccaaaagatatgcgcaaaaaaacggtatattttagtgtgactactccagttgctcctaattatattgcttttgcggctggaccattcaagcacatcaatttgaccgatttccgtgaacctgaagatgatgatgctatgggttctagtgctattgatattacaggatattatctacccaaatatgctgaggaagttgaaaacacatgtgtttttttatataaagcaatggatttttttgttcgggagtatggatcatatcctttcaattcattcaagttgtgttttgtggatgaaaccaattttcctattatttcgacaccctctttggtcatatcaagcaattctattttgtatcctaaggactcgcttgatcaaatatatgactccactaaaaccttaacttgggctcttgctagtcaatggattggtgtttatctcattcctaaagcatggagtgacttatggttgatatatggtttatcatactatatatgcggactatttttaaagaaattaatgggtaataacgattatcgttttcgtttaaaaaaacaggtttatcgactgttagaacttgatattggcaagcccccaatatctcagcgcaatataaatatccctattgatcccaatacgctagactttattgctttgaaatctccgctggtaatccacatccttgaacgacgtttgaccaaaaccggtggctcattaggaatgtcgagggttattcctaaattacttctccaagttatgagcggtgatatgctaaatggatgtcttagcacctctcattttttgaaaacatgtgaaaaagctagtcacatgcggctcgacgtttttgctcaacaatggatttatggctacggctatccaatttttagagtagtacaaaggttcaatcgtaagaaaatgatcatcgaaatgggaattgatcaggttcaaacaaaagaggccccccgagccccaatgtctgacaaaaactttttaagcgacgccatccgtcatttgaataacgaaagcattcctaccggccttcctgttttcagtggacccatgaccattcgaattcacgaggccgatggtacaccgtatgaacacgtggttgagttaaaggattcttttaccaaactcgatattcaatacaatactaaatataaaagaattagtagaaacaggtctacaaaaaatgtcaaaagggatggtgaccataatggtgatgattctgactacgttatccgaagtttgggggatgttttgcaaagtgacgaagatatagagcgttggcatttatatgactatactaaagaagaggaagatacaatggcgactgaggctttcgaatggattcgggttgatgcagacttcgaatggatttgtgatctacgtgtgcggcagccggaacatatgtatgtctctcagttacagcaagatagagatgtagttgcgcaactagaaactattcggcactttactagtgagagctttacggtctctcagcaagtttctaccgttttgcttcgtacactattggataataggtattattatggcattcgacaagaagcagcacgtgccttagcaagatgtgctattcctgaacttgattgggttggatattatcatcttcgcatggcttatttagaaaaattttgttttaaagactctactattcccaagagcaacgatttttctaatataacggaatactatgttaaatgcgcaatgcttgagtcctttcccaatattcgtgatcgcaagggggttacaccttcatccgttaaaaagttacttttggatttgctgtgttataatgataatgctaataacgaggtatgattttcctttactaattttgattaactaatattagttttccgatgcttattttatatgcttattgatagattctttggtagaaggattaattcctcgtggagaaacagttcaatatgcgtttagcgatccggaacacatggaattcgtcaatcaagttattaatgaaattgatcgatatatgagaattgatgcctgtatgccgtcgtttaaaaatattattacttgcaagtctttaaaagcaaaattgcgattggctcaaacattccatctggagttcggaccaaaagagttattaccatatactcaagaaggcaattatgtattagtgcgatgcatcgctttcaatttgatgctacaagcaggggctcttaaatatactcctttgatcaagtacatcttctatattcttaccaatgatttatcaccggttgtccgaagatccttgctttattctgttcaagacggattaggtgctttggctagaggtggaactaaatcggacgttgcatccgaggacctaattgtcgaagaggatattacaaaagccgttgagaagagaattgatatcacatcccgtgccagtatatcaggtgctatagaggctcttagaaatgaccttggtcagaatcacgattttgcaactgaaatttggaatgccataaataatccaaaatcggatttgcttactaaaagaaatcttcttatgatttgtcgcgtactctacaaagcaaagtcatctcttttggtgacgcttaaaataccaagtttaataccacgcttacgtgctatacatttgggaaaaggaaagattgtaattaaaaaagctcccttgaagcaaataactagcaaaacaaaagaaaagtccacgagtcctactcccccgtcaataacaatcaatcctattaaaccaaagggacctactttgaaaataaagctaacaaatctccgctctactccaccttctcattga

SEQ ID NO: 25833 - DNA, 447 bp, Schizosaccharomyces pombe
actacccgtaaccttacagatgagcagattgcagaattccgtgaagccttttcactgtttgatcgtgatcaggatggaaatatcacgtccaatgaattgggtgtagttatgagatcgttaggtcaatcgcctactgccgccgaattacaagatatgattaatgaggtcgatgccgatggtaatggcacaattgattttaccgaatttttgactatgatggcccgaaaaatgaaggataccgacaacgaagaggaagttcgcgaagcctttaaagtcttcgataaagatggaaatggatacattacagtcgaggagttgactcatgtgcttacaagtcttggtgaacgtttgtctcaagaagaagtagccgatatgatacgtgaagccgacaccgatggcgatggtgtaatcaactacgaagaattctctcgtgtcatttcttccaag

SEQ ID NO: 25834 - DNA, 1320 bp, Schizosaccharomyces pombe
tctatcaaggaaaatggcgcaatggtcgttttcggcgcttccggtgatctatccaagaaaaagacgtttccagctcttttctctttgtttagcgaaggacgtctccccaaagatattagaatcgttggctatgcgcgctccaagattgaacatgaagactttttagatcgcattacccaaaacatcaaaattgatgaagaggattcccaggccaaagagaagcttgaggaatttaaaaagagatgctcttactatcgtggctcttacgacaagcctgaagatttcgagggcttgaactctcatttgtgtgagagggaaggcgaccgttctacccacaaccgcattttctatctcgcgttacctcccgacgttttcgtatctgtagctacaaaccttaaaaaaaaatgtgtgcccgaaaaaggtattgctcgtcttgtaatcgagaagccatttggcgtcgatttgaaatccgcccaggaactccaatcccaattagctcccctttttgatgagaaggaaatttatcgtattgatcactatttaggcaaggagatggttcaaaatttggttcatcttcgtttttgcaatcctgttatttctcatctttgggacaaaaacagtatttccagtgttcaaattacattcaaagagcctattggtacggaaggccgtggtgggtactttgactctagtactattgtccgtgatatcgtgcaaaaccaccttgtccaaattctgacccttttgaccatggaaaccccgaccactttctctgcagacgatcttcgtgacgagaaagtcaaggtattgcgtcgcactcgattgggagatctcaaagatattgttcttggtcaatatgtcaaaagcaaggacggtaaaaaacctggctaccttgatgacgagactgttcccaagggtagtaggtgtcccacttactcagctattccctgttttattgataccgaaagatggcgcggcgttcctttcttacttaaagctggtaaagccatggatattggcaaggtagagattcgtgttcagttcaaagctgctgcaaatggtttatttaaggacgcatatcataatgagctcgtaatccgtgttcagccagacgaagctatttacttcaagatgaacattaagcaacccggtcttagtgaggctcccctccttactgatttggacttgacttactctcgtagatttaagaacatgaagctccatgaagcatatgaagcattgtttttggacgcgtttgccggtgaccaatcccgttttgctcgtatcgacgaattagaatgtgcctggtctttagttgat

SEQ ID NO: 25835 - DNA, 1482 bp, Schizosaccharomyces pombe
tctatcaaggaaaatggcgcaatggtcgttttcggcgcttccggtgatctatccaagaaaaagacgtttccagctcttttctctttgtttagcgaaggacgtctccccaaagatattagaatcgttggctatgcgcgctccaagattgaacatgaagactttttagatcgcattacccaaaacatcaaaattgatgaagaggattcccaggccaaagagaagcttgaggaatttaaaaagagatgctcttactatcgtggctcttacgacaagcctgaagatttcgagggcttgaactctcatttgtgtgagagggaaggcgaccgttctacccacaaccgcattttctatctcgcgttacctcccgacgttttcgtatctgtagctacaaaccttaaaaaaaaatgtgtgcccgaaaaaggtattgctcgtcttgtaatcgagaagccatttggcgtcgatttgaaatccgcccaggaactccaatcccaattagctcccctttttgatgagaaggaaatttatcgtattgatcactatttaggcaaggagatggttcaaaatttggttcatcttcgtttttgcaatcctgttatttctcatctttgggacaaaaacagtatttccagtgttcaaattacattcaaagagcctattggtacggaaggccgtggtgggtactttgactctagtactattgtccgtgatatcgtgcaaaaccaccttgtccaaattctgacccttttgaccatggaaaccccgaccactttctctgcagacgatcttcgtgacgagaaagtcaaggtattgcgtcgcactcgattgggagatctcaaagatattgttcttggtcaatatgtcaaaagcaaggacggtaaaaaacctggctaccttgatgacgagactgttcccaagggtagtaggtgtcccacttactcagctattccctgttttattgataccgaaagatggcgcggcgttcctttcttacttaaagctggtaaagccatggatattggcaaggtagagattcgtgttcagttcaaagctgctgcaaatggtttatttaaggacgcatatcataatgagctcgtaatccgtgttcagccagacgaagctatttacttcaagatgaacattaagcaacccggtcttagtgaggctcccctccttactgatttggacttgacttactctcgtagatttaagaacatgaagctccatgaagcatatgaagcattgtttttggacgcgtttgccggtgaccaatcccgttttgctcgtatcgacgaattagaatgtgcctggtctttagttgatcctcttttgaaatatatggaggaagagaaacctgtacccgagccttacgagtatggttccgatggtcccgaatgtttatactcttttttgaaaaagttcggatatatttatgattcccctgattactatgattatccagtcatgtccgttccttccgatcac

SEQ ID NO: 25836 - DNA, 3999 bp, Schizosaccharomyces pombe
atgtcctacgcaaattatcgttatatgaaagcaagagcaaaacgatggagaccagagaatttggatggaattcaaacatcagacgaacatttaataaacctttttgcaaaaatattatcgaagcatgtaccagagatagggaaattcgatcctaataaggatgttgaaagttacatttcaaaacttgatcaacactttactgaatacccttcattattcccaaatgagcatactaaaagacagtatacattgaatcacctagaagaattagagcaacaattcgctgaacgcatgttttctgagaatggaagtcttacatggcaagaattactcagacaaacagggaaagtacaaggatccaacaaaggtgatcgtttaactaaaacatttgaaggttttagaaatcaattggacaaagttcaatttataaggaaactcatgtcaaaagcaaatgttgatgatttccatactcgcttgtttatattatggatgctgccatattccttaaggaaattaaaggaaagaaattactggaaatcagaaatcagtgaaatttatgactttttagaggacaaaagaacagcctcgtatggtaaaactcacaagcgttttcaactgcaaaataaaaatctaggaaaagagtccctttcaaagaaaaataacaccactaatagcagaaacctgaggaagacaaatgtttcgagaatagaatactcatctaacaaattcctaaatcatactaggaaacgttacgaaatggtattacaagctgaacttccagacttcaagtgctcaataccctgtctaatcgatacgggcgctcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctacagctccagcacattttcaatactttatcaatacaatacttggtgaagccaaagaatcacatgtagtatgttatatggatgatattttaattcattcaaaatcggaatctgaacatgtaaaacatgttaaagacgttctacagaaattgaaaaatgcgaacttaattatcaatcaagcaaaatgtgaatttcaccaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttctcctccggtgctacgacactttgatttcagtaaaaagattctactggaaactgatgcttcagatgtcgctgtaggagccgtattgtctcaaaaacatgatgatgataaatactatcctgttggatactattcagcaaagatgtctaaagcacaattaaattatagcgtatcggacaaagaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtggaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccaaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatc

SEQ ID NO: 25837 - DNA, 1199 bp, Schizosaccharomyces pombe
atggcgactacggcgcaaaaaataaaagaagttgaagatgaaatggccaaaacccaaaaaaataaagctacggctaagcacttgggaatgttaaaggccaagcttgcaaaattgaaacgtgaattgatcacccctaccggtggaggaggtggtggagggcgtatgtactgaacgtcaaatttttgtttggagtactaatctttcttagttggtttcgatgttgctcgtaccggtattggtactgtaggtttcattggatttccctccgtcggtaaaagtacactcatgactcagcttacaggaacgagaagtgaagccgctgcatatgaatttacaactttaacaacggttccgggtgttttgcaatacaatggtgcaaaaattcaaattttggatttgcctggtattatcgagggtgccaaagatggtcgtggtcgtggtaaacaagttattactgttgcacgtacttgcaaccttatatttattgttttggatgtattgaaaccaatgtctcataagcgtattattgaagaggaattggaaggatttggtataagattaaataaggaaccccccaacattgtattcaaaaagaaagaacgtggtggtatcaatatcaccaatactgtccccttgactcatattgatttggacgaaattcgtgctgtttgcagcgaatatcgtgttaactctgctgacattgcttttcgttgtgatgccaccattgatgatttgattgatgtcttggaaggaaatcgcgtttatatcccggcactttacgtgttaaataaaattgattcaatttctattgaagaacttgatttgattgatcgtattcctaacgccgtacccatttgtggtaacaggggttggaacattgacgaacttaaagaaacgatgtgggactatttgaatttggttagagtctatacacgccctagaggtcttgaacctgattacagcgaacctgttatccttcgtactggccattctactgtcgaggattttgtaagttttcgaattgcttctgccgatcttcgtgttgctaacttctttagtgtaacaatattcattcaagtatcaaatcccagtttaaacatgcttatgtttggggaaaaagcgttccttatcctggcatgcgtgttggtttatctcatgtactgttggatgaggatgtagtgacgattgtcaaaaaataa

SEQ ID NO: 25838 - DNA, 846 bp, Schizosaccharomyces pombe
atgttttattcagactacctgaaactgttgaaaatattcgttgtcggagtgttcccatgcactctgtttgtaaatgcgccgcatggcaaattagccaagcaaagcaaattattcagcaaaggatacatatcgggtagagtgggatgggtattgatggagctggtagcaccactgacgttcctttatgcaattcgtaacaatcgacacttcgagtcgacgctgccctctcttggagatgggtcgaaccgagattatctggatagctgtcgaaaggtacttgctggtatgtttttagttcattacgccaaccgagcgctagtgagtcctcttttgatggcaccacaagtttcacccatgcattggacggtgtttgtttctgcggtattgtttaactttttgaacggtatgtcaataggtctgtacttggttcaagctagcgtccagcatcatccagtgtctatcattcgtcgatacattggtatgtttctttggttaatgggttggttgggaaatatgtatcacgacaacatcttatacgacctaagaagatcatctaataaaaaaaaggatcccgataatcttgacaccgtacaatctgagaattcgtattatcgaattccctatggagggcttttccagtatgtttcgtgtcccaattacttttgcgaatggattgaatggtttggatgctacttggcagccggtccttctgccgaacctttttggtggttcttcctgtcagagattctgttgatgcttccaagagcattaaaagcccatcaatggtactgtaaaaagtttccgaagtatccagcaaaccgtcgtgccatcatcccattcttaatg

SEQ ID NO: 25839 - DNA, 2292 bp, Schizosaccharomyces pombe
atggttaaatctgctgttttggggttccctcgtatcggtaagaaccgtgagttgaagaaggccaccgaggcttactggtctggaaagaccagcgccgaggaattgcttgctactgccaagcaattgcgtttggagcactggaagcttcaaaaggcccaaggtgttgacattatcccttccaatgatttctcattgtatgatcaaatcatggatcactctttctctttcaatgttatcccccccagataccgcctctccggtttgtcttctttggatacttactttgccatgggccgtggtatgcaacgtgctgctactgccgataaggctgccgttgatgtccccgccggtgagatggtcaagtggtttgacagcaactaccatttcttgcgtcccgaggtttctgaggagactgacttcaagttgagctctactaaggctctcgacgagttccttgaggctaaggaagctggtatcatcactcgccctgttcttgttggtcccgttacctacttgttcattgctaaggccgccaagggttctagcattaagcctattgaactcttgcccaagcttttacccgtttatgttgagcttatcaagaagcttactgaggctggtgcagagtacatccaaattgatgagcctatccttactcttgacttgccccaagagatccttgctagctacaaggaagcttatgagactcttggtaagatcggtaagctcattttgaccacctacttcggctctcttcaaagcaatgccgatgttttgaagggtctccctattgctggtgtccacgttgatgtcgttcgtgctcctgagaacttggaccgtgctcttgccgttctcggtgagaaccaaatcatctctgttggtgtcgtttccggaagaaacatctggaagactgatttccaaaaggccactgccatcattgagaaggctattagcgctgtcggcagtgagcgtgtgcaagttgcttcttcctccagcattcttcacattcctcactccctttctggcgaagaccaaattaatcctgaaattaagcgttggttcgcctttgctgttgaaaagtgtgctgaattagctattcttactaaggctgctaatgacggccctgcctccgttcgtgctgaactcgaggccaacgctgctgactgcaaagctcgtgctgagtctcccatcaccaatgttgaggccgttcgtgaacgtcaaagcaaggttactccccaaatgcatgaacgtaagagtccctttgagacccgttatgccaagcaacaagcttcccttaagcttcctcttttccctaccaccactattggctcttttcctcaaaccaaggaaattcgtgtaaccagaaacagattcgctaagggtctcatttctcaagaggaatatgatgccttcatccgtaaggagatttctgatgttgtcaaattccaagaggaagttggtcttgacgttctggttcacggtgaacccgagcgtaacgatatggttcaatactttggtgaaagaatggagggctttgtctttactgtcaacggttgggtccaatcttatggttcccgttgtgtccgtcctcctatcattgtcggtgatgtttatcgtcccgcccctatgaccgttaaggagtctcaatatgctcaatccattacttctaagcctatgaagggtatgttgactgctcccatcactattcttagatggtctttccctcgtgacgatgttcatgactctgtccaagctcaacaaattgctcttggtctcagagatgaggtccttgatcttgaaaaggctggtattaaagtcattcaatgtgatgagcctgccttacgtgaaggtcttcctcttcgtcgtgccgagtgggatgagtatctcaaatgggctatcgatgctttccgtttggctactgctgctgttcaagatgacactcaaattcactcccatttctgttattctgacttcaatgacattttcgatgccattcaacgtttggatgctgacgttgtttccattgagaactccaagtctgacatgaagttgttgaatgttcttagccgctatacctcttgcatcggtcccggtcttttcgatatccactctcctcgtgttcctcctgtttccgagttcaaggagcgtattgatgctattgtcaagcatgttcctaaggatcatctctggctcaaccctgactgtggtttgaagacccgtggatggcctgagactactgctgacttgaagaacatgattgccgctgctcgtgaagctcgtgagcaatacgct

SEQ ID NO: 25840 - DNA, 3642 bp, Schizosaccharomyces pombe
tccaacaaaggtgatcgtttaactaaaacatttgaaggttttagaaatcaattggacaaagttcaatttataaggaaactcatgtcaaaagcaaatgttgatgatttccatactcgcttgtttatattatggatgctgccatattccttaaggaaattaaaggaaagaaattactggaaatcagaaatcagtgaaatttatgactttttagaggacaaaagaacagcctcgtatggtaaaactcacaagcgttttcaactgcaaaataaaaatctaggaaaagagtccctttcaaagaaaaataacaccactaatagcagaaacctgaggaagacaaatgtttcgagaatagaatactcatctaacaaattcctaaatcatactaggaaacgttacgaaatggtattacaagctgaacttccagacttcaagtgctcaataccctgtctaatcgatacgggcgctcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctacagctccagcacattttcaatactttatcaatacaatacttggtgaagccaaagaatcacatgtagtatgttatatggatgatattttaattcattcaaaatcggaatctgaacatgtaaaacatgttaaagacgttctacagaaattgaaaaatgcgaacttaattatcaatcaagcaaaatgtgaatttcaccaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttctcctccggtgctacgacactttgatttcagtaaaaagattctactggaaactgatgcttcagatgtcgctgtaggagccgtattgtctcaaaaacatgatgatgataaatactatcctgttggatactattcagcaaagatgtctaaagcacaattaaattatagcgtatcggacaaagaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtggaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccaaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatc

SEQ ID NO: 25841 - DNA, 3269 bp, Schizosaccharomyces pombe
atgaagagtttgaaagggcgtctgttatttttaagaaaattcgtctttttttcgttgttgattcttctatttgctcatggggcttcttcttcctcttcttcgtttaattattttgataaaagaaccaatggtaaagcaaacaatgaattagctcttttttcacctactgctgattcaccttcctctgtggatggcgtattagaattgccatcggcagagaatgtcttcgcagaatctagtctttataatgccttcatagttgctactgttgatggatcattgcattcttatgatcgaattaccggccaagaactttggtcgctcttcacaaacgctaatccaggtctctcatacacaaaagatgaaaattcgcttctgtcaagtaaatttttaagtcaatcaaattttaaatcttataatagtactcatggggaattttacagtgattctactttaaacatcagttacttatctgacgacgatacagtttggtttgtagaacctatcgatggcggaatattgtacgcttttaatttacaaactggcttagtcagacttcctcattcaataaaggacctcgttcatgcatcaccaatccgtctgctaaacaacaatgtatttgttggtagcaaaaacactacgttattcactattgatgtttcaaacggggatattgtctctcaatacccttcaggccatagatatgaaacacatcactctgtgcataatttaggtacaaaaagagattctgtaccttctggcgcagactctgatttatcatttaaggacccttctggtaaaaaattgtctgaaagtttggacttgcttgatgatttcaattaccaggttactgtttcaaataaatcgtttgttgatattgctagaacggaatatttcataacaatatattctgattccaatgtcatacttgatttggtttacatcgattggacaccaactaaaaacgaaataatgtatgaatcttttcattcatcatcttttgattcgaaacttgcgctttcatcatatgacagttcgttgcacattgttgatacccattccaagttcataaaacagaacatccctttgatgtctcctgctgccacagtgtttgatatcgtaactttacctcacaacaagaagatagacaaatctcaaacacctgcgaaatttccgacttctgttctgcttcgacaaccgattgacacatacctagaaacgatgtttcctcaaattgcaagaaacaaaactgaacacgtatacataaatcatataggtaatgcatggtttgcgatgtcggaacgtcattatcctttggtatcacttgctccggaagcttccttcctttattacaatggattttatattccactgaatagtatttttggacttcattccctaatggcaacccctaagcctttttttgctttgccaggacttcctggttatgatattccttcttacgtggaatctgaaggctcaacaaaaacattaccttcaattggaaaaaaacctattcctttactagatccaaatcctatttcctctacgcctatttctatcacattttgggttataatgttcctaagtgtgtcttttacaattgttaccttcttttccattcttaggattcgctcttctgaagtcagaccgttaaaatctcagaaaaatacggtttctatcaataataaaattgatacttcaaaacgccggcgtaaaggcaaacgaagaaagagagttagcgatgagcattcggcttcttctaacttcaacgagatagaaagccaggcgtcttttgaacaaaatcaaacattggatatcttgagtgaaaatattgttgaaattcaagacaaatcaactgatcctttacaaaaaagtctcgatagcagcctaaaaagtcatcttcctgaggcaactgtaatccaaaacactgatggttcagtgactgtaaactcattgactgtttatcctgaagtaattggttatggtagtcatggtacaattgtttatcgtggtgtttatgaagatagggaggtagctgtcaagagagttttaatggagttttatgacttagcatcaagagaaataacacttttacagcagagtgataatcatcctaatatcgttcgttattattgcaaacaaaaaagtgaccaattcctttacattgtcatcgaattatgtaaatgcaacctatctgatttaatcgaaaaaccaattgcttatgatgacctattcaaatcgattgatctagtttcattgctatatcaaatagcttttggggtttctcatttacatagtttggatttagttcatcgtgatttaaagccacaaaatattttacttgttgttaataattcgccaaatctttccaaaactcgagtcagggctcttatttccgattttggattgagcaagaagttagattttaatcaaagcagtcttcgtaataccacttttgaggcagccggttcttatggttggagatctccggaaattttaagtggttccctgtctcaacaatcgaaagaaatacaagtgaaaactcgtgaaggtagaatccgacaagcttcccacgctactgatatttttgccctcggttgtattttttattatacgttaactggtgggatgcacccgtttggttcccattatgattgtgagggcaacattcttaaaggaaattattgtttggtacatttgcaatcattaggagagtgtggtgtgttggccgctgatttgattgaggatatgattgcatttgagccaagcaagcgtcctacaatcgaagtggttttgaatcatccgttattttgggactatgccaaaaagcttgattttttaattgatgtttctgatcgattcgaagttgaagaaagagatccaccttctccgttacttcaaatgcttgaaaacaattcgaaatctgtgattggagaaaactggacaacttgtttacactcgtccctagttgataaccttggtaaatatcggaagtacgatggttccaaaattctcgacattcttcgggtattaagaaataaggtattaatttaatggatgattattttacttttactaacttccttttttagagacaccattatcaagacttaccggagtctgtgcgtcgtgtactcggcgatttaccagacggattcacaagttattttgttgaaaaatttccaatgcttttattgcattgttatcatttggttaaagatgtcctgtacgaggaaagtcaatttaaacgttatctagagtattga

SEQ ID NO: 25842 - DNA, 1181 bp, Schizosaccharomyces pombe
atggcagttttactgagagataagcacataagttacttacacgatattggaaatgtaagcgaaaagaaaatagtttaataattcaattttcttacaaacagcgaactgatgagctggatttctggttgaaggagcatttacacgtcagcgcaatatattggagttgcatgagcttctggctattgaagaagaaagatcaaattgacaaagaacgtattgtatcgtttctgttgtcttgtttgacagaaagcggttagttatattactgatactgaaatattgatacgggctgctaacaatgagttaggcggatttgcttgttatccaggacacgatgatcacattacgaatacagtatacgctgtacaagttttagcaatgttggactctttgcatgtcgttgacaaagataaagttgcttcttgtaagtttctttgtatttgtacatgcgatccttaactaatttataaataattagacattattggcctacagaacgaagatggttctatgaaaggagaccgctggggagagatagacgctagatttctatattctggaataaattgtctggcaatactaggtaaattggactatcttaataaaaatactgccgtggattggttaatgaaatgctataattttgatggtgggtttggactctgtcctggagctgagtcacatggagcgatgggtatgtttaatttcaaaacccaattattgacctaatagtttttacctgtgttgccgctctcaaaattctcaacaagttagatttaattgatgaagaattattgggttggtggattagtgaacggcaagttaaaggaggtggattaaatggtcgccctgaaaagttacctgatgtacgaagattgctctttgtctagcatgtttactaatagttctagtcctgttacggttggtgggatctctcaccgttagcaattattggaaaattagattggatagaccgtaatcagcttattgattttcttctaggtacacaagatgcagacagcggagggtttgcagaccgaaaagaggatgccacagacgtttatcacacatgtttttctcttgcaggattatcactattacagtttccaaacatagaacccgttgaccctcgtttttgtctgcctttagaagtcactcaaaaaatgaaattataaatgatg

SEQ ID NO: 25843 - DNA, 924 bp, Schizosaccharomyces pombe
atgcttatgttagacggtggctctactgccattcttccaaagcttcctgaaagtatatctgagtctagattatggacctctgaagcactggtgcgttatccagagatcgttgttaagcatcatgaagaatttttaaaagtttgcgacattattagtactttcacttatcaactggatgcttctatctacgacgaaaaggtagaaggtgtaccattaaaacaggtttacgcaaacagcattgggttacctgtttatgctagagaacatttgggtttgcccaacaaatatattgctttatgtctcggaagtcatgctgctactattcctggatgtatggaatacaaaatgatttatgataaacccaccgattttgaaatgctatacaattttcataaaaacagaattgaagccattcaagcatctaatcctaaagctttcgaaaaaattgacttcattgcatttgaaagccttcctcacgtgactgaagcagaagtagtatgccaactcattcaagatatgaaaggttggtctaagcgttgctggatcacctgtacgtgccctgagcgcagcactattgaacgagtatcgtccattatctccaagatactgagcatcaatcatgactctatatggggcatcggtgttaattgctttcacctcagtttactcgaacccatcgcaaaaatgctatccagtcttttaccatccaacataactgctattttgtaccctgacggccgcgggttgtatcaaaatccagacggtactttttcacctggctcaacagatcatcctgccccttcacctgaagaatggtcaactataacggctaaatactcaaatctacataatggaaacctgatactcggtggatgctgtgaaacaaattataatcacttatctttactccgggagaaaacgaag

SEQ ID NO: 25844 - DNA, 1545 bp, Schizosaccharomyces pombe
atgggacaggggagcagtaaacacgccgacagcaagctcgattcctacccatccttttctcggtcagacactcaaggatccattaagtctttaaagtctctgaaaacagtcctggggaagggcaaagactcgaatcatgatcgccgaacgtctactgatacaacccatagtcgtcaccggtatcccgaaacaccaccaagccttcctcctcctccttctcctgggatattagctacatctccggctgtgttgcaaaagcatcaacaggaggattcgggaaattcttctcaatctccgacgtcgccgcatccttctaaccagcctgccatgcttagtccctctacggccgcttcccagcatcatcatcatcattcttcttcttcttcttatgccgtttctccaacatcacctacctcaccaaccagctctggcccaattggctccaactttgattcagcttctgagcataatggtcctgtgtatccacaagatcagcaggggcccgtaattatccctaattcggcaatttcttctacggatcctgatgatcctgaaacagttgttagccttaacgtagatgaaatgattcaaagattgatccatgttggctattctcgaaaaagtagtaaaagtgtgtgtctaaagaatgctgaaattaccagcatttgtatggccgtacgagaaatatttctttcgcagccgacacttttagaattgaccccgccggtgaaaatcgttggtgacgttcatggtcaatattccgatttaattcgactgtttgaaatgtgtgggtttcctccgagctctaattatttattcttaggcgattatgtcgatcgtggtaagcagagtcttgaaaccatcctcttgctctttttgtacaagatcagatatccagaaaactttttcttgctacggggcaatcatgaatgcgctaatatcactcgcgtttacggtttttacgatgagtgtaaaagacgttgcaatatcaaaatttggaagactttcataaacacctttaattgcttacccattgcgtccgttgtagccggtaaaattttttgcgttcatggtggtctttctccatcgttaagtcatatggatgacatacgggagattcctcgtcctactgacgttcctgactatggattgctgaatgatttgttatggtcagatcctgctgatactgaaaacgattgggaagataatgaacgaggtgtttcttttgttttcaacaaaaacgttatccggcaatttttggccaagcacgactttgatttaatctgtcgtgctcacatggttgttgaagacggttatgaattttttaatgacagaactttatgtacggtgttttctgcccctaattactgtggggaatttgataattggggggccgtgatgagtgttaattcagagctgctttgttcctttgaacttataaagcctctcgaccaggcagcaattcgacgagaattaaaaaagagcaagcgtagtggtatggctatttatcaatctccccctgctgagcaggttacccaaagcgtg

SEQ ID NO: 25845 - DNA, 1808 bp, Schizosaccharomyces pombe
aaaactctcccattcagcgaaaattttataatggcagattccgaagaatacaagactgtcattggaatttcttttggaaatcaaaacagttctattgcttttaatagggtaagaaaatttttttacttggagaaatgagtaatctcctagttcattcgcatagacttgctttatgcaggcagacgagaatccttagtaaattttcaaattaaagaagctaacaaatcaaacaggatggaaaaaccgatgtattagcaaatgaagagggaaatcgtcaaatcccttcaattttgtcgtatcacggtgaccaagagtatcacggagttcaagctcgcggacaacttgttcgaaatgctgataactcagtaactaacttccgtgatttgcttggaaaatctcatgatgaattgacacttcatcactgtcattattctgccaatcccgtgaatgtggagggtcaaattggtttcaagatcactgttcaagaggacgaagaatctgatcctaaagaaaagattttgactgctcatgaggctagtgtccgtcacttacgccgtcttactgagtctgctgaggactttttgggtacaaaggtcaacggatgtgttatgtctgttcctgtctattttactgacgctcaacgtaaggctctggaatctgctgccaatgaagctggacttccagttttgcagttgattcatgacccggctgctgttattttggccttaatgtattccgaagaggttctgatcgacaaaactgttgtggtcgctaactttggtgccactcgctctgaggtctctgttgtatctgttaagggtggtctaatgaccattttggcttcagttcatgatgagaatttgggaggtgagcaattaactgatgtgttggttaatttctttgccaaggagtttgaaaagaagaatggaattgatcctcgcaaaaatgcccgttcccttgctaagctccgtgctcaatgtgagatcactaagcgtgtacttagcaatggtactaccgcttctgctgctgtagactctttggccgacggcatcgacttccatagtagcattaaccgccttcgttatgaccttgcagcaagcgccactttaaatcgcatggccgatcttgtaaccgaagctgttgaaaaggcaaacatggagccttttgatatttctgaggttattttagctggtggtgcctccaatactcccaaattaacttccttgatggaatccattttccctgaacaaactatcatccgttcctctagttcagttactcctttgcaattagacccttctgaacttaccgcgatcggttccggtgttcaagcttctttgattgggcactttgatgctgctgacattgctgcttctactgatgcacaagtggttgatgttcctcaccttactgctcctatcggtatcaacgaaggtgagaactttgttactattttcgacatcgagactgctttgcctgctcgaaagactgttgaggtgattgctcctaaagagggtgctgcctttattccaatttatgaagctgagcgttcagtaaaggttaccaaagttgaaccggagcctattgatgaggaagaggcattttctgatgatgaagaagaggagccagaggagattaaagagcgtatcgctatacccaagactttgattgccaccattactcttcctgatgtttctcctaatgccaagatcgagctggttcttcaaatagatgctgaagggaaattaacggcaagtgcacgtcctaaggatggcaagggaactaacgttcgtggatctactgcataa

SEQ ID NO: 25846 - DNA, 1767 bp, Schizosaccharomyces pombe
atgcaaaccccttcttctgcatcggcagagtctgaaaaggattcaggaaacacctatgttgggccttggcttttgggaaggactttgggacaaggaaacttggccaaagtgaaatgtaagtacatgaggtgaaatttagttgactttgtcttgtaggggcttgttaataagatagagtagactacttatagacagtagagatagactacttaggtgtcatggttatcttgcgcatcgatcgtctttgattttgtttttggcaattgtacgatggctaacagtgtagtgggcaagcattttcaaacaaatgaaaaggtcgcattgaaaatggtttacaatgatgaattggaagataaagatacgtggaagcgtttacaaagagaagtgacaatcttaaggcaattgcaccatccaaacattatcaccctataccaggtgtttcgggttcccaagtacacagtgctcgcactagagtatatggatactgatttgcacagtatggtggttaagcataatcgactggatgaatgtaccactcgcaagatttttcgacaaattgtccatgccatcgattattgtcatcttcatcgtgttgctcaccgagatttgaagttggaaaacattttacttaataaagatctggttgtcaagctcacggattttggcctttccaattttatgcttgatggttcctttctgagtacctcttgcggtactccccattatgctgctcctgaggttattcaaggccgttattatgatggttgtgatgtagatgtatggggttgcggaatcttattgtatttgatgctcgtcggcgagtttccctttgaggatgtaaccatctccaatgtattaagtcgcgtttgtaaaggaatctacaccattcctagttttgtatcttcttcagcctcagatctcattcgtcaaatgttaatggtgcttcctacttcacgaatcaaagttgcagaaataatgcaacatccttggtttatcgctgatcttcccacgcattcccgtttaccttcccgtacttcatccttttcttccaagcatcgatctgtcaccttttctcctccagatcttgctattcttttcgacccttccataacttcgccttccagtagtgtaggtcaaattcctcagcccacagatcactcagccctatccccgtcaaaaccaatgtccatttcaggtactgaatctcctaatccagatcccgcatctttatgttattcgtcgtatgaggacttgtattcggctacttcgtggcattctgacatggcagaatcatccggatttttagatcctactgatattccaccaattccttctaacgttgaaactttacgctcttctcttccacagagacatgcttcattcatgaataaggtctacaaccatccattatcccgacctcccgcccccaaccgacttcgttctttacgctggcattatgggattcaaactgccaaaaatccaattgaagtattgagaaagctatgtgaggctttacttgagttaggagctcggtttcggccctgtgatgaggaatcttttctaaaggaaaataagtataaagtgttttcatgcattacatgtcataattctcctgtttatctggttattgaattattctctattggaccatctgctagcgtgattgatatccgcttttctagtagtgatgattctataaagtacacttcatcttacagtccaatgccatttttagaagttgtcaaacaattgatccttaaaattgca

SEQ ID NO: 25847 - DNA, 1077 bp, Schizosaccharomyces pombe
atgtctcaatacgacgttgaacctcttctctccaaggctgctattttaaacaagtatgccgatcttcctcaaaatggtaaggttatggctgagtacatctggatcgatggtttcaaccatcttcgtagcaagaccatgactctcgatgccaagccttcctctattgaccaattgcgcgtttggaactttgacggctcttccaccggtcaggcccccggcaacaattctgacactcttttgaagcctgttgccatgtacaatgatcccttccgtcgcggtgacaacattctcgttctcgctgcttgctacaccgctgatggctctcccaacggcttcaaccatcgtgacgcttgcgccaagttgttggagaagcacgctgacaaagaaacttggtttggtattgaacaagaatataccatgttggactactatgaccgtccctttggctggcctaagggtggtttccctggtcctcaaggtcctttctactgcggtgttggtactggccgcgtctttgctcgtgacatcgttgaggcccattacaaggcttgtctttacgctggtatcaacatttccggtatcaatgctgaggttatgccttcccaatgggaataccaagtcggcccttgcgctggtattgaaatgggtgaccaactctggatgtctcgtttccttcttcaccgcattgccgaagattttggtgtcaaaatctccttccaccccaagccaattttgggtgactggaatggtgctggttgccacactaacgtttctactaaggacactcgtgctgaaggtggtataaaagctattgagtcttatctcgagaagtttgccaaacgccataaggagcacattgctgtttatggtgacgacaacgacttgcgtcttaccggtcgtcatgaaactggttcaatcgataagttcacttatggtgttgccgatcgtggtgcatccgttcgtatcccccgttctgtcgccatgaatggttgcggctactttgaggatcgtcgtcctgcttcttccatcgatccttacctcgtcactggtatcatcactgagaccatgtttgagcat

SEQ ID NO: 25848 - DNA, 1056 bp, Schizosaccharomyces pombe
atgaaagacggttataaaattattgggtttatctcatctggaacttatggaaaggtttataaagcggtttcatctaattcgaatgataaacgactgtttgcaattaaaaagttcaaagctgagtcaaagcaagtaagctcgaatgctcaacaaaccggcgtttctcaaagtgctattcgtgaaatgatgctgtgtagagaaattcagcatgaaaatatagttagcttggttcaagttttactcaaagatggcacaattagcatggtttttgaatacgccgaacacgatctgttgcaaattattcatttccatagccgatctagaacaagacaaattccaccatcaattttaaaaagtattctatggcagatcattaatggtgtagcatacctacatgaaaactggattatgcatcgagatttgaaaccagcaaacataatgattacagctacaggcaaggtaaaaattggggacctagggctgggaaggctcattcgggatcccatattaccattttattccagcgatcgtgtagtagttactatttggtatcgtgcgccagagctacttttgggagctcacgattataccccagcaatagatgtttgggcaattggttgtatttatggagaaatgcttgctctttctcctcttttcaaaggagatgaaataaaaatggaagataaaaaagtcgttccttttcagagtactcaaatgctacgcataatggagttactaggcacaccaacagaagaacgctggccaggtctcaaaaattatccagagtactatcaattatcatcatttgaagttcgttactggaataatttgcttcctcagtggtatcaaaccgtaaaaaatcgggatccgcaagggttagatctactgatgaaaatgctacaatacgatccaaaatcacgcataactgctaagcaagctttggaacacgttttttttacttccgataaattatggaccactaggtacgtgttcttccttttcctatttatcatcgaaagaaataagcttttactaactcactttttagcccatttt

SEQ ID NO: 25849 - DNA, 1269 bp, Schizosaccharomyces pombe
acctgctctgctcctggtaaagtacttatagctggtggatacattgttttagatcctcaatacagcgggcttgttattggtttaactgccaaagggtacgcttccacaacgactttggacgataaatgtggaacggttcgtgtgaaaagccctcaattcattaacgctgaatggctttataatattgattggactgtatctcctattcgagttcatcagatatatgaaaactgtgaattggaaaaaaatccaaaccccttcgttcaactggcacttttttatgtaattaactactttttttccacggggcgacaacctttatgctggcaagatcttcaagttacattgcaggtagataatgcctattatcaccaaccacagttaaagcctgatcaaacaagctatccaaaattcaatttcttaaactgtactttaggtcaagtacataagactggtttaggaagctcggcagctatgattacaagtcttataggttcattatttttaagtcttagacgactaacagatgacactggtgacaaatctctcaaaattgatgattcaaccaaagtcatagttcacaatctggcacaaattgcccactgttctgcacaaggaaaagtaggaagtgggtttgatgttggcgctgccacttggggaagttgtatttatagaaggtttgatcctaaattaattgaacaactgctggtcccatacgacgaacaaataaagaacataaatttttccaccgaactgagaaaaatagtttctaaaaaatggtcagatgttgttccatttcaattgcctgctacttattgtttgctaatgggggacgtagctggtggcagtagcacaccgggtatggtaaaaaaagtacagcaatggcaaaaggaaaatccagaggaatctaagaattgctttgatgatttgtattcaagagtgctttccatcaaaaactgttttctttcttctgaaagcttagactctgaacttcaaagtcaatttcgatccattcgtcgtattcttcaaagaattaccgttgaagcaaaggttgacatagaacctttaaagcaaacaaatattttagacaacatagagcagttgcctggtgtcattggtgtgggagttcctggagccggcggatttgatgcacaattttgtttggccattaaccatacggagataatcgaaaatgttatcaaaacatggaaagatgatggggtagtacccatggacgtttctcctgctttcgatgggctagccgtagaa

SEQ ID NO: 25850 - DNA, 1896 bp, Schizosaccharomyces pombe
gcgggaggaattgaactggccaagaaggctatcaggagcctcaaaaattacgacgagcatgaaaaccgatatggatctattttcagcgtttctggtcctggtaagaaatcgttagttggagctttctactaaacatttacagtcgttgttgcagccaatatgcttggatgttcgatgtacgaactcgttcgcgttggtcatgaagaactagttggtgaagtaattcgtatccatcaagataaatgtactattcaagtatacgaagagacgtccggtctcactgttggtgatcctgtccaacgcactggaaagccattatctgttgaattaggtcctggtttagctgagactatttatgatggtatccaacgtccgttaaagcaaattttcgacaaatctcaaagtatttatattcctagaggtattaatacagaatcacttaatcgtgagcataagtgggatttcacaccaaataaggatttacgcattggcgatcatgtatccggtggtgatgttttcggttctgtatttgaaaactctcttttcaatgatcataaaattatgttaccccctagagcccgtggtaccgtcacatatattgctgaagctggatcataccatgttgatgaaaaacttcttgaagtcgagtttaatggcaagaaacattcttttagtatgttgcatacttggcctgtccgtgctgctcgtccagttgcggacaacttaactgctaatcaacctttattgactggtcaacgtgttttggatgcgttatacccctgtgttcaaggtggcactactgctatccccggtgcctttggttgtggtaaaacagttatttcacaatctctttctaagtactctaattctgatttgattgtttacgtcggttgtggtgaacgtggaaacgaaatggcagaagtgttaatggatttcccagaactaacaattgatattaatggtaaaccagagcccattatgaagcgtactacattggtagccaacacttctaacatgcctgtcgctgctcgtgaagcttccatttataccggtattacacttgctgaatattatcgtgatcaaggtaagaacgtttcaatgatggctgattctacatctcgttgggctgaagctttgcgtgaaatttctggtcgtttggctgagatgcctgccgattctggttatcccgcttatttgggtgccaaattggcttctttttacgaacgtgctggtcgtgctcgttgcttgggaagtcctgaccgtgaaggaacagtttcaattgttggagctgtttctcctccgggtggtgatttttctgatcctgttactagtgcaaccttgggaattgttcaagtcttctggggtttggacaagaaattggcccaacgtaaacactttccctcaatcaacacctctctttcctattctaaatacatcaatgctttgcaaccttggtatgaggaaagagttccaggctttaatactcttcgtgatcaaatcaaacagatcattcaacaagaagattccatgttggaaattattcagttggttggtaagtcggctctttctgaaacggataaagttactttggacatagccggtattattaagaatgacttcttacaacaaaacggttattctgattacgatcgctgttgccctctttacaagacttatcatatgatgcgaaacatgattgcttactacacaaaggctaaaagtgccgttgaaactggtagcgttccttggtcaaagattaaagaaagtacttcagatatcttttatgagttaacctcgatgaaattcgaaaaccctaatgaaggcgagaaggaaatagtcgaacactatgaaactctgcacaagaagattgaggacaagtttcacactctgactgag

SEQ ID NO: 25851 - DNA, 1230 bp, Schizosaccharomyces pombe
atggatagggaagatatcttaaaggaattttgcaatcgcaataatattgacgttagtcagggccgtttttttttagagtccacgaattggaattatgaattggctactgcacttttacatgaagtaatacctcctgaagaagaccatgggttgcaaccttccagtgatgtatcgaaagttcctgaagttactggaagctcaagtggaatcagtggtggtgatcaacaaccacctcgaccgttgcaaagacaacaaaatactcaaggccaaggaatgaagtcaggaactgcatcaaaaaaattcgccacgcttagggatttagagggaaatgatgaaagtgcagaagagaaatcacatctctttactggtggtgagaagagtgggctttctgtagaagacggtgatcctgatccaaagaaacagttggtgcgcgatattctcgaaaaggcacgtcaacacacaatatctcctttagatgagcaagattcaggtccttctagtcttgcatcgtcttgggctagtgtcggacaacgattaggcacagaaaatgaggcttctggttcgaccactcctgtaacgcagtcaggtcctccgcgtgaaaatcctcctactgagagtcaaccagaaaagcctttacgtcgtactttgtacttttggcgaaatggttttagtgtagacgatggtcctatctatacatatgacgatcccgctaatcaagaaatgttgcgttatataaatagcggtcgagcacctttgcatcttctaggagtatctatgaatcaaccaattgatgttgtagttcagcatcggatggatgaggattatgtagcgccgttcaaacctttttcaggcaagggacaacgtctcggttctacctacatgcaaccacgaatgtctcaaatgccaggtggtctttacactgatacttctacttcttcctctgttcctataaatgtcaaacccaattcaacaactccgcatgcatctttacagattgacgaaaataaacccaccacgagaattcaagtacgcttatcaaatggtggaagaactgtccttactgtcaatctctcgcatacacttcatgatatctatgaagctgtacgcgccgtttcaccaggcaacttcatcctttccgtacctttccccgcaaagactctcgaagatgatccgtctgtcactgttgaagctgcttcattaaaaaatgcctcacttgttcaaaaatctctg

SEQ ID NO: 25852 - DNA, 1923 bp, Schizosaccharomyces pombe
atgaagattgttgatttgattgataaaattcctaatggaaacgcattctactcatttgagtattttccaccgaaaaccacagtcggtttggaaaatctttctagtcgtataacgagaatgtcgcgaaacatgatgccattattttctagtgtaacatggggtacagctggttctactgcggaggtctcaatttatttagccaaaatgctagagcagcatcacaaaatcccagcttgtttacatttgacgtgtaccaatgtagataaagccataatcgataaggctctcgaaactgctaaggaatatggaattcgtaacatcttggccttgcgaggtgacccgcctttaaatagcgatcattgggaaggaaaggttagtgagtttgagcacgcggtggatttagtacgatacatacgtgaaaaatatggagattacttttgtataggtgtcgctgcttatcctgaaggtcatgtcgattccaacgttccggagctgtctaaagatccgttacgagacattcctttcctgattgaaaaagttgaagctggcgctgatttcataattactcaaatcttctacgagcccgaagcttttattaaatttgaaaattttgttaggaatcatagctctaatgctttacgaaatattcccattattcccgccattatgcctattcaatcctatggaagtcttaaaagaatgactcgtctttgtggttgcagtgttccctcttccttaatgcagcgccttaatgcagctaaaccagatgatgaagctataaaaaacattggtgtcgagcacatagttgatatgattaaaaagataatggacaatgtgcaaggccgggtgcatggatttcatttttgcacactgaatttggaacgatccgttgctcttatccttaaaaacagcggtttgcttaccaaacgttggaaacaggttgagtcagagatggaggatgagaaattgcttcgaacaacccgcaaacgtcttagccttgatgaacccgcggaacttcataatcaagtagttgttccctctcagcaaccagttgccgacaaatcgtcgaatcttttcgtaacttctaaacaaagtagtgtatctggccacaaagacaatttaaccgaagaagcaccgttctccgtttctgaaggtagtggagttttaggtcgtcaagcaaattgggacgattttacaaatggtcgttttggcgatccacgctcccctgcatatggtgaaattgacggttatggtccaacattacactttcctccaagtgaagcattaaaactttggggatatccggtggatgaatctgatatcacttctttgttccagaaacatattatgagtgacatatcagcaattccatggattgatgagcctgttgaagtggaaacgaaaactattgcgaagtatcttttaaaactaaatggtaattcttggtggacagttggaagtcaaccagctgtaaatggtgctccatctgctgatcccgtttttggatggggtcccaaaggaggaagagtctttcaaaaagcgtttgttgaatgttttgtcaacggtaaagatttgaaggattttattacgaaatggcacgacaatcctcaggttacctattacgccggaaataacaaaagcgaattcctaacaaacgctcccaaagatggtgcaagcgccgtgacatggggtgtttaccccggtagggaaatcattcaatctaccattatagcagaagtttcttttaaagcttggttaagtgaatcatttcaagtatggggtgagtgggctaatttgtactccaagaatactccttcacgaaaacttttagaaaattgcattaatgacagatggttagttaccgtcattcaccatgattttatggataaaaatgggttatggaaagtcttagaaatcgacttc

SEQ ID NO: 25853 - DNA, 2163 bp, Schizosaccharomyces pombe
atggacagtggtgagatgcaccacccttaccaagctttttcaaaagtcggtaaatgcgaaatttcacaaaccaacccaagcttttcatccggaatgcggtgcctggtcagaagcgcagatatccagtttaaaggtatttgtgggttaactcgtgggtttgctagttttaataagcccccccagaccatcactgaaaaaattgtacaaaaatttgcacaaaatattccagaaaataaatatgtacgttctggagattatgtaaccattaagcccaagcattgtatgtctcatgacaattcatggcctgtcgcattgaaattcatgggcattggagcgaaaaaggtatttgataatcgccaaatcgtatgtaccttagatcatgatgttcaaaacaaaagcgaggcaaacttgcgcaagtataaaaacatcgagtctttcgctaaaggacaaggaattgacttttatcctgctggtagaggtatcggtcatcagattatggtagagcagggctatgccatgcctggtagtatggctgttgctagtgattctcattcaaatacatatggtggtgttggatgcttgggtactcccatcgttcgtactgatgctgcagctatatgggctacagggcaaacctggtggcagattcctccaattgctcgcgttaatcttgtaggtcaattgccaaagggtttgtcgggaaaggacattattgtttccctctgtggtgcttttaatcatgatgaagttttgaaccatgctattgaattttacggagaaggtttaaattctttgagcattgaatcccgtttaaccattgctaatatgactaccgaatggggtgccctttctggattgtttcctaccgacgaaaaactcttagcctggtatgaggacaggcttaaatttttggggcccaaccatcccagagtaaatcgtgagactcttgatgccataaaggctagtcctatattagccgatgaaggcgcattctatgctaagcaccttattttagacttgagtactctgtcccctgccgtgtcaggccctaattctgtaaaggtttacaattctgctgctactcttgaaaagaaggacatcctcattaagaaagcatatttagtttcttgtacaaatggtcgactttccgatattcatgatgctgctgagaccgttaaaggtaaaaaggttgccgatggtgtagaattttatgttggtgctgcttccagtgaagtcgaggctgctgctcaaaaaaatggtgactggcaaactctcattgatagtggtgctcgtacacttcccgctggttgcggtccatgcattggcttgggtactgggttacttaaggatggcgaggtcgggattagtgctacaaatcgtaactttaaaggacgtatgggtagtcgagaggctttggcttacttggcatctcccgctgttgttgctgcttcagctattgccggaaaaattgttgctcctgaaggcttcaagaatgccgtttccttggtctctgcggtcgatatcaccgacaaggtaaacaagcaaactgcttccaagagctctactgaggctgttgattctgaaaccgccattattgacgggtttccttcaattgtcgctggtgaaattgtcttttgcgatgctgacaatttaaacactgatggtatttatcctggtcgttatacttaccgtgatgacattaccaaggaagaaatggcgaaagtttgcatggaaaactacgattctgaatttggcaaaaagactaagaaagacgatatccttgtcagcggttttaactttggtaccggcagcagccgtgaacaagctgctacagctatcctttctcgtggtatccctctagttgttggtggttctttcagtgatatattcaagcgtaactctattaacaatgccttacttgctattcaattgccagatcttgtacagaagcttcgtactgcatttgctaatgagtccaaggaacttacacgccgcaccggttggcacttgaaatgggatgttcgtaagagtactgtgactgtaaccacttctgataataaagaaatgtcttggaagattggtgaacttggcaattccgttcaaagtctatttgttcgtggcggattggagggttgggtcaagcatgaaatttccaaatccaat

SEQ ID NO: 25854 - DNA, 945 bp, Schizosaccharomyces pombe
  unsure (1)..(945): unsure at all n locations
atgtcttttcatattacgcccatatggatgtggaaaggaacgggcaacaactatgcctatttgctgacttgtgataaaaccaaaatcactgccatcgtcgaccctgctgagcctgaganggtaagtgaagagaatgaaataacgacttaaatactgttatctgtgatttcggaaacatgattttctcctcctgttttccgaattgttttgtttgtgcgctccgtaacatttaattaaccaaactaacattgacaaactctagtgttattcctgtcataaaagagaaaacggcgaagaaagaaattgatttgcagtacattcntgaccactcatcatncactatgatcatgcaggcggcaacgaagacattttgagctactttccttctttaaaggtctatggcggnannaaaaaatgcatctggtgtcacatacactcccaaagataaggagattttcaaggttggagaagttcaagttgaggctcttcnatacgccatgccatacccaagancagtatttgttattacgtttcctctccttncaaaanagagccgtgtnttactggagatactctttttacatcaggctgtggtcgcttttttgaaggagatgccaaacaaatggactacgctttgaatcacgtccttgctgctttacccgatgataccgntaactntacccntggtcatgaatacaccaaatcnaaatgccaagtttagttccacgatcttctctactcctgagcttnacaaaattggntggatttttgcaagnaatcatgaatctnactactggtncactnttaccatcggtgacgaaaagaagttcaatccattcatgtgccttgggttagaatcggtacaaaaagcagtgggcagtagtgnatccaatcactgttatgaagaaattgcgtgacatganaaaacgctgcttagaccgactt

SEQ ID NO: 25855 - DNA, 913 bp, Schizosaccharomyces pombe
atgtcttttcatattacgcccatatggatgtggaaaggaacgggcaacaactatgcctatttgctgacttgtgataaaaccaaaatcactgccatcgtcgaccctgctgagcctgagaggtaagtgaagagaatgaaataacgacttaaatactgttatctgtgatttcggaaacatgattttctcctcctgttttccgaattgttttgtttgtgcgctccgtaacatttaattaaccaaactaacattgacaaactctagtgttattcctgtcataaaagagaaaacggcgaagaaagaaattgatttgcagtacattctgaccactcatcatcactatgatcatgcaggcggcaacgaagacattttgagctactttccttctttaaaggtctatggcggaaaaaatgcatctggtgtcacatacactcccaaagataaggagattttcaaggttggagaagttcaagttgaggctcttcatacgccatgccatacccaagacagtatttgttattacgtttcctctccttcaaaaagagccgtgtttactggagatactctttttacatcaggctgtggtcgcttttttgaaggagatgccaaacaaatggactacgctttgaatcacgtccttgctgctttacccgatgataccgtaacttaccctggtcatgaatacaccaaatcaaatgccaagtttagttccacgatcttctctactcctgagcttacaaaattggtggatttttgcaagaatcatgaatctactactggtcactttaccatcggtgacgaaaagaagttcaatccattcatgtgccttgggttagaatcggtacaaaaagcagtgggcagtagtgatccaatcactgttatgaagaaattgcgtgacatgaaaaacgctgcttag

SEQ ID NO: 25856 - DNA, 1668 bp, Schizosaccharomyces pombe
atgactccaactatgaaatcaatagcccgtaggaaggctttgttaattgcactatctatatttgctgttacgttcattttatggaatggattcccaggctcatcaaaccgacctttaccatcttcaaacgacgaattccattatgaggacatcgagcttccttcaggctacagaagtgaaggagaggtagtcgatcttttgaatcccaaggatgagttagaggaacctcttttttccgaagaacctttatttcctgttactacctctatccctactaagactgctgtttctaaacctaaaatagctccaaccagtgcggcaaaggatgtaacattttcttcttctattgactcagatgattgttctgtggcttatgataacagcaagcctgttcgtcaatatgttttgatgatcgatgctggttccactgggtctcgtgttcatgtttaccaatttaacaactgcaatccttctcccaaattagaagaagagttttttaaaatgatagagcctggcttatcttcttttgccggtgatcctgaaggagcagcggcatccttagacccactacttgactatgccatggaaaacgtgcctgaggaatatcgtcgttgttcccctattgctgtaaaagcaaccgctggtttacgattgactggggaaagtgaggctaaagctattttgaaatcagtgcgacaacatttggaaaacgattacccttttcctattgtaaaagacggtgtttctatccttgaaggttccatggaaggtatatatgcgtggattaccattaattaccttctaggaactttgggtggtaaagccacgcactctactgtcgctgtaatggacctcggtggtgcttctacacagcttgtttttgaaccacgtttcgcttctgatggcgaatcgcttgttgatggtgaccataagtatgttttagactacaatggtgagcaatatgaactttatcaacattctcacttaggttatggtttgaaggaagctcgaaagctgattcataaatttgtgctgaataatgcagaggccctaaaggagtcattggagttgctcggtgattccactagcatcatccatccatgtttgcatctcaacgctagtctaacgcacccggattcaaaaagcgaagcttctgaggtcgtgttcgttggcccttcgttagcccatctttctcttcagtgtcgtggtatagcagaaaaagccttgtataaagacaaaaattgcccagtccgtccttgttctttcaatggtgttcatcaacccaagttcactgagacgtttactgattctcccatttatttaatcagttatttttacgatcgtatgatcagtttaggcatgccaagcacttttaccattgaagatatgaaatatttggcaaatagtgtttgtagtggaccaacatactggcaggacgccttttctttaactgacgcccttaaagagttgaaagaagagccagagtggtgtttagatttgaattatatgatttctttactttcggttgggtatgaaatccccaataaccgacagctccatactgctaagaaaattgacaacaaggaacttggatggtgtttgggagctagtttgtctatgttgtcagagcaaaacaatggttggaattgtaacgtgaaagaagaaatt

SEQ ID NO: 25857 - DNA, 2496 bp, Schizosaccharomyces pombe
atggaagaagaaggacataaaagtttaactgtaagaacaaatttaagtgtaatttattaatttttttccttatagtcgcatctacctcagtcctcgagttctttgtcgcaaagtcgagaaattgctaaagaatttacgtctaatatacctcctccgactattaaaactaattcatcttcatcaaatattctgaaacctcggttatcattgcaaaatgaagttaaccaactgaaacctgctaaatttcccagtaagatgttaccaccaggaagcttagcctcggttaaatcttctagtcttgcaaaaaaagccaggccttttaccgcgtcctctaatcccaggatgcccaagtctgcacatcccatttcaagtcggtcagtgtctgcttcttctcattttggtagacctgccagtgctgtttcatccagtttaaatagtagcgatgatgtgagaagtatgtcagatgaaagtatggaatcttataatgatgaaaagtctgttaatgccagcgccttaaggactacagaagaccggttgaggagtatggaaatggcttatgctcaattatcggctaaagttattccttcaccctcaaaaagaccagctaattacaaattttacgaacagagaattgctatgcttgaagaatcattagaagtcgagaggagtcgtacatcggagttacaagaacaattttcagtggctctgagagaaaaagctgaggcggaggctaataaaatcgtttctcaaaagggtatggagagtttggagataatgttaaactcaatgaaaagtgaaaatcatcagcgcatggccatgttggaagagaaccatgctcgggtgatggagacagctgagcttcagcatcaagcagaattacaggattttgcttccaatattgaacaaaaagcaaatagtttaatcatggagtacaaaaatgaattgcagtctgccgaagaacacttttcacacaagattaaagagcttacttcagaaaatgaactcaaaatttccagactacaagaggaaaaggattctttattaaagaaagttcaggagggcgcttcgctggctatgcaacgtgtccaaaataagcatgatctagaaaaaaaaagactgcaatctgcaattcaaccgcttcaggaagaaaataattctttgaaacagcagattgaacaattacaaagagaacttgcttctgaaacagttgttaaggaaaatctgaaatcttcgttggaccaacaaagtgccaacgttcagaagcttgaatctacaaatcgggctttagaaagcactatcaaaacacttgaagaagatgtttatactatgaaaaataagattatagaactagaaggcattttaaaatctgccaatgttgagagagacggtttagttgagaaactcatagctgaggaaactctgagaagaaaactccataataccattcaagaacttaaaggtaacatacgcgttttttgtcgagtgcgacctccccttggcgatggagaatcagcacaaatagcttttcctgatcaaaattccgaagctagtactatagagattgttgctcaagccccagggtcttcgttaacagggaacgggataaaacagtatgcctttaatttcgatcgtgtattttcccctgaaacgactaatgaggatgtatttaatgaactgtcacagttaattcaaagtgctatggacggatataatgtttgtatattcgcttacggtcaaacaggttcaggcaagacgcatacgatgtcttcaaatacaggaatgatcccttcatctgtaagaatgatatacaatcgctctacttctttgaaagaacgaggttgggaatatcggatggaaggacaatttctagaaatatacaatgaaaccattattgaccttttagcctccggaaatgaagaagagaagggaaagaaaaaactggagatatatcatgacacgaaggccggaaggacgactattaccaatataaccagcgaaccgttagacacacctgagcaggtaacctggttgttagatcaagcttcgaagaaccgttctgttgcggctaccaatgctaatgaacattcctcaagatcgcattcagtttttatgctacacttgaatggaagcaattctacgacaggtgaaacatgcagaagtacgcttaatttgattgatctggctggatccgaaagactttcgagtagccaaagtgtgggtgaacgtttgaaggaaacgcaggcaatcaacaaaagtttaagttgtttaggagatgtaatacatgctttgggaagtggaaaggaaggaacgtacattccgtatcgaaattccaagctgactaatttgttacaatattcgttgggaggaaatagtaaaactctcatgtttgtcaatatttccccactaaaacagcatgttcccgaaacattatgcagtttgagatttgcaacaaaggtaaataatactcaaattggcacagcacgcaaagtcacaaaa

SEQ ID NO: 25858 - DNA, 2022 bp, Schizosaccharomyces pombe
atgatctcgtcgagattcactaatgtagtccgtagcggattgcgtttccaaagcaagggagcatcgttcaagattggcgcttccttgcatggaagtcgcatgaccgcccgctggaattctaatgcaagtggtaatgaaaaagttaagggtcccgtaatcggtattgacttgggtaccaccacctcatgtttagcaatcatggagggtcaaacccctaaggttattgcaaatgccgagggtacccgtaccacaccatctgtcgtcgcatttaccaaagatggcgagcgtttggtgggtgttagcgctaaacgccaagccgtcattaacccggaaaacacattttttgctactaagcgtttaatcggtcgtagatttaaagagcctgaagtccaacgtgatattaaggaagttccttacaaaattgtcgagcactcaaatggagatgcttggttggaggctcgtggtaagacctactctccatctcaaatcggtggtttcatccttagtaagatgagggaaactgccagcacctaccttggaaaagatgtaaagaatgccgttgttactgttcctgcttacttcaatgactctcagcgtcaagctaccaaggctgctggtgccattgctggtttgaatgttttgcgtgtcgtcaacgagcctactgccgccgctttggcttatggtttggacaagaagaatgatgccatcgtcgcagttttcgatttgggtggtggtacttttgatatttctattttggagttaaacaatggtgtttttgaggttagaagtaccaacggtgacactcatttgggtggtgaggactttgatgttgctcttgttcgtcacattgtcgagacctttaagaagaatgagggtttggacttgagcaaggaccgtctcgccgttcaacgtattcgtgaggctgctgaaaaagctaagtgcgaactttcctctctttccaagactgatatcagtcttcctttcattactgcggatgctactggccctaagcatattaacatggaaatctctcgtgctcaatttgagaaacttgttgatcctctcgttcgtcgtaccatcgatccttgcaagcgtgcccttaaggatgctaacttgcaaacctctgaaatcaatgaagttatccttgtcggtggtatgactcgtatgcctcgtgttgtcgaaactgtcaagagtatcttcaagcgtgaacccgctaagtccgtcaaccctgatgaagctgttgccattggtgctgctattcaaggtggtgtcttgtctggccatgttaaggaccttgttcttttggatgtcacccccttgtccctcggtatcgagactttgggcggtgttttcactcgtttgatcaaccgtaacactaccattcctactcgcaagtctcaagttttctccactgctgctgatggtcaaactgccgttgaaatccgtgtcttccagggtgaacgtgagcttgttcgtgacaacaaattaattggcaacttccaacttactggcattgctcctgcacctaagggtcaacctcagattgaggtttcttttgatgttgatgccgatggcattatcaatgtctctgcccgtgacaaggctaccaacaaggattcttccatcactgttgctggatcttccggtttaactgattctgagattgaggctatggttgccgatgctgagaagtatcgtgccagtgacatggctcgcaaggaggctattgagaacggaaacagagctgaaagcgtctgcaccgatattgaaagcaaccttgacattcacaaagacaaattggaccaacaagctgttgaagacttgcgctccaagatcaccgatctccgtgaaactgttgccaaggtcaacgctggtgacgaaggtattactagtgaagatatgaagaagaagattgatgaaattcaacaactctctttgaaggttttcgagtctgtctacaagaaccaaaatcaaggtaatgaatcttctggtgataactctgctcctgagggtgacaagaag

SEQ ID NO: 25859 - DNA, 2898 bp, Schizosaccharomyces pombe
atggaaaatcgcatttgcacacttgcaaagccgttgccaaagttagatgaaagcaagcaagcatgggtttcatatttatggctcaagaaagcgttgccaggtttcgaggaacactctgcttatgtttacatgaccactaatcctacaatcgctggtcgcatatttttaccaattaataatgaagatctggaggatggtactgttgaaatttctggttatgataacttactggctgatgccttgtacatatcgacaattgcacctgtcaaactggattttgtgcagttgattgttatagatgacaattcacaagatcaggatgcaataattgaaaggattaaagggagaaatgctattttaatggaaagcgattttattaaccaaaatattttggtacaagtttgtcaacctgttcgacatggagttgtggattcagaaacgaaatttgttattgaaagaaaagatagttttacttttttagcatccaatgaaaaaaatatttcatcatttaaacgaggaaaaaccgaaacagatgctgagttggtcattcgtccatcaaaagtacatactgaaatacaatggtgcttacaaaactgctctttaattcatgttccttttgaattattattcaatgttggtaaaaaaaatggttgcccaataagccttcgcttgtcagatggaaaaaatgtctatggaattgcttcgataaaatctgatactgaacatgatagtgtacagctttcgccttctcttcattattttgatgaattcaacgaatctgttatatccgaggaaggtacagaggcatttcttgtcgctcgtgggccatctgtcgggatcgcttcaagaatctcacttcgtactattccaactcaatcctgcttttctgaaaagcttctaaaagccgctaacctttgtgttgtacaacaagttaaacaaaaagttttcttacaaagcaaacaaatattttgtgtacctataaattcgttaatggctaattcagattcagttgatatattagagcttacaaggaataccgacgcttatatatggtactctgttgaagaaatagatcctttaaatacttataacatttactataccaatgaggatacctcaatcgtgcttgacactcaactttcccacagacttcttcccagccttaggaaacctcttctaaattttgttaaagtacatcctccttcccaaaaactattaagattctgcagagctttttttgatcctcaacaagttcctgggtttaatcctttttttctgcttcatggaaacccatttacgggaaaaacaaaggcagtagaagaagttgcttctctttttagtgcacctgtttttacggtaagtttcaattaatcccaactcttttttgattccattctaactgttttctagatttcttcttacgaatttgctgacgcaactgcagatcatttagaagctaagcttgacatgtttgtgcaaaatgttgttaagtctccctgtgctatcatttttgtaaaggacttagatgtactctctatatcttcggatgaagggaacatagtacctggttcaaagagtattcaaatattattgtcgaaaattgatctggttaaatctcctcaaggtagatatattgttatcggaacatgccattcaattgaaaaaataccgtatgaaattctttcagaatcattttttgagttaaaattttctgaacttgagatggatgaacgtttggaacttttaaaaatttatgcaaataatgttataattgacaaaagaatatctttgaaagacgtggctctaaaaactaattcaatgtcttttggcgagcttgaatgtttaccagatcatatgactaaagctgccgtagacagaataaagagaactggttacgataatgattctattattttatcggggccaataattacagagcaagacgtggacgtttcaattaatcgcatccgtaaagaaaaatcgaataccatttttactgtccctaaggttaattgggatgacatcggtggattagaggaagcaaaaactgttttgagggataccctgcaattaccacttcaattcccagagctgttttctcaaggattgaaacctcgttcaggcgtacttctttatgggccaccaggtactggaaagacccttttggctaaggctgttgcaactgaattatcattagaatttgttagcatcaaaggtccagaattgctaaatatgtatgtcggtgagtcagaagccaatgttcgaaatgtattcgagaaggcaagaaactcttcaccctgtgttattttttttgatgaacttgattccattgctcctcacagaggtaactctagtgacagcggaaacgttatggatcgtgtagtgagtcagctgttggccgagcttgatagtatttcaaaagataataataagtatgtatttgttataggggccaccaacagacctgatcttttagacccatctcttcttagaccaggtcgattcgacaaattagtgtaccttggaattaacaaatctgaagagtcaaaagcaagtatgttacgagccttgactaaaactttcaagctggatgaaacaatcgaccttaacgaaattgcgaaaaactgtcatccaaactttacgggagccgatatgtatgcactttgttcggatgcggtcctttcagcgattaagagaaagacaaatgagatagatttacttattcaagcatcaggcacggacctttctactgaagaattctttaaacgtaatgaaaatcaagattccctagagttaagaataacaaaagaagattttcttacttccttgaagaaactaagacccagtatatcagaacaagagttgcatcgctacgaaatggtgaggcatcaattcagc

SEQ ID NO: 25860 - DNA, 2370 bp, Schizosaccharomyces pombe
gaagggacacctgacgaggatttagaagaatatagcgattacagcgatgttgacaattacggtgaagaggatgatgattcttacaagcctgcacccaggattcgtataaacaacaataaaactaaagcacaaaccacgactaatagcaatgaagcccgccaatctgggatttctgctatgtttggccaaaacgatttttctaatttactaggtttaaaattggatcatacggctaggccactttggattaatccaattgatggtagaattatccttgaagcattcagcccattggctgagcaagctatcgacttcttggtaacaatttcagagccagtttctcgacccgctttcattcatgagtatagaattactgcatattcactttatgctgctgttagcgttgggttaaaaactgaagatataatagcagtccttgatagactttcaaaaaccccaattcctccttctatcgtagactttatccgcgcttgtactgtctcttacggtaaggtcaaactggtcttgaagaaaaacagatattttattgaaagtggagatgcaagtgttttacgactgttattaagagatcctgtcataggccctcttcgaatcgattattctacccagtctagcaagcagaagtcttcaaagccttccaatgaagataatgtggaagacaaaaaagatatcaccaatgattcctcaaaagaaactgctgagaaaagttcatctgatgaactgttttcggcagtagtaggcttacaggaagaggaagatgatgaagatgccgttcatcttttcgaaattaagcactcttcagtggaaactatcaagaagagatgtgcagagattgattatcccttattggaagagtacgattttcgtaatgacaacatcaatccagatcttcctatagaccttaagccaagcactcaaattcgtccataccaagaaaagagtcttagtaaaatgtttggaaatggtagagctcgaagtggaattattgtattaccatgtggagctggtaaaaccttggttggtatcacagcggcttgtactatcaaaaaatcagtaatcgtgctttgcaccagttctgtttcggtaatgcaatggcgtcaacaatttttacagtggagcaacatcaagcctgatcacattgcggtttttactgctgatcacaaagaacggtttcacagcgaagcaggtgtggttgtctccacgtactcaatggttgccaataccaggaatagatcctatgattctcaaaaaatgatggattttcttacgggacgtgaatgggggtttatcctattagacgaagtacatgtggttcctgctgccatgtttcggcgagttgtcaccacaattgccgctcacacaaagcttgggttaactgctacgttagttcgtgaggatgataaaattgatgatttaaattttttgattgggcctaaaatgtacgaagcaaattggatggatttggcacaaaaaggtcacatcgctaaggttcaatgcgccgaagtttggtgcgcgatgaccactgagttttataatgaatatcttcgagaaaactcccgaaaaagaatgctactttatatcatgaatcctaaaaaatttcaggcttgtcaattcctcatcgattatcacgaaaaacgtggtgataaaattatcgttttttcagacaatgtctatgctttgcgtgcttatgcaataaaattaggcaaatattttatttatggtggaactccacagcaggaaagaatgaggattttggaaaatttccagtataatgaacttgtaaataccattttcctttctaaagttggtgatacgtctattgatcttcctgaagcaacctgtttgattcagatttcttctcattatggttctaggcgtcaagaagctcaacgtttggggcgtattcttcgtgccaagcgacgaaatgatgaaggctttaacgcatttttctatagcttggtatctaaagacactcaggaaatgtattattccagtaaacggcaagcatttttaattgaccaaggctatgcttttaaagtcatcactaatttaaagggtatggagaacttgccaaatttggcttacgcctccaaagcggagagacttgagcttttgcaggaagtattgctacaaaatgaagaagcagctgatttggatgacggtgaggatactagctttggatccagaagtctctctagagcaccggcgaaagctaaacgttctagtggttctttaagtacattggctggtgccgacaatatggcatacgtggaatataacaagagtgctaataaacagctgaaaaaggacagtaaagaacatcatgccttatttcggaagcacctgtat

SEQ ID NO: 25861 - DNA, 872 bp, Schizosaccharomyces pombe
atggagcctggaaaaaaggattatatagattctcctttgaggatgcaaccagcctcactttctggcgcatctacaccaactattgatttagacgggctttcttggccttgtaagtaatgaaagcatattttatactcatttaagtattctaataccaattaggtcaaggaacacaacgtagaatagatactgctgaggaagaaaaagtaaaaaaaatttccaatgctatttcaacaattttggaatgtttgggagaagatcctgagagacaaggccttttgggaacacctgagaggtatgccaaggcaatgctttactttaccaaaggatacgagcaaaatttgaccgaagtgatcaatgaggcagtatttcaagaagatcacgaagaaatggtcattgttagagatattgatgtattcagtttgtgcgagcatcatttggttccttttattggaaaagtaggtttcatttagaagtggattttatccattgcattcacgtgattgggctatgcaattatgtttaaccctctttcacaaactcagcgtattaaactaacattattgtagattcatattggttatattcctcgtaagcgtgtattgggactttcaaagctcgcacgtatagccaatatgttttcgcgtcgcctacaggtgcaggagcgtcttaccaaacaagttgcccaagctattcaagctgtcttaaaacctcagggagttgcagtcgttatggaagctactcatatgtgcatggttatgcgcggtgttgaaaaaccgggtagcagtactgttactagtagtcttactggtatatttcagagaagccataaaactagggaggagttttttagattgattggaaaattttaa

SEQ ID NO: 25862 - DNA, 2148 bp, Schizosaccharomyces pombe
atgtcagttagtgttgcattaaaagcaaagcccattgcttatggtgcagttgcatgtgcaaattatgtgaatctgtctggtgcaggaagcatttccgtcaagtatgaggacgttgctttattagacaaacaaaacaaggaatcgaacgtctccattcagcttaacggctctgattctcctgtattcggttccaagttggctttacagactttctctcaagtctatcctaaacttttcattggcgaaaacgatcgttctttggttgagagttgggtggaaactgcctctgccttagctggtaaccacaactttcttgagctttcttcacttcttgctcagttagacgaccatttaattatgcgctctctttttgtgggttattccctcacctctgctgatttttctatttggggtgccttaaaatcaaacaacatggcagctggtgccgtacgcactggccagtatttcaaccttgctcgttggtacaagtttatggattctcaaaatgccgtgagtgtcaccatggaagaattcaccaaggcagttaatattagcaaaaaacaaaaatcttctggtcctaactacgagatcggtcttcctgatgccattgatggtaaggtggtcaccagatttcctcccgaacctagtggatatttgcacattggacacgcaaaggccgcacttttaaatcaatattttgctaacaaataccacggaaaactgattgttcgtttcgatgacaccaatcctagtaaagaaaactcagaatttcaagacgccattttggaggatgtcgccttactcggtattaagcccgacgtcgtcacttatacatctgactatcttgacactattcatcaatattgcgttgatatgatcaaatcaggccaagcttatgctgatgatactgacgttgaaactatgcgccatgagcgtaccgaaggaattcccagcaagcatcgtgaccgtcctatcgaggagtccctagagattctctctgaaatggataagggttcagacgtcggtctcaagaactgcattcgtgccaagatttcatatgaaaatcccaacaaagcaatgcgcgaccccgtcatttaccgttgcaatttattacctcaccatcgtactgggaccaagtatcgtgcttatcctacttatgactttgcttgtcccattgtcgactccctcgagggtgtaacacatgcattgcgcactactgagtaccgtgatcgcaatcccttatatcaatggatgattaaggcaatgaacctccgtaaaatccatgtttgggaattttctcgtatgaactttgtacgtacattgttaagtaagcgtaagcttactgagattgttgaccacggtcttgtttggggatgggatgatcctcgtttccccaccgttcgtggtgtccgtagacgtggtatgaccattgaagcattacaacaatacatcgtctctcaaggtcctagtaaaaacatccttactttggattggacttctttctgggcaaccaataagaaaatcattgatcccgttgctccacgccatacagctgtcgaaagcggtgatgttgtcaaagctaccatagttaatggtcctgctgctccttatgccgaagaccgtcccagacataagaagaacccagagttagggaacaagaagagcatttttgctaatgaaattttaattgaacaagctgatgctcaatctttcaagcaggacgaagaggttactctgatggactggggtaatgcatatgttcgcgaaatcaatcgtgatgcttctggtaaagttacctcccttaaacttgaactccacttggatggtgactttaagaaaactgagaagaaagtcacttggttggctgatacggaggacaaaactcctgtcgaccttgttgattttgactatcttattaccaaggacaaacttgaagaaggagaaaactataaggacttcctaactcctcaaactgaattccactctcccgtctttgctgacgttggaatcaagaatttaaagaagggtgatataattcaagttgagcgtaaaggttattacattgttgatgttccatttgatggtacgcaggctgttctcttcaacattccagacggtaagactgtaaatcgttacggcgttaaaaat

SEQ ID NO: 25863 - DNA, 969 bp, Schizosaccharomyces pombe
atgtctcctcataaaattagtgataaccaccgtcatttgatgttaagtagatttatgatgggaaatggtgtttccatcataaacatgcctttctctggtggccagcccaaggacggtgcagagttggctcccgaaatggttgaaaaggctggccttgtggatgatttggaacaccttggatacgatgtcaagctcatccaaaaccccgaatttaaaagtcgtccttccaaggagggtcccaaccaggctttaatgaaaaaccctttatacgttagcaatgttactcgtcaagttcgtgatgctgtccaacgtgaattagaacagcaaagagttgttgtcaacattggcggtgatcattctcttgccattggtactgtggagggtgtgcaggccgtttatgatgatgcctgtgtcttgtggattgacgctcacgctgacattaacactcctgaatcttctccttctaaaaatcttcatggttgccccttgtcattttctttaggatacgccgagcctctccctgaagagtttgcttggaccaagagagttattgaagagcgtcgtctggcttttattggattgcgtgatttagatcctatggagcgcgcttttcttcgtgagcgtaacatagccgcttataccatgcaccacgtcgacaaatacggaattggccgtgtcgttgagatggcgatggagcacatcaatcctggtaagagacgacctgtccatctttccttcgatgttgacgcttgcgatcccatcgttgccccagccactggtacccgtgttccaggcggtttgactttccgtgaggcaatgtacatctgcgaagctgtagctgaatccggtacattggttgctgttgatgttatggaggttaatccactacttggtaatgaagaggaggccaagactacggtggacttggcccgctctatcgttcgtactagtcttggtcaaactttactt

SEQ ID NO: 25864 - DNA, 4203 bp, Schizosaccharomyces pombe
atggggctagagcatactttctatccagccgaagacaggtttgaaccgttgttggaacattcagaacctgtaaactttgtgccgaaagaaaatgctaaaagttatgttcgacagggctttgcatcaccgcatcaatctttgatggataacctcgtggatagcacggaaagcacgaaacgatctgaaaactttgtctcacacataccattgactccttctcattctggtcaaagtgaaaaattaatgagtactcgtacctctcatagcccttatatctctccaaccatgagctacactaatcattcacctgcgaatttaactagaaattcttcttttaatcaccaacattattccaccacgctcaggtctccacctagcatgcggggccgaggcatagatgttaattcttctcattaccctcatatatctcgtcctcgtaccagctctgattctcagaaaatgtacacacgagctcctgtggattattattacatacaagagaatccatattttaacaatattgatcaggattccatcagcgataagtcattaccttccactaatcaatccctccatcattcagaagaagatactgaatccgataacgatttttcagagagtatacatcccgagtttgatattgatgtattttataaagtttctaatatcctttatgatgagtctgatctacaagatccggaaaaaagagaacgtttagaatggcatagtatgctgtcttcagttttgaaaggagacgttatgcaaacggagaaacgaaggcttcgtttaacggagcccgatgggcatagtggtacatatataagtgaagtttggcttggtttacaagcctggctccatggtcgtctgaacgctgatcaggctgaagttattcgaaagagcagagaaggtgttgagcctgtacttcgggaggttattgattttcaaatacaagatgaagaaaccaccaagcctccattagagcaagtcactgaaatattagaaaaggttgaacagtgcaaacagttctatatatcttctagagaaatggaagaaaatgttcctttatctgcctcaaaagaattcaactacaaactgaacgcgcttatatcttggagcaatgtcatggagagtattcaagtggaaacacttgttcttcaaaaatgggtcggaaacgatgaatttgacttaactatgaggactcctcaatttaattatgatggtgtcgaaaatacttcatcttttgttgagcgaatttttagacaatctggtttgcaaaggacattcgaacaacgcacattgacgactttaaacagaattattcatcaagctaagcaaacaatttccgaaaatgctcaagcttttgaggaaatgaaacttcctacctacgaagataaattgctacctctcgtgcgttttcctattaagttgttggaagaggcgcttcgtcttcgcctggcatacgccaagaaaattaaaggacctaattttttaattgtagattctatgttagatgatttcaaaatcgcgttgtctgtggcagtacgcataaagcgcgaatacataaaaattgcgagcccatcaccgggttggagtttaccaacaaatgtggatgaagattatgataacgtgttacttgactccttgaaattttactttaaacttcttactttgaaactaagttcagggaacaagaatctatattttaaggaaatcgactttttggaaaatgagtgggcatttttaaatgaacacatctattggatcaatggtggtgatattcatatggctggacaatttagttacctatcaaatagtctgttgcttaatgttcatcgttatgtggagtcgcatctcaatggaccaacagaacgtactgccgcctcacttactaattggtattcgacacttcttaaaaacactcaaattcgttttcgaaaaatacttcgtttttcagaaacccttaattctcgatttgaaaatgcctcagattttgtgattagtgaagggcatttacctgacttagtaaatcggttgtctactactggtcattttttagcttatacagccaatttagagagagacggagtatttgtcatagctgatcacactttatccgaaaacccagaagcactgaaggccttactttttagtaaagatatatctaaccttgaaacgatacaacaaaattgctcctatgttctcattttatgtcccgttcatccgatagtttggaagggaaggattgaaaaagtggacgttcctgatttttcagttgatttgaaaactaatagagttagaattatcgcatctaacaaacgagagcatttgcaagctgcgaaatctgtttttcagagcataagcggcgacctcgtaacactcgcagttgaatgccgatcgagcataactcgagtttacaaagaatttattcgtctgagcaagttatgtatgcgaatatcttctacggtagtggattgtgtatctgcagtacgtgaggcatgttcaggagttaattgtcacgatctgatttatcacgtattttcttttgccgccgaatttgggcagcgtattttgcggtttttgagtttcgattcatattggcaaacgaagctaaagcggaaaattaccagtcttgctgttgaatggatttcattcatttgcgacgaatgcgatttgatggatagaaaaacttttcgctggggagttggagccttagagttcttaatgctaatgatccgtggaaacaatattttactgattgatgatgcgatgtttttaaagattagggaaaaagttggcaagtctatggcttttctgttaacgcatttcgatgttttgggtgcaaaatcaaaagtagctgcaaaattacaaagagagtcgaccgaggtatcatcgtctccaagactcactagctttggagatgtagaggaggaagctttgagcatccagctacttcagaaagaaacaatgctacgtattgatgaactggagattgaaagaaacaataccttacttgagcgcttggctatcggacatgttttggatgattctgtttttcgtaatcgggactttattaaacttgcgtcttcattttcaaacattaccatacgttggcagcaagggcactttgttcgcagtggaatgtttggagatgtttataccggtgtgaacatggaaacgggggacttgttggctgtcaaagaaattaaacttcaagattctcgtacttttagaagcacagttgatcaaatccataacgaaatgactgtcttggaaagactcaatcatcctaatgttgtgacatattatggtgtagaagttcacagggagaaagtatatatatttatggagttttgtcaaggtggctcacttgccgacttgcttgctcatggacgtattgaagatgaaaatgttctcaaagtttatgtagttcagcttttggaaggattggcatatatacattcccaacacattttacatcgtgatatcaaacccgctaatattttgctggatcatcgcggaatgataaaatacagtgattttggatccgctttgtacgtctctccgccaactgatccagaagtacggtacgaagacatacaaccagagttgcagcatttggcaggtactccaatgtatatggccccggaaattatattgggaaccaaaaaaggtgattttggagcgatggacatatggagtttaggttgtgttatactcgaaatgatgacgggttcaacaccttggagtgaaatggataatgaatgggccattatgtaccatgttgcggcaatgcatacgccatcaattccccagaatgaaaaaatatctagtctggctagagactttatagaacaatgctttgagcgtgatcctgaacaacggccaagggcagtagatttattgacacacccctggattactgacttccgcaaaaagacaataataactatgccccccgccactattacaaaaaagaccagcctttctcatactataacagaagaaaaaacagcacaattgcttgccggaaggcatgacgattccaaggctgaaacagatagcttagctgcatcttacaaagaagagtctgctcttccagtagcaagcaacgttggcctaagacaacctaatgaactacgcattgattccattaacttaccgccagctattgttaccccagacacaataaactatagtgttgac

SEQ ID NO: 25865 - DNA, 2175 bp, Schizosaccharomyces pombe
atgtcttctcagttaaaatcaacttgggcgccagttccttcaacaaaaccttcacagccttgtaaaattggcactgattttaaaggtgaaaggattgtttatcccgtaagtttgtcgaatccgtatgaattggtcgattaaagaacatttactaaatagtttttaggctaacaaagcgataataattcgtgaaattgagaaacaggaaaactgctttcaatataatgagcatactgctcctacaactgtagcacgatttagcccttctggatattatgtagcttctggcggtacgaatgctaattattgctattatttcttaagtttttatttttaaacgttactaatgatcaactatagacaatcaaggtaacgtccgcatatgggattgtgctggagaagataaaattttaaagaaccaagttactgctattagcggacgaattactgatttagactggggtaagcctgttcaagtttcaatatgctaattgatgaaaagacggagacagtcagagaataatagctgttggtgagggtaaagagcggtaagtgatttctattgttttcgaaggatgtgttaaattattggatttactcataatttcaaaaattccaatatttgttgactcttgctaatcttacttttaacagatatggacacgcgttcaccgctgactctggtaattctgttggtgaagtaagggttttattagtctccaacttccttaaaatgttaacggttacagatttttggacattcgagcgtagtgaatgctgtttctttgcgcaagagtagaccgttccgtgctgctactgcatctgatgataattccatcaatttttttcacggtactccttatagattcaaccgaagtttacgcgttcactccaaattcgtttatgatgtccgttactctcctaacgatgaaagatttgcttcagctggagccgacggtaaggtttatgttttcgacgggaaaacaggagatcaggtctatgaaattgatgctcataaggggtccattttctctatttcttggtctccagattcatctcaatttgtcacatcttctgcgggttacagttgcaaaatatgggatgctaataccggctccctaattcgcgaatggctttcgtcggacaagaagcaattagttggaacagtttggccaactaaagacctaataatagttgttaactcaaagggaaacttaacatatctaaatccttcggactgtaaggtaattgatacaatttacggacaccaacgctctatcactgccgctacactttcacctgatgctacccatttttatactgcctcatatgatggtactgttctttcatgggatatcggcaaacagaaagcattccctttggttggtgaaagtcataccaatcaagtcatgcaaatgataatggctgatgaccatgttatcaccattggcatggatgacacgttaagggtaatcgatatcaagcaagggtgtttcgcgaaagataatgtttttccaactggctaccaacctattggcgtatgctcggttgaagactgtttgattttggtaacggtttcggatatccaagtcctccgtagtcttactggtgtttctacagccaagactatttatcagcctagcgcagttgcttcgcatcccttaaaaagtgaattttgcgttggaggggaggtatgataccatattttaatttccatataattattgacttttttaggactgttgtgtatacatccatacccttgaaaaaggtgagctttgtgaagtagctcaatgcaaagattcaacagcaccgattacatgcttagcttactctccggatggaaagtatcttgcatgtggtgatgcctcagggaaggttgtactttatgacgccaattctcgggaagttattacttctcgctgggcgtttcacactggccgtattctaggaatgtcgtggaatgcaaaatctactcatttagcgaccgcttcattagacaccaacattcacatttattcagtagaacgacccatgaaatatattgcgatgaaaaatgctcactcattgggagctacccaagttgaatgggtttctgaaaatgagcttttaagtactggaagtgatgctgcaatcaaagtatggtcagtgaccttttgaattcgtagtacaatt

SEQ ID NO: 25866 - DNA, 1472 bp, Schizosaccharomyces pombe
atgtatcctctcaatgctaattcttatactctgctacggaaattaggatcaggttcatttggggttgtctggaaagcacgtgaaaatgtgtctggcgacattatcgctattaaacaggtaagactaattaatttttactcttctttagtatcacaaaaaacttacagttgcagattgatttagaaacaggtattgacgacattaccgacatcgaacaagaggtatttatgttatcgaattgcaacagttccaatgtaattcagtattacggttgttttgttgacggatacacattatggattttgatggagcatatggatggaggatcagtttcgggacttttgaaaatgggaaggttgaatgaacaagtaatttcaatcattcttcgagaggtcctttatgggctaaattatcttcatggacaaaacaaaatccacagagatatcaaagccgccaatatactactatcttcctctaccggaaacgtaaagcttgctgactttggagttgccgctcaactttcgaacgctgcttcgcgtagacacacgtttgttggaacgccattttggatggcaccggaagtaatacaacaaacaagttatggtttagctgctgacatttggtctcttggaattacggctattgaaatggctaacggaattccgccccgcgctacaatgcatccaatgcgtgtcatctttgaaattcctcaatccgagcctccaaagctagatgatcatttcagtccaacattccgtgattttgtgtcctgctgcttagatctcaatcctaatatgcgatggtcagctaaagaactccttcaacacccattcatcaaaagcgcaggaactgtgaaagacattattcctttgcttgttcagaaggagaataaattatttgatgattcggatcaaagtgtattggaagaaaccataaataatactttaaagccctttgaagaaccaattgctgaaggaaatgctgacattgaggattggacatttgaaactgtaaagaaatctgactcaactgtgttagggaatactagcattcctaaaaattccatcatcagttcacaaaataaagaggaattgccttcatcaataaaatatttagagaaaactataatgagtgatcaagcgacaccgcatcctttttccaagtcattgtctgaaaaaggtagctcttatcataaatcgttgacttccgattttgctatgaaacattatattaagtccaccatacgatcgatgttattaaatgataaattgtcagcaacgcagcgctcatctttagaatctttttatacatctttcatttctttagataaaaatctgtcctcaaaatttgttaaccaaattactccagacaacagactgcatcacaaaaagcaaaagcggagccccatatcacaactactattttcacggtggcttgaagaaactgagaaaagaagaagtctaaatggatag

SEQ ID NO: 25867 - DNA, 1140 bp, Schizosaccharomyces pombe
atgaatgaagaagagacaaacttcgttggaattgcggatttacctaatcagcgtcacaaaatagtttcacgaaatggtgtagctttcactttgatgctttgtggagagtcgggtcttggtaaaacaacattttgtaatacactcttttcaacaacaattaaatcacatatgggcccggaaaaggttcgtgcgaagcatgctgagaaaacggtcgaaatagagattacaaaagctgagttagaagaaaaaaatttccacttaaggttgacagtaattgatacccctggttttggggattttatcaataattcaggatgttgggagtcggtagttgaatttatagaagaccagcatgaatcgtacatgagacaagatcagcagccagatcgtcgtaagatcattgatatgcgtattcatgcttgcctatattttttgcgtcccgtaagaaatggtgttcggcctatggatttggaggctatgaaacatatttctaagcgtgtcaatttaattcctgtcatagctaaagccgatatgtatactcgaagggatttagctctgtataaaactagaatttctcaagttttagaataccatcaagtcaatgtttataaacctaatatggatgagggcgatcccgtttttcacagacaaattcaaggaatcattaattgcatgccattcgcgattgttggaagcgaagatgacatccgtactcctgatggtagggtcgttaagggtagagaatacccatggggaattgttgaaattgagaacgaagaacactgcgactttaaacagcttaggaatattttaattcggagttgtatgcttgatttgattcaaactactgaagaaaagttgtatgagcaatatcgacaagagcagatgaaagttcgccagtatggagaacctaaactgcggactattgataatgcgaaatttaaggaagaagaagaaaatttgagaaaaagatttacagaacaagtgcgcgtagaagaaactcgatttcgacaatgggaacaacgcttgattgccgaacgcgactcattaaataaagatttggaagctcagcatgttcaaataaaacaaattgaacttgaaatcgaacgactaaaggcggctaccagctctcgcaaacgt

SEQ ID NO: 25868 - DNA, 3090 bp, Schizosaccharomyces pombe
atgtcagaaaacagtacagactctaaaaatttccaattcagtgaaggttcacgcgagtctagcaatgatgagctcaaagtattgttaagagatacagaaactaaagaggatgagaagtcgtctttttcaaactctgaagaagagtcgataatcgagaatttgtcggactcttcagtcaataaggaatatgctaaaaattccttgaaattgagtgacgcggtttctgagtctaaatacttgaatccattacttaaagacaaaagacatgataggagcttcgcattacacaaagttgttgttcctgatgattacgattacattcctctaaataaacatatccctagtgatcctcctgctaaaacgtatcctttcgaactagatccttttcaatctactgcaataaagtgtgtggaacgaatggaatcagtccttgttagtgcacacacctcggcaggtaaaacggttattgctgaatatgctattgctcaagcattgaaaaatcgacagagagtaatttatactagtcctataaagtctttaagtaaccaaaagtatcgagagctactttccgaatttggtgatgttggtttaatgaccggtgatgtctctattaatccatcagctagttgtcttatcatgactactgaaattctacgtgcaatgctatacaaaaactcagaaatcatgcacgaaattgcctgggttatctttgatgaagtgcactatatgcgtgataaagatcgaggagttgtatgggaagagactttgattttgttaccagatgctatacgctttatttttctatctgctactttacctaacgcattacaatttgctcgttggatttcagagatccacaagcaaccctgccatgttgtttatacagattaccgacccactccactgcaacattttatttaccctcaaggagctgatgggatttatatgttagttgacgagaaaaacaagtttaaaactgaaaactttaaaaaagtactggaagtgcttgatcattccacacgccaggaaaactattccaaaagttccaaaaaggttaagaagtcatcttcattagaaagaattatcaatatggtcttatccaatagatatgatccaatcattgtattttgctttagtaagaaagagtgtgaaatcaatgctcaccaatttggaaaactggacttaaatgatacggaaaataaagaattagttacagaaattttcgactctgctatcaatcaactttcagaagaagatagaggcctccgtcaatttgaagaaatgcgttcgcttttacttcgtggcataggtattcatcattctggtttgcttcctattttgaaagaattggtcgaaatattatttcaagaaggtcttgttagaattttgtttgcaacagaaactttctcaattgggttaaatatgcctgctcgaacagttctgtttacaaaagctcaaaagttttcaggaaacaattttcgatggcttacatctggtgaatatatgcaaatgagcggacgtgcaggtagaagaggaattgatactaaaggattatccattgtaatattggatcaatccattgatgagcaagctgctcgatgtttgatgaatggtcaagctgacgttcttaattccgctttccatcttagctatgggatgatattaaatctcatgagaattgaggaaatcagtccagaagatatattaaaaaaaagcttttatcagttccaaaatatggaatctttacctttaattaaagaagaacttatgcaattaaaaaacgaagagacttcaattaatattcccaatgagacagctgtcaaggagtttcacgatttaaaattacagttagaaaagtatggggaagaaattcaaaaggtaatgacccatcctgataattgtttgccttatctgcaatctggccgacttatacaaataaaattagggggtattatatttccttggggtgtacttgtcaatgtcataaaaagagaatttgatccaaacactcgtgaacaagttgccccgcacgaaacctatgttcttgatgttttacttcccatctcctcaaactccatgtcaaatcataaagtgaatccctcgattttagtaccccctcgtccgaacgagacacctctttatgaaatagtttctgttttactgactgctgtttgtaacatttcttctatacgtatttatatgccacgagagttgaactcgaatgaatctaagctgcgtgcttatagacgtgtaaatgaggttatagaagaatttaaggaaataccttatttagaccccttagaacatatgcatattgaaagctctacgttaagtttatctcttcgaaaacttgaaattcttgaacccaaactcttcgacagcccttactacaaggattctaaacatagggccgaatatcatgaatttagaaaaaaactcaacttacgagctcagataaaagatatatcgacgaaaattacaaatactgaggcgattatacaacttcgagaacttaaaattagacaaagggttttacggcgacttggattctgcaccttagaaaatgttattgatattaaaggaagggtagcttgtgaaattacttctggagacgaactgctgttggtggagcttatcttccaaggtttttttaaccaaatgcctcctgaagaaattgctgctgcactcagttgctttgtttatgaagacaaatctgaagtttccacattgaatttgaaagagcctttcaaaaagatgtatctaacgattattgaagcagcaaagcgcatagcaaccgtttcgttagaaagtaagcttcaatttaacgaaagcgactacctccatcagtttaagcctgacattatggagcctgtatctttatggatcaatggagcctcgtttcaagaaatatgcattgtctccaagctttatgaaggttcaattgttcgaacgttcaggagattagatgagttgttaaaacaacttgaacatgctgctattgtattaggcaataatgaattgaaagagaagagtgtgttgactgaacaaaagttgcatcgtgatatcatattttcggcctctctatacctc

SEQ ID NO: 25869 - DNA, 978 bp, Schizosaccharomyces pombe
atgcctaactcaactgcccaatatccggaaaaggattcatgggaattcttagtcaaatctggaattgctggtggtacagctggatgcgttgcaaaatcagtagttgccccattagatagagtgaaaatcctttaccaaaccaatcacgcttcttatcgagggtatgcttattcacggcatgggctttataaggctatcaaacacatttaccacgtctatggcttacacggtctttatcaaggccacactgctactttatacagagtcttcccttatgcgggcattaaatttgttgcatacgaacaagtacggcgtgttttaattcgtgaccctgaacatgaaacacatgctcggcgatttttatcaggatcacttgccggaacttgctctgttttttttacatacccgttagagctgattcgtgttcgtttagcctacataaccaatacagggaagaatcctaccctaactcaagttacaaaagatatatttcacgaacgtgattttttgtgcaataagaagtatcctgggttatcccgtttgtcaaaaatctgtaatttttatcgtggattttctgttacgttaactggaatctttccatatgctggtatgtcgtttcttgcctacgatcttgcaactgatttttttcataaacaaaaaattgacgaatgggtttctacaaaaaagtcagataaaaaacttaaaacttggcccgaactactttgtggagcatttgcaggagtttgtggtcaaacggtttcttacccattcgaagtttgtcgacgaaaaatgcaaattggtggtatcagaaaaaataaatcatttcttagacttaagcaggtagtacaaactacttacaaagaagccggtatgagaggttttttcgttggacttaccataggttacattaaggttatcccaatggtaagcactagcttttttgtttacaatcacagcaaagcgcttttagggatagat

SEQ ID NO: 25870 - DNA, 657 bp, Schizosaccharomyces pombe
ttatagtctacctacttaagagagtacaaattggtagttgtaggagatggtggtgttggtaaaagtgctttgacaattcaattaattcaatcgcattttgttgacgaatacgatcctacaatcgaagattcatatcggaaaaagtgtgaaattgatggtgaaggtgcgcttttagatgtattggacacggccggtcaagaggaatattccgctatgcgtgaacaatatatgagaaccggagagggttttttattagtttataatattacctctcggtcctcttttgacgaaatttctacattttatcaacaaatccttagagttaaggataaggatacatttccagtcgttttagtggctaataaatgcgaccttgaagctgaacgtgtagtttcaagagctgaaggcgaacaacttgcaaaaagcatgcattgtttatatgttgaaacttcggcgaagctaaggttaaatgtagaagaagctttttatagtttggttcgcacgatccgtcgctataacaaatcagaagaaaaaggttttcagaataagcaggccgtccagactgcccaagttccagcttcaactgctaaaagagctagcgctgtaaataacagtaaaaccgaagatgaggtttcaactaaatgttgtgttatatgt

SEQ ID NO: 25871 - DNA, 1680 bp, Schizosaccharomyces pombe
atgaagtacggaaaggtatcttttctagcgcttttgtgctctttatatgttcggggatcacttgctgatcctgaatccgaacaagaacctttggtttttaacccaactgaagtgaaagcgcctcttgttgagcagtttcaaggtgcatggtctgaacgttggattccttcacatgctaaacgatttgtaaatggtattgaagaaatgagctatgtaggtgaatggactgttgaggaaagttctggtcccggtgcccttaagggtgaagccggtctcgttatgaaagacgaagccgctcatcatgctatttcttatgaatttgatgaacccataaatgaaccagaaaaggatttggtagttcaatatgaggttaaccccgaagagggtctgaactgtggtggtgcatatttaaagctcttagcagaacccactcatggtgaaatgtcaaactccatcgattacagaatcatgtttggacccgacaaatgtggtgttaatgaccgtgttcattttatcttcaagcataagaatccccttacgggtgagtattccgagaagcatctcgactctagacccgccagccttttgaaacctggtattacaaacctttacactttaattgtgaagcctgaccaaaccttcgaagtccgtattaatggcgatgttgtccgtcaaggatctttgttttatgattttatacctcctgttcttcctcccgttgaaatttacgatcccgaagatatcaagcctgctgattgggttgacgaacctgaaattcctgaccccaatgcggttaagcctgatgattgggatgaagacgctccccgtatgattcctgatcctgacgcagtgaaacctgaggattggttagaggatgaacctctttacattcctgatcctgaagctcagaagcctgaggattgggatgatgaagaagatggtgattggattccaagtgaaatcatcaatcctaaatgcattgaaggtgctggctgtggtgaatggaagccaccgatgattcgtaaccctaactatcgtggcccttggtctcctcctatgatccctaatcctgaattcattggtgaatggtatcctcgtaaaattcctaaccctgactattttgatgatgatcatccttctcatttcggtccactctacggtgttggtttcgaactttggactatgcagcccaacatccgctttagcaatatctatgtcggccattcaattgaggacgctgaacgtcttggaaatgaaactttcctacctaaattgaaagctgaaagagaattactttctaagcaagagtccatggaaaagcaatcaatgcatgttgacgaagagtctaatcaaattcttgagaagtttcttgacgtatatgatattattaaagctaaacttcctccaaatgttgccgaaaaagttgactactatgttgaaaccatcatcgagactcctgaaattgggattgcaattgttgccgttcttggctctttaaccgctgttattcttacttgttacttttatttctttgcttcctcttccccggcttctttatctactggaactacggaagctgagaaagagcagcaagagaagtttaagcaagagactgagactgagaagatagacgtttcttacgctcccgaaactgaatcaccaactgcgaagaatgaagac

SEQ ID NO: 25872 - DNA, 1383 bp, Schizosaccharomyces pombe
atgtttcctcttggcagtgtcgttgaggtaataaccggagagcgggggtttgtccgttatgctggagaagtggaaaaccgaaaaggtgtgtatgtcggcttggagcttttacctgaatttgccgagtttggtaaaaacagaggcgtcgttgatggtcgtgaatacttcaaaactaaaaacaacgagaagacgggcatttttgtgccattcgataaatgtaagcttgcatcttctatttcatcatcaccttctcccaaaatagatggaactgcagcatcaataggaatgggttttcctcctatgtctcctaatcttcaatcatctattccaagattaaccaatgtttcgtcctctagtaatctcagtatgaatactatttcctctactgccttaacgccaaccgaaaaaattcttcagaaacgtattgaggatttgctttacgaacgtcaaaaccatcaacagcaattggaagaagtgttggctacggttgatcaattgcagtcactcgttacaaatttcaatgaccaacaagatgaagtcgatgagcttcgtgaaagaattactttgaaagaagaaagaattcaacagatgcgcaatgaggcttcacaacggagatttgagtttaaaactactattgagtgtttagaggaatctagcaatcgtgcaattgagacatatgaaaaccgaatagctgaattggaagctcaacttgagatgtatatgtctggaaaatccgaagatgatttactttttagccttcaacaagagcgcgactatgctcttaatcaggttgagatacttcaagagcgtgttgataccttgatgaagcaaaaagctaacagttctactgctaatgaaaagttatctcatatggaaagcagttcacccaccctcaccaacgcttcttttgaaagtcccaaacgtggtaaaggttctaacgatttacctgaaaaccatcctcaacgccgtcagactcttgaattttacgaaattgaaatagaagtgctacgggaaaaagttgaaaaacttcaagcactttctgatgaaaaagatttttacatttctaaactagaaaaaagccttgacagaaatgacacaacaccagtcccatcagatgaaaagctttccaattatgcagcggagaaagaaaatcttgtatcacgtattagtgaattagaacatacgattgagcagttgaccatcaataatgaacgagataatgaaaggatgtcgccggccgaatttgagctagaaactactcaggaagtggaagaaaatgattcggatagccatgatgacgaagaaacttggtgtgaggtgtgtgaaacaaataatcattcattgcaggaatgtcccactgtatttggcagcacagacgaagct

SEQ ID NO: 25873 - DNA, 1419 bp, Schizosaccharomyces pombe
atggttacttttatggtatttggtgcatcaggcaacctcgccaacaaaaagacattccctgccctgttccatctcttcaaacgaaacctggtagatcgttcttccttttacgtacttggatatgctagaagtaagatacctatcggtgaattcagggaaagtattcgtgaatctgtgaagccagatactgaaagcaaacaggtgtttcaggacttcattgaccgagtatcttacttcagtggtcagtatgatcagagcagttcttatgtggaatttcgaaaacacctagaatcagttgaaaaaaaagcagactcttcgaaagcacttcgtatcttttatatcgccttaccaccatctgtttacgtgacagtcagttctcatatatatgagaatttatatttaccaggaaaatcgcggttagttattgaaaaaccgtttggtaaaaactatcaatcggctgttaaactcaaagaagaagttcataagcattggaaagaggaagaaatttatcggattgatcattatacagccaaagatatggttaacaattttttcacccttcgttttgcaaactcttcgtccattgacgcagttttaaatcgccattctattcaatccgtcgaaatacacatgtatgaaacgggaggctgtgaaggccgtattggttactatgatgcgaatggagtcgttcgcgacgtcgtacagaatcatttaactcaaattttttgtattgctgctatgaatgaaccgaagtctgcttctgcgagtgatgttcgtgctgaaaaggtcaatttgttgaaagctaccagaccagcatctttgaaagaaagtatgcttggtcagtatacaactagcgaagacggtaaaataccgggctacttagacttggagggagtccctaaagatagtaaagccaccacatttgctgcatccactcttcatgttgataatgatcgatggaagggcgtacccttcgtatttgtctctggtaagcggatgaaaaaaggtgaagtatatatcaagtactatttccgtctaaaagactccggaattttctccgacgtaaaacgacgtcggtacttgattcttcatgttcagccggaggagtttgtcaatttgacatgtactattaataaacccatgactactgaccttcaaccgattgacgcctatgcttcgctcaattataatgagcaatttaaagatctgatgaaggaaaaacgagatggctatgaaattttattcgaagatgcaattcgcggtgatcccactaagttcattcgttatgatgaggttgagtatgcttggaagatatgggacgaaatcctcgattctcccaaaaaacctattccctatccagctggttcagatggtcctgagggtttggaagcttatatgaaaaggcatctaggccatgaa

SEQ ID NO: 25874 - DNA, 1374 bp, Schizosaccharomyces pombe
atgaaccagactgaagcggctccagtcgtctcagtttcccgggtttgtacgtattgtgaagttcaaatttataaaaaaaggataacaaatgactaattagatttagatgctcatgttaatgaggagatgccccgtgaatactgggactacgagaacatgcaggaggtatttggatatcaggacaattatgaaattattcggaaagtaggaagaggaaaatatagtgaagttttcgaaggattaaatgtcttgaacaacagcaaatgcatcatcaaagtcctaaagcctgtaaagtacaagaaaatcaagcgtgaaataaagattctacagaacttggccggaggtcctaacattatctcactgcttgacattgtccgcgatccagaggtaagaataaaaaaaaaaagctttttgtattgaatcgtcttgaaacttgaaggagaagaaattttgtgcttttccgtctattgagtttatacgactctggcttttgaacgtttgatatccatcaaactattgtatttgtcgatactaatattttatagagtaaaacaccatctttaatttttgaatttgttgacaatattgatttccgtacattgtaccctactctttctgattatgatattcgttattactcttacgagttgctaaaagctttggatttctgtcattctcgtggtataatgcatcgtgacgttaagcctcataatgttatgatcgatcacaaaaaaaggaagttacggctaattgattggggtctggccgagttttatcatgctggcatggaatacaatgttcgtgtagccagtagatactttaagggtccagaactgttagtagattttcgagaatatggtaagttgcatccacttttgttaaatatatttacgtttcttttttcctaaccaaactttagattactccttggatatttggtcgtttggtgtcatgtttgctgctttgatatttaaaaaagatacttttttccgtgggcgggacaattatgatcagctagttaaaattgccaaagttctgggaactgatgaacttttcgcttacgtacaaaaataccagattgtgctggaccgacaatacgataatattcttggtcagtatcccaagcgggactggtattcttttgtcaaccgtgacaacagatcgcttgccaatgatgaagcaatcgatctgttaaatcgtttattacgttatgatcatcaagtaagttaccgaacctgaaggtttttacaggatcttatacaatcacttatttttttaagtggtatatactgtatagttactaacttagcataggagcgtttaacttgtcaagaagctatggcccatccgtactttcaagtactcaaataagaa

SEQ ID NO: 25875 - DNA, 2049 bp, Schizosaccharomyces pombe
atggcgagtgttgcaattaaagagcccaaaactgctataaccccgaagaagaagtccaaagcctctcgtctttgctttactccgccaactaatcttcataataataaaaaaaatatattctacactcgctacgattgcattggtgaaggcggctttgcgagatgttttcgagtcaaagataattatggaaatatttacgctgctaaagttattgctaaaaggtcactacaaaatgataaaacaaagctgaagctctttggagaaataaaggtgcaccaatccatgagtcatccaaacatcgtaggatttatagattgttttgaagattcgacgaatatttacttaattttggagctttgtgaacataaatctttaatggaacttttacgtaagcgaaaacaattaactgagccagaggttcggtatttaatgatgcaaattttgggagctttgaaatatatgcataaaaagagagtcattcatagagatttaaagcttggaaatattatgcttgatgagagtaacaatgtaaaaattggtgattttgggcttgccgcgcttttaatggatgacgaagaacgtaaaatgactatctgtggtacaccgaactacatcgcacctgaaattttgttcaattcaaaagaaggacattcatttgaagttgatctttggagtgctggagtagtcatgtatgccctcttgattggaaagccacccttccaggataaagaggtaaagacaatttataggaagataaaagccaactcatatagttttccttcaaatgtcgacatatctgcagaagcaaaagatttaatttcttctcttctgacacatgatccaagcattcgtcccagtattgacgatattgttgaccatgaattctttcacactggctatatggcttctacacttccagatgaaattttacattcaatgcctatatggccttcttcccaatcaaaatcaagctttcagagaaacctggacttcgttgcctctgcttccggagtaggctttggaaattcagcaggtgtagaaaagaataaaccttatgcacttcgaacagatgaagttgataatgatcgaatattaccaagtgttttaagtccaagggaccgtgtcaaccctgttatgaaaataggaccggaaaccaaacctgtaccatcaaagctctctacagccctccatgcagctcgtaaatccactgatggaagtttaggctcaagagttaaagttttgagagaagaatcacaatcatttgttccaactaagagcgctgtcactgaacaagttgaacctattcaattaattcggtctttatctgcaaatacagtttcaagactttctaaggttggaaatatgaaatcagacatttggatcagcgtaaagaagacagctcttaaaatcgggatggcattggaagcacatacacacgctttaacttcagaggatgctgactctgagcccgttctttttattacaaagtgggttgattattccaacaaatatggtttaggataccagctatccgatgaatcggttggcgtacactttaatgatgatacatccttgcttttttcagctgatgaggaggttgtcgagtatgctttacatcctaaagatacagaaattaagccatatatttatcctgcttccaaagttcctgaatctataagaagtaaacttcagcttttaaagcactttaaaagctatatgggacaaaatctttcgaaggctgtgcaggatgagagttttgaaaaacccaaaaactcaacttccaataccatgcttttcatgcagcattatcttcgtacgcgtcaagctataatgtttagattaagtaacggaatttttcagttcaatttcctggatcatcgaaaagttgttatttcctctaccgcacggaagatcattgtattagataaagagcgagagagagtggaattgcctttgcaagaagcatccgcattttcagaagacttgagatctcgcttaaagtatattcgcgagacgttggaatcgtgggcgtcgaaaatggaagtgagt

SEQ ID NO: 25876 - DNA, 2428 bp, Schizosaccharomyces pombe
tctgtcacccgagtcataactccaggaactctaattgacgaaaattttatgaatccttatgaaagcaactatatcctaactgtcgtcttcgatcccaatttttttagttccgatatttctaatcaaggaactgctgaagataaggattgtttcgctgattgtaaaattggattatcatggctcgacttgtcaactggtgagttcttcacacaagattccaacttgcagcgtttagcaggggatttgactagaatttctcctagagaaattgttttagacgaaagtttgaaaagttttactactcatcctatttattcctttattcaagaaagaaagtatttcctatcctacgtcgaaaatcgataccaatctctggattgttggaataagtttttagaaaaggaaattgacccttcctttataaaatattgtacaaaattggaggttacagctggctgtacattaatatcatatatcgctgatcggcttcaaaattcgcatccaaatattcaaccacccattcgagtttcgttaaacgaatacatgattattggagagtcagcaatgaaaggtcttgaaatcagatcatccttataccagaaccgctacacgggttcccttcttcatgccattaataaaacggttactaaatctggatcccgcctattaacccggagactttgtgcaccttctactaacattgttgaaataaacaataggttggacttagttgaaaaatttaagttgcttccggagttgtgttcgaaggtaataaacttgttgaagaaatcgaatgatacgcatcggattcttcaacatttattgatgggtaggggtaactcttatgatttattaaaaatggctgataatttctctattactaaggaaattcattctttactatctccccttgaatcttcatctgcttttaggttacttttattaaatatgcatccgcatgatgagctgaaacaactaataaataatgccgtggatgaaaatgctttgatgaagcagaaaataaacgaagaagaagaaaccgaagtaattgctcaagaagctgaagaaatacttcaagatgaaaatgctcaagtagagattgtaaagaaatcactatcttctgaatttgatattagacaaagtttcaaggaaaattgggttgtcaaatccaattttaataataatcttcgaaaactgcatgagaagcttcaaagtttgtttgcttcttacgataaacttcaagaggatttgagtaaacgcttagggaagaaagccactttacgaaaaagtcctgcaaagctttattatgtacatttaaaattgtcaggcaacgaaaccattgagcgatttatcaaaaaatttactcaagcagttctctttcaatcaacaaagagtacggcaagctttcaactaccgggctggacttcgcttggaatggatcttgagaatactaaattgcatatacatcaagaggagcagagagtcttgaaaagtatcactgatgagatagttagccatcacaaaacattgcgttcattagctaatgccctggatgaattagatatttctacttctttagcgactttagcacaggaacaggattttgtccgtccagtggttgatgattcacatgctcatactgtaatacagggacgacatccgattgtggaaaagggattgagtcataaacttattccctttactccaaatgactgttttgttggaaatgggaacgttaatatttggttgattactgggccaaacatggccggaaaaagtacatttttgagacaaaacgcaattatttctattctagcgcaaattggaagctttgttccagctagtaatgccagaatagggattgttgaccaaatttttagcagaataggatctgcggataatttgtatcagcaaaaatctactttcatggttgaaatgatggagacttcttttattttaaaaaatgctacaagaaggtctttcgtaatcatggatgaaattggacgtggcaccacagcaagcgatggtattgcaattgcttacggttgtctaaaatatctttctacaattaaccattctagaactctatttgcaacccacgctcatcaacttactaacttgacgaaatcttttaaaaatgtagagtgttattgcactaatttaagcattgacagagtaagattaagttttagatgaaattttttttaactcgatacacaggatgatcacactttcagtttcgattacaaactaaaaaaaggcgttaactatcaatcacacgggctcaaagtcgctgaaatggcaggtaagtttttgtttgcaatacaactaaactgacgctacaggtattccaaaaaatgtcctactggcagcggaagaagtgcttacattgcttcctaatacctctaaaccgacttccatgaaataa

SEQ ID NO: 25877 - DNA, 1223 bp, Schizosaccharomyces pombe
atggttaagctaaaaattcgtgctgttcagcctcctccaaatgattcacgatctagcactccagccactggtcctcctcccccaattcctaaaattaagatcaagacacgtgaacctaaaggccctcgattgacaaaaattcggttaaaaagagttcgcgaacctggcttaggatatgattcagaagcttctgacagagaagaagacacttatattgaagaacaaattatattacgtcttcctcctggtgaagattgtgagtatgttcgaaaagcaattgaaaatagggaagtgggacgaggtgcagacatatgggtgaagttcaaaggtaatgacttggttacactatattattattaacagagttagatcaaagaagagcggttgttcatgttaatggtcatttgtacgctgcgaagttagttgatttgccatgcatcatagaatctaataaatcattcgacaaaaaagttatcttcaaggctgctgacatctgtcaaatgttgatagctacagaaagaatcgagcacgaaaattctgttctcaatactcagttaaagcaagctgattacatttatccacatggattgacgacgccaatgcattgggtgcggcagaagcgatttcgaaaacgtgtttcgaacagaacaatcgaagcagttgaaaatgaggttgaccgattgcttgcaatggatgaacgcgctgaaagtacatcgaatgagttgattgatcaagcacaattggctcgtgactcaagcatcgctctttcagaggatacatcgtttgatggaatggcaggacttcgtggtaccagcatcgatcgggacgaccaaagcgtgcaaactgatatgtttgatggtatggatgaggacgatttggctggacagattgaacagggtatgcttgagcttagtcaagatactcgggagtcaacagcagaacctcgtgccgcaggtgaagaatctgctagtgaagaagaagaagaggaggaagaagaagaagaagaggaaaatgaagctgacgatgagactcgcgaaaataaacgacaaaatagacttgttcgtgagtttatttcagagttggagtcttctattcaaaaacgtagaaaggatgccgatgaagcaactaatcccattctacgaaatcgtttccttgcagacgttaatcgtatggtgaccgagttagagttaaaacgtactcaacttgtcgataaccctgaataa

SEQ ID NO: 25878 - DNA, 1350 bp, Schizosaccharomyces pombe
atgattggtcctcgtctttgcgctgcaacccctcgcttccctctcgtttccctcgcccacaggaactctaaagtatttgcgctcgcctcttccaatgccgttgcacaacgttggggcaaacgcttttatgctcctattgaaacggagacgcctcacaaagttggtgtagagtttgaagaatccaaagatcgcattttcacctctcctcaaaagtatgttcagggtcgtcatgccttcactagatcctatatgtatgtcaaaaaatgggccactaaatcagctgtcgtgcttgccgaccagaacgtatggaacatttgtgccaataaaattgtcgattctctttctcaaaacggaatgactgtcaccaaactggtctttggcggcgaggcaagcttggtggaactggataaacttcgcaaacagtgccctgatgatactcaagtcatcattggagttggtggtggtaaaaccatggattccgcaaagtatattgctcattccatgaatcttccatccatcatttgtcctactactgcctcctctgatgccgctacttcctctctttccgtcatttacactcctgacggtcaattccaaaaatacagcttttacccccttaatcccaacctcattttcatcgataccgatgtgattgttcgcgctcccgtccgcttccttattagtggcattggtgatgctttgtccacctgggtggaaactgaatccgttattcgctcaaattccacttcctttgccggaggtgtggcctccattgctggccgttacattgcccgtgcttgcaaagacactcttgaaaagtatgccctgagcgctattctttccaacactcgcggtgtttgtaccgaggcatttgagaacgtggtcgaggccaacacattgatgtctggtctaggctttgaaaacggtggtcttgctgctgctcatgccatccataacggtatgaccgccatccacggtcccgttcatcgtttaatgcatggtgaaaaggttgcttacggtaccttagttcaagttgttttggaggattggccgttggaagacttcaataatcttgcttcttttatggcaaaatgtcatcttcccattacccttgaggaacttggtattcccaacgtaaccgatgaagagttattgatggtaggtagagctactttgcgacctgatgagagtattcacaacatgtcaaagaagttcaatccatctcaaattgctgacgctattaaagccgttgactcctattcacaaaaatggcaagaacaaactggatggaccgagcgttttagattacccccttctcgtcatagtcctcacttgaccgacattcatcca

SEQ ID NO: 25879 - DNA, 921 bp, Schizosaccharomyces pombe
atgtgttttttttttcgactcgtttcttcttttgccattctgaggatttccttcctatcggtatttttctctctcgtttgtattatacaacgatgctttatgatgcttataacgattttttgttccctactaacccctattgctacgtagattaccaagtcaatcaaattttgcaagttacgtgcgctccaagtcgcaaatccccaacgaaaggccaaaacaccctcaaaccacgcgaccgaggagttacagcaatcttccacaaattccacaaccctacctacgcaagaagccgccgttgaaacgaatgcctctgcttctcatgaaacatcttttgctctccccactacatctccagcagcatcgctctccatctctcctacaaagtctgcagccgtatcttccgagcctaatgtagaagcagacgtaaaatcgttgtcttcaacaccggctgctccacaactaaattcaccttcccattcatatgagcctaccacgttcccctcaactacatcaataaccgaaaatttgccaacaatagatcctactcgttccactcgctcttcctcgcatatccaaagtttatctcctgagtcaaagcaaacatcagatgggcatcggcctccctcccctacgtcaatcaccaccacctccacctccatcgatccgtcagtagcattttccagcaagtcaactttagccacaacaagaacaaatgcccctctatcaaggccatctcaaccgactaaagcctcccccttgaacaagttttccgccttggaggctatccaatctgctcgaagtcatgcacgctatgcatacagtgcattagactacgaagacacaacgacagccattcatcatctaaagtcggcactaaaacttttggaggaagaggagcagggaaatcatactgcagac

SEQ ID NO: 25880 - DNA, 2819 bp, Schizosaccharomyces pombe
atgtctacaaaaaacgcgttgaatgattcccagataaagttattaaattctttaaatgacaatgtaaccgaatcccgtttttgcccttttctcaactaacagattatagaaaggaattccttctaccgagttcgtagagaagtttgctgagtccctttacgagacccaaaatgatggttctaaaaaatgtaagttaatattttgttttgtatcgaaaccatttcctcttcattcgtgtcctaagtatttcaaaagcttttttttaatcgctggagcttattgttattttgggtttactttcgatttatggttttcctacttctgtcacagttataatagcccaaaaaaataatacctcgaatactatacgttacatattttattatataggtatgatttactaacagaatgtttcagtatcttcaattgatgggtctatcaaatcatttgcggcatgccttcatgaattgaatcggctaaagtctagagttggtgataggatacgtgactatgcttcagcatcaaagcaagttcaaaatgagtatcaccagaaatctaatcatctacgtgaaaaatttgcacaggtcctcgaattatcaaggcatttggaagataacgttaatgacatgcgcagcggtttagttgatgctggccaagaattagaacgggcggaaaataaccgtaaaagaattttatcttcagcagaattgttgaggtattatttggaatttcggtctggaaaaccacaaaccctcatggatttttttcgtaccaataatcacgacaaaatgctattatgtgcgcaaaggacaagacaattgttagcgcttgctaatgaagttgatcttcctgattcgagcgaaacgctggcacgaattgaaaaattttccgagtttttagagacaaattttttaaaattttttaacaacgaatacagaaagcccaattggaagggtatggcatcttttggcaccatacttcaggagtttaatggtggtgcatctgtcgtacgtgaattcgttaatcagcatgagttcttcattgctgctgataaggttcaatctcgtcaaggtttagaacaagaccctatatggctgattttgccagatccaacgcagaaaataccaccgctaattcaaacactatcttctttatttagtgaattatgttctgttatagaaggtgactgcgcggtcattaaacgtgttttccctaatcccgaattggttctccaaactttctttcaaagaatttttggtcagtctattcaaaataggttagaagaagtgatggagattgctaaagggaagtcaaaccttgcatatttgaggacactccagacagttgtttcttctttaagaaaacttgttgccgatcttaaaacgattttagaaaatcgagggttttcggtatccgataattcccccctctctcttgctttaaatcaatatatggaagatttactggttccgtttattgaagttgatgattatcttaagcgtgaggaacattccttacggtctttatttcgactaagtttatacaaatatacaagctacaaaattcgcttagaaactccagagcccggtctgttaagatcactgatgactcctctacaaggcaatatggttgcgcctaccggagtccattcccaatttaatacaaaaactgaaggattccttttgaggattgctgacattcaggaaaatctaatacaaagtggttcattcattactgaagactacattaccattgaaaaaaaccatagccatcttaattcggaaaaagtatattcatttattggctggcatgcagaggctttaaatagggcgtctatcttaatttcaagccaagatttgtcagttgtaatatcttcgcttgtgaaccttttggataaactgatacgcgaagattatgtattcaaggagctttcatctatacaatcatacatctcttcacatgataagtcgaaaaacttggatcttcattacctagtggacattagggaatgtaagaaaattatgggatatttttctgcatatttaatgtcaatagtgattccgtttactggagtgaccgcgtcatctcgaagagaaacggttaacattctaagttcctcaatctccgttattgaatgtgccgttaatgatgtattttacgcgaccgtgcatgcactaggagaccatttggaaattattttaagtccgtataggcaaatttcttatgctatgacagaagaacaaattgattcttctaccgagcttcgtcaatcaatgactaggaatgttcaaaattatttagattatataaaaaacctatatcatagattaggaccttatgatccctcgttattggccttaaaacaaaagacggcaacaatgcttgctgcaatgcttataagttttgcttttcgttccaaagtcacagcggctggcgctttgttgttgcaaaagtacgcacaattttttgttttttatcgaaagtgattaatttactgactttatctagtgatattaattttttccattctactttgactagttggggaattgataccgttgatgcgaaatttaagttgatacttcaattattaagtttacttatggtcaagtaagtgaatatcttttaggagagaaagtttgttaacatttagaattgacgttcttccagcagtcatgcaagacaagcgtaaagcaggttttagtgaaatgaacattcatgaagttctccgtctacgttttgatttgcctgaaaacttgaagttgcaactgaacaaagaagaagctttattgcccccaaagagcagttgaaatcgctca

SEQ ID NO: 25881 - DNA, 756 bp, Schizosaccharomyces pombe
atggctacagaggccaacatatctgccacttctgctaatcctcagtcacagggtgaaaatttaaaaactttcgagatttatcgctggaacccagagaaaccagaagtaaagccaaagcttcaaaagtatacagtcgacttaacaaaatgcggaccaatggttttggatgcgcttattaaaatcaaaaatgagcaagatcctaccttaacgttccgtcgctcatgcagagaaggtatttgcgggtcttgtgcgatgaatattaatggcagtaatactttggcttgcatctgtaacattaaaaaagataacaaacctactaaaatttaccccttacctcattgcttcatcgtaaaggatctcgtacctgacctaacctacttttataagcaatataagagtattgaaccctggttgcaaaacgataacatccctaaagacaaggagttttaccaatctcgcgctgaccgtgccaagcttgacggtttgtatgaatgtattttgtgtgcctgttgttctacctcttgtccatcttactggtggaactcagaagagtatcttggcccagcagttttgatgcaggcttatcgttggatcatcgattctcgtgatcaagctactgctaaacgtttggatgtcatgcagaactctatgtctgtctatcgttgccataccattatgaattgcgctcgtacttgtcccaagggtttgaaccctggccttgccattgccaaggtaaaggctttgatggctactgct

SEQ ID NO: 25882 - DNA, 943 bp, Schizosaccharomyces pombe
atgtgtcaagaggacgaatacgattatttgttcaagactgtgctgattggggatagtggtgttggaaagtcaaacctacttatgcgtttcactaggaatgaatttaatatcgaaagcaagagtactattggtgttgaatttgctactagaaatattgttcttgacaacaaaaaaattaaagcacagatctgggatactgccggtcaggaacgttatcgggccattacctcagcttattaccgtggtgctgttggtgctctgattgtttacgatatcacaaaacaatcttcattcgataatgtgggccgctggttaaaggagcttcgtgagcatgcagacagcaacatcgttatcatgcttgttggtaataaaacggatttactacatttaagagctgtatctactgaagaagcccaggcatttgctggtaagtaattttgttggtgagatatggagttgttcggacgggaagtagtgaaaccggctttagccgctctcactttattccgttcatcgtttttagcaattttgaactgcttgaagcgtagaagatctctttttgttttgaaatattattcaccttgtcgattccattctctgtttattaagcacatttgtttgcctctgattcgtcataattttttgaacataattaactaatgtttttacagctgaaaataacttatcttttattgaaacctccgccatggatgctagcaatgttgaagaagctttccaaacagttttgactggtatgtttattcgtacttgctttgatttcttcaagttttactaatctagcgtagaaattttccgaattgtctccaacagatcactcgaggctggagacgacggtgttcatcctacagctggtcaaacgcttaatatcgcccctaccatgaatgatcttaataagaagaagtcttcttcccaatgttgttag

SEQ ID NO: 25883 - DNA, 984 bp, Schizosaccharomyces pombe
atgtctgaatctcggcaagagctcttagcttggatcaaccaagtacgctttaatatcttagttagattgaaaaaattatcagcttactgacttattttaaaggttacaagccttggtttgaccaggattgaggattgtggaaaaggttacgctatgatacagatttttgactccatatatcaagacataccactaaaaaaggtgaattttgaatgcaataatgagtatcaatatataaacaattggaaagttcttcaacaggtattcttgaagaagggtatcgataaagttgtagaccctgagagactatcgcgttgtaaaatgcaagataatctggagttcgttcaatgggccaaacgtttttgggatcaatattatcctgggggcgattatgatgcgctggcacgccgggggaatagaggacctgctaacactcgtgttatgaattcctctgcaggagcaactggcccttctcgtcgccgtcaggtttcttctggtagttctacaccttcaatgactaagtcatcagcaaacaacaataacgtgtcttcgactgcaaatactgcggcagtgttaagggcaaagcaagcacaacaacaaatcactagtcttgaaacacagttgtacgaagttaatgagacgatgtttggtttggagagagaacgtgatttctattttaacaagcttcgagaaattgaaatacttgtacaaactcatttgaccacttctcctatgtcaatggaaaatatgttggagcgtattcaagcaatactttattctactgaggatggttttgagttaccacctgatcaacccgcagatttaactaccgcccttacggaccatgatactaacaacgtcgctgaagaggctcaaatgactgacctaaaagactcagaaactcaacgcgttccctctgcaccagatttcgtacatgctaggctacaaagtttagaggttgatgacgatgagaatatcacgttt

SEQ ID NO: 25884 - DNA, 978 bp, Schizosaccharomyces pombe
atgaaagatgatcacgatgcatgggaaccagaagaactagtcagtgacaataactcttcagaaaatgagctacaagaagaccaaaattcttcaataacttttttaccaccttcagttaataaatcgaatcccgcaaaatcgaattactatcattcaacagtcactgatgatatttccaagagtcagccatatcgattaggagtagatgaagctggtagaggccctgtcttaggacctatggtatatgctgtcgcttactgtccagtcgatttcgatttgaccaactatgggtttgctgacagtaaaactttggcctccttaaagcgagaggaacttctgaaattaatttgcaacaaatctaacgagctaggaaaaaacgttggatggtctactatgtctatttccgcaagagaattagctgcaggaatgctgaggtaccggaacaagtataatttaaatcttcaagcacatgatacgacaattgacttaataaaaaaagtttatgaatcaggaataaatgttacagagatttacgtggatacagtaggacctccaatatcataccaggaaaaattacaagctcattttcctcaagcgaaagtcactgtcactaaaaaagcagattccctttttcccatcgtgagtttagcttctatctgtgctaaagttactagagatattcaactggaatgcgctcgtgaaagtattcgaactgagaactggggttctggatattcttctgacgctcgaactaccgagtggttaaaagtaaatgtcgataaaattttcggatggaagggagacatagttagatattcatggaaaaccgctaaggatttactagaattaccttccaaatcacagtcttcgattgaaatagattggcacgaagatgacgatactcctactttgaactttacacagaaaaagaaaccgaatccggcttctcgttcgtggtttggatcagagttttatttt

SEQ ID NO: 25885 - DNA, 3339 bp, Schizosaccharomyces pombe
attgaagacaaatggcagcttttacctgcatttttaaaggtaaaaggacttgttaaacagcatttagactcgtataactattttgttgatgttgatttaaaaaaaattgtacaagcaaatgaaaaagtcacttcagacgttgaaccttggttctacttaaagtacttggatattcgagtaggagcgcctgttcgaactgatgctgatgctattcaagcctcaatttcacctcatgaatgccgtttacgtgatttgacttatggtgcgaatatttacgttgatattgaatatacgaggggcaaacaagttgtaagaagaagaaatgttcctattggaaggatgcctgtaatgttgcgaagtaataaatgtgttttatctgggaaaaatgaaatggagatggccgctttaaacgaatgccctttggatcctggtggttatttcattgtaaaaggtactgaaaaagttattttagtgcaagaacaattatccaagaatcgtataattgtcgaagcagaaccaaagaaaggactttggcaagcttctgttacttcctcgacccatgagcgaaagtcaaaaacctatgtaataaccaaaaatggaaagctttacctgaaacacaacagtgtagcagatgatattcctatagtggttgttttaaaagcaatgggacttcaatcggatcaagaaatttttgagcttgttgccggtgcagaagcatcttatcaagatttgtttgcaccaagcatcgaagaatgtgcaaagttaaatatatatactgcacagcaagcattagaatatatcggtgcgcgtgttaaggtaaatagacgagccggtgctaatcgtttgccccctcacgaagaagctcttgaagttttggccgccgttgtgttagctcacatcaatgtttttaatttagagttccgtcctaaggcggtttacattggaataatggcccgtcgagttctcatggccatggtagatcctttacaagtcgatgatcgtgactatgttggtaacaaacgtctagagttggctggccagttgttggcattattgtttgaggatctttttaagaagtttaattcagaccttaagctgaacatagataaagttttaaagaaaccacatcgtacacaagaatttgacgcttacaaccagctaaccgtccatagtgatcacatcactcaaggtatggttcgtgctttgtctactggcaattggtcattaaagcgtttcaagatggaaagagctggtgtcactcacgttttatctcgattaagctatattagtgcccttggtatgatgactcgaattaccagtcagtttgaaaaaacaagaaaagtctcaggacctcgttctcttcaagcttcccagtttggtatgctttgtacttcagatacacctgagggtgaagcttgtggtttagtgaagaatttagcgttgatgacccatattacaaccgacgaagaagaggagccaattattaagttggcgtatgcgtttggtattgaagatatacatgtcatcagcggacgtgaattacacagccatggtacctacttggtttatttaaatggtgctattttaggtattagcagatatccttctctgtttgttgcttcattccgaaagcttcgtcgttcaggaaaaatatcaccttttattggtattttcattaacacgcatcaacgagctgttttcatatcaacagatggtggaagaatttgtagaccattgattatagttcagaatggattacccaaggtcgaatcaaaacacattagactgcttaaagaaggaaaatgggggttcgaagattttttgaaacaaggattggtcgaatatgtcgatgttaacgaagaaaatgatagtttaatttctgtttatgaaagagacatcactcctgacaccactcatcttgaaattgagccatttaccattctaggtgctgtcgctggcttaatcccctatccccatcacaatcaatctccccgtaatacctatcaatgtgcaatgggtaaacaagctatcggagcgattgcttacaatcaattgcagcgtattgatacattattatacttaatggtttatccccagcaaccgatggtcaaaacaaagaccatcgagttaattggatatgataaattaccagctgggcaaaacgcaactgtcgcgatcatgagttattcgggttatgacattgaagatgcactggttttgaacaaatcctcaattgacaggggctttggccgctgtcaagttttccacaagcattcagtcatagtccgaaagtatcccaacggtacccatgatcgtattggtgatccacaacgagatcctgaaactggcgaggtagtttggaaacacggtgttgttgaagacgatggtttagctggtgttggttgtcgtgtacaacccggtcaaatctatgtcaacaaacaaactcccactaatgccctcgacaattcaattactttgggtcatactcaaactgttgaatcaggatacaaagcaactccaatgacatacaaggcccctgaaccaggctacattgacaaggtcatgcttactacaactgattctgatcaaacattaatcaaagtcttgatgcgacaaactcgtcgccccgaacttggcgataagttttcctcacgccacggacagaagggtgtttgcggtgtaattgtacaacaagaagatatgccgtttaatgatcaaggtatttgtccagatatcatcatgaatcctcatggtttcccatctcgaatgaccgttgggaaaatgattgaacttttatctggaaaagttggtgttctaaggggaacattggagtatggaacatgttttggtggaaccaaagtggaagatgctagtcgaatattggtcgagcatggttacaactattctggaaaagatatgttgacttcgggaattacaggtgaaacattagaggcttacatttttatgggcccaatttattatcaaaaattaaaacatatggttatggataaaatgcatgcaagagcgcgtggcccgcgggcggtgctaacgcgacaacccacggagggacgttctcgagacggcggtctacgtttgggtgaaatggagcgtgattgtttgattgcttatggtgcctcccagttacttttggaaagactcatgatttcctcagatgcttgtgatgtggatgtttgtggccaatgtggtcttttgggttacaaaggttggtgtaatagttgccagagtactcgagaggttgtcaaaatgaccataccatatgcagctaagttattatttcaagagttgctaagtatgaatatcgtaccgagattagctctg

SEQ ID NO: 25886 - DNA, 2655 bp, Schizosaccharomyces pombe
atgcttattgaattgcaacaaattgtcaagtccggtcttgtacggaatggagcgaaacactgtacgaaaaggagcttactatgttccaatgcatcagtcattgcaagcaaacgttttcaaggcagttttgccccgggtcaacaacaaccgttaaacccactcgcgaaaccaattgaacaagatcgtgatgccatcattagaattctttcctccatcggaagccgtcgtgaagttgagcaatacctacgatactttacttccttcgaagctcaacgtttcgctattatcaaggttggtggtgccattatcaccgacgaattagacacattggcacaaagtcttgcctttttgaatcatgtgggtctttatcccatcgttgtgcatggcgctggtccccaattaaacaaaattcttgccagcagaaatgttgaacccgagtatagcgatggtattcgaatcaccgatgccgagactctttctgtagctcgtaaagttttcttagaggaaaatgcgaaacttgtagatgctttggaaaagttgggaactcgtgctcgtcccattacaggtggtgtatttcaggcagagtatctcgacaaagaaaaatacaagtatgttggcaagattgtcaaggtaaacaaagctcctattgaacacagtattcgtgctggaaccctccctattcttacgtctatggccgaaactgcttctggtcaattgttgaatgtcaacgccgacattactgctggtgagcttgctcgcgtattgaagcctctaaaggtggtctatctcaatgaaaaaggtggacttatcaacggtgaaacaaagaaaaaaattagcagcatctatttggatagggagtacgatggcctcatgaagcaaccatgggtcaagtatggtacgaagctcaaaatcaaagaaatcaaagagttacttgatactcttccccgtacatcttccgtagccattattagtacgaaggatttgcaaaaagagctttttacggaatctggcgctggtactttgattagtcgcggttttgtcatcaacaaacatgactcgttggatagcattccagacgctgctctagaaaatttgatcattcaaaaaaattctttagccgcacctagtgaaagcttgaaacagttcaaggatactctgaaagacagaaaacttcgtatttatagtgactctttcaatgaatctgttgctattgtcgacaccaccgactcatccttgccagtactcttagcttttggtgccgccgacaataattggttaaacaatgttgttgatagcatattaacaacattaaaagcagacttcccttctttgctatggcgtcttcaaccttcagccaagaatctggaatggttcttctctaaaagcgaaggtactttgtttgctaataatttttactacttttggtacggtgtaaaagatttgaataaaatctccaagttcattcagtctgacaagccatttgccgatgctatcattcagacccaatccactaaaccccctactgcttcatctaccaccaacaacccttcctcttcacagatcaatcaaaaacgaagttactcaactagttctttattttcaaaaaacaaaaaaatgaatcgttctttgtttttaaagggtggaaaacgatttttttctgctgaggctcagaagacccaaaaacctttgaaggcggtctcatcgaagccagcaaaagtcgttctccttggagcccgtggttataccggaaagaacttgattggattgattaacactcatccttatctcgaattatctcatgtttcttctcgtgagttggaaggcaccaaacttcctggctacactaagaaagaaattcagtatgtcaacttgtccacagatgatgttaaaaaattagaggaagagggagcggttgatgcttgggtcatggccctacccaacggtgtatgcaaaccttatgtcgatgctttaacgtctgcaaatggtaaaagtgtcattgttgatttaagtgcggactaccgttttgagccctcgtggcagtacggtcttcctgaactaaatgaccgtgaagctttgcgtaactcgaaacgtatttccaatcctggttgttacgctactggatcgcaagtcggtttaactcccatactctctttgattgacggccagccctctatttttggtgtatctggttattctggggctggcactaagccctctccgaagaatgacttgaatgtattgacaaacaatttgataccttactcattaactgatcacatccatgaacgtgaaatttcttatcgtttaaagcaacctgtcgcctttattcctcacgttgctcaatggttccaaggaattactttaactattaatgttccgttaaagaaaagtataacttcccgtgagcttcgtaacttataccaagaccgttataatggtgagcctttaattcatgttcaaggagatgtacctttggtcaaggacaacgcacacaagcatcatgtttcagttggtggttttggtgtgcactcttctggaaagcgtgcagtcattgtagttactatcgacaatttacttaaaggtgctgctactcaagctctccagaatctcaatctgtcctgtggttacgatgaatatgccggtatccatttggat

SEQ ID NO: 25887 - DNA, 981 bp, Schizosaccharomyces pombe
atgtctttcaaaaaatttcctcgtcatttactatccattcgtgatcttagtcgcggagagattgtaaagttgatcgatcggtcttctgaaattaaacaagcttataagcagaattttcagaatcgccgttctgttcaaatgagtggtttgtcgtctcagaatgtcgccatgatcttcagtaagcgtagcactcgtactcgtgtatcagtcgaaagtgctgtcagttgccttggcggcaatgccatgtttttaggtaaagatgatatccaattaggagtgaatgagtctttatacgatacttcaaaagttatatcaagtatggtttctggtattgttgctcgcgtaaacaaatattcagatgttgctacgctcgctaaacatgcctcttgtcctgttattaatggtctttgtgacacgtttcatcctctccaggcgttagcagatttactcactattaaggaaactttcaaaagctttgacggtttaaaagttgcatgggtaggtgatgccaataacgttttacatgatttgatgattgcaaatgccaaggttggtattcatactagcgttgctaagcccaaggacgtcaacgttcgcgacgatattttatcaatcgttaacgaagctgcgaacgaaaacggttctacttttgaaattgttaacgaccccaaggttgctgttaaaaatgctgatatcgtcgttaccgacacttggatttctatgggtcaagaagctgagaaggaacaacgtcttaaacaatttacaggattccaagtcaccggagagatcatgaagcttgccaaacctagctgcaaattcatgcattgtttaccccgtcatcccgaggaagtgtctgacgaggtattttatggagagaacagtttagttttccaagaagcagagaaccgcaaatggaccactgttgctgtcttggaggctttgcttgtcaaccgtggtgaaattcttcctcctgcctcagcc

SEQ ID NO: 25888 - DNA, 579 bp, Schizosaccharomyces pombe
atgactgttactcccattaatcctactaatcagccatacaaatatgtatttgtagtcatcggccctgccggttcaggaaaaacgacgatggctaaggcggtatctgagaaattgggttttgagtatattgagggtgatgatctacaccccaaagcaaacattgaaaaaatgagtcaaggccatcctttgaatgataacgatcgttggggttggttgcataactgcggaggtgcttgtgccatggaacttgacaaggaatcgataaagggagttgtgttaacctgctcggccttaaagcgtagttaccgtgatatccttcgtagctctttggagcatcgtcctgcaattttgcgctttatttatttagccgcttcgagagaaacacttattaaaagaacgactagtcgcaaaaatcattacatgaaggctgacatggttgaaagtcaattggcaatccttgaggctcctaccgctgatgaaaaggatgttattaccattagcgttgagaatggaaaagaacagtcagaagaagaatgtcttgatatcgtccacaaaatggttaatgaaaacaagcaacct

SEQ ID NO: 25889 - DNA, 1063 bp, Schizosaccharomyces pombe
gttcttgcaaacaaatcttgctgtggtgcagtagtaactgcattttcagtaattggtattgtgtttacaatccttaaatttacatcttttgccagtttcgtttataagacgttctttgccaaaggtgtcaaggtaagaaaactattatatcaatccttagacagtgctctaacttctttagctgtctgtttacggagccaagaaaggttattgggcggttgttacaggtgctactgatggaatcggtaaagagtatgctactcaattagccatgtctggatttaatgtggttcttataagcagaacccaagaaaagcttgatgcattagctaaagaactcgaaactgttgctaaggtcaaaactcgcactattgcaattgattacaccaaaacgaccgccgaaacttttgagaagcttcatcaagatttagtaggaactccaattacagtacttatcaacaatgttggccaatctcattatatgcctaccagttttgcggaaacaacagtgaaggaaatggatgacattatgcatataaactgctttggtactcttcacaccactaaggccgtactttctatcatgctcagagagagacagaagaatgaaaagggtccccgttgccttattttgactatgggctccttcgctggcttacttccttctccttatttgtctacttatgccggatctaaagcctttttgtctaactggtctgcttctttgggtgaggaagttaagaaacagggtatcgacgtttggtgtttcaattcttatcttgttgtatcagcgatgtcaaaagttcgtcgacctacattaacaatccctacacccaaaaagtttgttcgcgctgctttaagtagcattggtctccagcgtggaggaaccaatccttacataagtcaaccatatcctagccatgccgtaatgagttggtctttggaacaattgttgggcagtgcaaaggggtttgtcgtttctcaagttgctgcaatgcacctcagcattcgtaaacgtgcacttcgaaaagaagcacgccttcaagctcaaaatcaagcctag

SEQ ID NO: 25890 - DNA, 1009 bp, Schizosaccharomyces pombe
atgcacgaaaaaggtgataaaaacttattggcaatactagttttttctttcgtatctttttactttttcttgttttgctccctccaaaatgatgaaaacactgcatttatgaatctccttcatcttccccttcctctactaacttgtttagactaaagatttcttggcaggtgtgtctggcggcgtcgcccaggtccttgttggacagccatttgattgtgtcaaggttcgtttgcaatcacagagtaatgtttcccccatctacaacaatgctctcgattgtgtaaaaaaaatttccaaaaacgagggtttagccgccttttacaaagggaccgttttaccacttttgggaattggattttgcgtttccattcagtttaccacctttgaatattgtaaacgtttcttttctcgagacggtactcccgtgaccatgcctcagtattatgtttccggtgctatttccggcttggcgaattcttttttggtgggtcccgtagagcatgtccgtattcgccttcaaatccagacgggcaaaaatgttttgtaccatggtccttgggattgtatcaaaaagatttcttcgcaatatggtcttagtggcatcatgaagggttacaaccctactgccgctcgtgaggctcatggccttggaatgtattttttggcttatgaagctctggtgaaaaacacaatggccaagcatcatttgaccgatcgatcacaaaccccaggttggaaactttgcgtgtttggcgccggtgctggttatgcaatgtggctagctgcatatccctttgatatcgtcaaatccaaaattcaaacggatggctttttaagtaaagccacgtacaaaaattcttggcaatgcgccaaaggtatttacaccaaagctggcctccgaggcttttatagaggctttgtacccgtattagttcgtgctgctcccgccaatgctgttacattttatgtatacgagactgtttctcaacacatcaggcatctttaa

SEQ ID NO: 25891 - DNA, 1400 bp, Schizosaccharomyces pombe
gatcgtttgaattggatattggaaaaatattttacttatctaagaccctcttggcttaaaaaactgggtactcgacgggcatacgaacttataaaaatagaagatcagaataccgattactcttgtattggcccagtaaatgcagcaatgaacactgtttgcgtttactttcatgaaggaccttctagtaaagctttccaaaagcacattcaacgtttgcatgatttcatgtgggtccaaccagaaggaatgcttatgcgtggtactaatggtttgcaagtttgggaaacttccttcacattgcaagcgctcgtagaatcaggtctttacgaaaaagaggccttcaaaccagatatcgccaaagctctggagtttttggatcgacaacaggtgcgcttctttttttccaaatatgttgaattagacgatgactaactttaatttagattcgaacgcaatatgaagggagtggatataggtacaattctttgggggcatggccatttagtaatataactcaaggttatacggtgtcagatactacatctgaagctctgcgtgctgtattgcttgtccaatcattgccagattttgaaaaactggttgatatacctaggctaaggttatcggttgatgtgatattgggaatgcaaaatgagaaccttgggtttgcttcatatgagcctgcgcgaacaggtgaatggatggagttgttaaatcctgccgaagtttttggaaatattatggtcgaatactcttatcccgagtgcaccacatctgtcatattggcactccgggcttttacaaagtatgatcctggatatcgtcgtgatgaaattgaaaatactattgaaaatgctttggaatacgttgtaaagatgcaacgaccagacggaagctggtatggaagttgggctatttgttttacgtatgcagccatgtttgcgacaggttctttggcatcagccggtcgatattacgaaaactgcccagtccagaagaaggcgtgcgaatttttactgtcgaagcaaagaccagatggtggatggagtgagagttacatggtatggatacaaaatagataatgggagattgactaacggatgatttaggcttgtgttactggagtttacacagaaacagaatcaagtttggtaacacaaactggttgggctttggacgcactgattaatgcaaagtaccctgatagaaaaccgatagaaaagggaattaaatttttgatggcgtctcaaaagagcgatgggagctggcagcaaaaatcgatggaagggatctttaacaagaatgttgccattgcatatcccaactacaagttgtacttttccatatacacattgggaaagtttgcaaagcaatacggcaattacctgaccatttag

SEQ ID NO: 25892 - DNA, 1932 bp, Schizosaccharomyces pombe
atgagcaagtctatcggtattgatttgggtactacttactcgtgcgtcggtcatttctcgaataatcgagtggaaattattgccaatgaccagggaaatcgcacgactccctcctatgttgcattcactgacacagaacgattgatcggtgatgctgcaaaaaatcaagttgctatgaatcctcacaacactattttcgatgccaaacgattgattggccgcagatttaacgatcccgaagtccaatctgatatgaaacattggccttttaaggtcatcgagaaggatggtaagcctttgattcaggtagagttcaagggtgagaccaagacctttacaccagaggaaatctcctctatggttttattgaagatgcgtgaaagcgcagaagcctttttgggtggcaaagtcaccgatgccgttgttactgttcccgcttatttcaatgactcccaacgtcaggccacgaaggatgccggtttgattgctggactaaacgtccttcgtatcattaacgagcccacagctgccgccattgcttatggtttagacagaagcaaccagcatgaaaccaatgtccttattttcgaccttggtggtggtacttttgatgtctcccttcttactattgaagagggtattttcgaagttaaagccaccgctggtgatacccacttgggtggtgaagattttgactctcgcttagtgaaccactttgcccaagaattcaagcgtaagaacaagaaggacatcactggcaacgctcgtgctgttcgtcgactacgtactgcttgcgagcgtgccaagcgtactctttcttcttctgctcaagccagcattgaaattgattctttgtatgaaggtattgatttctacacctccattactcgtgctcgatttgaagagctttgtgccgatctcttccgtaacaccatggagcctgtggagaaggtcctccgcgactccaagatcgacaagtcctctgttaacgaaatcgtcttggtaggtggttctactcgtattcctcgtattcaaaagcttgtttccgacttcttcaatggaaaggagccctgcaagtctattaaccctgatgaggctgtcgcgtatggtgctgctgtccaagccgctattttggtgggtgatacttctgaaaagacccaggatttgttgcttcttgacgttgcccctctttctttaggtattgagaccgctggtggagtcatgactcctcttattaagcgtaacacgactattcctaccaagaaatccgaagtcttttccacctacgccgataatcaacccggtgtgttgattcaagtattcgaaggtgagcgtgctcgtaccaaggactgtaacttgcttggtaagtttgagctttctggtatcccccctgctcctcgtggtgttccacaaatcgaggtcaccttcgatgttgacgctaatggtattttgaacgtttctgcccttgaaaagggtactggtaagactcaaaagattaccattaccaatgacaagggtcgtctttccaaggaagaaattgatcgtatggtatctgaagccgagaagtacaaggctgaagatgaagcagaaacttctcgtattcaagccaagaatcacctggagtcttatgcatattctcttcgtaattccttggacgatcctaatctcaaggataaggtcgatgcttcagataaggaagccattgataaggctgtcaaagaaaccattgaatggttggatcacaacaccactgctgccaaagatgagtatgaggacaagcaaaaagaacttgaaggtgtcgcgaatcccatcatggccaagatttatcaagcaggaggcgcacctggtggtgcacctggtggtatgcctggcggtgcccctggtggtgctccgggcggtgctgacaatggacctgaggttgaagaagtggat

SEQ ID NO: 25893 - DNA, 1611 bp, Schizosaccharomyces pombe
atgacagatactcctaggatattgattactccatctccgcttagcgatataagcacaacgattaacaaaccaaatgttcatcccagtatgagtctattgaaggctcttcccgaatgccgactcgttgtcaaatccaagggtgataaaaataacgcaaacgttgttgaatttcctctggatcgtcataaacaattattaattgcaggaaaagtttaccatgattataagtttaagcctcgtaaatcgatttttgatcgtgtaaccgatcctaattatttcgcaaaaagtgagtttagagggttttatgtgcttttttggctttcaatggctgcatgggtactacagttatatgcaagaagttattggcaacgcgatactttgcttggtttaccactagctagacaggtctttcgccagtttttcgtgttgtttagctcagatttccttatgatttgcctcagcttttttagttatggtttacaagtgtgtattgagaagaacatgattagatgggctaatttgggttacacaatccaaactttgtggcagggcttttatatggtgttagctgtctattgggttaagcatcgagattttccaattgttcaatgtgttttcttcacgctgcattgtgccgttctaattatgaaacaattttcttattctcaccatatgggctatatcagtgagattcgtatattgcataatgaatacgaaaaacttttaaagtttgttcgtgaatgcctgaattccaccgagaaagatgagaaatacacgtttgaactgacttttcccaataagcctgctgaaacgatatctacattgcaggcagaagaaattgtcgctttaacagcaaaatatttgtcacgccagatgcgtagcgaagtgggcaatgttgtttatcctgataacatcaatttctttaattacgttgattatttattagttccatcccttgtctatagtatggagtttcctagagttgcccatttccgttggcattatatggcatttaaagcaggctccacattcggtttactagctctcaccttggctcttgtagattggtatttcgttccaagtgctgtggctgtcaaagatcttgacttcatagggaagctacgcattgctcccttgttaatgaacaaaattatgtttcccgctatcatactttaccttatcatgttttacctgatttttgattgcattcttaatgcatttgctgaaatcactaaatttgccgaccgtggattttatggtgcttggtggaatacagttacatgggatgaattttcgcgcgaatggaataagcctgtccacgtttttctcatgagacatgtttaccattcatcaatttccggtttcaaattaaaaaaatctcacgctgttctactcacttttttaatttccgctcttgtacacgaatttgtgatgctgctcgcaactggtaaattccggtgttacatattaacatttcaattattacaaattcctctttatgacctccaacaaatgtttgctttcaaaaaacgcgatatccttggtaatgtgtttttctggattggaatgttcactggtccttcatttttatgtatcttatacattgtcttt

SEQ ID NO: 25894 - DNA, 798 bp, Schizosaccharomyces pombe
atgagctcaatcgatacgcctgctaataaattgcaagcgaaaaccttgtttcacccagaacatctcgaatacatcaacaagcagttatcggagcttagtcctcaagatatcttaaaatggtgccgttggacacttccttctttgtttcaaacatctgcgttaggactgtccgggcttgttattatggacatgttatcgaaaatggatatgaatgttcctctgatttttatcaacacacttcatcatttcccagaaacactggatcttcttgaaaaagtcaaaactaagtatcctaacgtgcctgttcacgtctatcgttgtgctgaagcagccaacgaaaaggaatttgctcagaagtttggtgagaagctttgggagacagatgaatctcggtatgactttttagtcaaagtggaaccagcaagtcgtgcttattctgacttaaatgtacttgctgtgtttactggccgccgccgtagtcaaggtggagagcgcggatctttgcccattgttcagctggatggaccagtattaaagatcaaccccttggctaactggtcttttactgaagttcataattatattattacaaacaacgttccatataatgaacttctgaacaagggttacagatcagttggtgactggcactctactcaaccagttagagaaggtgaagatgaacgtgccggacgttggcgcggtcgagagaaaacagaatgtggattacacagtcatcctcaaagtaaattcgcacaatatatggcggagcttaaaaagaaggagacggctgatcag

SEQ ID NO: 25895 - DNA, 1368 bp, Schizosaccharomyces pombe
atggtcaattttgcttctgaggttgacaagaataatgcctttgattcggctcacccttctcgaaaatgtaaaggatctttggattgtaatgaccctgatcccatttttcgtcataaggttttggtaataatacacaaacttgctatttctagttggaatcgtattccgttaacattgtgtaacaagttacacatcaaaagaatttcaggagctttaactaatgctgtctattatgtggcaccgccagaaggttaccacgctcccaaactgttactacggatttatggtccccatgttgaattgtttattaatcgacaagttgaactggaaaacttgaagcgccttgctcgacacaatattgggccttatttaattggcgagttttccaatggccgctttgaacaatatatggaatcaactactttgacctgcaaaacaattcgcgatcccaaactttctatctatgttggccgtagactttgtgagttacacaattttatccttttacacccccatgaagttctcgaaatgcctgctgcttggaaaaattgcttggtatggcttccgaaagcaaaagcaaaaatacttggtagaaagcactccttagcaattactagtgaatttatgaaaactttggaagaagactttaacgcttattacaattggtttgttgaatggtcgcgtgataaaaaagattggtttggtttaaaaatggttttctctcataatgatactcaatatggcaacctcttgaaaattaaagctaaaaaacgttctatacctctttcccaaaagcatcgaacccttgtacctgttgattttgagtatgctgggccaaatctttgtgcttttgatttagctaactattttgctgaatggatggccgactatcatcatccaacccataattatttgatggaccgctcaaggtatccagattttaatgctcgaaagttggtttatcacgcatatgttgagcaatccgctgtcattaatgatctactcgaaattgaagatgcttcattgttgaaaactgatatttccgacgaattaaagaacacgtttgaaaagcaaattatgaacttagaagaatctgttcgcgcaattagtcctgctgcgaacatcgggtgggcattgtggggaattttacaatgcttggaagaagatgatgaatgggaggatctaagcgtttccagccaagttgcggatcgacctgaaaaacagttggttgaaggttctaccgtccctcctattggtacctcttcttttgactatattggatacagctctgaaaaatttgatctgttttacgagggatgtgctgccttaggcctaaacggtcgaaaccgttctacattttcgtatgct

SEQ ID NO: 25896 - DNA, 1419 bp, Schizosaccharomyces pombe
atgacaaacacaagattagctagtactcgacgacttgcttcgtcgttactttctcaagcgtcgcttcgttcccgtcaattaaacccccttttcacatcttcttactcaactcgttcctcttccttaaaggatcggttagctgagcttattcctgaaaaacaagcagaaatcaaaaaatttcgcgcagaacatggccaagatgtcattggtgaggtaactatcaatcaaatgtatggtggtgctcgtggggttcgttctttaatatgggaaggctctgttttagaccctaacgagggtatccgattccgtggttatactatcccggaatgccaaaaattacttccttcttctcccaacggaaaacagcctcttcctgaatctttgttctggcttttagttaccggggaaattcctactctgagtcaagtgcaggcgctttccgctgactgggccgcccgttctcagttacccaaatttgttgaagaactcattgaccgttgccctcctacccttcatccaatggcccaattctctctcgctgttactgcacttgagcacgattctgcatttgctaaagcatatgagcgtggaatgaacaagcatgattattggaagtatgaatatgaagactgcatggatttgattgccaagaccgttccaattgccggtcgtatctaccgcaatttgtaccgtgatggtgttgttgctcctattcaaatggataaggaccattcgtacaattttgctaatgttctgggctttgctaacaatgaggaatttgtggagcttatgcgtctttatttgaccatccatgctgaccacgaaggtggtaatgtatctgctcacaccggtcatttggtaggttctgctctttcttcaccctttttgtcgatggctgcctccttaaatggacttgctggtccccttcatggtcttgccaaccaagaagttttgaactttttgattacaatgaagaaagaaatcggtgatgatttatctgaagaaacaatcaagtcttatctctggaagcttttgaattctggtcgtgttgttcctggttatggtcatgccgtacttcgtaagacagatcctcgctatacggctcagcgtgaatttgcacttgagcatcttcctaaagatcccatgtttcaacttgtaagccgtctgtatgaaatagttccaggtgttcttacagagcatggaaaaaccaaaaatccatatcccaacgttgactcacattctggtgttcttttgcaatattatggcttgaaagaacaaagcttctacaccgttttgttcggtgtttctcgaacactcggtgttgcctctcaactcatctgggatcgagctttgggactacctattgagcgtcctaagtctttctctactgaagcattaaagaagatggttgaaacgaaa

SEQ ID NO: 25897 - DNA, 3246 bp, Schizosaccharomyces pombe
atggactcaagactaaatcgaattcagtccaagatgaaactgtggataaaagataaaaatctgagcaatccttctataccacttaaagtgctcaataaatcgtttaggtctagtcgccagtcttcagtttcaaatggccatggattgtattcattagatagagacgaaactgaatctcttatgtccagtcatgaagccagcaatgcaggtatatcgttggattcttcatttagggtaattcaggtagggcaacctgaaccgcaatacggcaataatgctgttactaatactaagtatgatctgtttacttttttaccaaaatgcctctatgagcaattccgatatttctacaatatgtattttttgctagtatccctttcccaattaataccaccattaaaaattggttatctttctacatacattgctccgttaatttttgttttattaattactctcacaaaagaagcagttgatgatttaaagcggcgaaggagagattcatatgctaacaatgagatatatactgttaatgattccccttgtgcagctcaaaacatacaggcaggagatgttgtttacattgctaaagaccaacgtattcctgctgatatgatcttgttggagacaacagtaggaaatgaagcatttattcgtacggatcagcttgatggtgagaccgactggaaactcaggataccttgctcaaatcagcatacagaaggcattgttcatgcggatgctcctattaagtctgttcatcacttctacggaactttcacattgaacaaccagaaacgacctatatccgttgatcatacattatgggcaaatactgtccttgcgagcgatggtgtgtatggcgttgtagtttacactggtaaagatacacgtcagtctatgaatagttctaaagctaaaaccaaagtgggtcttttggaaaaagaaatcaatttttactctaaaatactttgtacttttgtacttgtactttccattggattgactttcagtcacggcatcaaaaccgattggtacatttctgtttttcgttatttaattcttttttcgagcattatacctatcaatctaagagtgaatttagatttggctaaaattgtgcattcgaagaatacggaaagtgatccaaatttacctggtgtagtagttcgctcaagcaatattcctgaggagttaggcagaattgagtatgtgctaacggataaaacaggaactttaacccaaaacgagatggagatgaagaagcttcatgtcggtactatgggattttcagctgaatcaatggatgtcgttcaggcttgtatccaaaattattcaactcctataccattaagtgaggattctaaaactttggttagaaatttagttttagctctatccctttgccataatgttacgccttctaaaggccatgatggagtcgtatcttatcaagcagcaagtcctgatgaagtcgccattgttaaatggactagtaccctaggtttagttttgactaaccgtacaagggatgctattacattgaacaacaatgtttataaaattttgaacatatttcctttcaaatcggagacaaagcgcatggggataattgtgcaatcgcctgatgaaaaaataaccttttatttaaagggggcagattcaatcatgcaaaattttgtaaaacccagtttttggttagaagaagaatgtggtaatttggcccgtgagggtcttcgtacactggttgttgccaaaaaggatttatctgctgaagaatactcggcgttttcactagcacactctgatgccagcttgtcattttcgaattcaagggacaaaaagatggaagaaattgtttcgagatatttagaaaacgacatggatcttttggggcttacaggtgtagaggacaaactacagaaagatgtaaaaatcactctggaactgttacgcaatgcaggaatccatgtttggatgcttactggagacaaggtggagactgcgagatgcatcgctatttcatctcgtttggtttcgcggggtcaatatatacatacaatcaatcagctttcgtctcgtgaagaagcacataatcatcttttaacgcttcgtaacaaaccagattcgtgtttaataattgatggagagtctatggagttttgcattggttaccttcaaaacgagtttattgatattgtttcagacctttcgagcgtagtcatttgtagatgcactccaacgcaaaaggctaatatgacccgtttaatacaagaaaagaaacaagcttctgtgtgttgtattggcgatggaggaaacgatgtggggatgatacaagttgctaatgttggcattggaattgttggtaaggaaggtcagcaagctagtcttgctgctgactatagcgtcaaagaatttagtcatgtctcgcgtcttctactatggcatggtcgaattagttataaacaaacatcgaaattagctatgtttgttattcatcgtggtcttttgatttctgtttgccaagttgtctatagtgtaatttctgcatttgaaccgatcgctttatttcaaggtttgcttttggttggatactctacaatgtacacaatgcttcccgttttttcgattgtgtacgatagggatgtaagtgagaagctggtcttcttattcccagaactgtataaggaaatgagggagcaaaaatgtttttcttacaaaaattttatatcttgcgttctcattagcgtatatcaaggtatgttaaattttatttcattaccatacttacaaacataggattaattatccaactgtttacattctacctcattggatttgaggaagaagggaaaatgttggctgtttgcttttcttgtttgatcttcaacgagcttattatggttgctttacagattaacacatggtaagtttacctttctcacttgtgtgtaggtatatatactaacgacgttagggaacaaacaattgtaatgtctgagttgttaactttgatgatgtatatccttagcgtgccatttttaactaattattttggtatgtttaatatatttacgaagaattttagagaagctaatacatatagaactcaaattcctccttggattgaagttttattgggtgagtgcgcttatactatttatcagtcttttacccgtctggtgcggcaaagctcttaaaaggaagcttaaaccatcgagttatgcaaagctgcaacgttaattt

SEQ ID NO: 25898 - DNA, 1068 bp, Schizosaccharomyces pombe
atgaacaaaatacttttttacttttttttctttttgacactaattctttccgctactgtttatctttttggaggtccaatgatgctgttctttattaattataagacagaccttcttaaagttgatgacgtttataatcatgaaatttattcaaaccagtctgctgctattcctaaaattatacatcagacttggaaaaccaacgaaattccggaaaaatgggttggtgcccagaaaagttgcattgatctacatcctgattatgaatatgtattgtggactgatgaatccatgagggagtttattgctactgattatccttggtttttgactcaatatgattcttatccttacaatattgaacgggctgatgtcgttcgatactttattctttacaaatacggtggaatatatttggatttggatgttggttgtaatcgaacccttgatcccttattgcattatccagcatgggtgaggagaacttccccaagtgggattagcaataatgtaatgggatttgctaaagggcatccatttcttttacaggtggtcagaaacctacctagattcgcgtttaattaccacttcccttacctaaccgtaatgtattcgactggtccattgttcttgtcgataatatggagtgcttggcggaagcttccagatgccgaagcttggcatcatatttgggtgatggttcccgaattgtatgaaaagagccaccatgcattttttgaaatttatgaaggttcatcatggcacgatagtgacgctggatttgtattctatatgttgcatcactgggccatttttacatttcttggttttttgacgtttttcattgttgtatattttatatttggctatgctttgaagcctgccgctcgtgtctcccgcactggtcgacgggtattttcatctccgttttctaagacatctccgtcccgttggaagattttccatcgtttcacttcttccaatgaaaagtatgaccaaactcgttctgattctttacctttcatgtctgattatgatttggaatcgcaaactcaaagtcacagtccc

SEQ ID NO: 25899 - DNA, 2882 bp, Schizosaccharomyces pombe
gatcatcttttaagttacaacagaagcgcttttgatcttttcaactccgagaagccattaagtcctgaaaaaatctcgactatgttacaacatcttcaaatgagattgtcgatagagcagcaatgtgtttcgggcattgaaaaaatcatgtctctttactctaaagaacagaaggataaaactgatgttattataaagttgaaagagggtaagcaaaaggtcaatctattaaaacgctctttgaagcggtataatgaactacatatcccctttgatatttctacaccttcttctgaggaaaagcaacaggctagtggtcttaattttcgaggtctagccaaacctatatctggaaccctcaaggttaccattcattctctaagaaatattgaacatacatcatttcttcaaacgcattcatttacaatgccttcatatgctgttctttacgttgatgatgcacaagttgctaagtctcggatttctcaaacagacacatgggatgagacgtttatcttcgatgtacatcgtgccaaagaatttcaaataattatttatgaaaagaagaaagactttgatattcccattgcccttattcttattccaactactatcattgctgaggaattgcgtagaaaaaggaacattcaagaaatgtcggaaactagttggaaaccatcaatagctgagtcggcttcacgttccgatgaaaaagggtcaaaatctgatcctataaatgcccctaatagctcttccagcatttctactaattccccattagcacctactgcctattataagctgttatctaagtcttggctttcattggaaccggttgggcagatatgcatttcattgtccttttcaaagcgtaccaccaaacgtcaatttccagaaactggtttgggacgtcaaggagccattcgccaaaagaaggaagatgttgttgcgtctcaagttggtcatcaatttgtacaacgccaattttaccaaattatgcggtgtgctgtatgtgcagaacttttttcgtattctcctggtttacaatgtgaaaactgcagttttgtttgtcataaaaaatgtgtcaccaaagtactggctagctgcattgctcaatcaaattctgaaaagtcggatttcggtggtcttcgatacagaatccctcatcgttttgaaccttttaattctttaggagctcaatggtgtgcccattgtggtttctttttgccattacgtcgtaaagactgtttcaaatgtgtggaatgtggtattacttgccatggacaatgtgcacacctaattcctgactattgtggcatgtctaatgatcttaaacatcaactcttaactgaacttgaagtctctaaacgtccaaagaagccagaattgcctaatcaggaaaacaaaaccaccaatgaaaaagtttatcgaaagccgttatccagtcaaaatacttttgatacattaccaacgatatctcagggcttacttgctgctactcagccagttacaagtgtacttaatacgtctccacttccaaaaacccctgagaaagatcgatctttaaatgttactccttcctcttctactcctactccagcttctgttcttgctccaccttccagtgctagcttatcgtcttccaaggatgctaatagaagtgttccagaaagtccacgcagagagaaaaagaatcgtgttacgcttgacgacttcacatttttggctgtattagggaaaggcaattttggcaaggttatgttggctgaatataaagtgaataaaaagttttatgccatcaaagttctgaaaaaagaagccattttaaagaatgaggaactagagagtttaaaaactgaaaagcatgttttcgaagtcgcgaataaagaaaaacatccgttcttgctgaatctttttgcaagctttcaaactagtaccagggtttacttcgttatggaatatattcttggtggtgaccttatggttcatattcaacgtcaacagtttagcgtgaaacgtgcaaggtagtacttcaatctttatttttatttttatttttattttttattaaccccatagattttatggtgctgaggtttgtttagcattgaagtattttcatgagaatggaattgcttaccgtgatttgaaattggataatattctactttgtcctgatggtcatatacgaattgctgattatggactctgcaaagaaaatatgttgcttggcaatacaacttccaccttttgtggtacccccgaattcatggctccagaagtaaggcggaacttgttttggtttattttatctaacgaaaatagattttattagaacagcaatattccaaggatgttgattggtgggcttttggcgttttgatgtatcaaatgttactgggtcaatcccctttcaaaggtgaagatgaagaggaaatattcgatgcgattttaagcgatgaaccgttgtttccgattaatatgccagcggatgcggtttcgttattgagaggggtatgcaaatttctaaatatgttaactaattcaaaaaatagcttttaacaagagatccaaatcaacgacttggtagtggaccaaaagacgcaaacgaggttatggctcatcctttctttgctagtattgtctgggatgacttgtataacaaactttatgaaccatcatataaaccgcttatcaacgatccccgagacctcaataattttgatgaagaatttacaagtatgacaattgttaaaatatggttaattactaacgatcgattaggtgcatgtccaactttgacacctgtcaatactgttctcacacgacaacaacaagagtgtttcagaggattttccagttttgctactgaatagaattag

SEQ ID NO: 25900 - DNA, 1102 bp, Schizosaccharomyces pombe
atgattgacctcgataacataatagagagattatatgaaaaacaattgattgctgagtccgttattgcttatctttgttctctcgcaaaggaagttttaatgcaagaaagcaatgttgtcaggttgtctactcccattaccgtggttggtgatattcatgggtatgcatagattcaatattgcaaaaagttcattctttgtggacattctgcttacaaagtatatagccaatttgatgatctacttgaaatctttcgtataggaggcccatgcccatacacaaactatctttttctcggtaagttaaaatgatgttcattagaatcacattagctgattactacaaatcattaaaactgaacattgagaacacagcacatgctttattattcgttgctaactatttgaaggtgattatgttgatcggggctattatagtatagaaactataacccttttgatatgtctcaagttacggtatccaaagaggattactcttttgcgcggaaaccatgagtccagaggaataacccaaacctatggattttattcagaatgcttaagaaaatacggtaatgctaatgtttggaaatattttaccgatatctttgatttcctaacactttctgcaacaattgatgacactattttttgtgttcatggtggactttctcctagtattcagcacatagatcaaatccttgtcttagacaggtttagagaattcccacacgagggacctatggccgatctcgtgtggtcggatccggatcctagcgtgcaagaattttcactttcgccccgtggtgcaggtttttctttcggtgaagttattgtaacaaaatttctagaatacaacaatatgaagcacatcttacgagctcatcaactatgcagcgaaggttatcaaatattgtttgaaaaaaaattatcgacagtgtggtctgccccaaattactgttacagatgtgccaacttggctagcatccttcagatcgacacagatcaatcaagattttttaatgtttttgatgcagctcctaatcaagaaacgccttttgtggagccagctgcaaaagtgacagcggaatatttcctttag

SEQ ID NO: 25901 - DNA, 2312 bp, Schizosaccharomyces pombe
atgaccgaaattttcggtaaattgcatcgatcatcaaattctgagaatacaaatcaagcatcgccatccacaatacaatcgcattcaacgcaaccggttctttccaatgaccattctacgaaagtaaacgattacgaagggaaagagggtgcttcgtctaatggctatgatcccgttttcatgtcggatcggatgaagatgcgttacaatgagattacagctcagcttcacaaagaacaggtatgttataattgattttttgcttgaaagacaatcttccccatagctttctttattgtgtttttcaaaaatcactgtctccataaattgttgttcacttggctaacctatcatagtccttaaaggaagataaagaatctggttctaatagttccgaaagcaatggaattacaccaatgggtacatattcagaaaaacccaaactactacagagtcgtacacctccatcttcgtgttacattaggcatgataccgttgtgccaaaagataaaaatggtcagcatgcttttggacggctttatgttcgattacatcaaggtagagatttgaacgtcaaaagtgttaatgcacaaccttatgcagtaatcacctttgaaaaaacgcaggttatggtacctcctccttttaaagacattgacggtgggatacccatttccattccttctaaaaaccgtcctcttgctggatctgcttccggttcttcttctggactacattctgagctaatgttggctgatgtgcgttgtcctcattgggattttgaaactgtatttgatgtgacaaaaatgaaaagtcaaatggttgtatctgtatatgacaaatatgaagacgataaatttttgggctccgttaaaattacaccaattttcctacatgaatatgtgcaggaagcatggtataagcttgagcctcttgacttaactaagtctctggagggtgaaataaaagtggaaacaatttacgagcacattgaacatgttcgttatgggccagaagattttacggcccttcgtttaatcggaaaaggtaaagctgctttaagctaaaaaatttacggtatactaactttatttaggcacttttgggcaagtttatttggtccgtaaaaacgataccaatcggatttatgctatgaaaaagatatccaaaaaattaattgttcgtaaaaaagaggttacacataccttgggcgaaaggaatatacttgtcaggacttcattagacgaatctccgtttattgttggtttaaagttttcctttcagaccgcttcagatctttatttgataactgattatatgagtggaggcgaacttttctggcatcttcaacatgaaggtcgctttcctgagcaaagagctaaattttatatagccgaacttgttttggctcttgaacatttgcataaacatgatattatttaccgagatttaaagcctgaaaacatactattagatgcagatggtcatattgctctttgcgattttggtttgtctaaggcaaacctttcagctaacgcaactactaataccttttgtggaaccaccgaatatttggcacctgaagttttacttgaggacaaggggtatactaaacaggtcgatttctggtctttaggagtccttgtctttgagatgtgctgcggatggagccccttttatgctccagacgtccaacaaatgtatcgtaatattgcctttggaaaggtccgttttccaaaaggagttctttcatcagagggtcgaagctttgttcgaggccttttaaatcgcaatccaaatcatcgtttaggagcagttgctgacactactgaattaaaagagcatcctttttttgcagacataaattgggacctacttagcaagaagaaggttcagccgccttttaaaccgaatgttcaaaatgatctggatgtttccaattttgataaagagtttaccaatactaatgtgaaaaatatcaatatagtttccaatgttgatcccgctaatgcctcgacacctctatccaacacgattcaggacagatttcgtggtttcactttgtaagtttatttttaaatatttgaccatcaactaaccttaaactttatagtgtcaataagtccattgatgaacagtttcagaacctgggactacaagaaaacgaagagacagataatttacatgcgtgtcgcacaacaacccattcatcggttaattcaataaattcacatgggaatccacgtacggtggatgctaacgatcccgtcgcagatactgtgttcggcgagacgttcgaagcttgataagct

SEQ ID NO: 25902 - DNA, 1446 bp, Schizosaccharomyces pombe
atgactgttcaaatcgatgaattggacgacaaagatttggatgagataattgcaaacggaacacttgatggcgcgtaagtgtgaatactgaacaatcttaactatggactcgattgagcctctaaaataatgaaaattctctaacaattttcttatagtaaacagggagctgtggattcagagacgatgattcaatattatcgccatctttttccgtggaaatatttatttcaatggttaaatcatggtccggtagtcactaatgattttgctcatcgggagttcgcgttcacacttcctaatgatgcttatattcgttatttatctttttcaaattgggaagagttaaaaaaggaagctttaaatttatgcccaagccgatttgaagttggacccgtttatagtgccaatcccagggacaggaaaacaataaggaagtcaacatttcatccgcttaaaaaggaactcgtttttgatatagatatgactgactacgatgatgtacgaacctgctgctcaaaaacaaatatatgcgaaaaatgctggccatttattacgatcgcagttcaagttttagatatttgttttcatgaggactttggatttaaacacatattgtgggtatactctggtcgaagaggtattcacgcttggatttgtgacgaaattgcttgttctttagacgatcggtctcgtagaatgattgccagttatttacaggttgtagtaggtaatcctcaaggtggcgtacgacttattaataacttaaaaagaccccttcacccacatttgactcgttctctcaacattctcaaatcggcctttgtaaaaattgtccttgaagaccaagatccgtgggcttctaaagaaggagccgaaaaccttttgaaattactaccagacaaggatttagcatctgctcttcgtaaaaaatgggaggttgatcctgaacgatctagcaaaaataaatggtccgacattgacactgtcttagcatctggttctattgcctctatatctccttcagtaattgcgattgccaagcaggacattgttttaacctatttgtatccaagattggatgttgaggtttctagacatttaaaccatttgctaaaatctccattttgcgtccaccccggaactagtcgtgtttgtgttcccatagatatagagaggatggattcttttaatcctttgaaagtacccactgtgaatgatcttttgcaagagttggataaaaattcccaaaatgataacggccatggtccaacaatggaaactaatacaacagaaaaccaaaaagataatgctaggggacaatcaaacaaggggcatggcttttcaacttctctcaatccttatacgctgtactttaaatcgttcagtagccagctttttaaagaaacagtaggaaataaaagaaaacatgagaatttggaattt

SEQ ID NO: 25903 - DNA, 1398 bp, Schizosaccharomyces pombe
atgccagaacaacttgtgctccgtgcaactctcgaaggtcactctggatgggttacatctctttctactgcccccgagaaccctgatattcttctttccggttctcgtgacaagtccatcattttggtatgtaaatcaaaaaaatttcagtgcggtaattgttagcaatctaataatgaagttgtgcaatatgtaaattatacagtgatagcggtagaaaaaccagacctgaaaattttacctaattagcacatcagataaaaatattgagcgctttcgattgctttcttgctttagtactagttttctaacatctatttcagtggaacttggtccgtgatgacgtgaattatggagtcgcacagagacgtttgaccggccacagccacttcgtttctgactgtgccctttccttcgatagtcactatgccttgtctgcctcttgggataagaccatccgtttgtgggatcttgagaagggtgagtgcactcaccaattcgttggccacaccagcgatgtcttatctgtctccatttctcctgacaaccgccaggttgtttctggttcccgtgacaagaccattaagatttggaacattattggtaactgcaagtacactatcaccgatggtggtcactctgactgggtttcttgtgtgcgcttctctcctaaccccgataaccttaccttcgtctctgctggttgggacaaggccgttaaggtaagtattattttagtgtattattgcaatacatagtcattagatgtttatggttattggctctgcagtttttagtcaagcaaggaatgatgtttagattaatatttgctacttcggaggccttacggctcgatgagacaaaacaaatcaccatatgttctgacttttccaattgttattttgattttggctctggctataaccatttacaaatttattcattctaattaattaatgctaactctcttcaaaggtttgggatttggaaaccttctcccttcgcacttctcactatggccatactggttacgtatctgcagtcaccatctcccctgatggatctctttgtgcttccggtggaagagacggtaccttgatgctttgggatcttaacgagtctacccacctctactctttggaagccaaggctaacattaatgcccttgttttctcccctaaccgttactggctttgtgccgccactggttcttccattcgtatcttcgatttggagactcaagagaaggttgatgaacttactgttgactttgttggtgttggcaagaagagctctgagcctgagtgtatttctcttacctggtctcctgatggccaaactttgttctctggctggactgataatctcattcgtgtctggcaagttaccaagtaaaaa

SEQ ID NO: 25904 - DNA, 930 bp, Schizosaccharomyces pombe
gatctcaacggggctctccctgaaaaaaagaaaaaaccaaaaaagtctgttgcctttgatgatgaggtagatgcagtctcaaaggatgggcctgaagcttcttcagctggtgcaaccgatgaagatgattctgaaagaaaaagtagtgctaaggatttaactacacctgttacagagggagaggttgatgaattgaaggatatgttctctagcatgaagaaaaagaagaaatcgaaaaagagttctgcttctgcagaagagcaaactgaggatatcactactgaaagcggcgagctggacttcagctcaatgaagaaaaagaagaagaagaagaagagtgcagatttatctgcttttgaaaaagaattagaggcttcttctacgggtgatgctacttcggaccttagtaagcaaacttttgattctgaaaatatgggtgaacacgcttggttaaagtcggatcgtgactactactatcctgagttactgaatcgctttttcactttattgcgtaccaacaatcccgagcttgctggtgagaaacgtaaatatacaattgttcctccttccgttcatcgtgaaggcaagaagactatctttgccaatattagtgacatctcaaaacgtatgcacagatcattggaccatgttatccaatttttgtttgcagagttgggtactagcggtagtgttgacggttcctcacgtttgatcattaaaggtcgtttccaacaaaagcaaattgaaaatgttttgcgtcgctacattgtcgaatatgttacgtgtaaaacttgcaaatcccctgatacaattcttactaaagaaaacagaattttctttatgacatgtgaggcatgtggttccgttagatctgtgcaagccatcaagactggttatcaagcacaaatcggaaaaagaaaacatgtttct

SEQ ID NO: 25905 - DNA, 1958 bp, Schizosaccharomyces pombe
atgaatcaaactgagactttgattcctgcagcccgaaacgttattcgggtgctgggatacgaaattgaatattcgaaatggacaatttgcttcgcccttttggctgtctgcattgcttatgatcaaagtatgttaaagattgagaattatttttttgtatcaactgctgcataaataccacgatgaaaagcatcattttctctcgatttaagtaattaatttatctactttcgctttgctgatgcgaacgaatctgctattcgggaactggtgacaatgtcactctgtgccaactttatcaatggagcctagtgatcaaatcattcgttttaatgataaatttactacgatctcatatttaccatggattttaattgtgatttatgagttgctaattctttattctcaatgtttatttagtctattgatatgtaccgtgtgattctaacatttttttagtctcgtatcagatgcaaaaggggcatatccctggacctagatttaagatccctttcatgggatctttcttggatagtatgaaaccaacttttgagaaatacaatgctaaatggcaaaccggacccctttcttgtgtttctgttttccacaaatttgttgttatcgcttccgaacgcgatttggcccgtaagattttaaattctccaagttatgttcaaccctgcgttgttgatgctggaaagaaaattctaaaacacacgaattgggtttttcttgatggtcgcgatcacattgagtaccgtaaaggactcaatggtttattcactacccgtgctcttgcgtcttatttaccagcccaagaagctgtttataacaaatatttcaaagaattcctcgctcatagtaaagatgactatgctcaatatatgattccattccgtgacataaatgttgctacctcttgtcgcacattttgcggttactatatctccgacgatgctattaagcacattgctgacgaatattggaagattactgctgctatggagttggttaacttccctatcgtattgccgtttaccaaagtttggtacggtattcaatcacgcaaagtcgttatgcgctactttatgaaggctgctgctgaatcccgtaagaacatggaggctggtaatgcccctgcttgcatgatggaagaatggattcatgaaatgatcgaaactcgtaaatacaaatctgaaaataaagagggggctgagaagcctagtgtccttattcgcgagttttctgatgaggaaatttcacttacgtttttgtcatttttatttgcttcccaagacgctacttctagtgctatgacttggctctttcaacttttggctgatcatcctgatgttttgcagaaggttcgtgaagaacagcttcgtattcgcaaaggagacattgatgtcccactcagcttggacttgatggaaaagatgacttatacccgtgccgttgttaaggaatgtttacgtcttcgtcctcctgtattgatggttccttatcgtgttaagaaagctttccctattactcctgactacacagtacccaaggatgccatggttattcctaccctctatggtgcacttcacgattctaaggtttatccagagccagaaacatttaatcctgaccgctgggcaccaaatggtcttgccgagcaaagtcctaagaattggatggtttttggtaatggtcctcatgtatgtttgggccagcgttatgccgttaatcatttaattgcttgcattggaaaggccagtatcatgcttgattggaaacataaaagaacccctgactctgatactcaaatgattttcgctacgacatttcctcaagatatgtgttacctcaaattttcaccttttgatgcttcaactgttgactggaaaaactccaaggaggctttttcaaatgaagcagtctctgccgcaactgtggagactgagagcgcttga

SEQ ID NO: 25906 - DNA, 1005 bp, Schizosaccharomyces pombe
atgaatttctcaaaaacattactaaaaaattcaaaagacgggatttcaagtgtaatattttcaccctctgtcaaaaacgaactaattgcagggtgctgggatggtagcttactgcattatcaaatctcggaaaatcccgaacttttagggaaatacgatttatcaagtcctattctttctttagaatatacagatgaaaaaactgctttagtaggaaatttagatgggacagttactaccctcgatcttaatacgcgaaaccatgagtttttaggaaaccacggtaagggggtatcgtgcatttctaagttgcgtttggaaagtaagatatatattttattagccagctattctattaacattttagactgtttcattagtgggtcttgggacaaatcatttcgtgtttgggatgttcgcgtaaagcaacctgtcgagggacaggatataggaaaaaaaatttttgcaagtagctcgagagataatatattggttctaggctgttcagaaagagaaaatttggtgtacgatattcgaaatttaaaacttccatttcagcgacgtccttctagttttaagtatatgactcgaagtgtttgctgtaaccaaaattttgagggattcgtttcttccagcattgagggaaggacatctgttgaatatattaacccgtctcaggaagcgcaaagcaaaaattttacctttaaatgccatcggcagatacaaaaggactacgatattgtttatccagttaacgacctaaaatttcatccgattcatcaaacattggcaactgctgggggagatggcgttgttgcgttttgggatatacaagtccgaaaacgattaagagtgttaaatccttcaaagatcaatatatcatctatttcttttaatgttgacggaagcatgcttgcaattgccacttgtgctcaagaagaagccgctggtaatatctatgttcatgctttggaatccaactttgcagctccaaagttaaagtca

SEQ ID NO: 25907 - DNA, 948 bp, Schizosaccharomyces pombe
tttctaggtgcctccgatagtggaaaaagtaccatcagtaagcaaatcaaaattctcaacaaaaatgggtttagtcaagaagagattatgacatttattccggtgatccgacgaaacctgttggaatctgctaaaacccttgttaaaattatcgttcaaaaaggtatcaacttggaccctttaggaacccacaattgcgagataatcgaaaaatttaatccaactcctggtgagcttattaatgctaatattggccaagctattactagtctttggtcagccaatagtgttagatcctgtacatatggaaatgattccgtactcattgactctgccccttactttttttcgcgagccgatgaaatttgcagtcggcattatgtccctacaatagatgacattctccggtctagaaatagtactctgggtatttcggaaatatcgttcacattggatcatttgcaaattcgaatgttcgacgttggtggtcaaagaaccgaacgaaggaaatggatttattgttttgaaaatgtgaattcaatcatattttgtgtttccttaaatgattatgataaaaagctttatgaaagagccgccccagaacgcaatcgtttggttgaaagtatttctttattcgactctattataaacagtcagtggtttatgcattcttctatcattctgtttttgaacaaatttgatttgtttcggaagaaactggaacatgttccgttccaggattacttcccccaatatgaaggtaaaaattctgttaaaagtattacccggtatattctttggttatttgtgaacccttctataaatcgggctaagcataatatatatcctcacattaccaccgctgtagacacatctaacataaaggttgtcttttctgccgttaaggaaacaattctacaacacagtctgaaagaagcgggaatgttt

SEQ ID NO: 25908 - DNA, 975 bp, Schizosaccharomyces pombe
atgtcttaccaacaacgtgcaaacgattctatgaactctgctaagcaatacagctcaagcgctggtgctgtccacaacagtgatgagcccttctcttctagtggtgcccctcaaaatcgcaactttgacacctcttacacatctgaaattcccagcaattctagtcgtgctgctaacgacatgggaacagacattggatccggggatccttatgctggaatgactagcgacactaagaagggattcaatagtgtcgagtcacgtaagaaggaacaatcagatgtccgtggaggtgatacctcttactcgagaagacacgatgattcttcttactcttctaacaagtactctacaggaggcaatgacagttattcttccggcggacgcaacgaggattactctaccagcggaggtagttacaccaccgaccctagtcgtacagatgatactgcatcttacggccaaagccaatacaaccaaagtcgtaaaaccacccaaggtggtgactacggtgaagattacagtcaaagttaccccactgatacctatggcagtcgccaaaaagcaactccttctgacacagtcggtggtggtgcctatgattattcaagctctggctcccatacccatggtggttctcatggtactgagcatcgtggaggctcctatggcaacgacaatactgctaacaagaccagaggcgctgtttcctctgctggttacagcggtgagggatatggcaaaggtacctatgctactgataccactgctgaagctaatcgccgtgccgcaactggtacccgtaatgctcgtacaactgcacaaagaaatgcacagttggccgaggatgagcatgtcagtatgggtgacaaaatgaagggtaatatggagaaaatggctggtaaattgaccagagaccctgaactcgtccagaagggtgaagatttgaagactggccatcactctgaaaggtat

SEQ ID NO: 25909 - DNA, 1224 bp, Schizosaccharomyces pombe
atgaacaccgaactggatatgcagaatttcgaacatattaagtttctagagaatcagattagtgaggatcattttcgttggaaaaaaaattcgaaacatctatacaacttactaataacccgtactttaacatggccctctttaagtatccaatggctctcagcaatggaatcgatcactgaaaaagcggttttaaaaaaccgtcttctcctagggactcatgccgctgaagggatgccaaatttcttgcagcttgcagatttagatttacctgatttcaatcaaactatattggatccagtaaaacactacaatgaagatactggtgagctaggaggctatagtatgcaacattcttgcaagttccaaatctcgcaacgaattcttcataatggcgatgtaaatcgtgttcgacacatgcctcaaaacccaaacatcatagctactatgagctcttgtggaaatgcatatatatttgatcggacaaaatatacttcaatgcccgctgaagaatttttaccaaatatctctttgattgggcacaaaaaagaagggtttggactatcttggaatcgtcagcaaaattgccgacttgtaacagctgctaatgattcgaaaattttagaatgggatctaaataattttagccgtgatacgaggtgcttaactcccgtaaaggattttcattatgatgattctccggttaatgatgttgaatatcatccgcaccacaccaacttatatattgctgtaaatgataatggaattgcctttatttgtgataaccgacttcaacaaacatgttcgaaaacagttaaagcttcaaatcccctttttagcgtcagacataatccttcaattgcgactttgtttgctttggggtctgagcaagatttacagctttgggaccttcggaacttaaataaatcggtttttaacacttctgaagacttatcagataatagattaaaagtgccttctagactaactctaggaggcaccagtttgtcatggagctggagacactctggtcggattgttagtgcctgccaagagtattgctatgtgtggaattttaacaaagctaatcctttggagtttgtgcatgcaggtcataaaggtacggtgaatgaagtggactttgatccgtttgaggcacaatgtattgcttcggttgctgatgacaatgaattacacatttggaagcccaatgttattgttaat

SEQ ID NO: 25910 - DNA, 1539 bp, Schizosaccharomyces pombe
atgaagcacaacgaagtttttggatggacactgaaggtgctttcatttcttttggtggtaatcccggccaatgcattagacaaacatggttggagaaaacaatcaatttattctttgttgacagataggtttgcttctactaatccaaaaccctgtaatccagaagatcgtgaatactgtggaggcaactggaggggaatcattgataaattagattacatacaaggtatgggtttcactgctatttggatttctcctattatcaaaaatattgaaggaaggacaaaatatggggaagcttaccacggctattggccgcaagacctatacactctcaatccacattttggtactgaacaggacttaattgatttagcagacgctttacacgatcgaggcatgtatttgatggtcgatacagtagtcaatcacatgggatcatctgatcctcggaacattgactacggcatctatagaccattcaatcaatcaagtcattatcacccaatgtgcccaattgagcaagacaaacctttgtcgctcgaacaatgttggattggtactgaagatatgacattgccggacattgatacagaaaatcctcagattattgaaacattgtacaattttatccacgatcaagtgaagcagttcaaaatcgacggcctccgtgttgacgcaactaaacacgttcgacgtactttttggccaggattttgcgaatctgctggagtctattgtcaaggagaagaatggacagggcaggcggatctgttttgcgaatggcaggagtacatggacggattgcataactttcctgtccaaggtgtagcagctgaatctgtgatcccactaaatgaccgcgctttaaggaaaactgcaatcgcaatgaatcttgttgcccatcactgcaaagatagtactctgttaggtcttttcttggagtctcaggacgcaccaagattagctgcattgaataacgattataccgtactaaaaaatgcgatgactttaaaccttatgtcggatggaattcctattgttttctacggacaagaacagatgtttaatggaagtcacgatcccgtaaaccgtcctgctctttgggatcaaggatataatacagatggtcctttatatcagtataccagtaaggtcaataaaattcgccgtgacttaattaactctgaagacggcgaaatatacattaggtccataacacatgccatcatgataggtgatcacgttatggtcatgtacaaaggtcctgtaatcacattcattaccaactatggagccgtggacaaggaatatttaattaaaatgcctggttcagaaacaatgattgatctattgacctgtacgctcattgaagtagaaggagaggtgatgagaacatctattaagaaaggggaacccaaaatattgtatccctaccaactggcctttcgcgatggattttgtcaagaacagataactttacaagagattgatgatgtttttatgggaagaaatgaaattaatgggcccgataggaag

SEQ ID NO: 25911 - DNA, 4671 bp, Schizosaccharomyces pombe
attatcaaaaagctagtagatgctgaaaaacattgcaatgccgtgaaagacgcgtcttttgatgaacggacatggatctggattcctgattcgaaggaatcattcgtgaaagcttggatagttgaagatttaggagaaaaatatagggtgaaattagaaagagatggctcggaaagaattgtggatggatttgatgctgaaaaagtaaatccaccgaagtttgatatggttgatgacatggctgcgttgacatgtctcaacgaaccatcagtagttaacaaccttactcagcgttatgagaaagatttaatatatacctattcaggcttgtttctcgttgctgtaaacccctattgtcatttaccaatttatggcgatgatgttgtgcgaaaataccaatctaaacagtttaaagaaactaaaccccatatttttggaacagctgatgccgcatatcgaagtttattagaaaggaggatcaatcaatctattttagttactggtgaatcaggagctggaaaaactgaaactactaaaaaggttattcagtacctaacatcggtcactgatgcttccacaagcgattctcaacagttggagaagaaaatccttgaaacgaatcctgtgttggaggcttttgggaatgctcagactgtccggaataacaactcatcccgctttggcaagttcatacgaattgaattttctaataatggaagcatcgttggagcgaatttagactggtaccttttggaaaaatctcgcgttatacatccttcctccaatgaacgcaattatcacgtcttttatcaactacttcgaggtgctgatggatcattgcttgaaagtcttttccttgatcgatatgttgaccattactcatatttaaaaaatggtctcaagcatattaatggagtcgatgatggcaaagaatttcaaaaattatgctttggtctcagaactttggggtttgataataacgaaattcacagtttgttcttaattatagcttcaattcttcatataggaaatattgaagtagcatctgatcgttcggggcaagctagatttccttccttaacgcaaattgatcaattatgccatttactcgaaatccctgttgatggatttgttaatgcagctttacacccaaagtccaaagctggacgagaatggattgtgacggcaagaacacgtgaacaagtagtccatacactacaatccttagccaaaggcctttatgagcgtaattttgcgcatttagtgaaacgtctgaatcagactatgtattattctcagtctgaacatgatgggttcattggggttttagatattgctgggtttgaaattttcacttttaatagttttgagcaactctgtattaattttacaaatgaaaagcttcagcaattctttaatcattacatgttcgttctggaacaagaagaatatacacaagaacgcatcgaatgggattttattgactacggaaatgatttgcagcccaccatagatgctatcgaaaaatctgagcccattggtattttttcttgcctcgacgaggattgtgttatgccaatggctactgatgctacattcacagaaaaacttcaccttctttttaagggtaaatccgatatataccgtcctaaaaagttttctagtgaaggctttgttttaaaacattatgctggtgatgtcgaatatgataccaaagattggctggagaaaaacaaagatcctctaaatgcatgtcttgccgcactaatgttcaaatctactaacagtcatgtgtcttctctttttgatgattattcgtcaaatgctagtggtcgagataacattgaaaagaaaggaatctttcgtactgtgtcgcagcgtcataggagacagctttctagtcttatgcaccaactcgaagcaactcagcctcactttgtcagatgcattattccaaacaatttgaagcagcctcacaatttggataaatctctcgttcttcatcaacttcgatgcaacggtgtactggagggtattagaattgctcaaactggatttccaaacaaactattttatacagaatttagagctcgttatgggattctttcgcagtcattaaagagaggatatgtcgaagcaaaaaaggcaacaataacgatcatcaatgaattaaaattacctagtaccgtataccgtttgggtgaaacaaaggtattttttaaagccagtgtcttgggttctttagaggatcgcagaaacgctttactgcgggtgatatttaattcattttcagctcgcattcgtgggtttttgacaagacggagactttaccggtttaatcataggcaagatgcagctatccttctacagcataacttgaggcagttgaagttattgaagccacatccttggtggaatctttttctgcatcttaaaccgttattgggaacaacccagactgatgagtatttaagaagaaaagacgcactcataaataatttacagaatcaattggaaagtaccaaggaagttgcaaacgaattaactattaccaaagaacgagtcttacaattgactaacgatttgcaagaggaacaagctctggcacatgaaaaggacattttggtagaaagagccaatagccgggttgaagttgttcatgagagactgtcaagtttggaaaatcaagtaactattgctgatgaaaaatatgagtttttgtatgcagagaagcaaagcatagaggaggaccttgccaacaaacagacagaaatttcttatctttccgatttatcatctacattggagaaaaagctgtcttcaattaagaaggacgagcaaacgatttcttctaaatataaagagcttgagaaagactatctgaatatcatggcggattatcaacatagttcgcagcatttatcaaatcttgaaaaggctattaacgaaaagaatttaaatattcgcgaattgaatgagaaactcatgagacttgatgatgagttactattaaagcaacgaagttatgatacaaaggttcaagaattaagggaagaaaacgcaagcttaaaagaccaatgtcgtacttacgaatctcaattagcaagtcttgtttccaaatactcagaaacagaaagtgaattgaataagaaggaagccgagttagttatctttcagaaggaaatcacggaatacagagatcaacttcataaagcttttcaaaatcctgagaaaactcataacattaatgatgtaaaaagtggccccttaaacagtgatgagaatatttattctacttcttcgaccacgctttcaattttgaaggatgttcaagagcttaaatcattacatacgaaagaagcaaaccagttatctgaacggattaaagagataagtgagatgcttgagcaaagtatagcgactgaagaaaagcttcgtagaaaaaattctgaactatgtgatataattgaggccttaaaataccaaattcaggatcaggaaactgaaattatctctttaaatgctgataatctggatttgaaagatacaaatggtgttttggagaagaatgctagtgatttcatagacttccaaggtataaaaagccgttatgaacataaaatttcagatttactgaatcagcttcagaaggaaaggtgtaaagttgggctattaaaacaaaaaacagaaaatcggtcagttacacaacacactttagatggaaattctccacatccatcatttgaagagaaacattcaggtgatcctctaaaacgcattgatggtaataacgatgatcgaaaaattgacaataaattattgaaaacaattagtaaaagccttgatgctttgcaactaaccgttgaagaagaacttagcaatctgtattccctctctaaggatttatcttttactgacatttcgggacacataccaaactctattaggaagcttgaaaaagggttgagtactttatcagaattaaaggaacgtctcaatgcatcaaattctgacagaccttccccggacatttttaaagatactcaagctatcatgaattctcggaagctattaagcaatcctaattctgatgctcaaagtggtttaatatcatcattgcagaaaaagctttataatcctgaatctaatatggaatttactgggctgaaacctttgtctccaagcaaaatcagcaatttaccctcttctcaacccggctcaccttcaaagagatctggcaaaatggaagcactgattagaaattttgatcaaaatagtagtattcctgatccctttatcgttaatcaacggaattccgtgcttcaaacagagtttgaaaaaatcaatttgaagttaaaggaagctacaaagtctggaatcttagataacaaagatctatcaaaattttcggaacttatacaatctttgttaaaagaaaatgaggaacttaaaaacttaactactagtaatttaggcagtgatgataaaatgcttgattttgctccattacttgaagatgttccaaataatactagaaaccaaatcaaaggttttgtggaaaaggcaatatcatcgaagcgagctattgcaaagttatattcggcaagcgaagaaaagctgttttcaacggaaaaagctttaagagagataaccaaggaaagagatcgtttg

SEQ ID NO: 25912 - DNA, 5526 bp, Schizosaccharomyces pombe
atgagaccagaagttgagcaggagcttgctcatactttattattggagttgcttgcataccagtttgcatctcctgtccgttggattgagacgcaagatgtaattctttctcctccagtatcggctgaacgtatcgtcgaaattggacctagtcctaccttagctggtatggctaagcgtaccttgaaattgaaatatgagaacatggatgccgctttaagtattaatcgtgaagttctttgctactctaaagatgctcgtgaaatctattacaactttgaggacgaggttgctgatgaacctgccgaagccccagcttcaaccagctccactccaaaggttgaaactgctgctgctgccgctcccgctgccacgccagcccctgccccagcacaaacatcagccccagctgctgctttacctgacgagcctcccaaagctcttgaggtacttcatactcttgttgcccaaaagttgaagaaaagcatcgaggaagtctcccctcaaaaatctatcaaagatttggttggcggtaagtccactttgcaaaacgaaattcttggtgatttacagaaggagttcggtgccactcccgagaagccagaggaggttccattggatgagcttggagctatcatgcagtcaagctttaacggatctcttggtaaacaatcgtcttctcttatctcacgaatgatttcctcaaaaatgcctggtggtttcaataattctgctgttcgtggttatttaggaaaccgttatggtttgggtcctggtcgtttggagtctgtgcttttgttagcgcttaccatggaacctgcatcacgtttgggctcggaagctgatgctaaagcttggcttgatagtgtagctcaaaaatatgctgctcgtaatggtgttacattatcttctcctactgctgaaggcggttcttcgtccggttctgcagctgttatcgatgaagaaacctttaagaaactcaccaagaataataccatgcttgttactcagcaattagaactatttgctcgatacctcaataaagaccttcgtgctggccaaaaggctcaagttgctgaaaaggttatttccgataccttacgcgctcaattagatttatggaacgaagaacatggtgaattttatgcatcaggaattgctcctattttttcgcctttaaaagctcgcgtttacgactccgactggaattgggctcgtcaagatgctcttaagatgttttttgacattatctttggtcgtcttaagcatgttgatactgaaatagtcgctcgttgtatttctgttatgaatagatccaaccctactttacttgaatttatgcaatatcatattgatcattgtcccgccgaaaagggtgaaacatatcaacttgctaaaaccttgggccaacagctaattgataattgcaaatccgtgatagatgctcctccagttttcaaaaatgtgaatcatccaactgctccttctacgacgattgacgaacgtggtaatttgaattatgaagaaatccctagaccaggtgttcgcaaattaactcattacgttactgagatggccaaaggtggtaaattaccaacggagtccaaaaacaaagctaaggtacaaaacgatttggctcgaatttatcgcattattaagtctcaaaacaaaatgtctcgttcgtctaagttgcagattaaacagttgtacggtcaggttttacatgccctttcccttccattgccttcttccaacgatgaacaaacgcctgttaaagaaaccattcctttccttcatattaggaagaagtccgttgatggtaattgggaattcaacaagtcattgactggcacttatttagatgttttagaatcgggtgctaagaatggtataacataccaagacaaatatgctctagtgactggtgcaggtgcaggctccattggtgctcagattgttgaaggtctccttgctggtggtgctaaagttgtagttactacatcccggttttcgcgcaaggttactgaattttatcaatccctttacacccgccatggaagccgtggttcatgtctgatcgtggttccatttaaccaaggatctaagacagacgtagaagctcttattgattatatttatgacgaaaagaagggtcttggatggaacttggactacattgttcctttcgctgccattccagaaaatggtcgtgaaattgatggcattgattctcgttccgagtttgctcaccgtattatgttgacaaacattttgagactgcttggcgccgtcaaaagtcaaaaggcctctcgtggtatggatacccgacccgctcaagttattttgcctctttctcccaatcacggtacctttggaaacgatggtttatactcggaatctaagttaggtttagaaactttgtttaaccgttggtactccgagtcatgggctaattacctaaccatttgtggggctgtcattggttggactcgtggtacaggcttaatggcacctaataatattgtttctcagggaatcgaaaaatatggtgttcgtactttttcgcagagtgagatggcttttaacattttgggtttgatgtcccagaaagtcgtcgacttgtgtcaatctgaaccaatttatgccaaccttaacggtggtcttgagcttttacctgatctcaaggacctttccactcgtttgcgtaccgaattgttagaaactgccgaaatccgccgcgctgttgccgcagagactgcctttgatcatagcattaccaacggacctgactctgaagcagttttccagaaaactgccattcagcctagggccaatcttaaatttaatttccccaaattgaaaccttatgaagccctttctcatttatctgatcttcgtggaatggttgatttagaaaaagttcctgttgttactggtttttccgaagtaggtccatggggtaactctcgtactagatgggatatggagtgttatggtgagttttcactagaaggatgtgtcgaaattgcttggattatgggattaattaaaaacttcaatggcaagggcaaagacggcaagccctattcaggttgggttgatacaaagaccggtgaacctgtggacgacaaagacgttaaagctaagtatgagaagtatatactggagcattgcggtatccgtattattgaagctgaactcttccatggatataatcctgaaaagaaagagcttttgcaagaagttgttattgatcatgacttagagccttttgaagcatccaaagaggctgctcatgagttcaagcttcgtcatggtgatcaagttgaaatttttgaaattcctgattctaccgaatggtccgtacgcttcaagcgcggtacaagtatgctaattcctaaggctttgcgctttgatcgatttgttgctggccagattccacttggttgggatcccaaacgttatggcattcctgacgatattatttctcaagttgaccctacaactttgtacgttttagtgtctactgtagaagctctggttgcatcaggtattacagatccttatgaatgctataagtatattcacgtatctgaacttggtaatacagttggttctggtattggtggtatgtctgctcttcgtggaatgtacaaggaccgctggactgataaacctgttcaaaaagatattttacaagaatcattcattaacactgccaatgcttggattaacatgcttttgctctctgcctctggtcctattaagactcctgttggtgcttgcgctaccgctgtcgaatctgttgatgcagctgtcgacttgatcacttctggtaaggccaggatatgtattagcggtggttatgacgacttttcagaagaaggttcatacgagtttgcgaacatgggtgctacatcaaatgctgctaaggaaacagaaaggggacgtactcctcaagaaatgtctcgtcctgctacttctactcgtgatggatttatggagtctcaaggtgctggtgtacagattatcatgcaagcaaagcttgctattgagatgggtgtccctatacatggtattgttggttatgtttccacagctatggataaacaaggtcgttcggttcctgcccctgggcaaggtattttgactggtgctcgtgaaatcgcgactaagacaccccttcccatagttgaccttaaattccgttctcgtcaactccaacgccgccgttctcaaattggtgaatgggccgaacgcgagtatctttatttagaagaagaacttgatgcgatgaaggttcaaaatcctgacttggatttagaggcttaccgtatagagcgtatcaacgttattaaggaggaggttgttcgacaagaaaaggaggcgctcaatacttttggaaatgaattttggaaacgtgatcctactattgctcctatccgtggtgcattagctgtttggggtcttactattgacgatttgggcgttgcatcattccatggtacctctaccaaagccaatgagaagaatgaatgcgatgtcattgacagtcagttaacacatctcggacgctctaagggtaacgctgtgtacggtgttttccagaaatatctcactggacatagcaagggtggtgctggagcttggatgctcaacggagctctccaaattcttcgctctgggtttgttccgggtaatcgtaacgccgataacattgatgagtatctagcacgattcgaccgggttatgttccctagtgaaggtatacaaactgatggcataaaggcagcatctgttactgcatttggttttggacaagttggtggacaagttatagttatccatcctgattacatttacggtgtgattgatgaggctacttataatgcttacaaagctaaaactgctgctcgttataaggcatcttatcgttacacccacgatgcgctggtttacaacaatttggtccgcgccaaggattctcctccttacaccaaagaacaagagaaagccgtttatctcaatcctttggcacgcgcttcgaagagcaaagctggcacttggactttccctgccacactgcctgctgaatccgacatttctaaaaccaacgaaactacacgtactctacaaagcctaacaacctcattgaccaactccaatgaaaatgttggcgtggatgttgaacttgtatcagcgattagcattgataatgagacctttatagaaaggaattttactgataccgagcgaaagtactgttttgcagctcctaatccccaagctagctttgccggacgttggtcagccaaagaggctgtctttaagtctttgggtatttccggtaaaggcgctgcagctccattgaaggatatcgaaattatttcttcagagtctggtgctcctgaagtagttttgcacggagaggctgcgaaggctgcaacgaccgccggtgtgaagagtgtttccgtcagtatttcccacgatgataatcaaagtgtcagtgttgctttggctcacaag

SEQ ID NO: 25913 - DNA, 816 bp, Schizosaccharomyces pombe
atgaattctatcgtatctaagtatacacaaagtactaacaatgatgacccaaaaaaaataatagaagaagaaggatttacaaatcgatttgatgtcgtaccagtgcctcaatcttctctttatttacgaaacttaacagatgaaacgaaaaacaagcattgtcttattaaaatgaatcatggtactactactttagcttttcgttaccaacatggtatcgttgtttgtgtagattcgagagcatctgccggtcctcttattgcttcacaaaccgttaaaaaagttatagagataaacccatatcttttaggtactcttgctggtggtgcagctgactgtcagttttgggagacagttctaggaatggaatgtcgtttacatcaacttagaaataaggagttaatctctgtttctgctgctagcaaaattctttcaaacattacttattcatacaagggttatggacttagcatgggtactatgcttgctggaacaggaaaaggtggtactgcactttactacatcgacagtgatggcacccgattgaaaggtgatttgttttccgttggttcaggttctacatttgcgtacggtgttttggactctggatatcgctgggacttatctaaacaagaagctctttatttagctcagcgctctattgttgctgccactcacagagatgcatactctggtggctcagtaaatctttatcacattgatgaaaatggttgggtcttccatggaaactttgatgttgatagtcttatatgggaagcaaaagataacgaaaactcctttgctcatatccctcgc

SEQ ID NO: 25914 - DNA, 1269 bp, Schizosaccharomyces pombe
atgaagagtgctacaatcattggaggcggttctcatcctgaacttttacatctcatttctaaccgacttggaattacaccttgtgatgtatctctaaaaaggtttgcaaatggcgagacaagcgttgaaattcgtgagtcagtgcgagataaggacgttttcattttgcaaagtggaagttccactgtaaatgacagcttaatggagctccttattattataagcgcttgtaaaggtggatctgctaaaagaatcacagctgtcatgccttactttccttattccaaacaatctaaaatgcggaagtatcgagatgccattacagctagaatggtagccaatttattaaccgttgctggtgttgatcatataattactcttgatttgcatgcttctcaaatgcagggattcttcactcgcccagtcgacaatctatatgcagagcctaacatagctgaatggattcgtagaaacgtcgatgattgggaagaagcggtagtagtttcgaagaatcctggtggtgccaaaagagttaccagtttggcggatactttgaatttggactttgcattgattaacactgatagacaacgaagttctcatttttcccaaaattttgaagattccattatggatgaaacagaagcaactgaaacacatgttactaattgttctgtatatttggatcgtcctcgtatccatactgctaagtaccttttgggacatattatcgatgacgaagaaattataactaccccagctagtgtttgttcagaagattatgctcaagaagttaatttgtattctcagggaggatgtcccagtgatgatgatgaagaggaaaacattatgtctgcgtccatttatgctgaacgtatgatcacccttgtcggcgatgtgaacggtaaaaccgccttattaattgacgatacaattgaaaatccaacagctttcattgtcgcttccgaacatttggttaagcgatgtggagctaaaagagttatagtgattggtacccatggaatttttcaaaataaatgtttaaaagatttgcaatcttgtgaatacattgaacaggtaatgtcaaatatcacggaaagctgactaacgtaacaatagattgttgtcaccaatacgtatcctatcaaaccacaagcagtcctggaatgtgacaaacttactgttattgatattagtggggtacttgcagaggctattcgccgtacccataacggtgaaagtattagcttcttgtttaagaaagcgttc

SEQ ID NO: 25915 - DNA, 440 bp, Schizosaccharomyces pombe
ctaacttatttagcttacgttgatacttctttgctcggtactggaaaaatcgatcgcgctgctatcgtctctcgtgctggtgacagtgtttgggctgcttctgctggattcaatctttctcctcaggaaatccaaggccttgccgctggtttccaagatccacctagtatgtttggcactggtatcattttagccggtcaaaaatacatcactattcgagctgaaggacgttctatctatggtaaattacagaaagagggcattatttgtgtagctactaagctttgcattttggtttctcactaccctgaaacaacccttccaggagaagccgccaagattactggtaagtttttctcagtttactattcttaattagcacaattattaacaacgcaatagaggctttagctgattatcttgttggtgttgggtattag

SEQ ID NO: 25916 - DNA, 1365 bp, Schizosaccharomyces pombe
atggaggctaattttcaacaagctgttaaaaagttagtcaatgactttgaataccctaccgagtccttgagagaggccgttaaggagtttgacgaattacgtcaaaagggtttacaaaagaatggtgaggtgcttgctatggctcctgcctttatctctacccttcccaccggcgctgaaactggtgacttcttggcccttgactttggtggtaccaacttgcgtgtttgttggatccaacttctcggtgacggcaagtatgagatgaagcacagcaagtccgtcttgccccgtgaatgcgttcgtaacgagtctgttaagcccatcattgactttatgagtgaccatgttgagcttttcatcaaggagcacttcccttccaagtttggctgccctgaggaggaataccttcctatgggtttcaccttttcttatcccgccaaccaagtttccatcaccgagagctacttgcttcgttggaccaagggtcttaacattcctgaggccatcaacaaggactttgcccaatttttgactgaaggtttcaaggctcgtaaccttcctattagaatcgaggctgtcatcaacgataccgtcggtactctcgttacccgtgcttatacttcaaaggagagcgacacctttatgggtatcattttcggaaccggtaccaacggtgcttacgtcgagcaaatgaaccaaattcccaagcttgctggcaagtgtactggtgatcatatgcttatcaacatggaatggggagcaactgatttctcttgccttcactccactcgttatgatttacttcttgatcatgatactcccaatgctggtcgtcaaatctttgagaagcgcgttggtggtatgtatctcggtgagcttttccgccgtgccttattccacttgatcaaggtttacaacttcaacgaaggtattttccctccttccattactgatgcttggtctttggaaacttctgttctttccagaatgatggttgaacgttctgctgagaatgttcgtaacgttcttagtacattcaagttccgtttccgcagcgacgaagaggctttgtacctttgggatgctgctcatgcaattggccgtcgtgctgctcgtatgtctgccgttcccattgcttctttgtatctttctaccggccgcgctggtaagaagagtgatgttggtgttgatggttctttagtcgaacactatcctcactttgttgacatgctccgtgaagccttgcgtgagcttatcggtgataacgaaaaattgatttccattggtattgccaaggatggcagtggtattggtgccgctctttgcgccctccaagctgttaaggaaaagaaaggcttggcc

SEQ ID NO: 25917 - DNA, 522 bp, Schizosaccharomyces pombe
atgacgtctcaacttgaaaaagaagcaagagaatggatcgaagaaactttgcatacgaaattgaatgctcagttagacttactggatcaattacaatccggggtgattctttgcagaatttgcaaagaagctttaggcgctaacattcgatacaaagaatctaacatgccttttgtccaaatggaaaacatatctgccttcattaactatgcacagcaagttgtacatgttccttcacaagatatgtttcaaacttctgatttatttgagcggagaaatgatgaacaggttttaagaagtattcactccttttcgcgctatgccgcgaaaatgtttcccggcaaagttcgtggtttgggtcctaaattggcagagaagaagcctcgtgttttctcagcacagcagcagcgtgagtttcgagaaggcgtaaatagtcttcagtatggaagctttgatatgccgacacagggaaccgagaagattgcattttctagacgcagggacccgaccggaaatatgtat

SEQ ID NO: 25918 - DNA, 1281 bp, Schizosaccharomyces pombe
tatgttgaacaagctgccctcgaagcgcatgatggagtctctactggaaagtatactattggcctcggcttgactaagatggcttttgtcgacgatcgtgaagacatttattcctttggtcttaccgctctttctcaacttatcaagagataccaaattgatataagcaagattggtcgtttggaagttggaactgagactatcatcgataaatctaagtctgtcaaaagtgttttaatgcaactttttggggataaccacaatgtcgaaggtattgattgtgttaatgcctgttatggtggcgtgaacgctctttttaacacaatcgattggattgagtcttctgcttgggatggccgtgatggtatagttgtcgctggtgatattgctctctatgccaagggcaatgctcgtcctaccggtggtgctggttgtgtcgcccttttggttggtcctaatgcccctattgtttttgaacctggtctacgtggtacttacatgcaacatgcttacgatttttacaaacccgatttgacgagtgaatacccttacgttgatggccatttttctcttgaatgttatgttaaagctcttgatggagcatatgctaattacaatgttcgtgatgttgctaagaatggaaaaagtcaaggacttggattggatcgttttgattattgcattttccacgctcctacttgcaaacaagtccaaaaagcatatgcgcgtttattgtacaccgatagcgctgctgaaccatctaatcccgagttggaaggtgtccgtgaacttcttagcaccctggatgctaagaaatcccttaccgacaaggctttagaaaaaggtcttatggccataactaaagagcgttttaacaaacgagtttcccctagtgtctatgcccctaccaactgtggtaatatgtacactgccagtattttctcttgtttaactgcattacttagccgtgtccccgctgatgaacttaaaggaaaacgcgtcggtgcttactcttatggttctggtttggctgcctcgtttttttcattcgttgtcaaaggcgacgtctctgaaattgccaagaaaactaacttggttaacgatttggataatcgtcattgtttaacccctacgcagtatgaagaggctattgagctacgccatcaagcacacttgaaaaagaattttactcccaaaggaagcatcgaacgtcttcgttcaggtacttactaccttactggtattgatgacatgttccgccgtagctattcggtgaagcct

SEQ ID NO: 25919 - DNA, 1218 bp, Schizosaccharomyces pombe
atgtcttcagttgagacaagaaattcttttaatccttttcgggtattatttgatcttggttcctatggctggttacatccttcaaggctccttctgttggaaattccttttgtctttgctattatttccaaagttccctacacggagatagactggattgcttacatggagcaggtgaattcatttctattaggagaaagagattataaatctcttgtcggatgtacaggccctctggtctaccctggagggcacgtatttttgtacacccttttgtactaccttactgatggagggaccaacattgtaagggcgcaatacatttttgcctttgtatactggattacaacggctattgtagggtatttgtttaaaattgtccgcgctcctttttatatatatgttttgcttatactttcaaaacgtctacacagtatatttatcttacgtttatttaacgatggattcaacagtttattctcttccctttttattttgtcttcatgcaaaaaaaagtgggttagagcttcaattctactaagtgtcgcttgttctgtcaagatgtcctccttgctttatgtcccagcttatttagttcttttgctccaaatcttggggcccaaaaagacctggatgcatatttttgttattataattgtacaaattttattttctattcccttccttgcctatttttggtcgtattggactcaagcctttgattttggcagagcattcgattataagtggacagtaaactggagattcattccacgcagcatttttgagtctacatcattttccacatcaatactttttcttcatgttgctttgctagttgcatttacctgcaaacactggaataaactgagcagagcaacaccatttgcaatggtaaactccatgctgaccttgaagcctttaccaaaactccaactcgcaactcctaattttatctttactgcattagcaacatccaatttgattggtatattatgtgcaagatccctgcattatcaattttatgcatggtttgcttggtattcaccatatctatgctatcaagctagttttcctgctccgatagtaattggcttatggatgttacaagaatacgcatggaatgtttttcctagtactaaactatcttcattaatcgctgtatgcgtgccgcttattactattttgaagctatacacatccgactacagaaaaccc

SEQ ID NO: 25920 - DNA, 5562 bp, Schizosaccharomyces pombe
atgtcatcaagctcaaactcagatccaagctctagccctgataataccgatttcattccccttaaagataatcctaaagatacctcttcctacataaataaaaaaaatccattcgtaaacgattcttttgattcccatgatgattcctatttggataatgttaacccatttgagtataatgttgcagatgatgaagatacgatttccatgaccagcgacggtgtcgaatttcataaccttggcataaccgaaactgttgatgagcaggacaaaatcttgtctgaacttcaattggcctatcctactgtttctaggtactcagaaacactagataaaggtcttctgaatggagataaaactaccaagggagattacaccagtctaaggagatttagaaaacctttcttgtttgataaactatctccttattttactcattttttttccgaaatttacgctgcggttttgagagttgttggccctccaagagctaatgaaacacccggaagaaacttgccattttccccaattctccgccaaatttataatcaccctttatacaatatctttatttttgttgtaattgtgctacatgcggttttactaatgattcgttctgatgaccctcatgataagtctcaaactatcgattatttaattattgtaatcggtatcttatatacgttagagatgttgctcaaaatctatttatttggttttttatatgatggttcctcttcattttatgatttcataaactcgtataccaagaaaactcccagaacaatgtcttatttgcgacattcatggaatcgtgtcgattttgtggctattgttgctttatggatctctgtaattggtaaaaaacagcaaggtatttttcggctttttagtatgattgcttgtttgcgcctaactcggctgttgaatataactcgaaaaactgaaaccatcctaaaaagtttaaaagagtcgtctacacctttagtacaagtcgtctcgtttaatgctttctttggggtaatgatagctatattgggtgttcaattttttaaggcatcactgaatcgtcaatgcgtatggcttggtgattacggggaccagtatttacctactggtcaattttgtggtggtcattgggagaatggtataaaaagggcttacttagataaaaatggatttccatccaacgtgaaccccagaggttttatctgtgctgaaaaaagtgtttgtcgcgtggtggaaaacccctacagtaacactgttagctttgacaattttttcaattctttggaattgatatttgttataatgagttccaatgggttcacggatattatgtacgatatcatggatgcagaatattttgtttcttgtctccttttcataatatctgcatattttcttacactctggctcatgtcccttgtgattgcagtggtaacgagttcttttattgacttgcagcattccggaaagaatcaaaaagaacaaaaatctgttgataaacatctcattcgaaataagttatgtgagaagtacctattttactcgaactttatttggataagttttatagtagcccagtttgtaactctttgtactcaaacatatgatcaaacttctagcactgcaaataggtacctaatcttttacgcttgtgtggactttctactggctgcagaagtgattcttagattttttgcatacttgccagattataggcttttttttcgacggtatacaaatttggttgatattgtcttggccgttttgaatttggttactttattaccgagtattagaaaaaatcctgtagcttttggttggttgtcaatatttgctattgctaggatataccgatgcattcttttgattccctatacacggaaaattgctaaactcttgttctcaaattttaaacaactgctaaatttgatgctatttttggtaatcgtcttattcattgcatctttgtgcgctgtcaggttgtttcaagatttgcccaatgacggagattcagacgatgatgcgattagcttcgctactacttacgaatcgtttttatacatgtaccagattttgacaagtgagaattggacggatgtgatgtttgcaatccaagctcgattagcacatcttcacttatcgtggattcctggagctttttttactctttggtttctcttttcaaacaacgtggttttaagtatgtttattgctgtcattcaggtaaactttgcaccttcagaatctgatctaaaaatggaacaattgaaaatgtacttagctaggttattaaggaactataatccttttcaagcttcccttactttgaatgccttaattaaaaggaatggatctcgaaaagggaagacagtggatgaatctcattatgagtggttatatgaagacaatattattaaaggctttttgcgtgttactaatattcctcctaaagagccacttaaaccgagtttggatacctcacccgagttatctaaatattcactggcaaagctgtcaaataactttaagagatttgttatgcgtgatgaccctttttctcaagcatacttcaaacgtgttatcggtatacgctgggaaaaggatatgaatctcaagactgcagcgaaagatatgcaagctgctaaagcatttgtccgaattaagcagaccgaatttttaaagaatcacccaaagtataatgatgtgttttgggtcattaaaccgtcgaatagaattaggaggttttgtcaacgactggtaatgcccggtgtgaatgaacgatatggcggtgttgagccatatcaatgggtttaccgtgtaatacaagtttttatttatgcttgtattctaactgcagtgattattgaatgcattgctacacctatttatgagcgagaccatttattgaatgataaacaacatgcatggtttgtatggacagaggtagcttttgcaactatttttacaattgaagccgctataaaaataatagctgatggattttgtattacaccaaatgcataccttcgaagtacttggaattgcatcgactttttcgttttggttaccttatggatcaatctttatgcagtattaacaagccatgccttgctttcccgagcctttcgagcattcaaagcgcttcgtgtgcttcgattaatcaatcttacacaaacttcacagcggatgtttcatgacgccctaattagtggtttttttaaaatattttctgccgccgttgtgtcggcaacgttgctaattccttttgctctgtgggctaaaaacgtttttggtggattattatacagttgtaatgatgacaacgttttatcagcttctcagtgtgttttagaatacgcatccactcctaataattgggaggtttgggcaccaagagtctggtccaatccccctgattacgattttgatagatttcctcatgctctactcgctttgttcgaaatcgcctcaattgaaggatgggtagacattatgcgttcggtaatggacattactggattcaataatcaaccccagaccaatgcctcttctggtaatgctatgttctttgtgttgttcaaccttgtttcaatgatttatatattgactctttttattgccatcatcatcagcaattatgctgaacgtacagggtcggctttctttactgcggaacagcgcgcgtggttggaactgcgcaggaagataaaatcaatgcgtccgtcgaaaaggccggccattagacctctgggtttaagaggactttgttacgactttgcagtgcaaaaacatggcatatggagaaggacatttactgggttgtatattgtgcatctcttgttccttctaaccattttttatccttgtcctatagcgtacacttatgttcgaaactctatatttctaatactgtcaatatgttatacgataaacatatgtgtcaaagtttacggtctttcattctactatttttttcacagtttttggaatatgtttgatgtcgttgtaacattaggaagtctcacttgcaatattgctatccttgcaaagtttgaaaataggtcgttaacactcctgcaaactactttattggtgttagttactgtgcatctaattccgaagtttgacaattttgatcagctttctaaaactgtggttgcaagcttaccttctattttttcattgattgcgacatggattgttttatacattacctttgctatagcgtttaatcagattttcgggttgaccaagcttgggttgaatggagggcctaacaaaaactttaggtcaatacgcaatgctcttgttttgctttttacgatgacctttggagaaggctggaacgatgtaatgcatgattatactatatcatatcctaattgtgtgaatggtgacgatttctacaattcagactgcggtaacaaaccgtgggcttatggattgtttattgcttggaatattatctcaatgtacatttttgttaatatgtttattactgttgttttcgacaacttttcctacatccatactaaatcttcctcgtttacaaatttgcagcgtaacgatttccgacaatttaaggattcatgggcaccttttgaccccatggtcaccggttatattcccaaacgcaatgctgtaaaatttgttctttcgctaaggggtgtctatgatttcagaatatatcgagatgaacatacattgagaagcattatctccaaagttcagagtaaaactgggcagcaatctgtcccaatgctcgaaaatcccttgatgggttctgaaataaacttagaggcgctagaccaaattattgatactattgatgtaaacgtagtgaaagagcgaagaaacgtactgaattctctctgtacagagattatgacactaccgggcaacgtcatttctttttcgaatatattgatgttagttgtacttcataaaattgttgatcatcgtgaagcatttcctatttctgactacattcgccgagcgtacgtactttcggaattggaaaaatctattagaatggaaaagttgttgggtttggttgaaacttcaatcatcagaaaaacattccttcaacatatggaagaaaagaagaaagctttagaaaatcctttcatacttttgagtgaagtttctgagattttacccgaaacacccattcaagaagtccttcgccaacataatgctgatccagagcaacttttaatgtcaactagaacaccttcagttagtgatcgcagtttctccatcgttgaatcgactgtaccgacaatcgcttcgggtgaaggtgatgataaccatagcgtggaagatcatttgaaggtaccaactgataatgaacctcgaagatcaccttctctcaaagaagtccttcttcgtggatctcattctttacattcaaataacgaccgaacttcatttgacatcgaagcaggatttggaactgctgaaagcgatttccaatttggcggagcgacagaagatatcaatcgcatagctgaccgtatagatgattatttagatcgggattcatttaaagga

SEQ ID NO: 25921 - DNA, 1244 bp, Schizosaccharomyces pombe
atgccgagtattgactgcaagcgacttcaaaagttagcgcccaaatcaccagaaaaccaatcgaaatgtatctctaggcttcgttacatggtcatgcttgatcaagttgagtcggatgaaggtgggaattcaagcaccaggccatatgtttgggcagttcttttgaatgcccccccacggaacgctgacgaatacatacgatatgttcgccaaggaccgtctcctatggcacaaaagattcaaaatgatgtttcaagaaccctggtcgtagaatctcagtttcattctcgtgtgtctcaatcgtctctttcacgtttattaaatgcttatgtctggaaacgaggtgctttatatgttcaaggtatgaatgtgttagcatcaccttttttgtatgcttgtaaaagcgaaaaccaagcttttcagttctttgaccgtctgctacaaaatgaatgccctctatatgtcctcccaaacattgatggtgttcatcgcggcgcaaaggtaagtaactgtttatttattgttttaatgctcctatttattaatctattattgtcaatttactaactcaattacagttattggataaatgccttgaagtccttgaccatcgtttgtacacgtatcttttatccaaagggcttaccgcaaaaatttacgctttaccatgtaagtgaatagcgaatttatttgtcgttttgtgaaaagaattaataggtattaactttacttttcacatatagctatacttactttgagtgcttgtactgccccattatccgaagctcttaccatatgggattttttgtttgcttatggaatacaccttaatatcctatgtgtgattgcacaaatgtttattttccgagagcagctcatcgatcatccaaggtaagtattttctcatcaccctttcattataatgaaggatttacaaaagaggagaaaattatggaacaattttttttttttttttttttttaaactttactttcatttgggttcatcatatgtctcttctttctcatcctttctcaaattaaaaaaaataaataaataacgcatgctaacgataaagccccatgaccctattacgaacgtttcctcctttaaatgcaaaaaatataatgaaaattaccattctccttatttcgaaattaccgccagaactgtataacttgttagctcgccatgcgtgggattctgaagctggtgttctgattgaccgactaacataatactag

SEQ ID NO: 25922 - DNA, 1104 bp, Schizosaccharomyces pombe
atggcatcaaatacagctccaaagaatgtcgttacaatcaatcagaagcttgttcttcttggtgattccgccgttggcaaagtaggtcattcattcaagaactaattttatatattttgtcgttttagagctaattgtttataataatttagagtagtctcgttcttcgattcgttaaagatcaatttgatggtaagaatttacttatgaggcttttaatttttcatgcaatagaaaactgacatttttcctctaaacagattacagagaaagcaccattggaggtatgcaagcacaataatgggaaaggtttctctccttttaatcgtatcattttttctgactttcaaacttgttcagctgcttttttgactcaaacccttcctatagatgaaaacacttccgtaaaactcgaaatttggtatgcaagtttaatgcagcaaaatttattaatttgttttatttttcaactaactaaattttagggatacggctggtcaggaacgttataaatctctagctcctatgtactgtatgttgtagatgtgccgctttatttattaacttggttagatcgaaatgctaattgcgctattgtcgtatacgatattactcaagctgtaagtaaaacctccatcatacgatatggaaataagattatgttcgacgttttcttgttcggtttttaacaatatttaggcatctctagaaaaggccaaatcttggattaaggaacttcagcgtcaagctccagagggtattgttatagctttggccggcaacaagctggatcttgcccaagaacgtagagctgttgagaaagctgtaagtttttttttaagttatatacgtcttgtaggtgtattaacttttctctaggatgctgaagcatatgccgctgaggctaatcttttattctttgaaacttctgctaagactgctgaaaatgtaaatgagctttttactgctattgccaaaaagcttcccttagaagataagctcaaccaggccagaggcgctgtgaatcgtggtgtcaatttgtcagaagctcggcctgctgctcaaccaagcggttcatgctcttgctaatttttcatgtttacc

SEQ ID NO: 25923 - DNA, 1519 bp, Schizosaccharomyces pombe
atgtcaactacttcgtctcactccaacgtcgttggtgttcattaccgcgttggtaaaaagattggagaaggatcttttggcatgttatttcaaggtgtaaatttaatcaataatcagccaattgccctaaaatttgtatgtaattatttttagagagcaatccagattctcaatttcagtactaacgttgcattctcacaggagtccagaaaaagcgaggttcctcaacttcgtgatgaataccttacttataagctactaatgggtttgcgtaagtattcactatggttgctatactgattttcgtcaatttcctaacatttatccctagctggaattccgagcgtgtattattacggtcaagaaggcatgtacaaccttttggtcatggatcttctaggacctagtttagaggacctttttgattattgtggcagacgttttagtcctaaaaccgttgccatgattgcaaaacaaatggtaagtttgtaaacgtctatccgattgttgtcggattggctttatgtgattacattttaacagggttaatcagatcacccgtattcaatctgttcatgagagacattttatttatcgtgacattaaaccagataattttttaatcgggttccctggaagcaaaaccgaaaacgttatctatgccgtcgattttggcatggctaagcaatatcgagatccaaaaactcatgttcatagaccgtataatgaacataagagtctatctggtactgcacgttatatgtctatcaacacacatcttggtcgtgagcaatcacgaagagatgatttagaatccatgggacacgttttcatgtatttccttcgaggtagtcttccctggcaagggttgaaagctgctacaaataagcaaaaatacgaaaaaattggtgaaaagaaacaagtcactcctttgaaagagctatgcgaaggatatccaaaggaatttttacagtacatgatttatgctcggaatttgggttacgaagaagctccagattatgactacctacgaagtctgttcgacagtttactgcttcgcatcaatgaaactgatgacggaaagtatgattggactctcctaaataacggaaaaggatggcaatacagtgcagctaagcaacatgtcgtccaacgtcgacatactcagggtactaataacaggcggcagtcaactattcctccatatgctcgtactcgccagaatttgctctctagcccaagtaagcaaactccagtcaataacgtggttgatgccagtgttgcgacgcagaaagatggtataccagggaaagcggcttctccccaagttcaacaacaacagcaaacttcttccgctcaacagcagcaaccgcaacgggtggagcaacctgctcctcagactacccagcctacacaggtagacactcaacaagctgctaagcctgcgccctcgaaagagaaatcacgaaagaagttccatcttcgcttactgtcttgctgcatatcgaaacaagaatag

SEQ ID NO: 25924 - DNA, 987 bp, Schizosaccharomyces pombe
atgcctgttgatatcagttctcttttgcatgctgggtattcaaacccgttgcttcgtgaatggcaaggtgtacgtcccattaccaagtcatctctaatgtatcctatcttcatttccgaaatagatgatgctaaggaagccattgatagcatgcctaatcaatttagatggggtgttaatagattggaagagtttttgggtcctctcgtcaaaaaaggtcttcgtagtgtaattctgtttggtgtcatcgagtccaaaaaggactattgtggtagcatggccgattccgaaaatggaccagttattaaagccgttaaagaaattcgtcacctttttccggagctggttgttgcttgtgatgtttgtctctgcgagtatactgatcacggccactgtggtctgttatatgaagatggcactatcaataatgctaaatccgttgagagaattgctgaagttagtggaaattatgccttggcaggcgctcaaataatttctcctagtgactgcatggacggtcgtgttaaggcgattaagcagaaacttgtagagttggaactgtctcataaagtatgcgttatttcctattctgcaaagttcgcttctggtttttttggtcctttcagagctgctgctaatggtgccccaaaatttggtgatcgcagctgttatcaacttccctgtaatgcacgtggcttggccaaaagagcaattcttcgcgatgttagagagggtgctgatggtattatggtaaaaccgggaacaccttatctcgatattttggcaatggcttctaagctagcagatgaccttcctattgctacttatcaagtttcaggcgaattcgccattattcatgctgctgctgccgctggcgtatttgaattaaaaagacatgtgatggaaaccatggatggctttatgcgtgctggcgctaacatagttttgacttactttactcctgaattattggaatggctagaatat

SEQ ID NO: 25925 - DNA, 384 bp, Schizosaccharomyces pombe
atgcagatttttgtcaagactttgactggtaaaactataaccctagaggtggaatcctctgacactattgacaatgtcaagagtaagattcaggacaaggaaggaattcctcctgatcaacaacgattgatttttgccggaaagcagttggaggatggtcgtactctttctgattacaatatccaaaaagagtccactcttcacttggttctccgtcttcgtggtggtatcattgagccctctttgaaggcattggcttccaagtacaactgtgagaagcaaatctgccgtaaatgctatgctcgtcttcctcctcgtgccactaactgccgtaagaagaaatgtggtcataccaaccaactccgtcctaagaagaagcttaag

SEQ ID NO: 25926 - DNA, 2898 bp, Schizosaccharomyces pombe
atggagggcatcctggcattcgatcgcgaattagacgttgcccttttggatcgtgttgtccaaaccttttaccaaggtgtcggtgcagagcaacaacaggctcaacaagtcctgacccaatttcaggcacatccagatgcatggtcgcaggcttactccatcttggaaaaatcagaatatccccaaactaaatatatcgctctttccgtccttgacaagcttatcaccactcgttggaaaatgcttcccaaggagcagcgattgggaattcgcaattatattgttgctgttatgataaagaactcgtcagacgaaactgtcctgcaacaacaaaaaacttttcttaataaattggacctcactctcgttcagattcttaaacaagaatggcctcataattggcccaacttcatcccggaaattgtccaagccagtaaaacaaacctttcactttgtgaaaataacatgatagtccttcgtcttctgagtgaagaaatttttgattactcagctgagcaaatgactcagctcaaaaccaaaaatttaaaaaaccaaatgtgtggcgaattcgccgagatttttcaactatgctcacaaattctcgaacgtgcgcaaaaacctagcctaatcaaggctaccttgggaacacttctccgatttttgaattggataccccttggctatatatttgaaacaaacattgttgagttaattacaaatcgattcctaaatgttcctgattttagaaacgttaccattgaatgtcttaccgaaatagctagtcttacttctcaacctcagtacaacgataaatttgttacaatgtttaaccttgtgatgacctctgttaattctatgcttcctttacaaactgattttcgtgaggcttatgaagaaagtagcacaaacgagcaagactttatccaaaatttggctctcttcctttgcgctttctttagctctcatcttcgaccattagaaaatcctgaaaatcaagaagtccttcttaatgctcattcctaccttcttaatatctcgcgaattaacgagcgagaaattttcaagatctgcctggaatattggtcaaaattagtagctcagctttatgaagaaatgcagcaaatccccatgtctgaaatgaatccattacttaatctttctagtcctacatctctcatttcttctaatcctaatatgttagccaatcttcctttaaggaaacatatctataaagatatactttcaactcttcgattggttatgattgaaaacatggtcaagcccgaagaagtcctcatcgtcgaaaatgacgaaggtgaaattgttcgtgaatttgttaaagagacggatacaattaccctttataaatctatgcgtgaggttcttgtgtacctcactcacttggacgtggttgatactgaaatcgttatgactgaaaaacttgcacgtattgttgttggtacagaatggtcttggcaaaatttgaatactctttgttgggcaatcggctcaatatccggtgctatgaatgaagaaatggaaaagcgctttcttgttaacgtgattaaagatttattgggcctttgtgaaatgaaacgtggcaaagataataaggctgttgttgcctctaacattatgtacgttgtaggtcaatatcctcgctttttaaaagctcattggaaatttctcaagaccgtcgtcaataagctatttgagtttatgcacgaatatcatgaaggtgttcaggatatggcttgtgatacattcattaagattgctcaaaaatgtcgtcgccattttgttgctcaacaactgggagaaacggagccgtttatcaacgaaattattcgtaacttggccaagacgactgaagatttaactcctcaacagactcatactttttatgaggcgtgcggttatatgatttctgctcaacctcaaaaacatcttcaagaacgtctcatttttgaccttatggcgttacccaatcaggcctgggaaaatattgtcgctcaggctgcacaaaacgctcaagttttaggggaccctcagaccgttaaaatattagcaaatgttctaaagacaaacgttgctgcatgtacttctattggttccggtttctatcctcaaattgctaaaaattatgtagatatgcttggtctttacaaggctgttagcggtttaatatcagaagtggttgctgcccaaggaaatattgctaccaaaactccccacgtcaggggattacgaactatcaaaaaagaaattttgaaattagtagatgcttatataagtcgagcggaagatttggagttggtcggaaatactctcattcctgcgcttttcgaagcagtgttgcttgattatttacaaaatgttcctgacgctcgtgatgccgaagttcttaatttgataaccaccattgtcaatcaacttagcgaactccttactgataagattcctcttgttcttgatgctgtttttggatgcacccttgaaatgattagtaaagatttttcggaataccccgaacatcgtgcagcattttttcaacttttacgcgccattaacttgaattgtttccccgctttgctcaacatcccggcaccacaattcaaactagtgatcaatagtattgtatggtcctttaagcatgttagtcgcgacattcaagaaaccggacttaacatcttacttgaacttattaataacatggcgagtatgggacctgatgtttcaaatgcatttttccaaacttattatattagcttactacaagatatattgtatgttttgactgactctgatcacaaatctggctttaagcttcaaagcttaattttggctcggcttttctatctggttgaatcaaaccagattactgtacctctctacgat

SEQ ID NO: 25927 - DNA, 2034 bp, Schizosaccharomyces pombe
atcagttataacgaagatctagctcatttgcttctgagtcagccgacagatattctacctctgtttgagtctgctgtcactacagttgctaaacgcctactttatagaagtcaagaaaatgcttctacgaatatccccacttgccaggtaactctacgttacgatgctaacatccttccaatccgtaacctgacagcttctcatatctcaaaactggttagagtgcctggtatcatcatcggtgcttcaacactttcctgccgtgcaactgctttgcacttagtatgcagaaattgtagggctaccaggattttacagatttctggtggattttcaggtgttcagcttcctagagtttgtgaagctcctgttctcgatggtgaaaaaaaagactgcccgatggatcctttcattattgatcattcaaaatcgacttttatcgatcagcaggtgcttaaactacaggaagctcctgatatggttcctgtcggtgagttgcctcgtcatatattattgaatgctgatcgctatttaactaaccaaattactccgggaacccgctgcgttattactggcattttttctatttttcaaaataagtctgttaaagctagtggtgccgtggccattcggaacccttatatcagagtcgtgggtattcaaatggattcaaatgatggctctaaatctactcctttatttagtgaagaggaagaagaggagttccttgaaatttctcgtactccgaatttgtacgatattatatccaacagcatatctcccgctatttatggtaatgtagacatcaagaaagctattgcatgcctacttttttcaggttctaaaaaaattctccccgatggtatgcgccttcgtggtgacattaatgttttacttcttggtgatcctggtactgcgaaatctcaatttttgaaattcgttgagcgactggcccccatcgctgtttatacttccggtaaaggttcaagtgctgctggtttgactgcttctattcaaagagactcagttaccagagaattttaccttgaaggtggcgcaatggttcttgctgatggtggcattgtctgtattgatgaatttgataaaatgagggatgaagatcgtgttgctattcacgaagcaatggagcaacaaactatttcaatagctaaagccggtatcactactatattgaattctaggacatccgttttagctgctgctaatccaatttttggccgatacgatgatatgaagacaccaggtgaaaacattgattttcaatctacgattctttcaagattcgacatgatatttattgttaaggatgaacatgatgaaacaaaggatcgaaatattgcccgtcacgttattaatcttcataccaatttacaagaatctagtgagactttagcaattggagaaattccttttgataagtttcggcggtacataaactattgtagacagtaagtataccaaatttaatattagttactaatggatttagcaaatgtgcacctaatcttgatgcagaggcagctgaaaagctatctagtcaatttgtcgcaattcgaaaacgtgttcatcagtcagagcaggacagtaactcgcgttctaccattccaatcactgttcgtcaattagaggcaatcatacgaattactgaatcccttgcaaaaatgtcattatcacctattgcttctgaagctcacgctactgaagcgattcgactgtttttgaccagtacacttgctgctgctacacaaagttcgcctgaagttactgaggaagtaaaaaaaattgaagccagcttaagaaaaaggttacctatagggtttcaggcgagttaccgtatgcttatacgagaatacgtaaatggggtatgtttattgattaaatctaagtctaacataattttagcatggatattcacaacacgcgttagaaatggctttacaaattctttcgtcgaaggaaacaattcaactcagaaatggcggacaaacggtgtatcgatcaggagtatgaaat

SEQ ID NO: 25928 - DNA, 4338 bp, Schizosaccharomyces pombe
atttaccttcttatcagtggatgtctgcagtacttctatgaggttagaaaaaggtctcattattttcattttcgaagattttggacaatatggctgaagtctttagttattatggttctccttttcacccatatttatgactgttataaaacgaatgaaagtgtatggaatgtattaagcattataacttattttcttgctttgtttttgcatgttgtggagcagcctacgttgcgaatacctatggcctctttgttgatgttttggctttttaagtttttagcctcggctctggttttattacttcgtcctaattatacaatgttccctatgcttaacgtagttccctccattacttttttttgctcattggtatgccttctagctgaaatctacgtgcctcctgccaaccgagtttggtatcccgatgatgcagctgagttggaagagactggattaagaccatctcggtttacctatgccaacattttttcaaggatatcatttggttggcttagccctcttatgaagtttggttacagaaattatcttactgaatcagatgcttggtctcttcctcctgccgaacgttccagcaatctgactattgtttttgaaaagaattggatttcccatgcaaaaaagaaaaaaagtagtctttacatgtggggtgttttgtttttaaaccattggaagcttaccgttgttattatcgttttgaagttggtgcaagacgttgtagcgtttattcagccaaatttaattaggaagattgttatttttgttagctcctattcttctgagcatccacaacctcctcaagtaggtttcagtcttgcaatcgctatgtttttaaccaacgtcgtacaaaccgcattgttacaacaatatttccaacttggcatggtacttggcatgagatggaggtccgaattgattactgctatctatcgcaaatccttacgtctctcaagtgcggctcgtcaaagtcgatctgttggagatatcgtaaattacatgtctgtcgacactcaaaaagtttgtgatttaactatgtttttgtttgttattgtatcgggtcctttccaaattgtactagctctcacaaatttgtaccatcttgtaggatacggtgcgctctctggggcttttgtgacattcttactatttccttgtaatgttgtgattgcaagtatctttaaaaggtttcaaaatagacaaatgaaaaataaagacgcacgttctcagtttatgactgaaattattaacaatattcgcagcattaagttgtatgcttgggaaaacatattccttcaaaaattgctgcagttaaggaataccagagaattgcgcatgttgaaaaagattggaattgtcaacactattggcaactttacctggctttttgctcctattcttgtatcagccgcaacgtttggtactttcattgttctgtatggaaagacacgtgtgctttcagttgatatagtctttgcttgtttgagtcttttcaatttgttacaatttccgttaaccatgttgcctattgttgtcagttcagttttagaggcatctgttgctatttctcgtatctatgggtttctcactgcaggtgaattggactccaacgctgttcaacgctacccagctaacaaagaaccatccggagtttgtttagaaattaaaaagggtacatttagttggtccggtcctggacaaaatgccgcagaacctactttacgtgatattgattttgtggctagaaggggtgagctatgttgcatagttggtaaagttggaatgggtaaatcatctttgcttgaagcttgtttgggcaacatgcagaagcattctggctccgtgttccgctgtggttccatcgcgtatgcagctcagcaaccctggattttgaatgctactattcaggagaatatcctctttggccttgaactggatcctgagttttatgaaaaaaccattcgtgcttgttgtttgttgcgtgattttgagatacttgctgatggagatcaaacggaagttggcgagaaaggtatatctttatctggaggtcagaaggcacgtatttctcttgctcgtgctgtttattctcgctcagatatttatcttcttgatgacattttatctgctgttgaccagcatgttaatagagatttagttaggaatcttttaggttcaaaaggtttactcagatcacgatgcgttattctttcaactaactccttaaccgttttaaaagaagccagcatgatttatatgttaagaaatggtaaaataatagagagtggaagcttcactcaattatcttcttcgccagactcccaattgtttcaattactttcggaatttagcaagaaggataccgcatcatctactggagccgatactcctctctcccgttctcaatctgtaattacttcttctaccgatgtcacgagttcagctagccgttcttctgacacagttagcaattatccaaaggccaccataaaaggaacaggtaggatccgtaaaaggttaaccgacgaggacaatgtcaaagctactggacaagctgctgagaaaatggaacgtggtaaggtaaagtggaaagtatactggacgtactttaaagcgtgctctttgtttttaatcttcttgtatttccttttcattattggtggtattggtatgaatgttggtactaatgtttggcttaaacattggagtgaggtaaatacacaattaggttataatcctaaaccatacttttacttgggtatatacacattgtttggtcttctttcttgtgcattgatttctcttagcagcttaaccattaccgtgttttgtgctattaaaagctgtcgttatctacatgattcaatggtaaaggcggttttgcgtgctcccatgagcttttttgaaaccacgccaactggtcgaatattaaaccgattttccagcgatgtttaccgtgtggacgaagttatttctagagtttttatgtttttcttcagaaatctctttcaaatagttttcgtactagcagttatttgctattcttctcctatgtttatgatcctaattgttccattattctttctgtatcgttacaatcaagtttattatactcaaacttctcgagagctaaaaaggcttgatagcgttactcgcagtcctttatatgctcatttccaagagtctttgggtgggttgtcaactattcgtgcttatgacatggaagatacatttatctcggagaacgatattcgtgttgataccaatcaccgaatttggttcttgtacttcagttcaaatagatggcaggcaattcgtgttgaagcaataggcgctttggtggtattttcatctgcattttttggagttctctccgcagtccgtggaaatcctaattctggtttagtgggtctttcgttgtcttatgccgtacagattacccaaagtttaacctttgtcgtaagacagtctgttgatgtagaaacaaacattgtttcagtcgaacgaatgctggaatacattggtcttccaagtgaggcaccctccattattccagatcatcgtcctccagaaggatggccttcccatggtgcaattaaatttgatcactacagtgtcagatatcgtgaaaatcttccactagtcctaaacgatataagtgttaacattaaaccacaagaaaagattggtattgtcggtcgtacaggagcaggaaagtcgactttgacgcttgcattgtttagattaattgagccaacatcaggagacatacaattggatgatatcaatattacttcgattggattacacgatttacgctccagacttgctattatcccacaagaaaatcaagctttcgaaggtacaattcgtgagaatctcgatcctaatgctaatgctaccgatgaagagatttggcatgctctcgaagctgcttccttaaaacaattcatccagactcttgacggcgggttgtattcccgtgttacagaaggaggagccaatctttcgtcaggccaacgccagctgatgtgcttgacaagggcattattgacacccacacgcgtattattattagatgaagctactgcagctgttgatgttgaaacagatgctattgtgcaacgcacaattcgtgaacgctttaacgatcgtaccattttgaccattgctcaccgtattaatactgtgatggattcgaatcgtatattagtattggatcatggtaaggtagtcgaatttgattcaacgaaaaagctgctggaaaataaagcatctttgttttattccctcgcaaaagagagtggacttatttgagtt

SEQ ID NO: 25929 - DNA, 3050 bp, Schizosaccharomyces pombe
atgagaggaatgagttataacattactcatgaatgcgacgctattaatattctatcagataatttacatgaaggagcaatatcagaagatatggttgccctcagtggtccagccatagagttactagaaaataatgttggtagttcaaaaaatagctatcaagaagatgagggaagttcttcgattgatgagaacgcgcctcttataagcataaaacgaaagaggagaattcgtacggttaaatctacttcaaataaagaattagtgcaaagaaaagcatcgaaacctactaaacagaaatctgttttcacaccacttgagcagcaatacttagaattgaagaaaaattatcaagaaactattttggcaattgaagtaggatataagttccgattttttgggaaggatgcaaaaatagcctctgaggtgttaggaattagttgctattttgagcacaattttttaaatgctagtgttccctcgtatcgtattgactatcacttggaaagactcattaattttggtctcaaagttgctgttgttcgacaaactgaaacagccgctctcaagtcaactagctctagcagaaacactctgtttgacagacgagttgctcgcgtgcttaccaaggggactactctagatgatagcttttttcgctttgagcaaacacagcatggtacactacaagcttcccaatttatcctatgtgttgcagataatgttgataagagcaaagcaaaatcaggaagagttcaggttggactaattgccatacaattatcatctggaactactgtttatgatcattttcaagatgattttttgagaagcgaattacaaacaagactttctcattttcaaccttgtgaattgatatattcgaacaagttatcttccgaatcggttgccctactgaatcattacgtatcaactgaaaaaacttgcggtagagtagtgcgtgtgcaacatgctgttcagcaggacgtgaaactagcattggagaatttgcaggacttcttttcttctaaatgcatcatgtccggtagcaaaattatagaattacacatggaaaaggtgaagtctttacattctctttcaatcatttgtttggacatggccatttcttatttgatggaattctcattggaagatctattcgttgcttcaaacttttatcaaccttttgatagcatttcttctatggttttaagtaaacaggctttggaaggtcttgagcttttcgttaatcaaacagatcatacacctgttggtagcctattttgggtgttagatcgcacatacacaagatttggacaaaggatgcttcagagatggcttcaaaagcctttggttgataaagaaaatataatcgagcgtctggacgcggttgaggaattagcctttaattctaatagtcaagttcaagcaattcgtaaaatgctgtatagattgcccgatctcgaaaagggtctgtccagaatctactatcaaagggtaagttatttttctgtttcattttcttacagtagtgcactccgtctgaaatgttccatgttttgaagggtttttataaagccgcatctgctttctcgaaaaattcatactcttgttttaagtcagcattgcttagaagactaattcaacagcttcctagcatatcgtctatcattgatcatttcttgggaatgtttgatcaaaaagaagctgaaaataacaacaaggttgacatgttcaaggatattgacaattttgatttatcagaagagccaaacgatgtagattatgagttggcacaggaaattcgagagctgaaaatgagtattttgatggtcagaactgaaatggattttcaccttcaagaattgagagactatttagaatatcctaatttggagttttctatttggggaaatgtcaaattctgcattgaagtttctaaaggatgtaaaaaaattccaccagattggatcaagttaagttctactcgatctcttttccggtttcatacaccaaaaattcaatctctcttgattgaattgtcttctcatgaagaaaacctaacaatttcaagtgaaaaaatttatcgctcatttctttctagaatatctgaacattacaatgaattgcgaaatgttacaacagtattggggacattggattgcttaatttcttttgcccggatttcttctcaatcgggttatacaaggccagaattttcagataaggagctgttaatacatgaatctcgacatccaatgattgaattgctaagtgataaatcttttgtacctaaccatattcatctaagttctgatggtgtcaggtgtttgttaattacgggcccaaatatgggcggaaaaagttcttttgttaaacaattagcacttagcgccattatggctcaaagtggttgctttgttccagcaaaaagtgctctgcttcctatttttgattcgattcttatcagaatgggatcatctgacaacctttctgtgaacatgtctacttttatggtagagatgctcgaaaccaaggaggttttaagcaaggctacagaaaaatcaatggtcattattgacgaattaggtcggggtactagtactattgatggagaagctatttcttatgcagtcttgcactatttaaatcaatatataaaatcttatttattgtttgtgacacattttcctagtttaggaatactagaaagaaggtttgaagggcaacttcgttgctttcacatgggttacttaaaatcaaaggaagactttgagactagcgtttcacagtctatatcatttctttacaaattggttcctggggttgcttcaaaaagttatgggttaaatgttgctagaatggcaggaattccgttttcaattttaagtcgtgcaaccgaaattagtgaaaattacgaaaagaagcatagaaatgcaaggaaaaatgttttcatacgaaaggttgcaaaactattaatgattcttaatgccgaagagattgattttaaaaggcttttctatgatcttaccgctttcgaagaaatctga

SEQ ID NO: 25930 - DNA, 2379 bp, Schizosaccharomyces pombe
atgaatgattttagttttgaggacaagggtttgattagtcgaagtggctttggtagtcgtcatgttcgacgagtggttaaagctttggctttgatattcagtttgttaattctttacttgacaatttccaacgttagcgattctcctccgaaaagagactcgctgagtttagatgatattgttcttcaaaaatacaaaccttcatacaaacaagtcaattggattgatagccaaggcttgaaggatacttttttagtaaaatacggtgatttgattaatatacaagatccttataatcttaacaaaactctgttctcggtttcagatttagtgtataatggaatccagctcgattatgacagttattctatatcttttgacgcaaagtacgtgttagtctcggtcaataagtctcaacggtggagacattcatcatttgcacaatattatctttataataccgaaactaaggatgtcaatatgctgggtcaggacaacgagcattggactataagccttgcggaatggtcacctactggtcatcaactttccttcgtctataataatgatttgtatgttcgaaaaaacgatggaaatgttcaaagacttacttatgacggtaccgttgacgtatttaatgggttgacagattggatttatgaagaagaagtactttccagtccttcaacgatttggtggtctccggattcagataaaattgcttttcttaagctaaatgaatcagagatccctacttatcactatcctttatacaccgctgagctagatcccagtttgccggaatttgattataacaaggacatggcaattaaatatccaaagccaggtaatccgaatccttctgtttctttgtttgtcgctgaccttaattctaacgcttcctctaatttttcactgtggcataacgaacctttggcagaaccagtcgttcaaaatgtactctgggtcaatacctctagtgtattggttcaatttaccaatcgtaatagcacttgcattacagcgaggttgttggatacggagttgaaaagtatacatacagtgaaaacggaatgtttggaagaaggttggtatgaggttcaacagtctgctaaaatgtttcctttaaataattctcttgtttgggaaaattggtcggatggatattttgatattttagctttagatgattataaccatttggcatttattccatttaatggttcttctcctatttatttaacatctggcgcctgggatgtaacagacggcccaatacacatagatggagattttggaaatgtatattttttggccactttaaaagattctaccgaaaggcatctttattatgtatctctcgatacattagaaatttacggaattacagataatggagaagatgagggttactactctacctcgttttccccttttggagatttttatgttctaaattatcatggacctgacgttccatggcaagagcttcgatcaactaaagacaaagattattgtctgtctttagaaacaaactcacgtttgaaacagcagttgtcttcaattacgttaccgagtgttgaatacgggaaattaacttttaatgatacaacgtttaattttatggaacgacgacccagaaattttgatgttaacaaaaagtacccagttttattttttgcttatggaggccctggatctcagcaagttgctaaattgttcagagttgactttcaagcttatctcgcttctcatccagactttgaattcattgtggtaacattggatggaagagggactggatttaatggtaatgcttttagatattctgtgtcaaggcatttaggagaatgggaatcatacgatcaaggccaagctggtaaattttgggcggatttgccatttgttgatgagaatcatgtaggtatatggggttggagttatggagggtatctgacattgaagacattggaaacacaagacgttttttcgtatggaatggctgtagccccggtaactgattggcgtctttatgattctgtatataccgaaagatacatggaccttccgcaatataataaagaaggctacaaaaattcgcaaattcatgactacgaaaagtttaaacagttaaagaggttctttgttgcacatggaacgggtgatgataatgttcattttcaacactcaatgcatttgatggatggacttaacctcgcaaactgttataactatgacatggcggtttttcccgatagcgcacactctattagctaccataacgctagtttgtctatttatcatcgtctaagtgagtggattggagatgcgttaggaagaatagatccgtctaccggtgttcgacaacatcgatgggat

SEQ ID NO: 25931 - DNA, 2907 bp, Schizosaccharomyces pombe
atggatgggaaaccgcaagttgaagtgatagttaatggacaagttgttccaaatttggatgatagagagtatcgtcttattaagttggaaaacgacctcgaggttttgctagtgagagatccggaaacagataatgcaagtgcagctattgacgttcacatcggcagtcaaagcaatccacgagagttgttaggattggcgcacttttgtgagcatctgttgtttatggggactaagaagtatcctgatgaaaatgaatacagaaaatatctcgaatctcataatggaatttcaaacgcctatacagcctctaataatacaaattattacttcgaagtgtctcatgatgctctatatggtgctttagatcgttttgctcaattttttattgaccctctcttcttagaagaatgtaaagatcgtgaaattcgggctgtcgattctgaacattgtaaaaacttgcaatcagacagttggagattttggcggttgtacagtgttttgtctaatccaaaaagcgtgttttcgaagtttaacacgggaaacatagagacgcttggtgatgttccaaaagagttaggtttagatgttcgccaagaattacttaaattttatgataaatattattctgccaatattatgaagcttgtaattattggacgcgaacctcttgatgttttgcaagattgggcagctgaattgttttcccccataaaaaacaaagctgtccccattcccaaatttccagatcctccctatacagataatgaggtacgcaagatttgttatgtaaagccagtaaaaaatttacgacgtttggatatcgtttttccaattcctggtcaatatcataagtataaatgccgtccagctgaatatgtatgtcatttactaggccatgaaggagaaggctcttatttagcttatttaaagagcttagggcttgcaacctcccttatagcctttaatgtctcaatcaccgaagatgcagacatcattgttgtttcaacctttttgactgaggagggtttgactgattaccagagggttattaaaattttatttgaatatataagattgctcgaccagacaaatgctcacaagtttttatttgaagaaacccgtatcatgtcagaggctcaatttaaaacgagacaaaaaacccctgcttaccagtatgcgcatgttgttgctagcaagcttcaacgagaatatcctcgtgataaagtcctttattattcctcagtactcactgaatttgaccctaaaggtattcaggaggttgttgagagtcttcgtcctaataacttttttgccattttagctgctcattcaattgagaaaggacttgataataaagagaagttctatggcatagattacggattggaggatttggattctcagtttatagactctttgctacatattaagacatccagtgaactttacttgcctttggcaaatgaattcattccttggtctttagaagttgaaaagcagccagtaacgacgaaactgaaagtgccgaatttggtgcgaaatgacaaatttgtaagattatggcataaaaaggatgacactttttgggtacctaaagctaacgttttcataaatttcatatctccaatcgccaggaggtctcccaaagtttctgtgtcgacgacactttacacgcgattaatagaagatgctctaggagaatattcttatcctgctagcttagctggtctttccttttcactttcaccatctactcgtggcataatactttgtatttcagggtttactgataaattacatgtacttttggaaaaagtagtcgcaatgatgcgtgatctcaaagttcatccgcaaagatttgaaatattaaagaatcgcttggaacaagaacttaaagattatgatgctttggaagcatatcatcgttcaaaccatgtactcacatggttgagcgaaccgcattcgtggtcaaatgctgagttacgtgaagctattaaagatgtccaggtgggcgatatgtctgattttattagtgatttattaaaacaaaactttttagaatctttggtacatggaaactataccgaggaagatgccaaaaatcttattgaatccgctcaaaaactgattgacccaaaaccagtctttgcatcccagttgagccgtaaaagggctataatagttcctgaaggtggtaattatatttacaaaactgtggtgccaaacaaggaagagaaaaattctgctattatgtataatcttcaaatcagccagcttgacgatgaaagatctggagccctaactcgactagcacggcaaataatgaaggaacccactttctccatcttgcgtactaaagaacaacttggttatattgtttttactttagttcgtcaagtcacgccttttataaatttgaatatttttgtgcaaagtgagagaagtagtacatacttagagtccagaattcgtgccttgttggatcaattcaaaagcgaatttttagaaatgtccgacgaggatttcagtaagcacaaatcaagcttgattaactttatgctcgaaaagcatacaaacttaaaagaggaatcttctatgtattggttacgtatttgtgatggattttatgactttaccagattggaaaagcaagcagaaattgtgtctaccattaccaaggatgagttttacagtttcttcataaacaacattcattatgaaggagaaaatactaaaaaaatatctgtgcatgttgtttctcaacgctgtgaagatgaagtttacgaaattcccaatgttactatcattgaaaatggcaacatgttcaaggaaagcatgacattgagtaaagcggctttcccacttaaaccctttgatgaaatcgataggtctttattatttaat

SEQ ID NO: 25932 - DNA, 2832 bp, Schizosaccharomyces pombe
atggggagaattttaatagcacatttgtttcttccttcctcagttggattctccttcgatacagtcccgcacgatgaagttggatccaagtttatgcaaaaggaagagtcgaaggattggattgccgatacccctttagatgagagtgccatcgtatcggaagaggaatcagacgatgactctttgctctcagacctccccgaggagattgactcgacgaatgcacaaagtaatattgcgaccccttctcccggtacagtagctgcggcgatcagcgggattcaacctcctcctaaaacgccttcgtcggactccccgtcgttggagaattcgttgtcaaacctcaatgacttgttcaagtcgagaggccgccatatggctttttccaaaaatgacggcaccaatctctctctccctccttctcgtcaccagtctcctcctccctctagtgtccttgcgtcgcaacgccatcaccgtcgccatgacagtgaattagaagagtttgctcgtcgtgcctctcgctctttatcctttagtatgaatggaacaccccagcgacgtatgacttttgacgcagaagcttggaaaaacgttatctttaaaatcaaacccagctcctttggtaacgcaagtttttacaatgccatcagtgctgccacccgttccaagcaattcgacgaccatctttttgtcggtacctgcggcatccccaccgactctcttcccgattccctgaaagaacgtatttctcacgactacataactgaacacagcagtcttgttgtctatcccactgataccgattttgtgggtcactacaatcattactgcaagaatatcctttggcccaccttccactaccaaatccccgacaatccaaagtctaaggcatacgaggatcattcctgggctaattatgttaaagtcaacaaagcatttgctgataccattgttgataactacgaacaggacgatatgatttggattaatgactatcatttactgttagttcctgaaatggtccgtgaacgtcttcctcgcgcaaagatcggctttttcttgcacattccctttccttcctcagaagtcttccgttgtctggcgacgcgtcaagaaattttgaagggcatgctcggtgcaaacattttgggcttccagattcccgaatttgcttatcattttcttcagacctgttctcgactagtcaacattgacattcgcaagaatggcgtcgtctcttttgaaaaccgccagatagatgtgattgcccttccgatctccatcgacccaggattcatcgatcgctgccttgccagtccaccagtggagcattgggccaaggtattgcaggatcgattcagaggtaaacatattatcctttctcacgacaagcttgaccccattcgtggtttgcgctccaagttaatttcttttgagcgatttttacaaaagtaccccgagtatcgtgaaaacaccattttacttcaggttgcccccgaatccctacaggacagtgagcatcttcctcacatctccgacattgtcacccgaataaactctgcctattccaacattgcctctcgtcacgtgcccgttattttgctgagacagaaacttggttatgcacagtttttggctttaatgatgatatccgatgccttaattgacaattccttacgtgagggaattagcttgactagccatcaatttatttatgtgcagcgcaagagacacaggccattaattcttagtgaattcgttggcagcgcctctatcttgaatgacaatgccattattgtcaacccatgggattacagcaaaacagcagaggctttccgcactgcattaaccatgtctgaagaagagtgccaaaaacgcaacaaggcaatgtgtaatttgattctccgtcacgatgctgcttcttgggcagttactttccagagtttgattaaggaatcttggaaggaacaaatcgatatgcaacggattccagcattcaccgcacaacttatcaaggagccctatcaaaatgcacaaaagcgcttgattttactttattttgaaggaaccatttccacttggggttctcaataccataacgttatgacgagtttgcaacgtactatcaatttgctgaacatgttgacgtctgatcctaaaaacactgtttacgttttcagtgcgcttagctgtcaggagctggagcaactatttcaacgtgttccaaagttgggtatcgttgccgaaaatggttgctttgttagatcgcctcctaaaggtgatgcaacaatgccagtttccaagaaggaaattgccgagttgtggaaaaataaggtattaggcaccgatttaacttggatgaagacggtttctgaaattttcgagtactatgccgagcgtactaccggtgcatatgtggagaataaagatgccacagttattttgcaccttcgtgaagctgaagatgatgaggcagccatgtgggcagccaaagaatgctgtgaatctgttaacaacttcaatgttccctgtagcgctactattcaaaatgatatggtcgtttgccgatccaacaaagtatccaaacgccttgctgctgaggatatatactcggctaatggtggagattatgactttatttttgcagctagtaacgaccctgatgatgatacagtcttttcatggatgaaaaatttcaagcaaagtaagaaagaagttgtaccatttacattctctgtttgtgtctctgaacatggtaattctaccaatgccgatgctgaaagttctggtgtatttgggttcttgcaagcgcttgagaaagtttactccgct

SEQ ID NO: 25933 - DNA, 1086 bp, Schizosaccharomyces pombe
atgtcggctactcgcagaattgttttgggtctcattcctgctgatggaattggaaaggaagtcgttcccgctgctcgtcgtttgatggaaaatttacctgcgaagcacaagcttaagttcgatttcattgatttggatgctggatggggtacctttgaacgtactggaaaagctcttcctgaacgtactgtagaaagacttaaaactgagtgtaatgctgctttgttcggagctgttcagagtcccactcataaagtcgctggatattcttcaccaattgtcgctttgcgcaaaaagatgggattgtacgccaatgttcgccctgtaaaatcactcgatggtgccaagggtaaacccgttgaccttgttattgttcgtgaaaacaccgaatgtttgtacgtcaaggaggaaagaatggtacaaaacactcctggcaagcgtgtcgctgaagccattcgtcgtattagcgaagaagcctccactaaaattggaaagatggcttttgaaattgccaagtctcgccaaaagatacgtgaatctggtacttattctattcacaagaagcctttggttactatcattcataaatccaatgtcatgtctgtaactgatggacttttccgtgagtcctgtcgccatgctcagtctttggatccttcttacgcttccatcaatgttgacgagcagattgtcgactcgatggtttaccgtcttttccgcgaacctgaatgttttgatgttgtcgttgcccctaacttgtacggtgacattctttcagatggtgctgcctccttgatcggatcccttggtttggttccttctgctaatgttggtgataactttgttatgtcggaacccgttcatggctctgcccctgatattgccggtcgtggtattgcaaatcctgtagccaccttccgctctgttgccttgatgcttgaattcatgggtcatcaagatgctgccgctgatatttatactgctgtcgacaaggttttgactgaaggaaaggtcctcactccagacttgggcggtaaatctggtaccaacgaaattactgatgctgttcttgccaacatccataat

SEQ ID NO: 25934 - DNA, 753 bp, Schizosaccharomyces pombe
atgaaaactgctttgctattgaaaaccaaatcacagcctttcgatccatatgtggaggcctttgaaaaatatggaagagatacagccttcattcctgtgctgagacacaaaagggttcacgaagaacagcttagagataaattaaaaaacgttcgtaaaacttattgtggtttaatcgttaccagtcaacgagttagcgaaactctggatgaagcattaaaacaagaagatgaaacggagaggcagaaaatattgatggaaacaccaatatttacagtaggtccggcgactgatgatagtattcgacgtctcggttttcagcaaacacatggaaaggactgtggaaggggtgaggttttggcagatttaattgaagagtggtatactacgactaaacaacataagcccttacttttccttgtaggggaaaagcatagggatataattcaaagaaaactgggggacgacagagtagattcattaatcgtatatgctacgcaagaattagaaaatacagaaacccaaataaaggatacgattagaaaacatcctacaattgattggattgtcgcattcagtccgacatccatttgctctttattaaacacatttgaattaaagatcgcaaccattggacctactactggagattatctaaagaagctgggaactcaaccgaacgttgtatctccagcacctaatccagagagcttggcatccagcatagttgcctttgatgaggagaattctagt

SEQ ID NO: 25935 - DNA, 1116 bp, Schizosaccharomyces pombe
atggcgagcgctacttccacgcctactattgcggatgggaattccaacaaggagtcagtagctacaagtcgaagcccacacacgcatgatctaaactttgagctaccagaggaatacgaaatgatcaatctcatcggtcaaggtgcttatggagttgtatgtgccgcgcttcacaaacccagcggcctaaaggtggctgttaaaaaaatacatcctttcaatcatcctgtgttttgtctaagaactttaagggaaatcaagttactcagacattttcgtcatgaaaatataatttcaattctagacatccttccaccaccgagctaccaggaattggaagatgtttatattgtacaagagcttatggaaacggatttgtaccgtgttatacgttcgcagcccttaagcgatgatcattgtcaatactttacgtatcaaattttgcgcgctctgaaagccatgcatagtgctggagttgttcatagagacctgaagccatcaaacttactactaaatgccaattgtgatctcaaagttgccgatttcggtttggcacgttccaccacagctcaaggcggaaatcctggctttatgactgagtatgtcgcaactcgttggtatcgagcaccggaaattatgctgagtttccgagaatacagcaaagctattgatttatggagtactggttgtatacttgctgagatgctttctgctcgaccattgttcccaggaaaggactatcatagtcaaattactttaatccttaacattctaggaacgcctactatggacgatttttcaagaattaaatctgcacgtgcgaggaaatatattaaaagtcttccatttactcctaaagtatcattcaaagcactctttcctcaggcatcaccagatgctattgaccttttagaaaaattactgacatttaatcctgataagcgtataactgcagaagaggctctaaagcacccgtatgtagctgcttatcatgatgccagtgatgagcctacagcatcccccatgcctcccaacctcgtcgatttatactgtaacaaagaagatctcgaaataccggtattgaaggccttaatatttcgtgaagtaaatttcaga

SEQ ID NO: 25936 - DNA, 924 bp, Schizosaccharomyces pombe
atggaatctttacaaagattgttacaaggtgcccgcatgggtactggtatgatgggagatcagcctcttgttgataattccgagtgtgtatacatttcatctctagctttgttaaaaatgcttcgtcatgggcgacatggtacaccaatggaagttatgggtttgatgttaggagaattcgttgatgactttacagtacgtgttgttgatgtttttgcaatgcctcaatctggtacaggtgtcagtgtagaagcagtcgatccagttttccaaaaaaatatgatggatatgcttaagcaaacaggacggccagaaatggttgtaggttggtatcattctcacccgggttttggttgttggctttctagtgtcgatatcaacacccaacaatcatttgagcaattaacaccaagagcggtggcagttgttgtcgaccctattcaatctgtcaaaggaaaggtggtaattgacgcctttcgattgattaatccgtctaccctaatgatgggtcaggaacccagacaaacaacttccaatttgggtcacatcaacaaacctagcattcaagctttaattcacggtttaggaagacattactactcccttcgcatcaattacaaaaaaactgagcttgaagagatcatgcttttgaatttacacaaacagccttgggcacatggtcttttacttgaaaactttaattctgctgcggaaaaaaatcatgcttctattgataagatgaaatccttgtcagaacagtacactgaacgtgttcaaaatgaagtgactttaagtccggagcaacttcgtattcaatacgttggtaaacaagatcccaagaagcatcttgacgctgaggttcagaaatgtatagacaacaatatttcttccatgttagcttgtatgcttgattccgttgccttc

SEQ ID NO: 25937 - DNA, 1179 bp, Schizosaccharomyces pombe
atggacaaaaaggtttatcaatgcaccgttagtgcgcctgttaatattgcagtaattaaatactggggaaagagagatgtggcattgaacttgcctaccaatagctcgatcagtgtgaccctttctcaagatgacttacgtactgttactacagctagttgtagcgagaagtttgagaatgatacactgtggttaaatggaaacgctgaggaaatctttgccaataaacgacttcgtgtctgtgtagaggaactgcgtaaagctagattagatctcgaagaggaaaatgatgatcttgacaagattggtgcattgaagcttcatgtcgtttcagaaaacaacttccctactgctgctggtttggcatcttcagctgctggttatgctgctttttgtgaagcaatcgctagattgtacgatttaccatggacacccactcaattatctcgcattgctagacaggggtctggaagtgcttgtcgtagcttgtttgggggctatgtagcctgggagatgggcgagcttcatagcggtgctgatagtgtagcagttcaagttgaacctgttgaaaattggcccgaaatacgtgttgctgttttagtagcgtccgctgccaaaaaaggggtttcctcaacagctggcatgcaagctacagttgcatcttctaccttgttccaacatcgtattcaaaacatcgttccacaacgtatccaagaaatgaagaccgccattcgtgagcgtgattttgagacttttgcgaagcttaccatgactgattccaatcaattccatgcgtgctgccttgatacttttccccctatcttttacttgaacgatacttcacgtgcggttatccgagttgttgagaatataaatgctactgctggaaagaccattgctgcctatacatttgatgctggcccaaatgctgttatttacttcttggaagaaaactccgagattgtattaaatacactttatgctgttactaaaaatgctgaaggatggagcaagcagtatggctcttcccccgttactgttgattctgctgcagccaatattgtatcatctggtataagccgagttatcttaactcgagtgggtaatgggcctcgagttttgacgattgacgaatctttgatcgatgcatctggcaaccctaaatttataggaagtcat

SEQ ID NO: 25938 - DNA, 2334 bp, Schizosaccharomyces pombe
atgggctcgcgtatttttacgcaatccaccctcagaagcttttcatgcgctcctgtcgcagccaacattgacgctaaaaaggttgccatgagcaactttgaaaaaaataaatttattaattatcagcgcatcaaagacaatctcgagattgttaagaagcgcttaaaccgtcctctcacatattcagaaaaaatcctttacggtcacttggacgatcccgtaaatcaggatattgaacgtggtgtctcttacttgaagcttcgtcctgatcgtgttgcttgtcaggatgccactgcacaaatggctatccttcaatttatgtccgcgggtatgccggaggtcgctgtccccgtcactgtccattgtgaccacttgatcgaagcctacgaaggtggtcctatcgatctcgaacgtgccaacgttaccaataaggaggtttacgactttttacaaaccgcttgtgccaaatacaacataggcttttggcgccctggttcgggtatcattcatcaaatcgtccttgaaaactatgccttccccggtggtttgttgattggtactgattctcacactcccaacgccggtggtctcggaatggtcgctataggtgttggtggtgctgacgctgtcgatgttatggccaatttgccttgggagttgaagtgtcctaaagtcatcggtgttaagctcactggtcaattaaagggttggacttctcccaaggacgttatcttaaaggttgctggtattcttaccgtcaaaggtggtaccggtgccattgttgagtactttggtcccggtgttgaatctctttcttgcactggtatgggtacgatctgtaacatgggtgctgaaatcggcgctactacctctatcttcccatttaaccctcgtatgtccgagtaccttcgtgccaccaaccgttccgctattgctgattatgctgaagaattcgcccctatcattgccgctgatgaaaatgctcactatgaccaaattattgaaattgatttgaacacattggaaccccatttgaacggtccctttacccccgatttggctaccccaatttccaagttcaaggaagccgtcaagaagaatgattggcctcaagagctcaaagttggtttgattggatcttgtactaactcctcctatgaggatatgtctcgtgctgcctccatttgccaacaagccatcgacaagggcattaaaaccaaatctttgtttaccatcacacccggttccgaacaagttcgtgctactttgactcgcgatggtcagttggacacaatgagaaaggctggtggtattgttttggctaacgcttgcggtccctgtatcggtcagtggaagcgtaccgatgttaagaagggagagaagaactcaatcgtcacctcttacaaccgtaacttcactggtcgtaacgatgctaaccctgccactcatgcttttgtaacctcccccgatattgttactgccatggttttctctggtgacatgaactttaaccctcttactgatactttgaaagataaggatggaaacgactttaagtttgaacctcctaccggtgctggtcttccttccaagggttacgacccaggaagcaacacttatgttgcacctagctcggtcaatgtcaaggatgtcgccattgatcctcattcgaagcgtttacaacgccttactcccttcaagaaatgggatggaaaggatatgaagggtttgaaaatccttatcaaggctaagggcaagtgtactactgatcatatctctgccgctggtccttggttgaagtaccgtggacatcttcaaaacatttctaataactatatgattggtgctattaatgctgaaaacggtgaagcaaataagttgaaggatcaactcaccggtgaatacaagactgtccccaacgttgctattgattatcgtgatcatggaatccgttgggttaccttgggtgaacaaaattttggtgaaggatcttctcgtgagcatgctgctctcgaacctcgttatttgggaggcgccgctgttatcaccaaatcttttgcccgtatccacgaaaccaatcttaaaaagcaaggtttgttgcctttgacttttgccgatcccgcagcttatgacaagatttctcctttcgacaccgtcgatatcgatggtctcactacctttgctcccggtaagcctttaactttggttgttcaccctgctgatggatctgctgagtggtctaccaaacttaaccatacctttaacaaggatcaaattgaatggttcaaggccggtagtgctttgaatcacatggcaaacatgcacaagcaaaag

SEQ ID NO: 25939 - DNA, 5682 bp, Schizosaccharomyces pombe
atgtcatggcatgaacaagattacggctttggtacttcatctgaaaactctaaaataaattcggatgaatttgaggactcaatggatgtcacggaattcaataatccaggagaagagagtacatatccacaagccaattcatggaacgactcaaataaaaccaaggacattgcagaatattatgattacagctggtcaggacaaagagaagccaatcaacagattccccaaccagtacccgtacagccccgatatcctgatgaacaaaatttctcaatgaacggagaaacgtatccaagtgaggcatatgattacgactattccggccaagaagaagcaattaatgctatgaatatacttcaagggaacttggaaaggagtaacgaatattattcagaaggtgttccttacagcgaggaagacttgggtgcatatgctggaggaatgacagaagacgatcagatgtattcaaatttcaacgaaaccggggaatttaatttagatataggctcttcaaagttttcgtatctgaatgcaaaaaatccgtaccctgcatggattgctgaaaactcgatccccattaccgccgaaaatatacttgagatttttcaagagcttcaggcaaaatttggtttccagtatgattcaatgctcaatatgtacgacttttttatggttttattggactcgagatcttcacgtatggatgctgagaatgctttaaaatctctgcatgctgattacattggaggtaggaatgccaattatagaaaatggtatttctcatcaagtatggatattgatgattctgtcggcttgcaaaattgcaagttttcaagtaatgggccaaaaatcaaacaagcaaagaaaaagcaaaaacgaaagtccaacaaggccgagacagaaggaacaaatgaaccggaaacttccgtgcaaatcgatccattgaatgtttcaatggagaattgggaaaacgaaatgaaaaatctggattgcgaaactcaggttcgtcagcttgcactttaccttttgtgctggggtgaagccaacaacattagattttgtcccgaatgcctttgtttcatattcaagcttgcaaatgactttatgcaatcggaggattatgcgaaaagtgaacccattgaagacgattgcttttatctagacaatgtaattacaccattgtacgaattcattcgcgatcagcaatttgagcttcttgatggaaaattagttcgtagagaaagggaccacgctcaaataataggttacgatgacattaatcaactgttttggtacccagaggggatagcccgaatagttacggtggatgggacacaactcatcacactaccaaaatgggaaaggtttcacaagttaagtgaagtggattggaaaaaggctttttataaaactttttatgagagtcgctcgtggtttcatttagttaccaattttaatcgaatatgggtcatacatttcactacttattggtactacacagtctttaattcaccaactataattgagaagaattttcggcaatcagttggtcctaaaccaattccgtcatgccattggacttctgtctcccttggaggagctgttgcaactttgttgatgctattagcaactatttttgaatggattcatgtacctcgaaagtttccaggatctaggcctctattaaaacgcttcctaattctcattttgttcttcatcttaaatgtcgctccaactgtttttgtttttggattttcaactgaagaacagcagcgtactactggaagactaactgtcgcaattgttcatttcattttctctgtatttacattcatttacttttcccttgtgcctttaaacaatctgtttcatcgtgcttacaaatcttcctcacgcacgcatttagctaatagatactttactgccgattatgctcgtctccaaataaacgatatgtgtgtatcatggggactttggctgctggtgtttggagcaaaatttacggaatcgtactttttcctttccctgtcatttcgagaccccatcctcgtattgagtacaatgaagccctatctatgcaatataacgtttctaggctctcatctatgcatatggcaaccaaagattctacttggtatcatgtatgtcactgacctagtactgtttttcctcgacacgtatttatggtacattttagtcaacacagttttttcggttgcaaggtcatttttcttgggaatttcaatatggacaccttggagaaatatttttgctaggatgccaaaaagaatttacagcaaaattctttgtacccctgaagttgattcgagttataagcctaaagttcttgtatctcagatttggaactcaattattatctcactgtatagagagcatttattggccattgaacatgttcaacgtcttatttatcatcaagttaattctcttgatggggatggaagtaaaacattaaaaacaccaactttcttcgtatcccaggaagattcttcgtttaataccgaatatttccctgctcattcggaggccgaaaggcgactttcgttttttgctcaatctttagcaacaccaattccagaacccattccagtggatgcgatgcctacttttacggtattggtgccgcattatggtgaaaagatactgctttcattgaaagaaattattcgagagcaagataaactttctcgggttactttacttgagtaccttaagcagttgcacgctaatgaatggaaatgtttcgttcgcgacactaaaatccttgctgaagaagatgcgctttccaatcaagacttgaactcacaagatgagtcaatgaaggccgagcagcttcacaaaaaattcgacgatttaccattttattgtataggtttcaaaaacgctactcctgagtatactcttcgtactagaatttgggcttcattaaggagtcaaaccttgtaccgaaccgttagtggttttatgaattattcacgcgctattaaactgctttatagagttgaaaatcccgatgttgcacaattgtttgaagggcagatggatgttctcgaatatgaactagatcgaatggcatctcggaaatttaaaatgtgcgtatcgatgcagaggtacgcaaagttcactgctgatgagatagagaacacggagttcattttacgtgcataccctgatttattgatcgcctatttagacgaagatcctccaaaggagggtgaaacaacacctcaattgtatgcagcactgattgacggatattctgaattagatgaaaataagaaacgaaaacctaaataccgcatcaaactctctggaaatccaatcctcggtgacggtaagtctgataaccaaaatttatctcttcctttttacagaggtgaatatattcaactgattgatgccaaccaggataattatttggaggagtgtttaaaaataagaagtattttggctgaatttgaagcttttgatttaaaaacaaatgacccctatgctgaaactaatgcactttaccagaataatccagttgctatcatgggtgcaagagagtatatattttctgaaaatataggaattttgggagatgttgctgctggtaaagaacaaacatttggaacattatttgcaagaacgatggctcaaatcggtggtaagttgcattatgggcaccctgattttttaaatgccatttacatgacaacacgtggcggtgtctccaaagcacaaaaaggtttacatgtgaacgaagacatatatgctggaatgactgctcttcagagaggcggacgaattaagcattgtgagtattaccaatgcggaaagggtcgcgatttaggttttggctcaattctcaatttcactacaaaaattggtactggtatgggagagcagatggtgtctcgtgaatattattacttaggaactcaactaccatttgacagatttttatccttctattacgcacatcctggttttcatattaacaatattttcatcatgctatccgttcaactattcatggttgttttggtgaatctcggaggaatgtatcatgtggtaacagtttgcgattacgatcatgatcaaaagcttactgttccaatgaggccagaaggatgttatcaacttaatccagtagtaaattggttgaagagatgcattatatctattttcattgtttttttcatctcatttgttccattgacagttcaggaattgactgaaagaggtgcatggcgtgccctaactcgtttagggaagcactttgcatcgttttcccctatgtttgaagtattcgcttgccaaacatatgcacagtcggtaattgctaatctttcatttggtggtgcacggtatattggaacgggcagaggatttgctacagcaaggctttctttttcgttattgttttcgaggtttgcgggtccttctatataccttgggtcacggacgttgttgatgctgttgtttggaacaatgaccgtctggatacctcacttgatatatttttggatatctacgctagccatgtgcatcagtccctttatatttaatccacatcaattttcgtggactgacttctttgttgattaccgcgaattcattcgatggctttcaaggggtaattcacgttctcatataaactcatggataggctattgtcgtttaacccgaactcgaataacaggttacaaaagacgactgcttggggttccagttagcaagggtgttatcgatacatcgagggcacattttacgaatatgttttttacggaaatatttattccactaatgctggttcctttgacacttgtctcttatttttttatagattcacagcctggtaatcctgatccctcgaaagttaccaatccgattcttcgtatattaattttggcctttcttccaattatagttgccgccgtagtttctatgacatttgctggaatggcttgtatgatgggacctctgttagatctttgttgcaaaaaatttggagctgtactagcagcactggctcatggtattactgtgtttatgtttattatcgtctttgaggtatcttggtatttagaggcttggtgccttgcgaaaacggtgcttagtatgctgtgcataattgcgattcaacgattcttttttaagatcattcaagttttatttttaacaagggagttgaagcacgatggaacgaacctggcatggtggacgggaaaatggtattccagaggactgggatttcacgcgttgtcccagccgtcacgagaacttatttgcaaaatgactgaactaaatttttttgcagctgatttctttctttgtcatttacttttatttctgatgttacccgtacttttgattccgtttatagatagatggcattcgatgatgcttttttggttgaaaccaagcaaacaaattcgaccacccatatattcgatgcggcaaaaccgtttacgtaagaagatcgttcaacgctacggaactatgttctttcttttgttgattgcatttttagcgctcatcataattcctttagtagtagccaaggatttactagccaacttcgaaatggacatccttcgaacgtatggtctaatgcagccgcgagatacaaattggacggagaatggaacgaattggaccactgtcaatgaa

SEQ ID NO: 25940 - DNA, 1522 bp, Schizosaccharomyces pombe
atggatagctcaaatttgtcttcatcaatgccgcaggagggccagcttaaactgacagaagaggcgattataacaataaaacaagtagatgagagctctgcaaaacgaagcgttagtaacgaaagcagaaaaagtaaagatgttacaaggaaagagcaaattgcaagcgatcaacaaggagacgatcaatgccctcaatctgataccgccaaggataagaagactgagtttaaacaagatgaggttccaaactcaaacggtaaatcaatacctacctttcatccctgcaataatattgggattaatgattttaaccatcagcactacagtcgggtctgtagaaatggaatcgatatcaatttaatagtcgtcggagaaagtagtttgggaaaaaccacttttgtcaattcttttctccaaagcaacgatacaaacttcagacctaaaaaaacgatggactttgtggaacataaggcgacactttcagacggcgatcagaaattcaacctcacaatcgtcgatacacctggttttggcgataaaagtgacaatagcaattggtaagctattagaatatcttctattcttttttcgtttttttttttgacataacccaattcaaactaaccttctagctggagacccattgctaccaatttgctacacaggctaaacgcgtattttcaaaatgaggtaaaaatggatagggaaacatctgaaatcgattctaggattcatggatgtctgttttttataaatccaaatggccatagacttcagccactcgaaatttacatcatgaaaaaaatcgatcagtttgtcaacattattccggtgattggcaaggcagacactatgacttccgatgaattgaatcatttcaaaaagcgtgttatcgccgatatggttcgagaaaaaattcgttattttagagaaccccataatgaaaaaaaggcaaagatccctataccttttgctatagtgggtgccggggcacccattgaacatgatggcaaatgcattcgaggtagagcttatccctggggtttagtcgatatcgatgatcccaagcagtcggacttttgccaactacgtaactttttgctttacacgcatattgaagggcttaaacacaagacacataagctaatctacgatactttccgtacagaaaaactagttgctttaaatgccacaccagggagtcaattcatcaggtacgttgatacattacatgtgaatcatcaaacttgctaactaaagatatagtgccgaagagatgaatcagaagtacattagcgaacaaacacagttagtagaagaagctctaacaaaggtgatgaaggaaaagtatagggagaaggagaataacttagagttgttagaaacaaatcttaaaactcatcataaagactacaagcatgcattaaagaagcgtattaccgcgctagaagaagagaaaaatcgtctcattaaggaaatcgggcctgaaaaagtgaaaaaagcaggcatcttagcataa

SEQ ID NO: 25941 - DNA, 952 bp, Schizosaccharomyces pombe
cttaaagtttttgctaatttttcagagacttcaaagaaacttgtggtcgtaggagatggcggttgtggtatgcttgataaatataggtgaatgacagctggtctaatgtactaatgcttgatgtataggaaagacatgtcttttaattgtattctcaagcggaacttttcccgaggtatgccaatagatcgaacaataactgtttaagtgcagtgttcatatgattcatgtactcagttcacttgaattatctaagtatactgatttctaacatcatgctagagatatgtgcctacagtgtttgaaaattatatcaccgatataacatatggaccgaacagcaaagttattgaacttgctttgtgggatactgctggtcaggaggaatatgatcgtttacgtcctctaagttacccgaatagcaacgttattttgttgtgtttctcaattgattgtccggcttctctgaataacgttacggagaaggtatgtgctctataatttatattgctaaacgtagctttgggtttcttcaatgtcatttgcgtctagccattagtatttcatctttctcatattattttctaacatttttctttcagtggtatcctgaagttcaacacttttgccctagaactcccatcgttctcgtcgggctaaaagcggatttacgcaaagataggaatgctactgaagtactaagaacccagggtttaacaccagtaacctaccaacaagtatgtcaatgataagctaacttttttctttcgtttattttttttaacatatttaggctcaatccgttgctttatcaatgaacgctccatatgtcgaatgctctgccaaagaaaacactggtgtaaatgaagtttttcaacttgctgttggcctcactataaaaaaatcattttcgttttctaaaaagtcttgcgtgattttataatatcttgat

SEQ ID NO: 25942 - DNA, 708 bp, Schizosaccharomyces pombe
atgcgaaaagttctaataactggaggtagcagtggattaggtaagagaatcgcacaaatttggagccaaaaaggtcatcaatgtcatatagtggggagaaatgaatttcatttaaaggaaactttacagtcgctatcagtagctaaaggacagcaacatacattgacgattgcagatgtccaaagtgatatgaaaaatttaaagagtatatttgaaagtgttgagattgacactgtggttcacgcggccggcgttcttcaatcaagcctgtgtgttcgcaccagcgaaaaagaaattgatagcatcatatgtacaaatttagtgtctgcaatcaagctttcaaaaatggccattttagaatggtttcgaaacaaaaatagcgaacgagatcgactaattctaaatatatcatctaggcttagcacttatgcattacccggaacaagtgtttacgcggcctctaaggcaggtttagaatcctttactaaagtgttggcagcagaagttgcttctaagggaattcgtgtaaatgcaatttcaccaggttatgtggacacaccgatgctatctagccaaattcgagctatagcagaaaaaaaagtaccgataggtagattagcatcaacagatgaaatagtagatgcatgtacgtttctattagacaatcgatataccacgggaacaattttacctattactggtggactt

SEQ ID NO: 25943 - DNA, 2010 bp, Schizosaccharomyces pombe
atgagttatttgtccgtcggggatgaagtcctcatccgtggagaattaggaatagttcgatttgccggtagtactgattttgaaagtggtatttggttaggcgtagaattgttaaatggaaaaggaaaaaatgatggaagcgtaaaagggaaacgatatttttcatgtgagaaaggaaaagggatatttgtacgcgcatgctcttcgaatgtgatgaaaagaccaagtgtcgtcaagtcaaggaaaaaaggatcagaaaacatatcaaattttatggaaaaaactaaagcaattaaacaaaaatcacgtagggagccctcaaaatttgaaagatcattggcacgcccattgtgcattacacctattgattcgtctactcccacaaagacagctacgttttatacttcatctacaactgaaaatctagatgagctaaatttttcaacagaagaattatcaagttttgacactactttgttaaactcagatacgagcaaattgtctgggcttgacgatagtagttttatggaagaggaatttgtatggcaagttgacaacgttttgcaggaatgtgaaaaaaaatttactcctcattcaaagggaagttatttaaaagagaatttaaagtcagaattaaggaagggtcgtttggatgaattgatgtgtgaaaataccgccttaaaagaaaaaattgataaattaaataaggaattagagaaagttgaacctcagttgacattccttcgcagtaaaaacagtattgaaaaacctcggaattttaggcgtgaaaagtttctcaaaaaattcttggctatgcagaaagaaataaagtatctaagaaagcgaaagttgcaaattcgaaagattcctaattataagtactctgatcgaagtttgaattccaaaactcctaaaagccaggacaactggactacacaagttacaccatctagtctccttggggtctcagaggtttctaaggttttgcaattaaaacaggttcaggtcgacataactgagcttgtaaaaattcctaaaaacccgttttctgagaaattgacaatatctaacgtgaatagatacttaaatattgtaccgggaagtttggatttacaattttcattaacaaatgaaaattttgtacattggaatagcacagtttatcaagaattattaaacttaaagtccaacaactcttcagtggatggtgtgaagacaagaaggcaactgttggaggaaaatgctttgttgtctcataaagtattaaaactaacagaagaaattcaagacttggaaactttgaatcagctaaacactgaaatagaagcaagacaatcggaaaagttaaatgaggtgcaagaggaaactcaaaggctatctcagttactaatatcttctcaacctgctttgacagaagttaaacatttgaaactatgcttatcagactctcaagaggaattattgcaattaaatgcaaaacttgagaaagcaaatattgtaatagacgagttaaacagtgcaaaattgaaactatcaaaacaagtggaggaggaaagtagtatgaaagacgaccttacagaaatgaaccaacgtttaaaagaacaaattgaatcatacgagaatgaagttaactctgaaatcacttctagaacattgaaagaatttgaaacattaaagacacagtatgagaaaaatctttgtaatttaagagaacagctaaagaccgcaaggatgaaactggccgataaatatccacaaggtgacaatactagtgaaaatatagactggctcaaacacagtttacgggattctaatactgaaaactcaattccaagcccattgacctttgcctgcaaggagataagaaaattagttgcagatattaaacccgtttcagtagaaaagcagctggccttgaattggaaaaaagatatcgagcgacccagttttcatcacaatcaacagctatttaattattgtcagttaacagacattctttccaaaaaatgc

SEQ ID NO: 25944 - DNA, 3117 bp, Schizosaccharomyces pombe
atggagggttttaccttggaaacccatgcatcgcgaattatcgaagttcctttacttggtcaggaggaccagtcggtggaaatcgattgttctagcttaccaagcgatgccacggagttgtgtgaaattttggtgaatgaacaagctcccagagaattttggacgaagtttgctcacgaatactacattcgtggtttacgagaacaggccatcctaatccttaagagtgggttggaaacgctgaaagattcagaaagtctgtgcatcctaaatgccaatatcgctgccatttatttgtcaatggctcgagaggccatgcttaaaaaggatacagacttgcgggacgagcagttacgaaacgtacgtacatacctcgaagctgccaacaacatcgactcaaaatcagaaattaatgtcttgctgcatggaatttacagaattttattgaaccccacagataaggagtccttggaaaatgcagctcgctgctttgattttgtgttgcagaaatccggaggaaacatccttggttttcttggaaaagcgcgaatcttgtatgcaaaaggaaattatcgttccgccttaaagctttatcagcgtgcccttgtctccaatccacagttcaagcccgatcctcgcattggtataggtctttgcttttggaatttggatatgaaaacggatgccttatcggcttggactcgtgtacagcagcttgatccaaaaaacacagtggtggatacctatattggactttactattacgatctcgctttccaaaacgtcaataacgacagtttcgtccaaaattacggaaaagctttacaacatattcaaagagcatttaaaaccagaaacaacgatcctgttgcttctagcattttggaaagatatgtttattccaaaaaaaattatgaaggctgtatcaagttggctgagaacgttattcaaaattctttttcctctagcctgattgccgacggctattactggatgggtcgtgcttaccatcaaatgggtaataacgaaaaggccatggctagttatcaaaaggccaaagcagcagatgatcgacatctgctgtccagcgttggaatcggtcaaattcagattttacaaaatgatttaaccagtgccaaattgacgtttgaacgtattgctgagcagaatcaaagttgttttgaggctctagtcgtcctcggttgtcttcatgcctcagattcgaagccagaccttacaaaagctcgtatgttgctcgatcgggcctttaaccttgtcggaagctcaaagcttccacgggttgttgactccgacctctatattacccaggctagattgtgggagaaggaggacaccaaaaaaagtctcggatttcttaccagagctctggattttctagaaagcgctcatatgtctgtaggtcctgaattgttaaacaacattgcagtcttgcagtaccatttgggcctaattcctgaagcacatggaaatattatcaaggcgaaaagcgttttaccagatgccaatcctgaattaagcttgctcttggattacaatcttgcacgttgtgaagaagaattgggtaacacttctgtagctagtgaagcgtatgtttcgattctcgaaaaacatccatcttttattgatgcccgtattcgcaaatgtttacttcagttatccaatcctaacgaggaaacgtttaaagaaattcgtcatatcatgaacgcagattctcaaaatttagaggttcgagcattttttggttggtatttgagtaaacaaaagcgtcgcccagtagaagatcctgaagttagacactgctctcagacccttagacattggcacgatgacatttactccctagttcaactcggtaatgcctatatgagacaggcaagagagtttcgtgtacataatgatcgtgaaaagttaaaaaggcaaaaactttacatcaaagctattcagtcttatgatcaagctattaaatttgatccaaaaaacgcacacgctgcccagggtattgccattatattagcacaaaacaggcaattttctaaagctctacttattttgagtaaggttcgtgaagcaattaaggatgctacaacactcataaacattggcaattgccttgcagaactcaaacagttcagtcgtgctattgaggtatttgaaaccgtgtattctagtaccggagaaagtgatacttatggtgtattgagctgtttaggccgagtttggctacagcgtggtcgcgaaagcaaaaacgtcgactatttaaaagaatccgtgcgatatgctacattagctttagaaaaaaatcccgagaatccaagccttttatttaacgttgcctttgtacaattccagctatgtgagctcatccgtcagaaacccgagaacagtagaactgttgaggatctgaactttgcaatgcaacagcttgacgcatcgattgaaacttttaccaaactggtgtctgtcgaacatccaccctattctcctaccagtattgaacaacgtgcaaagatggctaaaaatactactaagcgtcaattggagcgcgctattcaagcgcaaatcgaatatgagaagagtgttgctgccaaacttgaagatgctaggattcaaagggaaaaggagaaggctcgaagattggcagaggaagaagctttacttaaggaaaagcaagaacgtgagaggcaacttcaggaagagcgacaaaagatgcaagaagaagttttggagtggagaaagagtcagcagaaggcttctgaagatgatatgagcttgtctgatgacgaagaaaaacagtcaggcaagaagaaaaagaaagatcgaaaaaagcgtaaatctaaatcgaaacaggaatcctcggatagcggagtaagcgaagatgatgaaataccattgagcgatgccagaaataaaactaaaaaacgtcgtgttaatagaagagtcatatccgaagagtatacttttgaccaggatagtgacgcggagggaaatcaagaagaggaggtttctcgtactatcgaagaaaagcaggataacgatatcacagacaatcaagatgacaataaagagttaaatctattctctgaagaggatgaagaa

SEQ ID NO: 25945 - DNA, 3117 bp, Schizosaccharomyces pombe; identical to SEQ ID NO: 25944

SEQ ID NO: 25946 - DNA, 1752 bp, Schizosaccharomyces pombe
atggcgtcgctctttgatatcaatgcagctgctgctgtaaagtaagtgtaaaattttacgaatgcctgtattaacaatttagggattattccataaaacctcgactctcttacaatactgtaaattctattactggtcctctagtaattttagagtacgttttctgagccttttagccgtactttgatgaattattgctaactctgctatagcaacattcgtagacctcagtacaatgagattgttaatctaaacctaccggtaagtgcccttgagaaattatatatcttggaagatgtgtttcttaatgtcttctgtttcttatttcgttactttattaatgctaattaataggatggttccgttcgttctggtcaagtcttagaagttgcaggtcataaagccattgtacaagttttcgaaggcacttctggagtcgatgttagaaaaactaccattgattttactggtcattccatgcgtatccctgtttcagaagatatgcttggtcgtgttttcaatggttctggtttaccaattgataaaggacccaacttgcttgctgaagattatcttgatatcaatggttctcctatcaatccttatgcccgtatttatcccgaggagatgattcaaactggtatatcttcgattgatggtttaaatagtattgctcgtggtcaaaagattcctatcttttctgctgctggtcttccccacaatgaaatcgctgctcaaatttgtcgtcaggccggtcttgtaaaacgtcctactaaagatgttcacgatggtcatgaagataacttttccatcgtgtttgcagcaatgggtgttaatttagaaaccgcccgtttcttccaacgtgatttcgaagaaaatggatcttttgagcgtgttacccttttccttaacttggccaatgaccccacaattgaacgtatcattactcctcgtcttgctctttcagcatctgaatttttggcttatcaaactgaaaagcacgttcttactattcttaccgacatgacttcttacgcagatgctcttcgtgaagtttcagctgctcgagaggaagttcccggacgtcgtggttatcctggttatatgtatactgacttgtctactatttacgaacgtgccggtcgtgtggagggtcgtaacggttcaattactcaaattcctattttgactatgcctaatgacggtatgtttttgtaaatcttttttttaattgctaattttttcttagatattactcatcccattccagatttgactggttacattaccgagggtcagattttcgtagatcgtcaacttcacaacaatgccatatatcctcccattaatgttttgccctctctttctcgtctgatgaagtctgccattggtgaaggaatgactagaaatgatcatggtgatgtttctaaccagctgtatgcaatgtatgccatcggtcgtgatgctgcttccatgaaatcagtagttggcgaggaagccctttctcaagaagatcgccttgctcttgaatttttgggtaaatttgaaaagactttcattagtcaaggtgcttacgagaatcgtactatttttgaaacactggatttggcttggtccctccttcgcatcttccctcgtgagatgttaactcgtattcctaagaagattttggatcaatattattcaagatcctctgcctatactgaatcttccaaagatgttatagacaacactcctgaaagctcttagttt

SEQ ID NO: 25947 - DNA, 1041 bp, Schizosaccharomyces pombe
atgtggaaccccaaaaagaagtcagaagcattagctaagtttaaatcctttccttaccctaagccaggcacttccaatgtacttgattccaaagaaggtgatactagaaggaagtattttaccaagacgcatctacataggttattcgtctttgtggtactgttgctctgctcaggctactttttaaagcatacactcttgacgcgtcccaaagagagtaatgttgttatgatatttgtcaataacatcggaggtggcgttttagatgtaaaaagtcccagacaatgggagctggagaagatttcaacggagaacaagaagaaatacgctgaaaggcacggatatcatttctttgtgaagagcacaggcttaaagagacgatatgctcatgaatggcgtgaatcttgggaaaaagcagattatatcatggaagccatgaagaaataccctcatgctgaatggttttggtgggtcgatttaacaacattcatcatggaacctcaatattctcttgaaaagcttattattaacagacttgaccatattgcgaccaggaatattactgatagcatggagttcaatccaaaaaatttccacgaaattccatttgttgactatagtgaagatatcaactttattttagggcaagattgcaacggtttcagtttgggttcttttctggttcgtcgaagtgattggactagcagattgatggacttcctttgggatccagtagtctatgggcaaaagcacatggattggcctcacgatgagcaaaatgcaattgagtacttctacgagaataatgcttggcttcgaagcggcatgggattcgttcctcttcgccttttcaattcatatcctccaggtgcttgtgctggtgaaggtgaaaatcctcgtttcttttataaccaaaaagaaggagacttcttggtaaacttggcaggctgtaattatggaagggactgcctagatgaaataaatcattataagggattagcgcaaagaaaacggggttggaggaagttagttccgtttctt

SEQ ID NO: 25948 - DNA, 1869 bp, Schizosaccharomyces pombe
atgggtgaacttcaggatgggataacccaagaagactccattgaaaaaaagtcaaagaatgttgcttcacacggagaaaaaaggaaagtgaagcgaaaaaaagaagacctaagtatggatggttcaaatgatggagtgaaagattcaccagactctaatgacgactctcagagtaaaaaaaagaaaaagaaaaagttaaaaaaatctcagcaaccgctaaatgaagaaaattaccctagattgcaaactacggaaaacaatcttcaaaaacccctaaaaattagcgacctacaagagcttgtattctggtgtttagctgatggacaggctccttcatgggttctagtgagaaataaacaaatgattcatagagcagtgatacttttagttcctggattggagcctagtcaatttgggtttcaacccgtgcgcggcaacaagcactcatttttgctgccgaatttgctaaatgaaaatggccccattcaattacctgatttttgtgaagtgtttgatcgcgcatggcctacgagatctcctggagatcgatttcgtgtcttttctccggtgaatgcctttttgcaatctcctctgagtaatgaacaaaagaagaaaagagataaagaaacacgtgctatggctagtttttccaaaccatctgattacttaatgagttatgaatctttcattgaagacgaatacccattacatcctactgtcatgaagggtgaagaggttactcagccttcaggatgggttgcttctgcaggagattttcattctcctcctataaatcccaaaattcttgctattgattgcgaaatggtgcggactgagaacgggttagaaatagccagagtaactattgtagacatgaaaagtgaggttatttacgacgaatttgtaaaaccagaatcacccgtcactgattatgttacccagtattctggcataactgaagaaaaactgagaaatgttactactgttctttccgatgttcaatcttacttaaaaaagactgtggacaacaataccgttcttttaggccatagtctaaattctgatcttaattgcttaaaatttacacaccctcatatcattgatacggcaaacatttataatcacactcgtggtcccccttcaaaaccatcgcttaaatggcttgcaacgaagtggttgaggcgtgagatacaaaaagcgggagctctggggcacgattctgcagaagatgctcttgcttgtgtggatcttctaaagttgaaagttaagaatggacctgcctttgggttgtttaaccaagactttgagtcaatctttcatagattgtcacgacagcagccaactccattgattggtgcaattgccgactatggtaatccggagtcgtgcattggcaaagcggctcataaaagcgtttcttgtgcgaatgatgatgaagtcgtaagcgctgttgtaagtctttcagacatgcataacttcgtgtggggtcgttttcgcgaattggagcatgcggctatgtggaacgctaatcgaaatacaaaacaagaaaacaactctgatactgatacagagaatgattcggtagaagaggaccaagtaactagctattcttctgctttagagcgttttaatcgaagaattcgtcttttatacgactccttaccaaaaggttctctattgcttttgtatactggtactggaaatcccatcgaaatgtcaaaattaaacgctattcgccaacaatttagaaaagaataccagaccaaaaaatgggatgagctatcagtaaaatggactgatgaagaaaatatgaaatatatatctgctgttgaaaacacaaggaatggattgtcttttatgacgatcaaa

SEQ ID NO: 25949 - DNA, 916 bp, Schizosaccharomyces pombe
atggtgttagaagcaacgatgattctgtaagaatttatttttgttaaattattgctctaacatggcagaattgataattcagaatggatgattaatggtgattatatacctacgaggtttgaagctcaaaaggatactgtacatatgattttcaatcaaaagatcaatgataatccggagaacatgtgtggtttaatgacaattggtgataataggtatatgattaatattacggcttgaacggtactttatgttcagctataaaatactttacagaaattctaatcatattagtccccaagttctttctacattaaccagagattatggtaaattcttatctgcaatgcacgacctgcctgtccgaggaaacgcaaagtttggcgatggtatacagattgcgcagttagccttaaagcatagagaaaacaaaattcaacgtcaaagaattgttgcatttgtaggttctcctattgttgaggacgagaaaaatcttattcgtctagccaagcgtatgaaaaagaataatgttgctattgatatcattcacattggtgagcttcagaatgaatcagctttgcagcatttcattgacgctgctaattcaagtgacagttggtaagtctacggatttttcggacatttttggcttcttttttttactagtattaacaattttagtcatcttgtcagcattccacctagcccgcagttactttcagatttggtaaatcaatcccctattggacaaggtgtagttgcttctcaaaaccaatttgagtatggagtcgatcctaatcttgacgttgaattggcgttagccttggaactttcaatggcggaggaacgagcacgtcaagaagttgctgctcaaaaatcatctgaagaaactgaggataaaaaaatgcaagaatga

SEQ ID NO: 25950 - DNA, 1389 bp, Schizosaccharomyces pombe
atgtcgaatgatgttgatgatgagtccaagattgaaacaaagtcttatgaggctaaagacatagtttataaatccaaagtctttgcatttaaggatggagaatatcgaaaggcggagattttaatgattcaaaaaagaactagaggcgtcgtctactatgtacactataatgactacaataaacgtttagatgaatggattacaatagataatattgatttatcgaaaggaattgagtatccaccgccggagaagccaaaaaaggctcatggaaaaggaaaatcctcaaaacgtccaaaagctgttgacagacgacgatcgattacagcaccttcaaaaactgagccttcgacgccttctacggagaaacctgaaccatccaccccttctggagaaagtgatcatggatcaaatgccgggaatgaaagtttaccgttattggaggaagaccacaagcccgaaagtctttcaaaagaacaagaagtagaaaggttacggttcagtggctcaatggttcaaaatcctcacgaaatagctcgaattcgtaatataaacaaaatttgcataggagatcatgaaattgaaccttggtacttctcaccgtaccctaaagaattttcggaagtagatatagtttatatttgcagtttttgtttctgctattacggatctgagcgacaatttcaaagacaccgcgaaaaatgtacattgcagcatccacccggaaatgaaatataccgtgatgactatatatccttttttgaaattgatggaagaaagcaacgtacatggtgtaggaatatttgtcttttgtccaaactttttctggatcacaaaatgctttactatgatgttgatccctttttgttttactgtatgtgtcgccgcgatgaatatggatgtcacttggtaggatatttctcaaaagaaaaagagtcctccgaaaattacaaccttgcttgtatcttaactttacctcaataccaaagacatggttatggcaagttactcatacaattttcttatgaattgaccaagcgtgagcacaaacacggctcacctgaaaaaccactttctgatttggggttgattagttatcgagcgtattgggctgaacaaatcatcaaccttgtgcttggaatgcgaactgaaaccactattgacgaattagccaacaaaacttcaatgactactaatgatgtgctacatacacttcaagcactaaatatgcttaaatattacaaaggtcaatttattatctgtatttcagatggaattgagcaacaatacgaaagattgaagaacaaaaaaagaagaaggatcaatggagatttgttggcagattggcaacctcctgtttttcacccttcccaactacgatttggatgg

SEQ ID NO: 25951 - DNA, 884 bp, Schizosaccharomyces pombe
atggaaaaggaggcaatttacaaactcattagagaatctcctccaggagaagttaatcaagtagttcatggtttgttaaagtgctgaatacctcaacattctaatgcatataatagatatacgcgacatcggtctaagtgatgaggaagcaattcacgaacaactgaagctttatcatgaagactacaactcttctgtcagcatatcggatgacgaaaaagtaattatttcagctgataatcgtctagagggcaatcgctattatgatcaagttttacagaaatcatttaccattaattatgaaactatggtaaggttaaatttttcaaatcttttttttgtgataattgttaaatagctaacagtattcataggaagctgaaaacgttgaagattataccgaagccataaaaattcccgatgaaatagtaaagcaaattaaaaaggttgcttcggatcactatctatctgatgtaacatttggaatcatcaaaaaaagcgatgaagtggaatcgtttacaattgttttggtttcttcaaagtataatcccaagaactattggaacggttcgtggcgctgtatatgcaattacaacgtttcggaaaagaaactggaaggcaggtcgcatattcgtgttcattactatgaagacggaaatgtttggttggatgcatcccgtcctatttctgctacagtcgaggagaccagtaagctttatgaagtgttggctcaagtcgaaaatggaattcaacagtccttcaacgttgaactttcttcacttaatgacaaaaagtttaaagaattgcgtcgtcaacttccagtcactcgccagaaaattaattgggaaaacgttagtggcatccgtatgagaaatacttgaaac

SEQ ID NO: 25952 - DNA, 1331 bp, Schizosaccharomyces pombe
atgatttttaactatgtttttagtaattcgttttcctttttatacttgatggtgaatgtgcaatgtagaatcaaagaaattatgtattggaatatatgcttgtactgggatgtatttagcaaattaattatatacaacaaagtatgtcaatttggtagaattcatatttttcatggtaagaaccgacaccaacttcttagaacgtgtcatttcactccctcaaagcgccattcagcaatgtcattttttgaagctctgggtgtaagaaacaaaacaaacataaataactataatgaggactaatcaaaaatttctaggcaggaatctgtgctggattggcagttgatctatccttgtttcctattgatacacttaaaactagactacaagcaaaaggaggatttgtaaaaaatggagggtttcatggtgtatatcggggattaggcagtatactagttggcagtgccccaggaggtatgaaaaaaaagaaagaaagtaatctaaatgtatggtttctttctctggtcttaacaaacgatagacacttattaaattacctcttataatatattacaaagttcacaaagtgtataataaactaactcactaacgctactagcctctttattttttactacttatgaaaacatgaaatccagattatcccagtctggccttggactatcagatccccaaattcatatgtgttcagcttctctaggtgaaattgcggcttgtatagttcgagtccctacagaagtaattaagcaaagagcacaagcttctggtggaacattatcatctagaaatattttgcaaacgattttaaaatctaacaatgtctggcgcgatttttatgctggttatggaatcactattgcaagggaaatccctttcacactaatccaattcccaatttgggagcacctgaaactgaaatggagaattaaacattctcgaaataagaatttagctcatgaagcagctatctcgggctccattgcaggtggaatagccgctgctttaacaactccatttgatgttgttaaaacgagaattatgacatctcagcaggtatgtgtttgattttttgattaaactaaagaattttgcgcgtgaatcactaccttgatatacacttttgatactaatttgtttagcgactttcttatgtgtttacaattaaatcgatagttgcccatgaaggctttcttgctctttacaaaggtatagttcctcgagtcttatggttaagtggaggaggtgctattttcttaggctgctacgatgtcatattgaattttatgaaagccgaaggattgtgattgaaa

SEQ ID NO: 25953 - DNA, 1223 bp, Schizosaccharomyces pombe
atggagtctgctcccattgttctagataatggaactggttttgtgaaggtaatcagtttaattaaatctttgtttacactgtgactaacgttagcaaggtcggatatgctaaagacaattttccgcgctttcaattcccatccatcgtaggaaggcccattttacgtgctgaagagaaaacaggaaatgttcaaattaaagatgttatggtcggtgatgaagctgaggcggtgagatctttacttcaagtaaaatatcccatggaaaatggcattatccgtgattttgaagagatgaatcaactttgggattacactttctttgaaaaactaaaaattgatccgaggggtaggaaaattttgttgaccgagccccctatgaatcctgttgctaaccgcgaaaaaatgtgtgagacaatgtttgaacggtatggttttggtggtgtttatgtcgccattcaggccgttctctctttatacgcacagggattaagcagtggtgtagttgttgattctggtgacggtgtaacccatattgtgcctgtctatgaaagtgttgttttaaatcatttagttggtcgccttgacgttgccggtagggatgctacccgctatttgattagcttacttcttcgtaagggttatgctttcaatcgtacagcagactttgaaactgttcgcgagatgaaagaaaaactttgttacgttagttatgatttggaattggaccataagcttagcgaagaaactaccgttttaatgcgtaattacacccttcctgatggaagagttattaaagttggttctgagcgttatgaatgtccagaatgtctatttcaacctcatctggttggtagtgaacaaccaggtttgagtgaatttatttttgacactatccaagcagctgatgtggacattcgcaagtatttgtatcgcgccattgttctctcaggtggtagcagtatgtatgccggtcttccttcacgtcttgaaaaggaaataaaacagttatggtttgagcgtgttcttcatggagatcccgcacgtttgcctaactttaaggttaagattgaagacgctcctcgtcgccgtcatgccgtgtttatcggcggcgccgtattggcagatatcatggctcaaaacgatcacatgtgggtgtccaaggcagaatgggaggagtatggagtacgtgcactagacaaattgggtcctagaactacttag

SEQ ID NO: 25954 - DNA, 1149 bp, Schizosaccharomyces pombe
atgagttccaagctaaccgtcaatgcgcattactctcctttaaaggatgaagatcctttagaccacattgatagccaaacggcgttggactctatggaaaccgactccactggcaaatcttccttgtatttttccaagtcggatgatcccttgtcgaaagatattgaggatggtatatcaaccaggaagttggaggagatgagtgttctcgaggccaatgcaaaagagcccgactcggaaaatgctcctgtttcacgactgaccatattttttgcggtttcctcccaaatcgttttcgctatcctagttaccattctcaacaagcaagctctcaatatcatcaacgcaccacttctgatgttgtcgtttcaaatggcattcacatctctcatggtaaagatgtattggcgattctcctccgttcattttcaaaccctaagattagcttctgcaattcaacttaaaaagtttatctttgtcaagattcttggcatcgttagtaagacctattgcttggcttttgtacctgtctcattttaccaaatttccagaggtttgttgctaccctttacaattctcctttcatttgtattgttgaagcaaaaaactcgcttatttccctttggcggttgtttacttgtaatgcttggctttggctttggtgtacgttttgagagccatgttgcccccataggaattatactgggtgtttggagttccttcactaccgccatcgaatccgttgccgtcaagcattacgttcacgagtacccgaccttagatttgatctacatcttttcagctttaatgtcggtgttttgtttgttgctatccgtggcgtccctagaacttctccacacagtccaggaggttgtcggtatgcaggctatcaaattttttatcgtacttattctttcgtcactttctaacttttatttaaacattgctacttttacacaaataaaagtgacttctcccgtcacctacatgatttctgtatctgctcgcagtattctgcagactttactagcagttgccttcttgggcgaaacactgtatggaaatcgcatttatggagtaattttaattttggtaggtacgcttctctacacacttgccaaagaacatgagcgccgtgtcgcttctgca

SEQ ID NO: 25955 - DNA, 2673 bp, Schizosaccharomyces pombe
atgggaagacaattcatttgctcaatttatcttccatataccatcaattttcaccttgatgagctggaaggtaaccatgaatcacatccagcaattactcatcaggagaaggtcacacaaacacaccgtgattctgtcaagatagatgatatccttactcgtttaagtatctcaaaatccgaaagtggtcaggctactcctgttttgacgcctcaacttgaggggatgaatgactattttagcttgggtccgtcaaagagaactggtggttcaatgaccccgggattaggtgctatgtcccctattccaggatctggccgatcctctcctctgtatacccaacctcgttctcgcgctacttctccttctcgtgttaggcaggccgatcgttttgcggcacctggtatcggcgctggtgcacttcctattcgtcgaaagagaagagattctttagcgaaatctgttgcactttttgaatctgctcgttggtctgttgagcgaggagttgtaggaaatagtggtttatttcatgctgtggacgcagctgttcgtgatcatggattgcagaaccctctatgggttggtctccttggtatgccaactgaatcgttatctgagaaaacaaaaaatgctatttcaggagctttgttagtaaaacaccaatctttggttgtttatacctctgattcgaactttgagggtcactataatcactactgccgtaagattttatggccctcattgcattatcagcataacgaaatattttcattcttccatgaagaaagtaattgggacgactatgtcgccgtaaacagggcgtttgccgatgctttaataaagaattacaaaactggtgataccatttgggttaatgactatcatttgcttttggttccaaatatggttagagagaggatacccagtgcaattattggcttatttattcatgtttcttttccctcttccgaagtttttcgttgctttgcccgaagaaaagaacttcttcaaggtatgcttgggtcgaatttaattggtttccaaactgaggaatacaagcgccatttccttcaatcttgttctcgtgtactttatgctgaatcaactttcgatcgaattcttctggatgataggtatatagatgtatatgcacatcctatcggtgcagacccggttttagtggacaagtggcttgaaaaccctgagactttagaggttaaagaagttctcgaaaagcgctacgcaaatctcaatatctttgtgggatgtgacaaaatggatcctataagaggaattcgtgagaaacttttggctttcgaacaatttctttacgataaccctgagtatcaaaaaaataccattctgattcaaacttcaacctttactgaagagcagaaggagtatggcgttgcaatatccgatatcgtcactagaatcaattctgctttcggagacttttcactagatcatcttcctgtcacaattttgtcaagtgatctatcatatcctcagtatcttgctttgctatctgttgcagatgctttcattgtgacatctttacgtgaaggaatgagtttgacttgccacgaatttatccttacacaacgtcaaaagaagtcgccgttgattgttagtgaattcattggctgtgcttcaatgttctctaacggtgcattcattgttaacccctggagcacgttggaactgagtttgtcaatgaaaaaagcgcttacgttaagtactaatgaacgtaatcagcgatattccaactgtctggatgttgtattaactcattctgctagcaattgggtcactggctttgagacgaaactcaaaaagtcttggacttctcaacaaaaacgtgacttttctcgtttgccaagattcacattgaatttcattggcaatcgctatgatcatgcaaagaagaggttattaattcttaattttgatggaaacgctgttacctgggaaggtcgccatgagtttgtcgatttccattatggatatatggtcagcatattgtcaaagttgatcgctgatgatcgaaatattgtatacatagctagttgtttagaggaagacgagcttgaatcgttattcatgcatgttccgggtgttggtttgattgcggaaaacggctgttatgtgctaccacactatgctgagaatgttcatcaatcgtggattcgtttgtacaaaaagcaacaaatggactggcgtgagccattgcatgacattattcaatattacagtgaaagaacacctggctcctcgctaattgatcacggctttgccatggaatttaattatgtaaaggcagaaaacagagagaacggtttacgatcggctggcgagttggccagtagtattaatgaaacacagcatggctgccgtgctgttcctctagatgggcgagtactttgcgagcctactactattagtaaagctactgctgccaattacattatgactcatctcattaaaaatcctgaagagcttgatttaattctagtggcaggaaacaatcgtaccgacgaatcagtttttgcttgggccaataagagcaaagtttcatcatttactgtttcaatgggtgttggtaatacagaagctaaggcttatactgatggtattccaagcttcttcaatgttttaaactcattatgtgct

SEQ ID NO: 25956 - DNA, 675 bp, Schizosaccharomyces pombe
atgtcacagtctcagtttgatccttatgtacaaaatggtggtaccactgttgcaatcgctggcgatgggtttgccattttagctggagatacaagaagtgttaatggttacaacattaatacgcggtttcaacctcgcgtgcatgaagtcggtgatgatttggtcattggagcatctggtttcgaagccgatgccctagctttagttaagagaattcaacaaagaattgacttgtatcatgataatcatgaacgcaagatgagtgcacaatcctgtgcttgcatggtacggacacttttgtacggaaagagattttttccctattatgtatatacaaccgttgccggcatcgataaagagggaaaaggagagatttattcttttgatcctgttggctcttatgagcgggaatggtgccgtgctggtggatccgctgcaaacttcattactccattcctcgacaatcaagtgaacttacataatcagtacgttcctggttcacatggaaaagagagaaagccaaggagacttttaaaattggaggaagctatgaagattactactgatgcatttacaagtgctggagaacgacacatcgaggttggtgattcagttcttgttaagattatcacaaaagaaggtgtagagacaagaattattcctttgaagaaggat

SEQ ID NO: 25957 - DNA, 2697 bp, Schizosaccharomyces pombe
atgaattgtgaaatggtaacgtcgcctgaatcggtcaacttaggagactccaacagagcagtaagtccattttgcctgcccgattgctcagaaaacgcagttgctcagacgaggagtaaaaccttagataatgctgctttggatctcccatatgttggcaataggaagaaatcggagcaggatttctttaagatgctatcatcaagggatcgcgatgctcatagtactctacgtaaacgatcaaattctttatcttcttttctgagtacgaaatcgacatcagcttcagaaaataaattccatggaggattgaattggctttctctgaagttaaatcttttgctacgcttgcaaggtcgaatgaattctgcgagaacaaatacttcaatgaacccttactcatgcgatagtaacgaaaacttatctactctgagctcggtgaatcaaaactttaattctcgacagctattagctactatagtccctgaatctattcaaaacggatgctctttacttcgtataaccaagaaaaaggtgcgccaacgtaaagtctctttagaccctatatctggatatcttatgctggacaagaatactggtaaagcttataagaagctttgtgttgatgacattaaagaaattcgacagggccgcgatgctcgtaattatagagaacagtacaaaatttcttctgagaacgagaaacgctggttcacaattatatattgtgctgataataaattaaaggctatgcatatgatatctccaactttagatgcgcataatcaatggattatggctttagaaggtctaaaaacttatcgattgaatgaatttattattggacttaatctcgtttgccatcaaggtgaaaaaatgatagattattcagagaatttaaatccctgggaaaagttagaaaaggagcaaagtgcacagttggatctaggagacgtgcatcgcatgtgccaaatgctacatttgaatgcatcaatggagtttttagaagaaacatttcaaaaggcagatgctgatcattctggaaagctaagttttgaagaatttcagcattttgtaagccttttaaaaacaagatccgagattgtagatatttttaaagaatatacatctggctctgacaagatgtctttggaacagtttcgtcactttctatcaacttctcaaaaggctcgtttggatagtgactcaattaggactttgtatgtctctttttgctcaaatgatgattcaaaaatgggtttgatagaatttacttcctttctactttctcctcataattctccagtagttcctgtgatacaagatatgtcgcgaccactgaatgaatacttaatttcttcgtcgcataacacttatttactaggtaagcagtttggtggagaaagttcaattgaaggttatatccgttcgctacagcgtggctgcaagtgtattgaaatcgattgctgggatggaccgaatggtcctgtagtttgtcatggacatacatttacttctatgataaaatttaatgatgttattgatgctatacgaaaatatgctttcgtcgtttcaccttatccattattcatttctttggaaattcattgctgccctgaccaacaacgtcaaatggttagttacatgaaacaagcatttggggatactttggtgatgaaacccgttaccgctaacgaatcagttcttccttcacccgaagatttactgaacaaaattttgctgaaagtcaaatgttcagcaacaccattgcaccaattttcgacagacatactgaaggttgggataactgattcttcgactgatactaccgaatcatcggagctagaaaattcagaattaacagggttaaggaaaggtaaaagacggatgaaaaatatcattgtgcaggaattgcaacagcttgcaccttatgcccgatcattgaaatttcgaaatttttctttaccggaatcaaaaacgtatagccacatattctcattttcggaaaggactataaaaaagcatggaaaagctatggttccaagacttagcaaacataatttacgctatttgtgtcgtgtataccctggcccattgagagtaggaagtacaaattttaatcctcaggtgtattggcgcctgggtgtgcaaatggttgctctaaactggcaaacttatgatacaggtcttcaaataaatgatgctttgtttatagctgatcctccgactgggtacttgttaaagccaccttgtcaacgaataattggtacaacagttggcgaagaaggacttcctcgtaaaataaaattaacaatagatgtcatatctgggcaacaacttagaagagctagagaactttctaattctgaaactctcagcccttatgttgagatccaagttcattcaatggaagaatctccttttcgttggtgttccaaagttgtgcacgaaaatggatttcgacctttttggggagaaaccatggtttatgagagtataattagtgatgacttttattccatgatccgatttctcgtccatcatcgaggaagtaatggaaatgactctatatttgctaattttacttgtccgattgacagactgcaacaaggctatagacatattcgtttattggatatgcaaggcgaaaatttgttattttcgagtttgtttttgaaaattaaaaaagaagacatt

SEQ ID NO: 25958 - DNA, 4116 bp, Schizosaccharomyces pombe
atgatgacggctagttttaaaggtatcagaatctctaaaccaattgttaaagaaatttcatcgtttgggtctctaacaaacattgatttacacactgacccatatgaaaaagtcgaagcaaaagcattatcgcgaagcagattaaaaaaccaaagcgtaaagaaaacagaccttcgtattacaaatgattactcttcactatttgtgagtattgaaaacaaaaaaaacactattccggatattcattgcaacaatttatcaaaaagacctgttggatttaccgattcatatgtaccaggcgaagcgcttctatgtccggatgacccgaatttagtgaatgaattattcgatgatgttttaaaaagattacgcgaagaaaaatctgattctggtgagcagtttcattgggacgcgaacgttacactctctcaagaaaacaaatggtctttcatcactggctatttatcgagaaacgataaatttttaaaaatatcatcaaacgattctgaactaaatgtcaaggcatccgtcatttcctatattgaaaagttaagctgtacaccgttgaagctcaagtacgtggaatctttggcggttgcattgagaaccgaatcagttacctgggttcgatattttcttttgatgggtggacacatagtacttgctaaaatattgcaggcaattcatgagaagaaacatctaaaaagtcctgacataactttagaaattgcaatcctcaaaagcatgaggtgtattataggacagaagattgggactgatttctatctgagtaataagtatcctatcgattcagttgttcactgcctcctgtcaactaaattactagtaaggaaactagctgccgaattacttacttttctttgttactcagaaaagccgaacggaatcaacgcaattatgaaatgtatgaaaaactttgcaaatttgaaagtcgagtctatgaacgtctttgatttatggctttctcaatggaaaagaacactcttagagaaagttgttactgaagaaaagaaagtactagaagaagcggccttacatgataaaataactattgagtatatcatttcacaaatgcttcttataaatgcatttcttgaaaatatcccatctaaaactgctttactccagttcaaggaatccttgagaatagggaatttcaaaagcattttactcattctaaaaaaaataaatgatgaaggagtattaaaacaactcgagaaatgcgtgaaactcgtatcattagacactgctaatgagaaacattttttaaagcacactccaaattctgctgctcatcaatcccttttaaacacaaacatgtttaatgatgcaaatttcgaatttatggttaaagagcatattaaaaattttttaaaacttttgaaagagcacaacaaccccgtccgtattataaagttacttgattgtttagtgcttactttacaagctgataaagggaatggtaattcaaataatgatattgattgcttttataaggaattaaagattggaaacgagcaagggaacaacgctccggggtactcaagtgttacgtctggctacggtactaccaatagcaaaaaagttgtcgcatcatatgataatactgatgataatgaatacagcgtctccaaatcagaactttatgctactggtgatactaataacactacaaatcaaggatatgagaattccgaaagaaagtatgtggaaagttcgaagtatgaaaccgatctgaaaaatatctttgattgtttgtgtttgttgtttccatcagagtttgatcctcaatcttccttttcagccgaaaaaatttttagtaaactaaagcacttactgacgcgtacgcgcgattcatacatttccgaagataccaaaattcttcgattattgaaccgatcaagtagtaaactgcaagatcgtgaccaagagtatttaatttctaaaaacaatgtgaatggaaatggaaacagagattgggttcaacccgtgaacactacctctagcgttagtgcttttgcttcaccaaggataaaacctaaactgctttttcaaccaaatcaggatgaaaaattaaaactttgcaaattagatctagctaaagcaaactcaatcactttaaaatccgagccatcttccgctgtttcaacgcattcttttgaggttcatctgagtatgccaggaacacaaataaaaagtgctaacttagcagaaaaaatggaaacttcaaaacacaaggtttttaatccaaaaaggattgatgttgttagtgatcttcccttagactatcgaaagtcgtactatggccgattttccataactgataccaagaggttttctaaaatagaaaatatgagaatcaaagaagttattgatgggaatccattcaaagctccacctcctgcaccattaccacctcctgcacctcctttaccaactgcaatgtcttctctccagaaatttgaaaaaaatgattcacaaatttttcggaagacgataattattcccgaaaatatttcaatcgatgacatatttaaattctgttcaggttcagagtctgaagtgtatgcaagcaaaattcctggtgagctatgcaatccttctaaacggctaaagcagcttcattggaaacgcctcgaagttcctttcgaaaaaactctatggaatattgtagttgcagatccttatttattaactttaaaacttactgcggaagggatttttaagcaactcgaagattgttatccattgagagaagtaacagtttccaataaaaaagttaaggaatataccggatttatgccagttgatttacagcaaatggttagtattcgtttgcatagattcaattccttgacaccaattgaaattgccaaaaaattttttcattgcgaccatgatatcatggaactagtcgatttttttaatgaccgaaagttttttcgacaagaaggtcttaaaaagcaactaaagccttatatgtcatctcgaaacgaagaggtaatggaagtaagtgaaaagcttttagaattgtctcgtttcgatcaaatttatacgttaattgttgttgacattgatacttattacgaaaaaagaatggcagctttaaaaatcaaatcgtttctggccaacaactttagggattttagaagacaaataaggaaacttcattgtgcttctttagagttgaaatctagtttgcatttcaagtattttttaaatttggtccttcatattggcaattttatgaatgatgcaccccgtcgagctaaagggtatcgattggaaagtttactaagagcttccatgattaaaaatgacaaaacaggattaacacttcttcatactattgaaaaaatagttcggactcactttccacaattggaagcttttctcgtggatttgaaagccattcccgagatttccagatttaatttggagcagttggagcaggattgtaatgatatttgtgaacggatgaaaaatgttgaaaaggactttagcaatgaaggcattttttcgaatcataaagctcttcatcctgatgaccatatctgtgaagtcatggttccatggattccatcaggaaaatcaatggtggatgaacttaattctgatattactgaactaaaaacaacccttaaaacaactctcttaatgtatggtgaaaatccagatgaacctacatcgagtgctaggtttttcaataatttaaacgaaataatactggagtacaaaaaggctagcactgtaaatcagaagatggagaaggaagaagaacttgcttttctaagactacaagctttaaaagcatctgttaaaagcaataatgcagaaaatagtggttcttcaaagaatgaggaagtttcagcaacaatggaaaatttaatatctcagctacagaaaggtttgtgtgatgattctttaagcaacaaaaccgattgcactgaatcatcgaaacaaacaatcgaaactctaatgaattatgaaaatgataaacaaactctagaaggctcaaataaaaagagacaaacagtcgtccttaaagctgaatgcatgcttaagcagctggagaataacaatgaacttaagaga

SEQ ID NO: 25959 - DNA, 574 bp, Schizosaccharomyces pombe
tctttttcaggtgtcaaagtctctcccgaatgcttggaagctttccaagagctcaagcttggaaagtcactccgttacgtagttttcaaaatgaacgataccaagagtaagtgacgaaaacgatttagatggaatttgagaaagtccaatatccctttttttaaaaataaatttatttatctacattgatatatattttatgtttgtaatgtctttctatgtcgtttttataattatgtggaacctttcactaatttttttttgtttagctgaaattgttgttgaaaagaagagtacggataaggacttcgatactttccttggtgacttgcctgaaaaggattgccgttatgctatctatgattttgagttcaatctcggagaaggtgttcgtaacaagattatctttattagctggtctcctgatgttgctcccattaaatctaagatggtttactcttcttctaaagatactttacgtcgcgcttttactggaatcggtactgacatccaagcaactgatttctccgaagttgcttatgagacagttcttgagaaggttactcgtaagtaa

SEQ ID NO: 25960 - DNA, 1359 bp, Schizosaccharomyces pombe
atgaaatctacagtaaagaaatcagctcctcgtgagtttggcggtgccaaaggtgcattggcaattatgacaggattcccttgtctaatgtattacttatgggcatgctccaaatttaatgattcgcagtttattaaaccagaatcttttacgatagcaggatttcaaaatttttttagaacgttaggccattatatctacgtcggtgcctatccaacacggtatgcattcttggttttttggtcgttttgtatagttcaggctgtcatgtacttaactcttcctggtgttcggacgcaaggtttgcctttaaagcatcgcaataacgaacgtcttccttacttatgcaatgctatctggtctttttacacgacaattgttattcttgccgttcttcacgtgacccacgtatttccaattactacatttatcgacatgttcggtcctttgatgagcgttgcaataataaccgcttttgtctgtacctttgttttgtacactggaactttgctttttggtgatcgactttttgataaacctcatcggttatctggaaatcccatctacgatgcctttatgggagcttgcttgaatcctcgccttggcaaattgcttgattttaaaatgttctttgaagttcgtatcccttggtttatcctattctttatttccgttggtgctgctgttcgtcaatatgaaacttatggcactgtaagtcctcaggtacttttcgtttgtcttggccattatttgtatgcaaacgcgtgctcgaagggagagcagttgattgttccaacttgggacatggcttatgaaaagtttggttttatgcttatcttttggaacatggctggggtcccatttacttattcacactgcaccctttaccttttttcgcatgatccatctgtttacaactggtcaactcaatatacaaccggtatttatgttttgcttctttgctgttattatatatttgatacttgcaatggtcaaaaaaatcatttccgtaatcaaatttatggtactgaggttcatcgcaaaacatttccccaacttccctggcttatcatcaagaaccctacctttattcgttgtgcaaatggcggtactttgttgacttcaggttggtataggtacgctcgtaaaattcattatactgctgatttctttcaatcattgtcatgggcattgatcaccggttttcagtcccctctaccttacttttacccatgctttttctttgtagtccttgtgcatcgtgtttcacgtgatattaaaaagtgcaaagctaagtatggggctgatttcgatgagtattgccgtatatgcccttacttatttattccctatatattt

SEQ ID NO: 25961 - DNA, 1492 bp, Schizosaccharomyces pombe
atggcgtcaatggtactcgcggatggtatgcctacagttaaagatgattccactagaagcaggggttccgacgttgattctttcacatctacagataatgtaacgcaaataaatgttgaggcagccatttcagaaaacaagaatgaagaaaaacccattcaggataattctgaacaagaggtaatcaattatttaaaattcctttactaatatttagttcaatccgcacgttagtataatccagcgtcagttgaacggatacgttggattcgctagtcttcctaatcaatggcatcgtcgttgtgttcgtcaaggttttaatttcaacgtattagtattaggggaaagcggttcagggaaatctacacttgtgaatacgctattgaatagagatgtttacccaccgacccagaaatctttaactggggattttggagtgaacccagaacccactgttatgatcaactcttctgcagttgaaatagtggaaaatggtatcagtcttcaattaaatgtaattgatacacccggttttggcgattttattgacaacaccgattgttggcaaccagttttgacagatatcgagggtcgctatgatcaatatcttgagcttgaaaagcacaatcctcgatctactattcaagatccaagagttcatgcttgtatattttttattcagcctactggtcatgctataagtgctatggagcttcgagttatgttggctttgcacgagaaagtaaatattatacccatcattgcgaaagccgatacactaacggatgatgaacttaactttacgaaggaaatggtaagccctaatcttgatttaaagttgctaatgaaaaaatgatagattttgagagatatccaataccacaatatcagaattttcttccctccgacatatgagaccgatgatcctgaatcagtggcagaaaatgcagacatcatgagtagaataccttttgctataattgcttctaatacattcgtggtcaacaatgaaggaaagcgcgtccgcgggaggcggtacccatggggcgttgttgaagtcgataatgaagagcattctgatttccctaagcttcgtgaaatgcttattcgaacacacttagaagaactcaaagaacagacaaataagctgtatgaagcgtatcgtactgaacggttgcttagcagcggaatatcacaagatcactccgtttttcgtgaagtcaaccctagtgctaaactcgaagaggagcgtgccttacacgaagagaaattgatgaaaatggaagcagaaatgaaaaccattttttctcagaaggttcaagaaaaagaagatcgtcttaaacaatctgaaaacgagttacgtacccgtcatcgcgaaatgaaggcagcattggagaagcaaaaagctgacttaattgatcacaaaaatcggttaatgcaagctaaagctgcggccgaaaatgagaagagtaaaaggaagttttttaaatag

SEQ ID NO: 25962 - DNA, 1925 bp, Schizosaccharomyces pombe
atgcctccatcttcctctataactcaagaggataaggcaactatccgtaaatacatacctaaaagcacaaataaaatcattgcagcagccgtcgtcaagctatatgtagcttatcctgatccgaacaaatggaattatacaggtctttgtggtgctcttgtattgtcctatgatacaacagcaaaatgctgttggtttaaactggttgacgttgtggtatgtgtatgaagctttgatactcaaagcaaactacaaagagtggtatacaatttaattgaattataaccttctaacgttttagaataatagtggtataatatgggaccaagagctttatcaaaatatggactatcgccaagatcgtacattttttcattctttcgagcttgataaatgcctagcaggttttagttttgcaaacgagacagacgctcaaaaattttacaaaaaggttttagataaaggttgccatcctgaatcaattgagaatccggttttgtcatttattaccagaaaaggttcttctagacatgcgcctaacaacagcaatatccaacctccctcagctgctcctcctgtacctggaaaggaaaattataatgctgttggatctaaaagtcccaatgagcccgagcttttaaattcgcttgatccgagcttaattgattctctaatgaagatgggcatttcccaggatcaaattgctgaaaacgcagatttcgtcaaagcgtaccttaatgaatcagctggtacacctaccagtacttctgcacctcccatccctccaagcattccttcctctcgtcccccagagcgtgttccttctttgtctgcacctgctcctcccccaattccacctccatctaatggaactgtctcttctcctcctaactcccctccccgtcctatcgctcctgtttcgatgaatcctgctattaattccacctcgaaacctccactccctccaccatcttcaagagtcagtgcggcagctctagctgctaacaaaaaacgacctcctccgcctccgcctccatcccgtcgtaatcgtggtaaaccaccgattggtaatggttcttctaactcgtctcttcctccacctccaccacctcctagatctaatgctgctggctcaattcctttgccgcctcaaggtagatctgctcctcctccacctcctccaaggtctgctccttccactgggagacaaccaccccctttatcttcatctcgtgcagtttcaaacccaccagcccctcctccagctattcctggtcgttctgcgcctgcacttccccctcttggtaatgcatcacgaacaagcacacctcctgtccctacacctccttctcttcctcctagtgcacctccatctttgccccccagtgcaccaccttctctacctatgggcgcaccagctgctccccccctaccacctagtgcaccaattgctcctcctctacccgctggtatgccagctgctccaccattgcctcccgctgcaccagctcctcctccagctccagctcctgcgcccgccgcgcctgttgcttcgatagctgaattgcctcaacaagacggccgtgctaatttaatggccagtatcagagccagcggtggtatggatttactgaaaagcagggtaagtattgatattattacttaatggttactcgtactaatattttccagaaagtatctgcttctcctagtgtcgcatctacaaaaacttcgaatcctccggtagaagcacccccttctaacaatcttatggatgcattggcaagcgctttgaaccaacgtaaaaccaaagtcgctcagagtggtatgtccggatttctcgtattttttttcaaaagttcttaagtttactaattctttcagacgaagaggatgaagacgacgatgagtgggactagttatta

SEQ ID NO: 25963 - DNA, 4150 bp, Schizosaccharomyces pombe
atgcctagcctaatcaattttgatgctattagttcattgaaatcctctttgcatggcttatccatatgtgcttttaatcatctacaccatgtacctcagcacaatggctcattagctcatgagggacctacaaaccaaactgattattcttctcgtcatcacgaaagccagttttcacaagaagcacatgcggaacaacgttcgagggatgatgaggaagctaactcttttgaaggttcgtgtaacaactcagatcagtcatggactagccgtgttacatcaaagaagaatgaagctgggaccgaaagtggagatgcttctgttcgcagaatttacgtaactagcattccagaagaacacaggcatttaccatcgcaatggtttcctagtaataaaattcgcacaaccaagtatactccagtttcgtttatccccaaaaatctttggaatcaatttaaaaacatagcaaatgctttttttttgtttgtcactcttcttcaatgtattccgttgttttgtcccgagcacctgggcttatcgtttattcctttgagtgttattttgcttactacagctattaaggatggaattgaggattatcggagatgtgttcttgataagaagtttaataataccttaacttggaaattggtagggttcaataatgccaatgcattaggcgagcatattggattatggagaaaattaaaaaaatttatttctcataccgtcgccgatatgtcctattgccttaaaaattccggtatctcatctgggctcgctaccttaaccgtggataatatatcccacaggcacagtctcgaatccgactctgcctttactttatcatctgtttcacaagatagtcttgagattcatgagattggtaacagtggtccttccaacagcttttctgtcatccaggaacaatcaacaggctcatcgaatgccaaatttgagcgtgtgtgtaggaaaagtttgcttgtgggcgatatcgttaaggttttggctgatgaagcgattcctgctgacttgctcatcttaagcacagaaaactcaaacggtgtttgctatgtggaaacaaaaaaccttgatggtgaaactaatttgaaagataaatacgcattatgctcaacaaaatgctgtaaatcagagtataggtgtagtgcggcatctttttgggttgaatgtgaacagcctcatgctgatctgtacagtttgaacggtgtcgtcaaagcacccggcgctgtgcaatcaccgtctgagagtacaaacggaagaaaaatacatgaagaaccttttagtatttctaacgttctactgtgtgggtgtactctgagaaattcaaaatgggttattggtcttgttttatatacaggatcagaaactcgcatacagaaaaatcgagggttaactccttctaaacgaagtcgcattactcgtgacttgaattggacaataattctcaattttctattattgtttgctatgtgtttattttctggtgtgttacgctctatctattcagctcagaacaactctgcaagggtgtttgagctatcaaaaaattcaaacaccgctcctgcgcatggcatcatcagcattttcacttccctcattctttttcaaaatttagtgccgatttctctatatatcactatggacattgttagaagcatacagtcctattttatttttagtgatcgagagatgtatgatgaaaaactagactgtccttgttctccgaaatcgtggaacatatccgatgaccttggacaaatagagtacatattttcagacaaaaccggaactcttactcagaatataatgagttttaaaaaatgttcaattaacggtattcgctatggcaaaagtcacaatgaagatacatgcatcaaaaaacgaaggaatttaaattacaatgaaaacttatcatgcaaggttgacttggataaaaagaaaatgcttgagacattaagtttaagcgactcacctaacccagaatcaatcactttcatttcaagtaaattcgtcgaccatctgcaatccaacgaaaattatattcaaactgaagcctgcttcgaattttttaaagcactcgctctttgccattctgtggtaacagacgtccaagacgaaacacttatttacaatgctcagtctccagacgaagaagcattagtgaaagttgctcgtgatttcgggtttacgcttctaaatacaaaaaacagacgctatactattcgcattaggggtgaaaataagaattttcgagttttggatataatcccttttacttctacgagaaagcgtatgagcgtgataattcgtgatgaggatggtataattcatttaatttgtaaaggtgcggatacggtaatatttccaaggctttccagcggacaaaacaatatcattgaaaagacgaagaagcatttagcttcattttcatccgaaggatttcgtacgttatgtatcgctcgtcgaactattgataagcaagattatcttgaatggaaagtgaatttcaacgaagctaatagtgccattcatgaacggaacgaaaaggtcagtaaagtttcagagatgattgagcaagagcttgaattactcggtggaacagcaattgaagataaacttcaagagaatgtaccagaaactatcgctcttttggctattgctggaattaagttgtgggtgttgactggtgataaggtagaaacggcaatcaacattgggtattcatgcaatcttcttgatccaaacatgactatttttcgaattgatgcaaactctttcggtgccttagaagaagtagaagcttttattagaaacacattatgctttaattttggatacatgggaacggatgaagaattcagatttttgttgaaagaccacagtccgccatctccgaaacacgccatagttattgatggggatgccctgaactttgttttgtctgaacaggtctcttttctttttttaatgttatgtaagcagtgtaagacagttttgtgctgcagggttagtccctctcagaaggcagctgttgttgctttagtcaagaagagtctaaatgttgtcactttagcaattggagatggcgctaatgatgtttcgatgattcaagaagccgacgttggagtagggataaaaggcgttgaagggcaagcagcttcaatgtcggcggattatgccatcggtcaattttctttcctagggcgactacttctagttcatggacgatgggactataaaagaatgtctcaaatgatttcattctttttttacaaaaatgttatttggacatttatacttttttggtatcaattttataacgagtttgatggaaactacatatttgattatacctacgtgatgctttttaatctgctgttcacatcactacccgtaattattgcaggttgttttgaccaggacgttgacgcatctgtttcaatgaaaaatccaagcttataccaacggggaattttaggtctagaatggaacggaaagagattttggtaagtataactctgaagatttctgtttgctaaatatttattttaggtcttacatgctagatggaatatatcaatcattggtatgctttggggtagctctatttgtttttaagtttggtgattttgtaagttggactggaaggaacatcgagtgtatagaagacataggactttttatatcctctcctactatttttgtaatcaacatttttatattgatgaatcaagagagattgaatttaatatcacttattacttggatgttcagcataggtgtattttggatatggacatttatttattcagaagttggcccctcttacgctttccacaaatcagcttcgcgaacttgtcaaacttttggcttttggtgtgttactgttttaaccattgccttatgtttgttgcctcgcttttcctatatttgcttacaaaaattgttttatcctagagatattgaccttttacggagacgactttgtgcaaagtcagatgatgagactagcagtagttcatcatttgcaacagatatagaaatgtgcgaacaatgtaacgacccattaagttcgaaaaaaaattccggtattgttacttcagtttcattcgatgattctaataagtag

SEQ ID NO: 25964 - DNA, 750 bp, Schizosaccharomyces pombe
atggacaaagaatcatatgactatttggtaaagattgtacttgcaggtccttcgggaactggcaaatcctgcttgttacagagatttgttaagaatcaatgtaagtacatgcaaatttaacaatgttcaagtttttaatggaaattaggggatgatcaagtatcacatactgttggaatcgatttcgcaagtcggattataagtgttggaatgggaaaccagcaaaaaagaatcaagttacaaatatgggatactgctggtcaggaaaagtttcgaagcgtggctaggaattactatcgtggagcagcaggtgctgttttagtctatgatgtgacaaacaaggactcgtttgaagaattgtcgtcttggctgtctgatattcgagctatggctccatcaacaatatgtgttgtattggctggtagcaaatctgatttacaaaaccaacgacaagtctctactgaagaggcagctgagttttgctcagaaaagcatatatctagtgcgcatgaaactagttcttatacaggaagcaacgttgaagagtgttttctttccgttgtctccaccataataactaggattgagttgggtgaaattgatccccaagatcaatccttaggtatacaatatggtgatttaagtttccgtagaccggttcacccttccagtacttcgaattggtggacttcaattacgaattgggacgacctggtccgtttggaaagacagaccagatcctattgctgc

SEQ ID NO: 25965 - DNA, 647 bp, Schizosaccharomyces pombe
tacgctcccttcttcggtgtcatgggatgtaccgccgctatcgtttttgctagctttggtgctgcctatggtacagccaaagctggtgtcggtattagtgcaatgggtgtgttgcgccctgatttgattgtgtaagtttatttgataaaatttacggttttttatgtttttttatttcataaaatgctttaatgtttacttttgctggttatttaaaaagcataagttgggaaatgtaacaaaaaaccgggtttcacggattttttatgacatattgattattgcattggaagtatcactaacctaacttatcattcagtaagaataccattcctgttgttatggctggtattattgctatttatggtcttgttgtttctgtcttgatttccggaaacttaaagcaaattctcagtctttacagtggatttatccaactcggtgctggtttgtcagtcggtttggctggtctggctgctggtttcgcaattggtattgttggtgatgctggtgtccgtggtaccgctcaacaacctcgtctctttgtagccatgattttaattcttatttttgctgaagtcttgggactttatggccttattgttgctcttttacttaatactcgtgctaccgataacgttactgta

SEQ ID NO: 25966 - DNA, 2127 bp, Schizosaccharomyces pombe
atgcatcctgctttgctatgtgggccaattcttgcaatatttttacagtttttggtttcttcttgctctccattagaaaacgatgatttatttctagttcaagtggaacctgaagttgatcctgtagtagcagcagaagccattggtgctaagtatgtgcgccctttattaaatttgaagtatcaccatttaattaagctacataaggggagcgatgattcagtccaaagttcaattcgaaaacgaggcattgatgccggaatcttggaattggagcgccagacgcccagatggcgctacaagcgggatgcgagtgaatctgatgaattactgaatgagttctctaatcattttggaatttcggatcctctcttttatggccaatggcacatattcaactcgaataatcctggacacgatctgaatctacgtgaagtctgggacgccggttacttcggtgagaatgttaccgttgcatttgtagacgatggaattgattttaaacatccagatttgcaagctgcttacacttcgcttggttcttgggacttcaatgataacattgctgaccctttgccaaagttatcagatgatcagcacggcacccgttgtgctggagaagtggctgcagcttggaacgacgtttgtggcgtaggcatagctccacgcgccaaggtcgctggacttcgtattctttcggcccctattactgatgctgttgaatcggaagcactgaattatggctttcaaacaaatcatatatattcatgttcctggggccctgcagatgatggaagagcaatggatgctcctaatacggctactcgtcgtgcgttgatgaacggtgtccttaatggccgaaatggtcttgggtcgatttttgtgttcgcttctggaaatggaggccattatcatgataattgcaattttgatggctacacgaatagcatattcagtgctaccattggtgctgttgatgctgaacataaaatcccattttacagtgaggtgtgtgctgcgcaattagtttcagcatatagtagtggctcacatttgtctatattaactacaaatcctgaaggcacatgtactagaagtcatggtggtacctcagcggctgctccgttagcatctgctgtatatgctttggcgctttcgattcgtcctgaccttagttggagagacattcagcatattacagtgtattcagcatctccttttgatagcccttctcaaaatgcagaatggcaaaagactccagcaggattccagttctcccatcattttgggtttggtaaattggatgcatcgaagttcgtcgaggtggctaaggattggcaggtcgtgaatccacaaacctggctcattgctccagaaattaatgttaataaatcattcgggagtgttaacaatgagacaataactgaaatggtaagcgaatttaccgttactaaggatatgattgagaaaagcaacttcaaaagattagaacatgtcactgttagggtgtgtataccttttaaccgaagaggagcattggagattctcttggaaagcccttccggcattcgttcaatccttgccagtgaacgaccgtatgatgagaatagtaaggggtttttagactggacgttcatgactgtgcagcattgggccgaacctccagagggggtttggaagttactggttaatgatcgaagtggtggaaagcatgaaggtacgtttgaaaattggcagttggctttgtggggagaatctgaaaacccttctaatactgcaccactcccttatgacactcttgagcttccaaaggagatggtcttgggaatatactctgaaccaaatagcgatctgactaactcaagtaccttgttgagccctacgtctacttcatttacttcttacaccgtatctgccacagctacacctacatcaacgtctcatataccgattcctacagtcctaccccctacccaacctgtattggaaccctcttatagagaaattgttgcatttattactttctttttgttgtttgcctttattttcgttgctgtcatatggacatggatttccgcattttggaaagctaaagcacccccaccattgtctcagcaagaaattgct

SEQ ID NO: 25967 - DNA, 1938 bp, Schizosaccharomyces pombe
atgatgaataagtgggcaaaaaattggttcgggctgtctaaaaaatcggtttccaccaattctgctaaagggtcacttccccgaagtcctttggcaagcatccaaaccaatcaaccagttgaggaaggtgaaggtggttcacttccttcagtttcaaatttaggtccttcctcgatagaccatcccatggaagaattcgccagtgaccagtctacggttggtaacagaaatagtaatgatatattacctgaagttgaccatgaaccttcaggctatttgaaacttcaaataggttcattagttttgggaggacctcatactgatgcagcattagccatggaatgctcaagacttaatcagttgtttgttgttgttcaatttggtacgacggagtttgtttcacctccattgaaatgggaatcacctggccgtgatataggcacatctagtcgggattctgctaatgtgagtaggagttcatctatgatgagctctcatcccattcctactcctgcaattcaacgtacgtcttcaattccaaatcccttaactccatcttatgttgtatttgatgttgctaaaccggtccccatcgatgttaatatttatgaccatggtaataataatgaatttgttgggagaacttacattcacccgtcttataattatggtcaatttgaacagttttgcaacagcgttgaagtttctcccgcatacaaccgtatggttgatcttcgtctttctctcaatactgttttccagcctctcagtcaacactcctacggccctgatgacttcgttccgttgaaattaattggaaaaggtacatttggtcaagtctatcttgttcgtaaaaaagacaccgagcgcgtatacgcaatgaaagtactttccaaaaaagtaatagtccgtcgcaaagaagttgcacacactgttggggaaagagacattctcgtccaaacttctgcagctgattcgcccttcatcgttgctttacgtttctcttttcagacccccaaagatttatatttggtgacagattatatggctggaggcgaattattttggcaccttcaaaaatcggtacgatttccagaagaaagggcaaaattctatattgccgaattgttgcttgctttgcaagcgttgcataaacgaggaattgtatatcgggatttgaaacctgaaaacattcttttggacgttcaaggacatattgccttatgtgatttcggtttgtcaaaggccaatctttcagtggggactactacacgtacgttttgcggtaccacggattatctagctcctgaggttattttagacgaagcagggtatgatatgatggttgacttctggtctttaggggtacttttgtacgagatgacatgtggctggagccctttctacgctgataacacacaacaactttacaagaatatcgtgtttggtaaagtccgttttcctagagggttgctatctgtagaagccagagatttgattaagctattattgaatcgtaatccaaagcataggcttggtgcacatggggatgttgaagaggtaatgaagcatccattttttgatggaattgattggaagaaactcgctgcgaaagaaattagtccaccatttaaaccaatagtggaaggtgaaatagatgtttctaattttgatgtcgagtttacaaataaagcaatcgatagagactttagtagcacagatgaaatgtcgacctctgcacctttatcatcaactgtccaaaatgggtttaagggttttacctatattgacgcaagtgctatggatgaagcattcggataccacaactcaaatgattctgcttctagtatttccagtcaagatgattattctaaggacaattccgatatggacttaaatcgtgcgaacgatgaggtatttatgggacaaatagatcca

SEQ ID NO: 25968 - DNA, 2781 bp, Schizosaccharomyces pombe
gagttacttttaagattctttgagtctgcccatttcacgagtcaactttgtgttgcatatctttcacgctatcctaacaatattggcattcatcactttctttgcgaaaaactagcaacgtatgtctaccgtatcatttctttgttttttatgtctaacacatattagatttccttatgaagagatagaattttttattcctcaattaatgtacgtttatttcgataaataaagaaaaatttttggggggaaggaaagtaccaaaaagtcgagctcataagtcagtgaaagccgagtatatgactcatatgcctatttcataatttaatgactctcttaccttttgattttctttccttcaaacgtttattccgttgtgttcgtgcatctctaatatcatactgtagtcatctcgtccttaacaaagattctgaaagcgttgctttagaagaatttatcatttctcaatgtgaacaaaatacacaatgcgcactcattacattttggtatttgcaagcccatatggtggatctaggtttacagccgcattcttcttgttttaaaatatgtaaacgactttacaatcgtattcagattttggttttcatgtcatcatcatcgttaatacagtcccaacaaaaaatctccgaaaatgtaacccctgccctaatcctttcaggcatcatgctaggtggtgtttgtgtgcctgaactactaaaaaaagctggccccattgcaattgctcaaggccgtaaagcccctaggcaagatccagatgaatcagatgttgatgttttacgccgtctttccaccgaacctcgatattctctggacgtattacgttcgtctttgaacaactctattgtcgagcaacattccgaagtatcccttagactaaaagctccagaactaacccgcacccattcatatcaatcatcagctacattatctattgacgaacagcgtcgtgttctacgctctaattattttcaacaagaaattcaatttctttttgctttacaagatatatctatccgtctcatcattgtacctagacaagctcgcctttcttcattacgcgccgaacttgctcttttaaataacaaccttccagccgatgtgaacataccgcttttacgatcatatcataaagaagtgagtcataaaatcgttcgcattgatcctaaagaggctaccatactcaattctgccgaacgagtaccttatcttattatggttgaggtcctatctggtgaactcagcttcgagccacaatcgaagaaaaataaggctaaggtgcaaaagattgtctctcataaaaaccaaagaaaaaggtggtttgacctcacagatgtcgatccttatacgaaccttcaagacagtaccgacaatgatatttcagagtcggaaagtgagggaggggatttaagtatgtctcctctgataaaagggttggtaccggacactctttctttgagtaagtcattctcttcgtttggtaatgtatctttgcaggtaccgtcctctcatagagataccgatgtcgtcctgttatctgggcgccactctgattctgatggaaatggcgccttaaaaagaagtaaaatctatgcttcagaaataacagcgagaatgcgagctgcggcaactatgctaagtcagcttgatgctgaaggtagcagacgtcccaaagctgagactgaacgaataaaaaatagcattattcttgacatgcaaagactcgaagaagagcgccttaatgaaccatccatttatcctgtttcagtcgacatatcatgcgcagaagatctgcgatttggcaaagaaactcaaaaggcagaacggaaaggtgatagagatgatcccagtgccgctacattccaagaagattggtatgccaagaaggaaaggataagaaagtcttctccttatggtcattatcccaattgggatttggtcagtgtgattgttaaaacgggtgcggatctccggcaagagacatttgcctgtcaacttatatacgcgtttcagcgtgtttggctagagtgtaaagaaaaggtttgggttcgaaggatgaaaattttagtgaccggcgacaatagtggcttaatagaaacgattacaaatgccattagtgttcactctattaaaaagaatttgacgaaacagcttcgggaagctgaactagcccaaggaaaaattgctggtaaaaatgttgttacattgaaggattattttataaagcagtttggtgatcccaacagcagccggtatcgacaggcacagacaaatttccttcaatcattagtggcatatagcattatatcatacttactacagttaaaggatagacataatggtaacgttcttattgatagtgaaggtcatattatacatattgattttggctttttacttacgaatacaccggggaatgttggctttgaaagcgctccatttaagcttacggcggattatttagaaatccttgacgaccggtttgatgaatatcgttccttgatgaaagctgcgtttaaatctgttcgaaaaaacgctgatcagatcattttgcttgttgaagttatgcaaaataattccacaatgccttgctttcgtgctggtgaaaacacaagtgcacaacttttgcaacgttttcaactacagcttggtgacaaagaatgtgatgactttgtggatttgttgattcaaaaggcaaattgtagtgtttggacgagactttatgatctgtttcaaaatattacgaacggaatttactagtaa

SEQ ID NO: 25969 - DNA, 1288 bp, Schizosaccharomyces pombe
  unsure (1)..(1288): unsure at all n locations
atggtagaccaactggaggattcggttattgaaaccaactacgatgaggtntattgacaccttcgacgacatgaatnttgnaagcctgagcttctccgtnggtatnttatgccnntacnggttttgagcgtcncttctgccattcagcaaagnagccanttnatgcccattttgggagagcgtgatgtccttgctcaagctcaatctggtactggtaagnactgctaccttctcaatttctgttttgcagaagattgacactagcttgaagcaatgccaagctcttatnccttgctcctacccngtgangcttgctcaacaaatccaaanaggttgttgttgctttaggcgatctcatgaatgttganatgnccatgcttgtattggtggtactcttgnttcgtgatgatatggctgccttgcaagctggtgttcacgttgttgttggtacaccaggtcgtgttcacgacatgattcaacgtcgtgcntcttcctaccgatgccgtccaaatngtttgttcttgatgaggctgatgaaatgttgtcccgtggtttcaaggaccaaatttacgnacattttccaactntttgcctcctactgctcaagttngttcttctttctgccaccantgccntcnaagatgttttggnaagtcaccaccaaatttatgcgtgatcccattcgtatccttgttaagaaagatgagcttaccttggaaggtantcaagcaattctatgttgccgttgaaaaggaagagtggaagcttgacactctttgcgatctttatgaaaccgtcactgttactcaagccgttattttctgtaatacccgtagaaaggtcngattggcttaccgagcagctcactgagcgtgattttaccgtctcctccatgcacggtgatatggaccaagctcaacgtgatactttgatgcatgagttccgtactggttcttctcgtattcttatcaccaccgnatcttcttgctcgtggtatcgatgtccaancanagtctccttggttatncaactatgnacttacctgctaancagagaaaactacattcaccgtattggntcgtggtggtcgtttcggtcgtnaagggtgtttccattaactttgttaccaacngacgatgttcgcatgatgcgtgagattgaacaattctacaatacacacattgaggaaatgcctatgaacattgctgacttgatttaaaaaatacaaaagtcctttcttctctttgttctagatatggaacgctccgtgattgctcttctcgcaacc

SEQ ID NO: 25970 - DNA, 1227 bp, Schizosaccharomyces pombe
atgtttcgaacttgtacgaagattggaacagttcccaaggttcttgtgaaccaaaagggcttgatcgatggccttcgtcgggtcaccacagacgcaaccacttctcgtgccaatccggctcatgtgcctgaggaacatgacaagccatttcctgttaaattagatgatagtgtattcgaaggatacaagatcgatgtcccttctactgaaatcgaagttacaaagggagagttattgggtttgtacgagaagatggtgactattcgtcgtctagaacttgcatgcgatgccttgtataaggctaagaagattcgtggattctgtcatcttagcattggccaagaagctgtagctgcaggaattgaaggtgctattacacttgacgacagtattatcacatcttatagatgccacggttttgcttatacccgtggtttgtcaattcgaagcattattggtgagctcatgggacgtcaatgtggtgcttccaagggcaagggtggttctatgcacattttcgccaaaaacttctatggtggtaatggtattgttggtgctcaaattcctttgggtgctggtattggtttcgcacagaagtatcttgaaaaacccactactacttttgctctatatggtgatggtgcatctaaccaaggtcaagctttcgaggccttcaacatggccaaattatggggtcttcccgttatttttgcttgtgaaaacaacaaatacggtatgggtactagtgctgaacgctcttctgccatgactgagttctacaaacgtggacagtacattcccggtcttttggttaacggtatggatgttttggctgttttgcaggcttcaaagtttgctaagaagtacactgttgaaaactctcaacctctgcttatggaatttgtgacttatcgttatggtggtcactccatgtccgatcccggtactacttatcgtagccgtgaagaagtgcaaaaagtacgtgctgctagagatcctattgagggtttgaagaagcacatcatggagtggggcgtcgctaatgccaatgagcttaaaaacattgagaagagaatccgtggtatggttgatgaggaggttcgtatcgctgaagaaagccctttccccgatcctattgaggagagtttgttttcagatgtttacgttgcaggaactgaacccgcttacgcccgtggtagaaattccctggaatatcatcaatataag

SEQ ID NO: 25971 - DNA, 633 bp, Schizosaccharomyces pombe
atgactaccgaagctgcacctaacttgctcgtccttacccgtcacggtgaatccgaatggaacaagttgaacttgttcactggttggaaggaccctgccttgtccgagactggtattaaggaggccaagctcggtggtgagcgcttgaagtctcgtggctacaagtttgacattgccttcacctctgctcttcaacgtgcccaaaagacctgccaaatcatcttggaggaggttggtgagcccaacttggagaccatcaagagcgagaagctcaacgagcgttactacggtgacttgcaaggtttgaacaaggatgatgctcgtaagaaatggggtgctgagcaagtccaaatctggcgccgttcttatgacattgctcctcccaacggtgagtccttgaaggacaccgccgagcgtgtcttgccctactacaagtccaccattgtccctcacatccttaagggtgagaaggttctcattgccgctcacggtaactctctccgtgccttgatcatggacttggagggtcttactggtgaccaaattgtcaagcgtgagcttgccactggtgtccccattgtctaccacttggacaaggacggcaagtacgtctccaaggagctcattgacaac

SEQ ID NO: 25972 - DNA, 963 bp, Schizosaccharomyces pombe
atgtctgctgaacaaaagtatttcgaaaacgctcaaaacgttcatttcacacttgctgatggcagcaaaatccccggtttgggattgggtacctggagatcggagcccaatcaaactaaaaatgccgtaaagactgccttacaatatggctatcgccatattgatgcagcagccatctacggtaacgaggatgaagtaggtgatggcattaaagagagtggtgttcctcgcaaggacatttgggttacctcgaagctttggtgtaatgctcacgctcccgaggcagttcccaaggctttagagaagacattgaaagacttaaagttagactacttggatgaatatcttatccattggcctgtcagctttaagactggtgaggataaattccccaaagacaaggatggaaatctcatttacgagaaaaaccccattgaggaaacctggaaggcaatggagaagcttttggaaactggcaaggtacgtcacattggtctttccaacttcaacgatacaaacttggagcgtatcttaaaggttgccaaggttaagccagccgttcatcaaatggagcttcatcccttcttacctcaaactgaatttgtcgaaaagcataagaagcttggtatccacgtcaccgcctactcaccttttggcaatcaaaacaccatttacgaaagtaagattcccaagcttattgaacacgagaccattcaaaagattgccaagtctaaaggtgaaggtgtaactggagccactattgctgtttcttgggcaattacccgtggtacttctgtaattcccaaatccgttaatgaacaacgtatcaagtctaacttcaaatacattcctctcaccaaggaggatatggacgaaattaatagtatcggtattcgtgcccgttttaaccaagctacttttagcaatgaacctgtttttgccggcttggaagacggtcgtact

SEQ ID NO: 25973 - DNA, 429 bp, Schizosaccharomyces pombe
atgcctgcctccaaagaacaaaccgatgaaatgaaagaggcatttgtcctttatgatatcgacaaagacggtttgattcctacgagtcatgtgggttccgttttgagaagtctcggaatcaatgttactgatgccgaattagcaaagctttctaatgaattaggcgatgccattgatgaaaaaaaatttatgagctttgtttccaacaaattaagggaaacagaatcagaggaagaatatataaaagcatttagagttttcgacaaggacaatagtggttatatcgaaaccgctaaatttgccgattatatgaaaacgttaggtgagaagctttcagataacgaagtacaattgatggtgcaagaggccgatcctactaattctggaagctttgactattatgactttgtacagagaatcatggcaaaa

SEQ ID NO: 25974 - DNA, 2907 bp, Schizosaccharomyces pombe
atgatatttcgaaaaagtatttccaaatctccatcaagcaagggaagcacagtatgctttcgctgcggacaggcatttcaacgtagagagacacctatttcgtttgggggtcatatgtggcataaggattgcttctgctgtacgaagtgcgataaaggattggagcacagtgatcaaatgctggtgcaaacctctgatggacgaccggtgtgtagctcttgcgcccatacctgtacagcgtgtcgtatgaggatcaaggactatgccctaatgtcaggctacgactcctatcacagagagtgttttcgttgccatgattgccgaaagcaaataattgactctaactttaaaagagataataggactatattttgtaatgattgtaaacaagtccgtcacccttccaggtcttcagacgagagcgctgattatcacaattttgaggttgatgtcacgattaagcccacagagacaaagtcttcagtggaatctaataagtctttaagcattgaaattatgtctcctcaaaagccaccattatcaccttttggtggaagcagagaccgcttagttagcgaaacaccgactaacatgagtcaggcagaagggggtaatgtgccgaacgatggacaggatagtaatcttgcgtctaattctgcagattcgctgctgcctagtgccaaaaatcgaagtttttcctcgtttacgagttttgaatcgccgatgaagtatgacgattctttctttcctatttcaccttctatatctccgttacaaaaagttaacaagcagcaacaaattgagtctcctacagccacatttccgttaagcaaaaatacttggaagaatcgattccatacgtttcacaaacaatcttttactcctgttaacgatagctcttcctcggacagcttaaaacccacaattaatgaggaagccctggacgactttgctggctctgcttctccttataaaaccatgtcattgactgaccgagcagagccaattgtcatgaatggacatatgcgttctcttcacaatgccacctctccctttcggcctttttctccctcttacaggtcgagtgatacgcattcaccgagaacccgctcaccgaatgtccaaacccataaaaaaacctcttctcagccatctgacctttcatcttttgcgcagctactttcaccgcctcaggttctttctcccaaaccaaatggcgggggccataaaagttttcggcattcgcattctctttctgagacttctcagcaaacactcgttccttcgctgggatctaatggagagtaccatttaccgacaaacgatcattcttcaactccagcacaatcagagcgagattcggatgttgaagaattgcgtgaacagttggaaaatcttactgctcttaccaaaaaattgtccgaaaggctctcaagttctacgtttgacaactctaagtttattcgtacggaagataaggatactgttcgttcggctaaacttgaaatttgtgaaaagtttttttcgtttgctgatgtgacagatgatcccacgctgaaagatccgaaacatcaggatttggtggctgccgccaatgcttacatggcaatgcttcgtgagagttacggcactgaaataaacaatcttttggaaaggagaaatgagctgcttgacgattacaataatgtacaaaaaattttaaatgaatcgcttgaagcatctgtacacctaaataccaaaaatctcgagttggccgacttaaacaacaatttggtaaaacaaattcagcatagagtacctcctgaaaaccaatccaatttggagcatactattaccacatcttccaaaaatacaaccagcagtattaatccacttactgccgtgagtagcaactctgggcagtcatcaggtcgacctggtccgttgtcaccaaatttgaatgtgactacgagaattgacattaagggaaaaaagggaagtatgcatttgcaaccaagagatgtaaaccgtaaagtcccgttcaaatcaatgcatactaaatcaaagtctgccgatcctgtagtaggaaatgaagatcgtactcaatgtgaccatgtgtttcatgttaatgccatattcaagccctcaaggtgttatatatgctcggagagcgtatggggatctgaactccgctgctttcattgctcaatttcatgccattcgcggtgtttaaaaaggctgtttgcagagtcggagcatgagaaaacaatgagtgaaactgtaagtgaaaatagtaaatggatgccggaaatgccaacgaggatgcctcctcctgggccttcaccaacgatgtttggacgatcgttagaaaatcaattgaaaattgaagggtcggttttgcctcaagtaattgctatgtgcgtttcttgcgtggatgcgcatggattggaggttgaaggtatttataggatatctggcagtgcttctcaggtccgagtgttagtcgacgaatttgaaaacgggtctatccgaatggagcatttgacttctgacttgtttgcctgtacgtcggttttgaaaacatatttgcatcgcttaccggaaccagttatacctggcactcaatacgaggagttgttggaagcggaaaaaatcgaaaaggaagaggaaaaaattgaacgggtagtggaagtaatgaaaacgcttcatcctgcacatttgagcgtatttcgatttttgattgcacatttgggtcgtgtatgcaagcacgcggagaaaaatttgatgaactcgaaaaatgtctctacagtatttgcacctactttaatgcgagataaggtgaatcggtttgatttacagcatgctaccaaaaagagtacggctcttcagtttatgcttgataacgtggataagattcttcataatctg

SEQ ID NO: 25975 - DNA, 1446 bp, Schizosaccharomyces pombe
atggctgtatcagctgttccccatccttccaagcaagcgcaggcttcggaggagggaataaatcaagaaaaatgcatcaatgaaggtatgtctgcaacgttttaacatacaatttctagttgatcaatgtaaaatgtgtttctaatctgaaacagagtataaaatttggaaaaagaactcaccgttcctttacgatttaataattactagagctttggaatggccttgtatgtcactacaatggtatccagagcagcaaatgtaagtcaatcatttgaatcataatgtttaatcttgtttatgtgactcaaaaaacttaccattattttttgttatagttttgcagaacatggatatactgagcagaaaatgtttctgggagttcgtgctgatgttggcaaatacttactagctgttgcgtctattcaattaccctatttaaatcagactgttcctcctactacaatggagggagcatctgcgggtgacgagtcttctctacgtgttaatatctcaaatctttattctcatcctgagtctgtttgtagtgcgaagcttatgccacaagacgattcttgtgtagctacggtgggtaactatcataatgatgtgttggtttttgacaaggaatccttcgaatcttatagctcggctagtgagtctcctcttaagcccaaatatagattgaccaaacatacccagccctgtactagtgtttgttggaattttctttctaagggtactttggtttctggatcgcaagacgctactctttcttgttgggatttgaatgcttacaacgagtcagattcagcgtcagttttgaaagtgcatataagcagccatgaaaaacaggtcagtgatgtacgctttcattataagcaccaggatcttcttgcttcagtttcctatgatcagtaccttcatgttcatgatattcgtcgccctgatgcttccacaaagccagctcgaagtgtgcatgcccatagcggtcctattcattctgttgctttcaaccctcataacgactttattttggctacttgttcgactgacaaaaccattgcactttgggatttacggaaccttaatcaacgcttacatacattagaaggacatgaagacattgtaacaaaaattagcttttctcctcatgaagagcctattcttgcttctacctcagccgatagaaggaccttagtttgggatctttcaagaatcggggaagatcagcctgctgaggaagctcaagacggtcctccggagcttctttttatgcacggaggccatacttcttgtacaattgacatggattggtgtcctaattataattggacaatggcaaccgctgctgaagataatattcttcaaatttggacaccttctcgctcaatttggggtaatgaacaattagaggaagatgctacggcatatttaagttaaccg

SEQ ID NO: 25976 - DNA, 3012 bp, Schizosaccharomyces pombe
ataaagaataggatgttccgacgaatgtcggatttggaaagctatccggctgtgatgcgggatgttgcagaattaaaagatgacaacgaacgtttaaacttggatactatcaaacgtaatgcgctagttgaattgaagaaattacgactcatcaaacagcaagaatctcttcgccatcaagtgatgcattgccaaccgcatttacgtaccatagttaatgccgtagaacgcatgtcatgccgccgtcctaagctagttcctcaagctacacgcctgactgaagtattagagcgccagcaaagaagtgatcgcgaaagaaggttaaagcaaaaacagtgcgattatctgcaaactgtatgtgcccatggtcgagagattaatgtccgaaccaagaatgctcaggcaagggctcagaaagcgaatcgcgctgtattggcgtatcattcgcatatcgaaaaagaagaacagcgtcgtgctgaacgcaatgcaaagcaaagattacaagccttgaaggagaatgatgaggaggcctacttgaaacttattgatcaagcgaaggatacaagaattactcatttattacggcaaactgatcattacttggattccttggcggctgctgttaaagtacaacagtctcaatttggtgaatcggcctatgacgaagatatggatcgccgaatgaatcctgaagacgatagaaagattgattattataatgttgctcataatattcgtgaagtcgtcactgaacagccttctattttagtaggaggaaagctgaaggaatatcaactacgtggtttgcaatggatgatttcactgtataataatcatttgaacggtattcttgctgatgaaatgggcttaggtaaaactattcagacaatctctcttattacccacttaatcgagaaaaaacggcagaatgggccatttttggtaattgttcctttatcgaccttaacaaattggaccatggaatttgaaagatgggcgccatcaattgtaaagattgtttacaaaggacctccacaagttcgaaaagctttgcatcctcaagttcgtcactctaatttccaagttcttttgacgacatacgagtatatcataaaagatcgaccacttttaagtcgtattaaatggatttatatgatcattgatgaaggacatcgtatgaaaaacacacaatccaagttaacaaatactttaactacctattattcatcacgttatcgtcttatccttacaggaactcctttacaaaacaatcttccggaactttgggctttgcttaattttgtattaccacggatttttaattccattaaaagttttgatgagtggttcaatactccttttgctaatacaggcgggcaggataagatggaacttacagaagaagaatctttgcttgtcattcgccgtcttcacaaggtcttacgtccttttcttttgcgacgtcttaaaaaggatgttgaagccgagcttcctgataaagttgagaaggttattcgttgtcagatgtcggggcttcagcaaaagctctattatcaaatgaagaagcatggaatgttgtatgtggaagatgctaaacgcggtaaaactggtatcaaaggcttacagaatacggtcatgcagttgaagaaaatctgtaatcatccttttgtgtttgaagacgtggaacgttcaattgatccaacaggatttaactatgatatgttgtggagagtttctggcaaattcgaactgttagaccgtattttgcctaaactgtttcgttctggtcatcgtatattaatgtttttccaaatgactcaaattatgaatatcatggaggattacctgcattatcgtcagtggagatatctgcggcttgatgggtctaccaaagctgatgatcgttcaaagttattgggagtatttaatgatccgactgctgaagtaaatttgtttttgttaagtactcgtgctggtggacttgggcttaatcttcaaactgctgatactgtaataattttcgactcggattggaacccacatcaagatttgcaggcacaagatcgtgctcatcgtattggacaaaccaaagaggttagaatttatcgactgattactgaaaaatcggtagaggaaaacattcttgctagagcccaatataaattggacattgatggcaaagttattcaagcaggaaaatttgacaacaagtcaacaccagaggaacgtgaggcgtttttgcgttcgctcttggagaacgaaaacggtgaagaagaaaatgatgagaagggcgagttagatgacgatgaactcaatgagatacttgcccgaggtgacgatgagttgcgacttttcaaacaaatgactgaagatttggagagggaatcgccatatggtaagaataaagaaaaagaaagactcatccaagtaagtgagcttcctgaattttaccaaagggaagaacctgagaaaaccaccgacttgttgcaggaagaaccactcggtagaggagcccgcagacgtaccccagttgtatatgacgaagcagtacgagatgctcagtggatggcagaaatggatatggaatctgaagctcgtccaactcgtggtcgcccaaagcgtaatatagcgagtgttgacgaaacacctgctcttacactcaatggaaagccaaagaagaaacgtggaccggctccggatacacttacttcagagcaccgttcgctacttcgtcgtgtgtgccttgaaatatacaaggccgttaatgagcttgaagatgataatggtcgtcctctgaataaactatttttggagcttcctagtaagaagttatatcctgattattacatgataattaaatcccctatcgcacttgatgcaattagaaagcatatcaatggcactttctataaaactttagaagctatgaaatcggatcttatgacaatgtttaataatgctaggacgtataatgaggaaggttcttttgtctatgaagatgcgaacaaaatg

SEQ ID NO: 25977 - DNA, 633 bp, Schizosaccharomyces pombe
atggcgtctgcatcaccttcatcttccagaagactgacaaaagtaagtaaatttttatatttttactttattcttacatagctaatattcaaatggtaaccaggaatattctgacttgcgagaacaccctattccagatattcgagttaacctagttgacgacaatctatttcactgggcttgtacagctcttggtccatcggattcggtgtacgcagggggaaaatttcatttctcattaaaatttcctttggactatccatttcagcctcctactattgagtttactaccagaatataccatccaaatgtaagcattttatcgtatttctgtatggagtaatcattgatcacatttttaaacgagatacataattatttatatatttatgaattttctaacctgtttagtttgactctgaaggaaacgtttgtttggccattttgaaacaacaagttttcaaacccagcatcaaactgaggagtgttttggagcaaattttgcaacttcttagggaacctaatcctgacgatcctcttgtagcttccatcgctgaacaatatcgaaacgatcgcccttcgtttgacaaaattgctagggattatgtcgagcaattcgccaagtcttgaaac

SEQ ID NO: 25978 - DNA, 1167 bp, Schizosaccharomyces pombe
cttgccagcatagacactgattcacatttgtcgccaaaagtccttgaaaaactgagaccgacagagaaccttgcatacgaggatgacagtctagatgatgacacatggcgttccaagagatgggagtttgattatcagtattctggtatatctacctttgctcatttgccgcatgtaagatgtttggttgagcaatcagaagactttgatatagccataataggcgtcccgttcgatacggccgtgtcacatcgtcccggtgcacgtttcgggcctaaaggtattcgttcagcctcttcccgtcaaatggcaattaggggttttaacccctcgttgaatgtcaatccttatgaaagctgggctaaaattcttgattgcggcgatattcccgtatcctcatatgacaatcagttagcagttaggcaaatgaccgaaggatatattgatctactttctcgtaaagccactgcttcccctgcgtctaacaatcttaaaacggcgggattagccaaagatggaatttttcatcctcgacttattacactaggtggggatcattcaataggccttgcatctttaagagcactaggtcatttttatggaaatgttagtgttattcatttcgactcacatttggacacatggaatccaaagagatattatccttcttactggcattccgatcgagcagatttcactcatggaacaatgttttggatggcaagtaaagagggtttgatcaacaacggcacatccattcacgccggtttacgaactcgcctaagtggaaccgattactatgactacgaagaggataaccgagtcggatttacctttattgaagcgcaagaaattgacgaaatcggggttaatggtatcgtcgagcgtattaagcaagtcgttggagacactcttgtttatttaagtattgacattgatgttgtcgatcctggattggcacctggaactggtactcctgaaacgggtgggtggactacacgagaaatgaagagcattcttaggaagctggacggacacttgaacctcgtaggtgctgaggtggttgaagtgtctcctccttacgatgaccgtgctgaaagtacatctttggcagcttcagatttcatctttgagatactgtcgagcatggtgaagcatccattatac

SEQ ID NO: 25979 - DNA, 945 bp, Schizosaccharomyces pombe
aaagaatttgctaagaacgcacgtgaagcttacttcacgcttcctaatggtgataaaataccttctattgggcttggtacttggagatctggtaaagatgaaaccaagaatgctgtttgcgctgctttgaaggcaggataccgccacattgatacggctcacatttatggaaacgaaaaagaaattggtgaaggaattagagagagtggagttccacgtacagatatatgggtaacctccaaactgtggtgtaatgcacatcgggcgggactggttccgttggcacttgaaaagacccttcaggatttaaaccttgaatacattgacgcgtatttgattcattggccattcgctttactttcgggtcccgaagagttacctagaaatgagaagggtgaattgatatacgaagatgttcctattgaagagacatggcaagcaatggaagaacttctcgaaacaggaaaagttcgatacattggtatttccaatttcaataatgaatatcttgacagagtactgaaaattgcaaaggtcaagccaacaattcatcaaatggagcttcatccttatttacctcaaactgagtatttggagaagcataaaaagcttcaaattcatgtatctgcctactctcctcttgcaaatcaaaatgatgcatacaatagtgatatttcaaaactcattgagcacaaaactcttgttgacattgccaatgctcgtggagaaggtataactcccgctaacattgcaatctcttgggcagtgaagcgtggtacatcagtgcttcccaaatcagtcaacgaatctcgtatcgtatcaaattttctgtacatacccctcaccgacaaggaaatggaagcaatcaataacattggtgtagttagacgttttagccatggtaagtttgctcccaagccaatgttcgtgggcttacaagatggc

SEQ ID NO: 25980 - DNA, 1305 bp, Schizosaccharomyces pombe
gtatttcgtaatatctttggagatgctgaaattcgaaaaatttggtcagatgaaaatcgcactcaagaatacttaaactgggaagctgcgttagcaagggcagaagcatcattaggcataattccgaaatatgctggtgaggaaatccaaagggtttgtaaagttgagaacatagatttctcgaagctagaggaagagaccattaatattgggtatccagttcttggagtagttcatcaactcgccaatctatgtagcggtgattcaggaaaatactgccattggggtgcaactactcaagatgtgacggacagtgctactgtacgacaaatgatcgatagcttcaaaatcataaagggctatctcgaaaaagcaattgaacttgcaaccgttcttgtaatcaagcatcgtgaaacaactatggctggtcgtagcaacctacaacaggcggttccaattacgtttggatttaaaatggcaagatttgtcgctacattacgcagacatcaccaaagactttgtgaattactaccaagggtgtccgtattggaatttggaggcgcctgtggaactcttgcatctttagaaaataaagggttgatggttcagcaaaagcttgccgaagaattagggcttctccagccagaaattgcctggcatactgagcgcgatcgcattgctgaagctggttgcttcttggggatgctcacaggaacgcttgctaagtttgcaacggatatcaagctgttgatgcaaactgaagttgctgaggtttttgaaccatttaaagctaatagaggttcttcatctactatgccacaaaaaaggaatcctatttcatgcgtttacatcaccgcgtccacaagtttcgtaagacaaggagtagcggcattacttgacgcgatggtagaagatcacgaaagggcaacaggagcttgggaaattgagtggattgtactaccagatgtttttgtacatactgttggtacattaaagcaaactgtttttcttttagaaggcttggaagtacatccgagtcgtatgaatgagaatctttcaattactaatggattgattgtttcagaggctgttatgatggctttagccccaaaattgggtagagatgaggcccatgatttagtttatagactctgtcatcttagcattcaagaaaacaaacctcttgttgaacttctacttgctgagcgccaagttacaaattacttatctaaagaagaagtgacctctctacttaatccagaaaattatttgggttctacctttgagatgattgaacgagctttg

SEQ ID NO: 25981 - DNA, 2747 bp, Schizosaccharomyces pombe
gcagttggagaaacaacaattacgcttccagatctcgtaccagtagcgggaacagtagtagtaaaccaagaagtaccagaacccgtagtcgaagttaccgtaccagcagtaggtactacgatctcaacagttcctgaggtcgtaccttgagcagggatagtcgaggtaaacggaatagatccggaaacaatagtctctgtgacggtaccagcggtaggttcaaccacctcaacagttcctgatgttgtaccttgagcagggaatgtggaagtatacccaacagaacctgatattatggtctcagtaacggtaccagcggtaggttcaaccacctcaacagttcctgatgtcgtaccttgagcagggatagtcgaggtaaacggaatagatccggaaacaatagtctctgtgacggtaccagcggtaggtgcaacaatctcaacagttcctgatgttgtaccttgagcagggaatgtggaagtatacccaacagaacctgatattatagtctcagtaacggtaccagcggtaggttcaaccacctcaacagttcctgatgtcgtaccttgagcagggatagtcgaggtaaacggaatagatccggaaacaatagtctctgtgacggtaccagcggtaggtgcaaccatctcaacagttcctgatgttgtactttgagcagggaatgtggaagtatacccaacagaacctgatattatggtctcagtaacggtaccagcggtaggttcaaccacctcaacagttcctgatgttgtaccttgagcagggaatgtggaagtatacccaacagaacctgatattatggtctcagtaacggtaccagcggtaggttcaaccacctcaacagttcctgatgtcgtaccttgagcagggatagtcgaggtaaacggaatagatccggaaacaatagtctctgtgacggtaccagcagtgggttcaacaactatgacagcaccagacgaagtgtcatgagcagtaatcgttgacataaaagaaactgaccccgaaataacagtctcagtaacggttcccgcagtgggttcaactacttccacggtgaccagaggtagttccactagcagggaacgtggaagtatatccaacagaaccagaaacaatggtctctgtaatagttccagcagtgggttcaactacttccacggtaccagaggtagttccattagctgggaatgtggaagtaaaagttttagaaccagaaacaatggtctctgtaatagttccagcagtgggttcgactacttccacggtaccagaggtagttccattagctgggaatgtggaagtaaatgctttagaacctgacactatggtctcagtgatagttccagcagtgggttcaaccacctctacagtgccagaggtagttccactagcagggaacgtggaagtatatccaacagaaccagaaacaatggtctcagtaacagttccagcagtgggttcaaccacctctacagtgccagaggtagttccactagcagggaacgtggaagtatatccaacagaaccagaaacaatggtctcagtaacagttccagcagtgggttcaaccacctctacagtgccagaggtagttccactagcagggaacgtggaagtatatccaacagaaccagaaacaatggtctctgtaatagttccagcagtgggttcaactaacttccacggtaccagaggtagttccattagctgggaatgtggaagtaaatgctttagaacctgacactatggtctcagtgatagttccagcagtgggttcaaccacctctacagtgccagaggtagttccactagcagggaacgtggaagtaaaagttttagaaccagaaacaatggtctctgtaatagttccagcagtgggttcaactacttccacggtaccagaggtagttccattagctgggaatgtcgaagtatatccaacagaaccagaaacaatggtctctgtaatagttccagcagtgggttcaactacttccacggtaccagaggtagttccattagctgggaatgtggaagtaaaagttttagaaccagaaacaatggtctttgtaatagttccagcagtgggttcgactacttccacggtaccagaggtagttccattagctgggaatgtggaagtaaatgctttagaacctgacactatggtctcagtgatagttccagcagtgggttcaaccacctctacagtgccagaggtagttccactagcagggaacgtggaagtatatccaacagaaccagaaacaatggtctcagtaacagttccagcagtgggttcaaccacctctacagtgccagaggtagttccattagctgggaatgtcgaagtatatccaacagaaccagaaacaatagtctcagtgatagttccagcagtgggttcaactacttccacggtaccagaggtagttccattagctgggaatgtcgaagtatatccaacagaaccagaaacaatagtctcagtgatagttccagcagtgggttcaactacttccacggtaccagaggtagttccattagctgggaatgtcgaagtatatccaacagaaccagaaacaatagtctcagtgatagttccagcagtgggttcaaccacctctacagtgccagaggtagttccactagcaggaaacgtggaagtatatccaacagaaccagaaacaatcgtctcagtaatagttccagcagtgggtgaagtt

SEQ ID NO: 25982 - DNA, 3999 bp, Schizosaccharomyces pombe
atgtcctacgcaaattatcgttatatgaaagcaagagcaaaacgatggagaccagagaatttggatggaattcaaacatcagacgaacatttaataaacctttttgcaaaaatattatcgaagcatgtaccagagatagggaaattcgatcctaataaggatgttgaaagttacatttcaaaacttgatcaacactttactgaatacccttcattattcccaaatgagcatactaaaagacagtatacattgaatcacctagaagaattagagcaacaattcgctgaacgcatgttttctgagaatggaagtcttacatggcaagaattactcagacaaccagggaaagtacaaggatccaacaaaggtgatcgtttaactaaaacatttgaaggttttagaaatcaattggacaaagttcaatttataaggaaactcatgtcaaaggcaaatgttgatgatttccatactcgcttgtttatattatggatgctgccatattccttaaggaaattaaaggaaagaaattactggaaatcggaaatcagtgaaatttatgactttttagaggacaaaagaacagcctcgtatggtaaaactcacaagcgttttcaaccgcaaaataaaaatctaggaaaagagttccttccaaagaaaaataacaccactaatagcagaaacctgaggaagacaaatatttcgagaatagaatactcatctaacaaattcctaaatcatactaggaaacgttacgaaatggtattacaagctgaacttccagacttcaagtgctcaataccctgtctaatcgatacgggcactcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctatagctccagcacattttcaatactttatcaatacaatacttggtgaagtcaaagaatcgcatgtagtatgttatatggataatattttaattcattcaaaatcggaatctgaacatgtaaaacatgttaaagacgttctacagaaattaaaaaatgcgaacttaattatcaatcaagcaaaatgtgaatttcatcaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttctcctccggtgctacgacactttgatttcagtaaaaagattctactagaaactgatgcttcagatgtcgctgtaggagccgtattgtctcaaaaacatgatgatgataaatactatcctgttggatactattcagcaaagatgtctaaagcacaattaaattatagcgtatcggacaaagaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtagaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccaaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatc

SEQ ID NO: 25983 - DNA, 3999 bp, Schizosaccharomyces pombe
atgtcctacgcaaattatcgttatatgaaagcaagagcaaaacgatggagaccagagaatttggatggaattcaaacatcagacgaacatttaataaacctttttgcaaaaatattatcgaagcatgtaccagagatagggaaattcgatccaaataaggatgttgaaagttacatttcaaaacttgatcaacactttactgaatacccttcattattcccaaatgagcatactaaaagacagtatacattgaatcacctagaagaattagagcaacaattcgctgaacgcatgttttctgagaatggaagtcttacatggcaagaattactcagacaaacagggaaagtacaaggatccaacaaaggtgatcgtttaactaaaacatttgaaggttttagaaatcaattggacaaagttcaatttataaggaaactcatgtcaaaagcaaatgttgatgatttccatactcgcttgtttatattatggatgctgccatattccttaaggaaattaaaggaaagaaattactggaaatcagaaatcagtgaaatttatgactttttagaggacaaaagaacagcctcgtatggtaaaactcacaagcgttttcaaccgcaaaataaaaatctaggaaaagagtccctttcaaagaaaaataacaccactaatagcagaaacctgaggaagacaaatgtttcgagaatagaatactcatctaacaaattcctaaatcatactaggaaacgttacgaaatggtattacaagctgaacttccagacttcaagtgctcaataccctgtctaatcgatacgggcgctcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctatagctccagcacattttcaatactttatcaatacaatacttggtgaagtcaaagaatcgcatgtagtatgttatatggataatattttaattcattcaaaatcggaatctgaacatgtaaaacatgttaaagacgttctacagaaattaaaaaatgcgaacttaattatcaatcaagcaaaatgtgaatttcatcaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttcgcctccggtgctacgacactttgatttcagtaaaaagattctactagaaactgatgcttcagatgtcgctgtaggagccgtattgtctcaaaaacatgatgatgataaatactatcctgttggatactattcagcaaagatgtctaaagcacaattaaattatagcgtatcggacaaagaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtggaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccaaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatc

SEQ ID NO: 25984 - DNA, 1422 bp, Schizosaccharomyces pombe
atgtcttctactgccaccgttactgaaagcactcatttttttcccaatgagcctcaaggccctagcattaagaccgaaactattcccggtcccaaaggtaaggccgctgctgaagaaatgtccaaataccacgacatcagcgctgtcaagtttcctgtagactatgaaaagtccattggtaactatcttgtcgacttggatggtaacgttctcttggatgtttactctcaaatcgctactatccccattggctacaacaatcctactctcctcaaggctgccaagtcggacgaagtcgctaccattttaatgaaccgtcctgctttgggaaattaccctcctaaggaatgggctcgtgtcgcttatgagggtgccatcaaatatgcccccaagggtcaaaagtatgtttactttcaaatgagtggaagtgatgccaacgagattgcttacaagcttgctatgcttcatcatttcaacaacaagcctagacctactggtgattacactgctgaagagaacgagagctgcttaaacaacgctgctcctggatctcccgaagttgctgttctctctttccgtcactctttccacggacgtctctttggttctctttccactactcgctccaagcctgttcacaagcttggtatgcctgctttcccatggcctcaagctgatttccctgctttgaagtatcctttggaagagcacgtcgaagagaatgcaaaggaggagcaacgctgcattgaccaggtcgagcaaattttaactaaccaccattgccctgtcgttgcctgtatcattgagcccattcaatctgagggtggtgacaaccatgcctctcctgactttttccacaagcttcaagctactttgaagaagcatgatgtcaagtttatcgtcgatgaagtccaaactggtgtcggctctaccggtactttatgggctcacgagcaatggaatttaccctatcctcctgacatggttaccttttccaagaaattccaggctgccggtattttctatcatgatttggctcttcgtcctcatgcttatcagcacttcaatacttggatgggtgacccattccgtgctgttcaatctagatatattcttcaagaaattcaagacaaggatctccttaataacgtcaagtctgttggcgatttcttgtatgctggacttgaagagcttgctcgtaagcaccctggcaaaatcaacaacctccgcggtaagggaaagggtacttttatcgcttgggattgtgagtctcctgcagcccgtgacaaattctgtgctgacatgagaattaatggtgtcaacattggtggctgtggtgtagctgctattcgtcttcgtcctatgcttgtattccaaaagcaccatgctcaaatccttctcaagaagattgacgaattgatt

SEQ ID NO: 25985 - DNA, 3247 bp, Schizosaccharomyces pombe
atgatcttaacacgcgagagttacgcgttaggaagtattgtacgaattaaattagtgaactttgttacatacgattattgtgaactgttccctggtccatatctaaatttgattatcggtccaaatgggacaggtaagagcacaattgtttcagcaatatgcattgggctgggatggcccccaaaagtaagtctttcaatattataaaaaataacttaattgattaacgatttagctacttgggagagctaaagaggcccgtgaatttataaagtatggcaaaaacactgcaaccatagaaattgaaatgaagtatcgtgacgatgaaacggttactatcacgagacaaataagccaggataagagtagttctttctctattaatagggaagcatgtgccacttcttcaataacgtctctaatggatactttcaatgtacaattgaataatctttgtcattttttaccacaagaccgtgttgcagaattcgctcagcttgatccttattctagactgatggaaactgagcgtgcaattgaccatgaagggttacttcccgcacatgagaagcttattgatttacgaaaacgagaaagggaaattttacaaaataaaaaccaaggacaatcaacattaaattcattaaaagatagacaacaggcactagagaaggaagtcaatatatttaaagaacgggaaaaaatcaaatcatacatcgaaatgctagggttagctaaaatgttagttatatacagagagaaaaccaatgtctttaaccaacttcgtgcagacaaaaaaaaattaaaaaaggatttgaaagacctagtggaagaatttcaacctattttggataaaggtgaagagctgcgttcggatttaaaactaaaagatgatacatttaacgattactcctccgcttcgatggaacttaatacctcaaatttaagagccagagcttctttttcgaatttcatggagaacgagaaaaagctttatgagaaggttaataccaatcgaacacttttacggaatgcaaatcttacattaaatgaagcacaacaatcggtgaagtcattaacagaaagacaaggcccaagaccttcggataacggtgttcaagatctacaagaaaagatgcaagaagttaatgcggaaaaacttcaacatgaaaacgagaaacttgagagctctcatgaactaggtagtatcagaacattgaaagcacaaaagcttattgaccttgataacattaaaagagagttgtcctactacaacgatgctacgaaaaggaaactagactttatgtcttctgctccaggctgggaagatgcttatcagacgtatcagttattgaaggaatacgaatctgcgtttgaagcacccgcatacggcccaatttatatgaatttgaaatgtaaggaaaaagggtttgcagctttgatagaagggttttttcgcacggatacgtttcgaacatttataatgtcaaattataatgattatctaaagttaatggatcttatcacttcaaaaactaagtacactcctactataagagaattctccagtgaacgaaaaaagaagatagaagattttgaacctccatgctctcgtgagaagcttcagtctttcgggtttgacggatatgtgatcgattttttagaggggccagaagtggttttggttgctttgtgccatatgttaaaaattcatcaaattccgattgcaaaaagggaactacctcccgcatcagtgaatgcgttaaacaattttcgtctggctaacggggatccagttcttaaaacttacttggcgggctcatctatccacttggtttttcgttcagcttacggtgatagagaaattactaggcgaacagacccattaccttctcgcagtatatatttttccgagaacgttgagatggatttggtaaagcgaaaggaggagcaactaaatgctcaactctctcaattggaaaatttacagaatgaggaaagaaagttacaagaaaaggtaaatgagcacgaatcgctgctttctcgtacaaacgatatattatctactctacgaaaagagcgtgacgaaaaattaattcctattcacgaatggcaacaattacaagaaagaatagaacaccaaactcttctactaagacaaagagagaaagttcctgagcaatttgcagctgaaattgaaaaaaatgaagatatcaggaaagagaacttcgaagctcttatgaattcggtgttaaaagttaaggagaattcaattaaagctacgaataatttcgagaagatgttgggaagtagacttaatgtcatagaagcgaaatacaaacttgaaaaacacgagatggatgccaaccaagtcaacgctcgattgacagaagtacaagatcgtcttaaagatattaccgataagttagcctcagcaagggaggatgctatgtccttgtacggttcagtggttgattcattgcagacacaatcatctgacagacaaacggcaataactgaattaaatgaagaatttgctactagttcggaagtggataacaaaattagcatcgaagaaacgaaactgaagtttatgaatgttaatagttacgttatggaacaatatgatgcgcgtaaaaaagaaattgaggaactagaatcgaaaatgtcagactttgatcaatccgttgaagagctccaagacgagatgaactcaatcaaagaggattgggttagtaagttagaggagaatgttcaatgtattagcgatagattttctaaaggaatgagtggaatgggatatgctggagaagttcgactagggaaatccgacgattatgataaatggtatatcgatattttagtacaatttcgagaggaagaaggacttcaaaaacttacgggtcaacgacaatctggtggagaacgttctgtatctactataatgtatttattatctttacaaggtttggcaattgctccgtttcgaatagttgatgaaataaatcaaggaatggatcctcgaaatgaacgagttgtgcataggcatatcgtcaattcagtgtgtgacaacgctgtttcacaatacttcttagtcactccaaagttattaccagatttgacataccatcgaaatttgaaagtgctatgtatttgtaatggtgcttggttaccagcaacttttagaacatccctttctacctattttgaaaagttaaagaagtccgcactcatttcttcgtcataa

SEQ ID NO: 25986 - DNA, 1430 bp, Schizosaccharomyces pombe
atggactttttatcacatgccatgcttagtcgatctgaatcaacgcaaattctttgtgaattgagtcaaatagacgaaagtactatggatcctcaatatactgaagatgatgttctcgctcgattgtttgttttttcatcatcttctccacaaacaggtgtgttctcttgtttcaattgatttttgacatatattagtactgaatgttaagaaatatgaagacgtttctgttggaaggagtaatacatgcaattatcagcttctgcaattcactgccagttataagcactttagagtgtattcggtgctaatcgatgatgatatggatccccttgtttattgtgaagatcagagctctaatggaacattcttaaatcatcgtttaattggtaaaggcaatagcgtccttttatcggatggagatatactcgatgttcggcactgcgcttcctttcttttccagcagaaatacactactgataatgattttcatcacgagtatgcgggtgagagatttaacatcactcaaagactattgggaattggtggcttctcgcgcatttacatggcaatggataataacactgggggacaatacgcgtgtaaaatcatcgacaagaaaaaaatctcaacgaaacggtttttcgaggaccacgagatgacaattcttaggaaacttgatcatcctaacattatcaaagtaaacatggagtataattcggaaactcagttgtaagtagattgaatgcggtttgttattttgatgattaatattccttagttttatatttgaggaaatggtgacgggaggagatttgttcagttatttaacgaaattgggaacggttcctgaagttaccactttatttattatgtttcaaattctacaagggctaaaatatttacatgagcagaatataattcacagggatttaaaacttgaaaatattctcattgcgtcgtcctctgataccatttttagaatcattttaaccgattttggtgttgcaagatgtatgcagaagggaaaaagactttcgactttcgtaggcactccggaatataccgccccggaaatccaaagattaaaaggaaggtctcaagtggaaaaggaaaattcttctggttacggtaaagaggtcgatttatggagccttggagtaattatgtttttgctgttgtcaggtaattcaccatcatttgcagatggagtgaaagaaaaacaagtggattttcgagatcctgtttggaaatccgtctccaggcaagccaaagatctgatatcaaatcttttaaaaacgaatcccccagatcggttcacagtcaaacaatgtctttcccatccctggttcgcgcgacatagtagtcgtctcaccaaattatatgaaactcgtattctcaaacctcttaaacattcccggctatagcca

SEQ ID NO: 25987 - DNA, 1485 bp, Schizosaccharomyces pombe
gaacgtattcgtggagcctataaccaagctcaaatgatggagtctggacgtgtactttctattggtgatggtatcgcccgtatctctggtctttccaacgttcaagcagaagaactcgttgagttctcatctggcattaagggtatggcccttaacttggaagccgataccgttggttgtgtgctttttggtaacgatcgtttggtccgtgaaggtgaagtagttaagcgtactcgtcatatcgttgatgttcctgtaggcgaagctttactgggccgtgttgtcgatgcattgggaaatcccattgatggcaagggtcccattaagaccacagaacgccgtcgtgttcaacttaaagcccccggtattttgcccagaacctcagtttgtgagcctatgcaaactggtttgaaggctatcgattctatggtacctattggtagaggtcagcgtgagcttattattggtgatcgtcaaaccggtaaaactgctattgctttagatactattttgaatcataagcgctggaataactcttccgatgaaagcaagaaactatactgtgtttatgttgctgtcggtcaaaaacgttccaccgtcgcccagttagttcaaaaactagaagagaatgattccttaaaatactctattattgttgctgctaccgcttccgaaagtgctcccttacagtatctcgctcctttctcgggttgtgctatgggtgaatggttccgtgataatggtaaacacggtttggttgtttatgatgatctttccaagcaggctgtcgcttaccgtcaaatgtctcttctattacgtcgtcctcctggtcgtgaggcttaccctggtgatgttttctaccttcattcccgtcttttggaacgtgctgccaagatgtctcctaaacacggtggtggttctttaaccgccttacccgttatcgaaactcaaggtggtgatgtctcagcttatattcccactaacgttatttctattactgatggccaaattttcttggaatctgaacttttctttaagggtatccgacctgctattaacgttggtctttcagtctctcgtgtcggttccgccgcccaagtcaaggccatgaaacaagttgctggtcaaattaaacttttccttgcccaataccgtgaagttgcttcatttgctcaatttggatctgatttggatgccggtactcgtgccactttagatagaggtcttcgcttgactgagcttcttaaacaacctcagtactctcccttggctgttgaagagcaagtccctttgatttattgtggtgtcaagggttatctcgataaaattcctgttgatcgtgttgttgaatttgagcacaagtttatcccttatctccgaagcagcggtgctgagattatggaagctattcgtaaggagggtgttcttagcaagactaccgaagactccctgaaggcagttattaaggaatttttatcttctttc

SEQ ID NO: 25988 - DNA, 2276 bp, Schizosaccharomyces pombe
atcaccgtaagtcactttggtgagtctatttttctgccgtatcatcaagatatcgaatggattacctcaactgaaggtaccgtattatactacgatcaaagcacattttcactttctctgttttatccagatggaaaggaatatgggtcaaacgtcgatagtttgattacaagctttgtgctaacgtgtaaaaatttacatcgcaagcgatattcttcggatatggagtatatagctttttcttgctctaaggacagaagatggagacactcttattacgaggacgtttatctggttgaacgtgctaccgggcgtattgaacatttagcatctgatcagtccaaaaaaattgtggttgccgaatggtcaccgattggacacaaacttgtatatggtcttggatctaacctctttatttgggaatccttttctgaaccaccggtatgcattaccgaccaatccgacctagatggtttattcaatggtaactctgactgggtttacgaagaagaaattttgcaatcttctaaagcagtatggtggtctccggatggtaattgtctttcctatttatcaattgacgattctaaagtccctgtgcatgtattacctttcgaacaactcgatagtaaagttgaagatcagaaccgtgtaaataatttttttcattattcaactccaaaagatcctattccattcgttaagttattcgttaattgttttactgattctggcgaatccatagaggttgattcgtcttttccgctgtctacacagcatagatatataacagatgttgcttgggcaggtaatgaaaagctaatgtttgtcgaggttttgagaggtaattatgagagggttacaagtctttttgatttatcttccagaaagactacaatagagaataccgaagtgtcagaacatcccttggctttaacttctagtttacatttgaagtacctatcgttcgaatccctgggaaatttgaaagaaagatatgttcggcaatattttttgtctaataagaaaaggattgccatatatgaattagataatccagttcccatttatttaacgccggttaatatctcatttttaagtgatttatatctcattaataatactttgtaagtgaaagtttttgagtatgaaacatctaactttattacagatattttaccgctatcagcagcggcagcccattttcaagggtttatcgtttgtgcaccaaaagtttgatcctatccgaaataaatatccaaatcggtagtgggctgtttggtataaaagtttcaaatgatcaaaattatctgttggttaattacttgggcccagaaattccgaagcaatttatttattcgattcacgaagataaagtatccacgagcaatgatcattccaaaaataatttaccaagcgattcctcatcaacttctctaggtaaagtgaaattagaactttgcaattcgttagaaacgaacgaagaattaattatcaccaaagaaaaatttgctttccctagcgtcttctttaaggtaataaaagttaaaaatattaccgcgtacattcaagagatacggccccccaattttaacccgcgaaagcgttatcctaccgtttttcatttatatggtgcacctcaatctgctttagtgacggggaaatatgaaatggatatcaatgaactaatggcatctgtatataattttttggttattaaagttgatattgtggacatttcggatgtttctggtcaacatttattttctgatagtcatgaattgattatcaaaagttggatagagttgttaaggtcatatgttgacactccctacatcgacaggcatcgagtgggaatatggggttggagttttggtggctatcttaccttaaaaatccttgaaaatgctgattttattaaaactggtgcagtagttgcacctgttacagactggaggtattatgacgcttactattctgaaaatcttctcggtgcttattccaaacaaacgactgctatttacgacaaaactgctgttcattattctgaaaattttaggaaactatgtggacttctagtcctgcatggaacttctgatgacaatgtacatattgaaaacactatgcaactaaccaaagctatggttgaaaaaggcgtatataattactatccctttattgttcctaatgccaatcatgaattttcggatcctaccgattatacgtttcttagagaaaagctctccggccattttcatcacgctttatattgctag

SEQ ID NO: 25989 - DNA, 698 bp, Schizosaccharomyces pombe
atggctttgcctaagcgtattattaaggtttgcgctttctgttagcatttttcaactaataattggtaggaaattgaaacccttacgagagatcctccacccggaattgtagcggctcccactgaagataatcttcgctattttaaaattactatggaagggcctcagcaatcagcttatgaaggtggaaaatttcacttagagctgtttcttcctgatgagtatccaatggtaggttttttttgaaaacacagtattgagcctaccatggtccttttgctagccctgctagttcaacaaaaatttgaagaatggcattgtcagtttcaaactgtcttcaaaaaattgtataattgtgtaatttgagttttaacaactattagatgcctcccaatgttcgttttcttactaaaatttatcatccaaacgttgataaattaggtcgcatatgtttatctacgttaaaaagtatgttaaacttcacacgtttcatcttattttggtgtactaacattaataaatcagaggattggagtcctgctttacaaattcgaaccgtgctactttcgatacaggcattaatgggtgctcccaacccagatgaccctttagacaatgatgttgcaaagatttggaaagaaaatgagccacaggcaattgcaaatgcccgtgaatggacgaaaaagtatgcagtttga

SEQ ID NO: 25990 - DNA, 681 bp, Schizosaccharomyces pombe
atgtcgttgtcggatgaacaagtgcaagcagagatgcacaaaatggtgagctttattaagcaagaagctcttgaaaaggccaaagaaatccacactctgagtgaagaggagttccaagtggaaaaggccaaaattgttagagaacaatgcgatgccattgatcaaacttacgatatgaagctcaaaagagcctccatggcacaaaaaattgctaaatctaatgttttgaacaaaagtagactggagattttaaatagcaagcagaaagttattgatgacatattttcccgggtggagaagaaacttgatggaattgagcagaagaaagatgcctatactaaatttatggccgatttaatagttcaagctatggagttgttaggtgaacccgtgggcattgtttattctcgtcaacgtgatgctgaaattgtgaaggctgccattcctaaagctactgaagtcttaaagtcgaagaacggatctatagattacgaacttgacgctgagaccgatgatttccttaatgactctgtgcttggaggtgtcgttttagtaggtttgggtggtaaaattcgtgttgataacactttgcgtgctcgcttagagattgtgaaggaagaagcccttcctgaaattagacgtcttctcttcggtgaaaatcctaaccgaaagttcgataat

SEQ ID NO: 25991 - DNA, 282 bp, Schizosaccharomyces pombe
atgtctgatcccgcaagaaagtcttttactgaacaaggcaaggagaaaatgactcctgactcctccaagtctaccctcgacaaggccaaggaatccattactggtgcctacgacaaggtcgcctctgcttttacctctgacgaggacaagagcacctctcaagaggctcatgacaaggctcaacgctttgttgatgacaagttgtaaagaggttcttatgacttaaaattcatgcttttggctggtgaaactcaatccaccaaagcatcgggatgatttctt

SEQ ID NO: 25992 - DNA, 1107 bp, Schizosaccharomyces pombe
gtttttttacccagcggtgaaacttacgatcaagagcatcttgatgacaaccgtgtcttaggttacaaccctttggttcctgccgctttggttcaacaagagattcctgtttctgaaacttctcgcaaagtcatcactgactccagaaaggagattcaagctattctcaacaaacaagatgacagaattatcgttgttgtcggtccttgctccattcatgaccctaaattggccatggactatgctaagttgctgaagcccaaagctgacgagcttcaggatgctttgtgcgttgtcatgcgttgttatttggagaagccccgtactactatcggatggaagggtttggtcaacgaccctaacttggatggttcttttgctatcaacaagggtattaggatggctcgtcaaatgtattgcgacgttaccaattttggcattcctttggccagtgagatgttggacaacatttctccccaattcttcgccgacttactcagttttggtgctatcggtgctcgtactaccgagtctcaattacatcgtgaattggcttctgccctttccttccctgttggtttcaagaatggtactgatggtactgttggtgtggcgattgatgccattggtgctaccgcccatcctcacacaatgctaggagttactaaacaaggtctcgccgctattaccatgaccaggggcaacaaggataccttcatcattttgcgtggtggtaagaagggtcctaactatgatgctgagcacgttgccgccgttcgcaaagatcttgagaaggccaaccttcctcctcgtatcatgatcgattgctctcatggcaactcaagcaagaatcatttgaaccaaccaaaggtctccaagagcatcgccgaacaaatcagaaatggcgactcttccattgttggtgttatgattgaatctcatatcaatgaaggtcgtcaagatgctccaatccgtcctggcgttaaggatactctcaagtacggtgtcagtatcactgatgcttgtgttagctgggaacaaactgctccaatgctagacgatcttgctgaagctgtccgtgctcgccgtcaaaaccaaaaaagtaat

SEQ ID NO: 25993 - DNA, 514 bp, Schizosaccharomyces pombe
aagatagctttttctttatttgaccgccatggaactggtcgcatccccaaaacgtccattggtgatcttttaagagcgtgtggacaaaatcctacgctggctgagattactgaaattgaatctactttgcccgcagaaggtatgatttcttgttatgggtttggagagttatactccttagccgtgcattaagtgacaatactaattggtagtcgatatggaacaattccttcaagtgttaaatcgtcccaatgggtttgatatgcctggtgacccagaggaattcgtgaagggcttccaggtgtttgataaagatgccactggcatgattggagtgggtgaattgcgctatggtatgtatttatagagatctatccttttttcagattgataaaaaaatgcgaaactaattgtatcagttttaacttctttgggtgaaaaactcagcaacgaagaaatggacgagttattaaagggtgttcccgtaaaagatggcatggttaattatcacggt

SEQ ID NO: 25994 - DNA, 2084 bp, Schizosaccharomyces pombe
caagtgaacgatttgtatccgattgctgttttgattgatgagttaaaggttggtaacaaattgttttacgtctgatatgttcaactctgactattgttaaagcatgatgaaattacttataggctcaatgctttggaacggttatcgacaattgctctcgctttaggtcctgaacgtacaagggatgagttgattccctttttagatggtatgcattcaataataaaattatggaactataggtttaaatttttaaaattctttatattttttaataaacgatgtatgtttgtcggctaacattccttgaatacagaatcgattgacgatgaggacgaagtcctatcagctctcgccgaccagttaggaaattttgtagattatgttggaggccctgagtatgcgcatgtccttttgtctccccttgaaaatcttgctgcaactgaagaaacggtagtccgcgataaagccgttgactctctcaataaagtatgtatttgcctatcccaagaacaattagagcaatattttgttccattggttcaacgtctttcaaccgctgagtggtttacctctcgtgcgtcctctgctgggctttactgcgcggcatattctcagtcagaaaatcctgctgtcaaagtctctcttcgtcaaagttttagtcatctatgtcacgacgaagctcccatggtccgtcgtcctgcagcaacgaactgtgccaagtttgtttttttggtaactaaacaggaggctattgacgaattcattccattgttcaactccctttctaatgatgaccaagactcagttcggctcctttctttcgacattatggtttctttggcggaggtattaaaatctgactcggaaattcgtcactatttgcttcaaccattaaggtcttttgtttcggatagcagctggagaacacgttatatggttgctgctaattttgtaaaacttgctaaagtagttggaccatctcttattaaagatgaacttattaaaccattcgtactgctcatgaaggataccgagcaggaagtccgccgtgctattgctactcaaataccaggattttgcgaattgttggataagcgaattgttcttgaagagattattccagttattcaagagttaattaatgatcccgctcaacatgtccgtgctgctttagggatgaacataggtgctctcgccccacaattaggaaaggaaaagtatgtctgctaaaaataacttttcttttaaaaacctcattttactaatcgttatatttaggactacagagtatcttttaccaatgtttttggaattacttaaagatgaaaaccctgaagttcgtcttaacattatttcgaaattggaagttgtaaacaaaggtaaattgcaaattcaaaatatagctattgctacagttatactaactcactttagtcgttggtatcgaattactttcacaatctttattgcctgcaattgttacacttgctgaagataaacaatggcgtgttcgtcttgctatcattgactacattccactacttgctcagcagcttggggtcgaattttttaatgagaaaatgggcaatttatgtatgtcatggttagaggaccatgtatattctattcgtgaagctgcgataaagaatttgcgaaaacttacggaaatttttgggttggaatgggcaactgagacaattattccaaagtttttggctatgcgaagccatccaaattatttataccgaatgacaactatttttgcgatcagtgtaagtttttcttttttgcttttttccagttctaacgtattttaggaaatcgcacctgcattgaatgctgaagtaattgaaaaacaaattcttccaactttggaacagttggttaatgaccctattcctaatattcgctttaacgttgccaaggcgtttgaagttcttaagcctgttttggcagctggtggtgactcgaccgtatatgaacagcaaatcatcccattgctcgaacaacttacaaaagataatgaccctgatgttcaatattttgctactcaggccttagagcaaacaaatgactaattg

SEQ ID NO: 25995 - DNA, 3822 bp, Schizosaccharomyces pombe
atgaaatttcgtttaaatgctaatttcaacttctcgttccgacgttactgcttcgttcagtgtcgaaataaataccattctcacgtaaggtacttgtcatcagccaagaagtctggcattttacgaaactcttataatcaaagaactgaacgatattttacgaatattatgataccttcggattattcaaataaattctatcctgtagatggcgttgttcccaagcatgaaacacaagcttatgagtttttgaagaaatttcctgaatatgatggtagaggtgtcactgttggcattttggatacaggagtcgatcctggagctccaggtttatcggtaacaaccaccggtttaccaaaattcaaaaatattgtcgattgtactggagctggtgatgttgatacaagcgtggaagttgctgcagctgattcaaatgattacttgactattacgggtcgttcaggaaggaccttaaaattatcgaaagaatggaagaatccctcgaagaaatggaaagtgggttgtaaacttgcttatgagttctttcctaaggatctgagaaaacgattgcaaaaactagaaaccgaagacatgaacaagagtaatagaaagcttttacaagatgctacagacgagtatgctaaattcaaggataagtttcctgaagcaccgctcgataaggataacctacagacacagaaggaacttgaggctaggatcgagtgcttaaagcagcttgctgaaaagtttgacaatccgggaccactctatgatgtagtcgtattccatgatggtgaacattggcgtgtagttattgactctgaccaaactggtgacatatatttacataagccactcgctgattttaatgtagcacaagaatggtctacctttggatctctcgatttacttagctacggtgttcacgtttatgacaacgggaacataacatcaatagtcgcagtgagcggtactcatggtacgcatgtagctggtatcattggagcgaaccatcccgagacacctgaattaaatggcgctgctccaggttgccaacttgtttcacttatgattggagatggtcgtttggactctttggaaacaagtcatgccttttctcgtgcttgttcagaaattataaaaaatgaagttgatattataaacattagttttggagaggatgctggtattccgaataagggtcgcgttattgaactccttcgtgatgaacttgctggaaagaggaatgttgtcatagtttcttctgctggtaataatggacctgcttatacaacggttggagctcctggtggaacaacttttgatgtaatctctgtaggtgcatatgttacatctggcatgatgcaggcccaatacaatttactctcaacagtacatgacacgccatatacctggtgttctcggggtcctacactggatggtgacactggtgtatcaatctatgccccaggaggtgcaattacttcagttcccccttattccttacagaattctcagttaatgaatggtacaagtatgtcttctccgtctgcttgtggtggtatatctctaattctctcggctcttaaagctcaaaagaagccatatacagctgccgctataaagaaagctgtaatgtatacttcaaaggatttacgggatgattttaatactggtatgcttcaagtcgataatgcttatgagtatcttgcccagtccgattttcaatatactggtgctcgttcttttacaataaatggaaacattggcaatagtaagcgtggtgtgtatttacgcaatcctactgaggtttgtagtccttcgcggcatatgtttaatgtcgctcccaagttcgaagatggtgaagaatacgaaaaatcacactttgaggttcaactttccctcgcaactacacaaccgtggatccaggccccagaatatgttatgatggcgggtactggaagaggaattccagttcgtgttgacccgactgctctggctccgggtcaccattttggaaaggtcctagcatatgacgctagtaacgaatcccgtcgctgtgtgtttgaaatcccagtgactgtcatgaaaccttcctctatttctaacacttgtttttctcttcgtgatgtttcttttgaacctacattgataaagcgtcacttcttggtacctccgaaaggagcaacttatgttgagattcgtgtgaaggccacttctgaattggaatctactaacatgctttggattagtgttaatcaaaccatcccccaaactaagttaaatgaagcttctactgagttaattatgcctgtaactcagaatgaggttactaccaaactagtatcgattgacgattcttatacgttagaactttgtatggcacagtggtggtcttcgcttgaacctatggttttagatattgatgtcaactttcatggcattaaagttgttaatggcaaggagattaatttaatctcatcccaaggattgaagcgtgttgactgtgccagcataagacgtgaaaattttaaacctgatattacattaaaggactacgttgattcattcaaaccaacaaatacagttataaagcctttaggagatcgagatattatgcctgacggacaacaattattcgaattgatggcgacgtattctgttgaaatctccgagaagactgagctaaaggctgattttgcagttccacataacatgtatgataatggttttaatggactgttttttatggtgtttgattctcaaaagcaacgcgttcactatggtgacatgtatacttcatcgcataccttggaaaaaggagaatatctctacaaatttcagctactcagcgtagatccatctacccttgaacgtttcaggaatgttaccttaagattaaccaaaaagcttaaaaaaccaattactcttccactttatgctgatcatattgacttttgtgacaacaagacatatgagcgtgaaaatattgacgctggtgttgttgaaagcttcgttgttggtactaatatcgaaggagaacaatatgcatccgaactcaaagaaaattcgcttttaactggtgaattaaaatttggagattgtgaaaagggtaccgttccagtaacattggttttgcctcctaagatatcgactaaagaggatacaaaattaggcgaaaaatgtgccaatattgttcaattacaagttgatttgttgtcgaaattggcagaccaagaaaaagagaagcacttgaagtatttgcaatcttcttataaaaacagccttgaagttcagcttgctaaattggatattgttaaagaaaccaatgaacgtttatctactgcagattccatcctctccttaattgacactgaagccttgtccagatactacagttgtcaacagaaggtcgaagatacgatacctcgagatgtcgtgttagaaaagaaaatggcactgcagagagatgctttcatccgtgctttagtggttaagtgtgaaacatttagcacacaaggtcacaaggacaaagataattattttcagaactatcagttacttttgaattggcttgaaaactccgatcctcgagtatggcaaatcaagaaagattattacaaaagtcagaatcagtacgggttggcgttgaaagcgcttttggaactattgaaggaaaatggaaattccggaaaaatggacgttgcaaaacttctgtcagaagagaaagaattgcttgtaaacttaggttggaattattggcacgatattgtatttgtagaaacagtaaagcgtgttcctccttattcttatgcgttattt

SEQ ID NO: 25996 - DNA, 2109 bp, Schizosaccharomyces pombe
atgtcactctctaggtgtccaactgacaattcgtcctcccgtataaattcctctgttcctttaataaatagcagcagccctgctacacctccagaatcatttgatcctcaagtatttccttcttcacttattcatggggataacctgcttcctcaagatgatcaaattgcatcggatcctcgctcagaatcaaatagttgtaatggcaatacgagttcttccctgccgtgcactgattcgtatcagtacccattaaagcattcttgtacgccttcttttcttcgaaagtttaatgaaagtatagagaatgtctcttataaatgcttagaccactcaccgccagatagtgttcctggcgatttttccatttcccttgttcctcaaaggaattttctatattctcattcttctcttccacctaaaattatatcaattgatagaaacaatcgaattaagttagataatagcatttcatctaactccgacaatttccctccttctccgaaagtcgacacatcaaacactgtttcacctggtagtaaacctatctctgaggatcttgaagatttaaacttacagtcaattgttcaaacttttgaggatcttccagaaggaattcaatcttatgcgttttttcaactactccgttcgtgcaatcggcaatcgatgcgtttattattgaatgaatgcgagccgcttctaaaaaaagatatactttcaaatcttcctttttccattgttcagtctatattattaaatctggatatacattcttttctttcttgccgtcttgtttcgcctacttggaatagaatacttgatgtgcatacttcatactggaaacacatgtttagtttatttggctttcaaatcaatgaaaatgactggaaatatgctaatccaaacttaaatcgtccaccttttttgcacaacgaccaaatctcagatgactattttccggaaattttcaaaagacattttctcaatagaaaacgatggttatttccttcgatacctccaagtcatctatcttttcccattcatgttccaaactttatgataacttctttactacttcataaagacagaataatcaccacttcgggatctggaacaattcaaattcataatgctattaccggtgttttagaagctcgattagagggtcataaagaaggtgtttgggctgtcaaaatacatgagaatacacttgtatctggttcgatcgataaaactgttcgcgtttggaacatagagaaagctaaatgtacgcacatatttaggggacatatttccatcatcagatgcttagagatcttagttccgagtcgtcttattcgccatggagttgaaattgttgaaccagatcaaccgtacattgtcagcggctctcgggatcatacacttcgggtttggaagcttccaaaaaacacggatcctccttatcttccagataatacaaactctattgaccgttgggagaagaacccgtattttgtacatactttgataggacatacagactctgtacgaactatatccggctatggtgatatacttgtgagtgggagttatgattcttcaattcgcatttggagagtttcaacaggggaatgtctttaccatctgcggggtcatagtcttcgtatatatagtgttttatatgaaccagaaaggaatatttgcataagcggtagcatggataagtccattagggtttgggatttatcgacagggacttgtaaatatgtgcttgaaggccatgatgcctttgttacgcttcttaatgtattccagaataggttgatatcaggttctgctgactccacaattagaatatgggatttgaatactgggaaaccattaatggttttgccgtctaattcaggctacattagtagctttgtgtcagatgaacacaaaattattagtggtaatgatggttctgtaaagttatgggatgttaggactggaaagctgttacgttttctattaacagacctcacaaaaatatggcatgtcgattttgatgctatgcgttgtgtggctgcagtgcagcgtgatgatcaagcatatttggaagttattaatttttccggatcaagaccg

SEQ ID NO: 25997 - DNA, 4221 bp, Schizosaccharomyces pombe
atgagtacaagtgctatagcacttgctttgtcatcatctaaggctattgagcagctggatcacgttcaaactgaaacccctaatcttaagcaggaaatgtccgaatccccttcgaatagcggcgtagcctccaagcgcaaattacaatctactgaatggctcgacccagagctttacggtcttcgacgttctgtatgtctcacattattttattcattatgaaacttacttagatgctaatcattatagggtcgcactcgtagtaatccaggaagatatgtagacactgatgatcaagaagatgtgttcccatccaagcatcgtaaaggtactagaaatggttcatctttttctcgtcatcgaacaattcgcgatttagacgatgaagctgaatctgtcacctctgaggaaagtgagtcagatgatagttcttatggcggaactcccaaaaagcgatctcggcaaaaaaaatcaaacacctacgttcaagatgaaattcgattttcttctagaaatagtaaaggtgttaactataacgaagacgcgtattttgaatcgtttgaagaagaagaggaagaagagatgtatgagtacgcaactgaagtttctgaagaacctgaagatacacgagctatagatgtcgttttagatcatagacttattgaaggacacgatggctctacaccttctgaagattatgagtttttaattaaatgggttaatttttctcatcttcattgtacatgggaaccttacaataacatttctatgatcagaggatctaaaaaggtcgacaatcacattaagcaagtcatacttcttgatcgagaaattcgagaagatccgaccactacgcgtgaagacattgaagcaatggatattgaaaaagagagaaagcgtgaaaattacgaggaatataagcaggtagacagaattgttgccaaacacttaaactccgatggctcagttgaatacttagtgaaatggaagcagctgttatatgatttttgcacatgggaagcttcctcaattattgagcctattgctgccacggaaattcaggcatttcaagaaagagaagaaagtgctcttagtccatcaagaggtacaaactatggtaattcgcgtcctaagtatcgaaaactggagcaacagccttcgtatataaccggtggtgagcttcgtgactttcagcttacaggcgtcaactggatggcatatctttggcataaaaatgaaaatgggattttggccgatgaaatgggtctcggtaagacagtccaaactgtggcttttctttcatatcttgcacattctttaagacagcatggaccttttcttgtagttgttccactttctacagttcctgcctggcaagagacattagctctttgggcttctgatatgaattgtataagttaccttggaaataccacctcaaggcaagtaataagggattacgaattttatgttgatggaactcagaaaataaagttcaacttgcttctaactacttatgagtatgtactcaaagatcgctcggtgcttagtaatataaaatggcaatatatggcaattgacgaagctcatcgattaaaaaacagtgaatcgtcactttatgaagcactttctcagttcaagaactcaaatcgattacttataactggaacaccattacaaaataatattcgtgagcttgcggctttggtagacttcctgatgccaggaaagtttgagattcgtgaggaaattaatttagaagcaccagatgaggagcaggaagcttatattagaagtttacaggagcatttacaaccctacattttacgaagattaaagaaagacgttgagaaatctcttccttctaagtctgaacgtatccttcgtgttgagctttctgacttacaaatgtactggtacaaaaatattttaactcgcaattaccgtgtccttactcaaagcataagttcgggaagtcaaatatctttactaaacatagttgtggagttgaaaaaggcaagtaatcatccttacttatttgacggagtagaagagtcatggatgcaaaaaataaactctcaaggaagacgagatgaagtcttaaaaggtttaattatgaacagcgggaaaatggtgttacttgacaaacttctatcacgtcttcgtcgagacggccaccgcgttttaatttttagtcaaatggttcgtatgcttgacattcttggtgattatctttctttgaggggatatccacatcagagactggatggcactgtccctgctgctgtacgaagaacttcaatagatcattttaatgcaccaaacagcccagattttgtgtttttattatccacacgagctggaggattaggtattaatttaatgactgctgatacagttattatttttgattccgattggaaccctcaagctgatttacaagctatggcacgtgcgcatcgcattggtcagaaaaatcatgttatggtatacaggcttctttccaaagatacgattgaagaagatgtcttggaacgtgcacgtcgtaaaatgattcttgaatatgcaattatttcattaggtgttacagacaagcaaaagaattccaaaaatgataaattttctgctgaagagcttagcgctattttgaaatttggagcttctaatatgtttaaagcagagaataatcaaaagaagcttgaggatatgaatttagatgaaattttggaacatgccgaagatcatgatacttccaatgatgtgggtggagccagcatgggtggtgaagagtttttgaaacagttcgaagttacagactataaggcagatgtatcttgggatgatattatacccctaactgaacgtgagaagtttgaagaggaagaccgcttaagagaagaggaagaagcgcttaagcaagaaattgagcttagtagtagacgaggtaatcgtccttatcctagctctgcggtggaatccccatcctactctggaacttctgaaaggaagagcaaaaagcaaatgcttaaagatgaggttttactggaaaaggaaattcggttgctttatcgtgctatgattagatatggaagccttgagcatcgctacaatgacattgttaaatatgctgatcttactacgcaagatgctcacgtaataaaaaagattgcagctgacttagtaaccgcttcacgcaaggctgtatcagcagccgagaaggacttatctaatgatcagtctaataataagtcatctcgtaaagcgctgctcattacatttaaaggtgtaaaaaatataaatgctgaaacattggtacaaaggctaaatgatcttgatattctttatgatgctatgccaacgtcaggatattctaacttccaaattccaatgcacgttagatctgttcacggctggtcctgtcagtggggaccccgagaagattccatgttgctttctggaatttgtaagcatggatttggagcttggttagaaattcgagatgatccagaactcaaaatgaaagacaagatctttttagaagacacaaaacaaacagacaactctgtccccaaagataaagaaaataaagagaaaaaggtaccttcagctgtgcatttggttcgtcgaggtgaatacctacttagtgctttacgtgagcatcaccaaaattttggcataaaatcaagccccgctattagtactaatggaaaaactcaacctaagaagcagacggctaatcgcagacaaagtggcaagcctaacgttaaatctgcgcaaaaaatagagagtgcaactaggacaccatcgcctgcaatttcagaatctcgtaagaaaccttcttctaaagacacgaagattgaaacacctagtagggaacagtctcgcagccagacagcttcacccgtcaaatctgaaaaagacgatggtaatgtaagtctaaatgctgaacaaaaggcacgctgcaaagaactgatgtatccagtccgtaagcatatgaaaagacttcggaaagattctagtgggcttggacgcgcggagttggtgaagttacttactgagtgtttgacaacgattggaaagcatattgaaaaaactgtcaatgatacaccctccgaagaaaaagctactgttaggaagaatttatggatgtttgcatgttacttttggccgaaggaggaggttaaatataccagcttgatcagcatgtatgaaaagatgaag

SEQ ID NO: 25998 - DNA, 2547 bp, Schizosaccharomyces pombe
atgccttcaggcgcgcaaggaaatactcaatcagctgcttataaacgtattgttaatgtctctcgaaattttcaatttaaagcagccttaaataaagatactcgcgaatggacgtttcagcatcgtagtagtggcactgccctttactcagcaattgcttcattgggagatcctagttcaccctgggacgccgtgtacgtagcttctcctggacctgtacaaatttcggaaggaaatgaccatacagtggaaactaagattgatgaagctgctgttgttcatcgttcttcgtcgattgtcataagcccagaggatcaagaaatttttctaaagaaggctactgagtattacaggaaaaagaacatagaagctgatattgtccctgtatggggcaaggttcaacgtgtaccacaagctaagtcctcgtccgcgactattactccatccgtgtctaacaaactttccacggcttatcaaagtattaaatcagaagcattgaaggatggaccaatgtatgctgatagcgtcttatgggatgtgctacattatagaattccaaccttagatggataccagcagcataatttatggaaaaactttactcgatggtctcaatattttgctgacaatattgtatctaactatcgtcctggtgatctaatattaatacatgattattccttatttcttcttcctaggcttattcgtaagcagctttcagatgctcctatcgttttctttttgcatgctcctttctgtacttctgaagtttttcgttgtttatctaaaagagctgaaattttaaagggtgtattagcatcaaatgttattgcaatgcaaaccgactcatacactaggcattttttgagtacttgttcaaatgttcttgggttagaaaccacttccacacatatagatacttctgatggattccgcgtggtagttttctcttcacatgtgagcattgatgttccacgtgtctattcccgttgtaacagtaagcctgtcagcttaaagattcaacaactcaaatcgctttatccctctgataaaaagctcattgtagggcgcgaccaattaactaaagcttgtggtgtcactcacaaactacgcgcatttcgagaactactaatacatttccctaaatggcgtggtcatgttgtccttattcaaattacgagccttcctgtaggcaataattattctaatgaagaactcaaaaaaacagaaaacttagttgcccaaattaattcagaatttggttcactggattatacaccagtcatacattttcaccagttgctagatccagatgagtattacgcccttctaagtgtggcaaatatagcatgtgtttcatctgttcgtgattcaatgaatacaatggctctagagtatgttgcttgtcagcaaaagaacaagggctcccttattttaagtgaattctcggggactgcagaacttttactatctgcttatttagtaaacccatatgactattcccgttttgcagaaactattaattactgccttaatatgaccgaaaaggaaagggagcgtagattttcgtctctttggaagcaagcaacttcccaatcttctcaacaatggatatataagctgataaatagagcagcctatgaagtgaaagcattggagagtcatatgacaaccccattgcttacttataatattttaataaagccttatagaaatgccaaaagacgtttatttcttttggattatgatggcactttaattgaatcggcaaggaattcaattgacgctgtacctacagaccgattattgcgcacattaaaacgtttagcctctgactcaaggaatattgtttggattttatctggtcgctctcaaaaatttatggaggaatggatgggagacatatctgagcttgggctttcttcagaacatggtagtgcaataagacctcctctagctggtagctggtcaagctgtgctgaaaatttggatttatcttggaaggacaccgttcgagatttctttcaatactatgtagaaagaactccaggctcctacatagaagagaaaaaacattcaatatcttggtgttatcaaaatgcaaacacaacttacagtaaattccaatctttagaatgtcaaactaatttggaagatatgttgaagcattatgacgtcgaaattagtccagcaaagtcttttcttgaggttcatccaaattacttaaacaaaggatctattgtaagacgtattttaaagcgttctggttcagtcgacttcgtcttttgtgctggtgatgataaaactgacgaaaatatgtttgaagtgttccttcctaccgcattcagtaattcacatctcatcgacgaaatagactctacggaatactcaggttcacaccatacagacgataattccgatgcaaataaagtggaaaatgttaaagtagcaacatttcgtgtacacattggattaactgacaagcctacactatctgattatcaccttcctgctcctcgtgatttaggagaacttttgcataaccta

SEQ ID NO: 25999 - DNA, 2662 bp, Schizosaccharomyces pombe
atgtgtcattcgaaagaagtaaaatttaaaaccaattttcatcacccgtataccccatacgatatccaactagagttcatgcgcagtttgtactcttccatcagcgatggaaagattgggatttttgaatcaccaactggaacgggaaaaagtttgagtttaatctgtgcttcacttacttggctagacgaacatggaggtgttttacttgaggataatgaaaaatctaatgacaataaatctaacacatcctcaaaaattccagattgggttctagagcaagacttgaaaatacaaaaggatctagtaaaagaaacacatgcacggcttgaacagcgccttgaagaaattcgaaagaggaaccaaagtcgcaaaaatcaaatgagcaataattcaactacataccacagggaaacaaaaaggaggaacataaacgcagaagcctcaacctcagacaattgtaataattctaatacttcggttgatccgatggacgaatatctagttacagcagaatatacgatgccatcgacttctgaacaatctgaagatttatttaataacggttacagttccaaagtctctgaactattgcgaaaattaagtcccgataatgaaaaaccacctatagttcaaaaggtacgaatttaggtgcttataaggaatattcatttagtggtaatatttttctaacctactgctagatatattttacttctcgaacccactctcaattgcaacagcttgttcaggaaattaaaaagctcaataatcaaaccttctcaacgccaatacgagtagtttctttggcttctcgtaagaatctttgtattaataatgaagtccggaaacttcgaccaacgtctgctttaaatgaaaaatgcattgagcttcaaggtactttaacaacttcactagattgaaaattcagtttaatattaacttttacattttaggatcagctcacaagtgtccctttttacaagacaacactcaattatgggacttccgggatgaagcacttgctgaaataatggatattgaagaactcgtagaattgggccagcgtttaaaggtctgcccttattacggaacgagggaagcagtggattcagctcaaattgtgaccctaccttatcctttattgctacaagaatcagcacgaaatgcgcttaatttgactcttaaagacaatatatgtataattgacgaagctcataacttgattgatgcaatctgttccatgcattcttcttccatctcgtttagacaagtttgtattgctgaaactcaattgcaacaatattttctgcggtttgaaaaacgtctgaatggtaataatagaatgcatataaagcaattgatcaaagttgtctataacctaaaatctttttttttaaattgtctagaaactaatacgaattcaaaagtgatcaatgtcgattctttactggtatcaaatggtgcggatcaaattaacttgcaccatctgtctgaatacttgaatgtttcaaaactagcaagaaaagtcgatggttatacgaaatatatgcattcattggggacacaagaattggagtctttgaatgatcttcgtagtgaaagattttcaaacggcaatggatatgaagaggatccatacacaccggtcctaatgcaattagaatctttcttactgaatatcgccaaccctgctcctgaggggaaactattttacgaaaaacaaacgggggacaatccatatttaaaatatttgttactcgatccatccaaacatgtcgagatattgaccgaacaatgtcgttcagtgaatttagctggtggcaccatgtcaccgattgatgactttataacccttttattttcagatgaacaatctcgtatacttccattttcatgtgaccatatagttcctcctgaaaatattacaaccattctagtttctcaaggtcctgcaggcgtcccttttgaatttacacataaaagaaaagacgatgagaatttattaaaagatttgggaaggacttttcagaacttcatttccattatcccagatggcgtcgtggttttctttcccagttttgcatttttgcagcaagctgtaaaagtatgggaaatgaatggaattacaaatcgtttaaatgcaaaaaaaccattatttattgaaagtaaagattttggcgataatcctttggatacttttgaacactataaacagtccgtagatgcaggcttgagtggaatgttgtttagcgtgataggaggaagactttcagaaggaatcaacttttcagataaacttggccgagccgtaatggtggtaggaatgccgttccctaactcgcaagatgtggaatggcaagccaaggtctcatacgtagaggaaaaggccaaggagaaaggcataaatgcaaaacaagcttcacaggaattttatgaaaatacctgtatgcgagcagtaaatcaaagtataggtcgagcgattcgacaccgagatgattatgcaagtataattcttttggattccagatataatcgatcaagtatacaaaggaagttaccaaactggttaagcaaaaacatccattctagccctaatttcggacctgctatacggcaacttgctacttttttccgggctaaaaagatgtgtgattagaca

SEQ ID NO: 26000 - DNA, 2553 bp, Schizosaccharomyces pombe
atgacagctcgcaattctgctagtattcctaccagtattaggaaaacatctgaaaatgaagtctctggagatgagacaccagctggagttgggaatttatctacaaagacggcctctaagacttcgctgacttttcgacagtcttcttctgacgagtcgacgagcagttatagtggaaaccaccataatattaacattcaacatcaccctaatcgtccttttcggaccaattcatcttcattcagtccaaatgactacagcataagtgaaagtcctagtaaatcgaagaaggatggcgtgcatgtctcagcggttcaacttgacaatgaaaccgactctgaagtcgagtcagaagtagaagagttggaacgtgaattagaagccattgaagattctgtttacccagaagttcgtgctgccgtaaatcctactgacgacgttaatttgcctgtgaacacttggagaacttgggtgcttaccaccatatttgtaatagttttcgctgctgtgaatcaattttttagtctacgttatccggctttgagcatcagtttcattgtcgctcaattaattttatttcctctaggaaaactattgaacttgttaccaaattggaagattggttatggtcgattctctttttatcttaattcttccccctttaacgttaaagaacatgcagccattacaatcgctgtttccctaacatcatctaccgcttatgccacgaatatcctgtccgcccaaactagcttctataaacaaaacctctcgtggggttataaaatacttattgtgcttacctcgcaaatgctgggttatggatttgccggtctcactagacgctggattgtgtatccagctgctatgatctggcctcaaactttagtaagcactgttctgtttagaacacttcacggtaatagtggaaatgacattggggtattaaaaaataacaggatatctgctaatggctggaccatttccagatatcgcttttttgcatatgtaatgattggatcatttgttttttactggtttcctgggttcatatttaaaggtctttcttattttaccgttctttgctggatatggccaaagaatcgtgttgtaaatcagttatttggatacaactccggtcttggcattcttccccttacattcgactggcagcaagtcgtttacaacagcaatccattggcttctccctggtgggtaatttgcaatacttttggatcggtggttttaattttttggattgtcgttcctatcttgtactataaaggtgtttggttctctaattatttacccatgctttcatcttcaacatttgatcacaccggtgtaagctacaactcttcacgtgttcttaatagtgattactcatttaatcatacaaaatatgaatcatattcacccttatatatgcctatgtcctatagcatgtcaactgctttgaattttgctgctgtgacagctattttcacacattgcgctttatacaatggaaaagatatatggcaacgcttatggaaagagtctggtaaagatgaatgcattcatcggaagctgatgcgcaattataaggaagcacctcagtggtggtatgccacattgttcatcgtagtctttggcttaaccattttcacagttcgttactatgatacgcaatgtcctgtgtgggctctcattgttgccttgttgatttttattgtaaatttcattcctcaaggtgttcttgaaggcattacaaatcagcatgtcggtctcaatattatcactgagctaattggcggttatattttacctgggaaacctttagctaatttgatgattaaactgtatgggttcattcctatgcggcaagggctagagttttctcgtgatcttaaactcgctcaatatatgaaaatacctccacgtatattattttttgttcagctttttgctacaatcctcggtggaattacccaggttgctgtacaggaatggatgaattatcacattccaggtatttgtacaacttcacaatcaaatggctttacttgtcccaacggtcgttccatctataatgcctccttaatttggggtgcaattgggcccgctaaaatgttttcaaaaggaaaaccatattacccattgatttttttctttttgataggtgcagttgctccttttataacatggggtttgagaaaaaggtttcctaagtcgtggattggaaagcttaatgctccggtccttttcactggtcctggcaatattcctcccgctactggaattaactattcttcttgggcaattgttgggtttatatttaattatgtgattagaaagcgcgcgatacactggtggaggaagtacaactacgtactggctgcagctatggattctggggttgcagtcgctggagtagtaattttcttatgtgtatcataccctggaggtaagataacctggtggggaaacactgtgtacactaaaacttatgattggaaaagtgtgccatataggtcacttgggccaaacgaaacctttggttacaccaattgg

SEQ ID NO: 26001 - DNA, 1719 bp, Schizosaccharomyces pombe
atgaagcttaatatttttaaaagccatggggattctaatacggcagaggagaggcccgttccccttgaacaagtagaagctgaagatcagcaacatgaaaaccgtttctggttgggtttgactgcaaaggaatttagactcatgatgttagctggtgtgggtttcttccttgatagttacgatctttttattatcaacttggtcactcccattttcgaatatctttactggggtggtattgaaaagggacccaacggaaagggtcattatccctctggtattcgtggtttggttaatgccgcttcaaacattggtaatatctttggtcaactgatgtttggttttatgggagatttctttggccgtaaatttgtctacggtaaagaaatgattattgttattatcgccactattcttttgattgccatgcctaaaagtatccattcccccctttctaaaatgatgtgggtgttctgctggcgttggttgcttggtgttggtattggtggtgattatccaatgtccgccgccattacttctgaacgtagtaaactgaaccgtcgtggtactcttatttctttgatttttgccttccaaggtttcggaactcttgctggtgccattgtcaccatcatccttttgggttgtttcgaacatccattgaatcgtgaaggtcattaccgtaaactcgaaggtgtttggcgtttacaatttggtcttgctttggttcctgcaattggtgtccttatccctcgtcttatgatggaggaaactcaaaagtttaaaaattcacaacagctcaattccggcgataatagagatcctaaaacttcactcaactttgaggacgatgagcttgttaaaaatccatctgtcaccaaaggacaccctgaaatccatgaatctagtgagaattacttgagtcgctctaataccgttgagaatgagcctgaaaacattgagaaacaatttgaatcagttagtgctcctgctaacagaagtggctttatccaatactttagacaatggcaccacttcaaacatcttttgggtacttctgtttgttggtttttgttggatattgccttctatggtgtcaatcttaatcaatctgtcattcttaagaatatcggcttcagtagtggtacgaacgaataccgcacattgatgaaaaacgcaattggtaatttgattattgctgtcgccggttatgttcctggatactggttcaatgtcttccttgttgagatccttggacgtaaatggattcaactacaaggtttcgtgattactggtttgatgtttgcaattttggcaggacgttggaacgaaatttccactggtggtcgatttgcttgttttgttattgcccaactgttttctaactttggtcccaactccaccacttttatttatcccgctgaggtcttccccgctcgtgttcgcggtaccgctcatggtatttctgctgccttgggtaagtgcggtgctattcttgcatcacttcttttcaactttttgactagtatcattggatatggtaatgtcatgtggattttctgcggttgtatgtggggtggtattcttttcacacttttgttaccagagactaaaggtcgtgacgccgatgagatagatcgggtggaattattttatggtggtgatggtaaagttgagtgcaactcaaagtggaagagctggtatgttaatgggattttt

SEQ ID NO: 26002 - DNA, 1737 bp, Schizosaccharomyces pombe
atgaaagttgtgccaagcgaaaaaatcaaaccgaattggtggagagagacttcagtatatcaaatatatcctgcctctttcaaagattcaaacggtgatggctttggtgatttagaaggaatcatttccaaagtggattatctgaaagctctaaatgtagagtctatttggctttgtcctatttacccatctcctctaaaagacatgggttatgatgtttctgattacaaacaaattgactctcgatatggaactttagaggatttggacaggctaatgaaagctctacacgaaagggacatgaagttagttatggacttggtgttaaaccacacttctgatcaacatgagtggtttaaggagtccagatcttctaaaacaaatccgaagcgagattggtacttttggaaaccagctaggtacaatgaaaaaggcgaacgcttacccccaaataattggagaagctatttcgatacttcggcgtgggaatgggacgaagctacgcaagaatactacctacatctttggtccgtagggcaacccgatcttaattgggaaaccccaaaagttagggaagcggtacacgatattctacgtttctggcttgatagaggagtagatgggtttcgacttgatgctattaacatgatcagcaaagaccaaaggtttctagatgctccaattactgatgacaggtacgaatatcaactagcctatcaatattacgccaatggtcccagaattcacgagtatcttaatgggataggcaatattcttacagagtatgacgctttttctgtaggggaaatgccttacgttttggatacgaacgaaatcctgcatgtcgttggtgctgatcgtagagaactgacgatgatatttcagtttgattttgtggaccttgatctcgatcctaatcagcataagtatattgaaggaagttgggagctttctgatttgaaaaagtcattaaaaaaatggcagtctgcactactttccggtggtggttggaatgcttcctttattgaaaatcacgaccaaacgagaactgtttcacgatatctttctgattctcccaagtatagagcatatagctccaaattgatggctctttttatcatattccaaagtggtaccccatttgtattccagggtcaggaacttgctcttgccaatatcccacgagattggccgattgatgaataccttgatgttgaaacgcagaacttctggaaactttttatgagtggcaatcctagtcaggaagaaattgagaagactatggacattgttaacaaacgtgctcgtgacaacggtcgcacaccaatgcattgggatagctcacccaacggtggtttcacaaaggctggagtaaaaccgtggatgagagtgactaatgactacaaagaatggaatgctgccaatcaagttaatgaccctgaaagtccttacacattttggtcaaaggcattggagcttcgtaaagaattgaaggatgctgttgtgtatggatcgtttgaattgatatctgaagaggatccatcgattgttgcatttgttcgtgaatcatcgacttataaactcatcattcttttgaatttcacgggtaataaagtttcttatgactgtcctttgaacctgacttcctatgaaattctacttgacaactataaggactttatttgtatgacttctcctgtcacattgaatccttatcaagcagtcttgttaaagctc

SEQ ID NO: 26003 - DNA, 1671 bp, Schizosaccharomyces pombe
atgggaagaacacttacatctgtcctcgtggtcttcatttctatggccggatggctaggaggtgctgataccggttccattagtggtatcttgggaatgcgtgattttcaatctcgttttgctgaccggtataatcctatcacgaactcttatagttactcagcctggcgacaagcactgttgacaggaaccgttaacgctggttgcttatttggtgctatgctttcctctccatttactgaagccattggcaaaaaatactccattgccttctttagcggttgttacattattggtcaaattcttttggtaactgctgttccttcttgggttcagattatggttggtaagttatttacaggtttaactattggtgctttgtcggtgttgagtcctggataccaatctgaagttgctcctccgcaaattcgtggtgcagttgtttcgacctatcaactatttcaaacttgcggtactttaatcgctgcttgtatcaatatgggaactcataaacttcgtaaaacagcgtcctggagaacttcctttggcattaacatactttggggtatctttttgatggtgggtgtactgtttttacctgaatcaccgcgttacctcatctataagggaagagatgaagaggctcttcgaatcatgtgtcaaactgctgaactagatcctgagagtgaaatcattcaaaccaattttaataccattaagagtgatattgaaatggaaatggctggaggtaaggcaagatggcctgaggtttttggaaaagaagttcgctatcgtactgtcttgggattccttactatgttactgagagaattgattggtaataactattacttttattatgctacacaagttttcaagggaactggtatgacggatatattcttaccagccgttattttaggtgctattaattttggtacaacgtttggtgctttatacacaattgataacttaggacgtcgtaacccactaatttttggagctgctttccaatcgatatgcttctttatatatgccgctgtaggcgatcgaaagctcatatataagaatggtactagtgatcacagagcaggagctgtaatgattgtgttttcttgtttgtttcttttctcttactgctgttcttggggcccaatgggctgggttattgtcggcgaaacctttccaatacggtatcgtagcaaatgtgctgctgtagccacatcgggtaattggctgggcaactttatggtttcattcttcactcctttcatctcaaattctattgggttcaaacttggatatatttatgcttgtatcaatatgacttctgcgtttcaaatatttttgatggccaaagaaactaaaggccttaccttggaagaagttaatgaattatacgagtctgacattaagccatgggattcctataagtacgtgagacaaattgaatctcgtcgtatacacttcagtaaagaagaagaaaagcgagaaagagagaagtcaaaaggataccgcggtcaagaagaacgttttatcgaaaatgcagatggtgcggataatgacgatagcagcgcttcttcagaatcctttgcatctgctggcgcacactccagatcggtttttcctaggaggtcaaacgtgtcagaagaatcacacccgacttgggta

SEQ ID NO: 26004 - DNA, 539 bp, Schizosaccharomyces pombe
atgaatagttcaattaaacgacttcacaaagaatatgccagtttccaggctggagatatatctggtctcttacttttaaaaccggtcactgatgttgatatgttccattggaaggcagtcattgaaggacctactgaaacaccgtatgaaggggggcaatgggttctcgatattcatgttcacgaagggtatcctattagtcccccgtctgtgtattttcaaacaaaaattgtacatccgaatatttcatggacggtaagccaatttaaatagagttttttagattacattcattagctaacgtcaatggtagaacggcgaagtatgtatggacatattaaagacacattggtcgccggcctggagtctacaatctgcttgtttagcaattatctctcttttaagtaattacgatgctagttctccattaaatgtagatgccgccaagctgttgagaaccggggacaaaacggcttataattcattagttcgatgtacaacctatctttacgccaaaggtaagatagaagatctttcat

SEQ ID NO: 26005 - DNA, 1312 bp, Schizosaccharomyces pombe
atgggagaccgattcattcccattcgcaacgttagcaatgagttcaactttagtttccagtcattcaaagaatgtgtgttaagccatggatcaaatcttaggcgcaaaacctctggcactagtatgtaccttttttagttttatattcccattactaacgacagcagttcaaaggcaattcatggagctactaagcatggagctcttcggttcacaagcatctcgctctagagccttctattatggagaagacaaaaggaaaattgagaagaaaatgttggatacacctgatagaaaatcatattctctatctcctatttcaccgcaatctcaagatatgttgcggcaaccacaaaagcccaaaagagcttttccaaaaactccatataaaatcttggatgcaccttacttaaaaaatgacttttatttaaacttgcttgactggggccaatctaatgtcttggcagtcggactagcaagcagcatttatctctggtcagcagcaagtggtaaagtggttcaattacatgatttcggagcaacaaatcatgtcacaagcgtcttatggacaggtaaaggaactcaattagctgtagggacagattcaggagtaatttacatctgggatatcgagtctacgaaatcagtcagatctttaaaaggtcactccgaaagggtggcagcattagcatggaacgataataccctcacaagtggaggcaaagacgaagtaattttacatcatgacctaagagcaccaggttgctgtgccgaaatgatgaaagttcatgaacaagaaatatgcggattgcaatgggatagaagtctaggacagcttgcttcaggagggaatgacaataatttattcgtatgggattaccgctcttcacgtcctttacataagtttgaagagcatacagcagcggtcaaagcaattggatggagccctcatcaacgagggatcctcgcaagcggcgggggtaccatcgacagatgtctaacgattcataatactttgactggaaggctacaaaataagttggatactggctcacaagtatgtaacatggcctggtccaagacttctaacgaaattgttactactcatggttttgcaaaaaaccaagtatccttatggaaatatccttcattgaaaaatatcgccaatcttactgcccatacaaaccgtgtcctctacctttctatgagtcccgatggccagtctatagttacgggagctggggacgaaacgctaagattttggaagctttttaacaaaaagccaaaagaagaaagtacattaattcgttaa

SEQ ID NO: 26006 - DNA, 1032 bp, Schizosaccharomyces pombe
gatctcgacgaaatcgacactgacattgtcacactttcctcctttattttgcaggaacagcgccgatacaatcagaagcataaaaatgaagaaggaaaaccttgcattattcaagaggctagtggggaattgtcattactgctaaacagtttacaattcagcttcaaattcatcgccaacaccattcgtaaagcagagttggtaaatctcattggtttatcgggaatcgtcaattccactggcgatgaacaaaagaagctagataaaatttgcaatgatatcttcattactgcgatgaagtcgaacggatgctgcaaactcatcgttagtgaagaagaggaggatcttatcgtagttgatagcaacggttcctatgccgtcacttgcgatcccatcgatggctcttccaacattgacgccggtgttagtgtaggtaccatatttggtatctataaactgcgacccggcagtcaaggcgatattagcgatgtcttaaggcctggtaaagaaatggttgctgctggctatactatgtatggtgcttcggctcatttattgcttaccacaggtcatcgtgtcaatggcttcaccttggacactgatattggcgaattcatcttgacccatcgaaacatgaaaatgcctttgcaacatagtatttattccattaatgagggttacactgcattttgggatgaaaaaatcgctcgttttattgctcatctcaaagaaagcacaccagacaaaaaaccatactctgctcgatacattggttctatggtcgccgatatgcaccgtaccattctttatggtgggttgtttgcttatccatgctcaaaaggaaataacggaaagttgagacttctttacgaatgtttccccatggccttccttgttgaacaagcaggaggtattgcggtaaacgacaaaggagatcgcattctggatttggtacccaaaacattacacggaaaaagcagtatttggcttggaagtaaacatgaagtcgaggaatatattaatttcataaaa

SEQ ID NO: 26007 - DNA, 1719 bp, Schizosaccharomyces pombe; identical to SEQ ID NO: 26001

SEQ ID NO: 26008 - DNA, 1737 bp, Schizosaccharomyces pombe; identical to SEQ ID NO: 26002

SEQ ID NO: 26009 - DNA, 1671 bp, Schizosaccharomyces pombe; identical to SEQ ID NO: 26003

SEQ ID NO: 26010 - DNA, 539 bp, Schizosaccharomyces pombe; identical to SEQ ID NO: 26004

SEQ ID NO: 26011 - DNA, 1312 bp, Schizosaccharomyces pombe; identical to SEQ ID NO: 26005

SEQ ID NO: 26012 - DNA, 1032 bp, Schizosaccharomyces pombe; identical to SEQ ID NO: 26006

SEQ ID NO: 26013 - DNA, 1312 bp, Schizosaccharomyces pombe; identical to SEQ ID NO: 26005

SEQ ID NO: 26014 - DNA, 1041 bp, Schizosaccharomyces pombe
atgaaaaaagatctcgacgaaatcgacactgacattgtcacactttcctcctttattttgcaggaacagcgccgatacaatcagaagcataaaaatgaagaaggaaaaccttgcattattcaagaggctagtggggaattgtcattactgctaaacagtttacaattcagcttcaaattcatcgccaacaccattcgtaaagcagagttggtaaatctcattggtttatcgggaatcgtcaattccactggcgatgaacaaaagaagctagataaaatttgcaatgatatcttcattactgcgatgaagtcgaacggatgctgcaaactcatcgttagtgaagaagaggaggatcttatcgtagttgatagcaacggttcctatgccgtcacttgcgatcccatcgatggctcttccaacattgacgccggtgttagtgtaggtaccatatttggtatctataaactgcgacccggcagtcaaggcgatattagcgatgtcttaaggcctggtaaagaaatggttgctgctggctatactatgtatggtgcttcggctcatttattgcttaccacaggtcatcgtgtcaatggcttcaccttggacactgatattggcgaattcatcttgacccatcgaaacatgaaaatgcctttgcaacatagtatttattccattaatgagggttacactgcattttgggatgaaaaaatcgctcgttttattgctcatctcaaagaaagcacaccagacaaaaaaccatactctgctcgatacattggttctatggtcgccgatatgcaccgtaccattctttatggtgggttgtttgcttatccatgctcaaaaggaaataacggaaagttgagacttctttacgaatgtttccccatggccttccttgttgaacaagcaggaggtattgcggtaaacgacaaaggagatcgcattctggatttggtacccaaaacattacacggaaaaagcagtatttggcttggaagtaaacatgaagtcgaggaatatattaatttcataaaa

SEQ ID NO: 26015 - DNA, 2205 bp, Schizosaccharomyces pombe
atgccttcgaaattttcctctaaatacgtggatacagaagccatttcaaatgatgatgacaatccctttgcaaccgctaagagttattactccaaggatacagacttgtcgactcgggtaagtgctggccgtcctcgcaccttatccacttcgatggaggcatccgccgcaccaactataccagaattaaagaatttacgtcgacgtggaagtcttgatgaacataaacaaccacgaaaatttcttgttgatgttgataagacattgaatgcacttttggaatctgaagacaccgaccggaacatgcaaatcaccatcgaggataccggacctaaagttgtttcccttggcagcgctagctcgggtggatatcgcttgtatgagcttcgcggcacatatcaattgtcaaatttacttcaggaattgaccttggcaaaggattatggacgtcgatatattttacttgatgagcgaagacttaatgaaaaccctgtgaaccgactttctagactcatcaaaggtaccttttgggatgcccttactcgaagaatcgatgccagtgttttggatgttatttgccgtgataccaaagaccgatcaggatcacacgtgaatcgaatttatgttcctaaagccgaacaagagatgtatgaatactatgttcgcgctgctaaggaaaggccttacttgaatttacaggtcgaatatctgccggaagagattactccagaatgggtgagagatgtaaatgataagccagggttacttgcacttgcaatggaaaaataccaagatgatgaaggcaatacacatcttcgaggtgtgccatttgtcgttcctggtggccggtttaatgaactgtacggctgggactcttactttgaatcactgggtttgcttgttgacgatcgggttgacttggcgaaaggtatggtggagaattttatttttgaaattacctattacggtaagatcttgaatgccaaccgcacttattatcttcttcgctcccagcctccatttttgaccgatatggcccttcgagtttatgaacgtataaaaaacgaagaaggatctttagactttttgcatcgggccttttctgcgactataaaagaatatcacactgtttggactgccactccacgactggatcccaaaactggtctttcccgctatcgccctggaggactcggtattcctccggaaactgaagcttctcattttgagcatttgcttcgtccttacatggagaagtatcatatgactcttgaggagtttactcatgcatacaattaccaacaaattcatgaacccgcgttggatgagtatttcgtgcacgaccgcgcagttcgcgaaagcgggcatgatactacttatcggttggaaaaagtttgtgctgacttggccaccgtggatctgaactcgttgctatacaaatatgaaaccgacatctcacatgtgattttagaatatttcgatgacaagtttgtacttccaaacggaactatagaaacttctgccatttgggatcgtcgtgctcgtgctcgtcgtgctgcaatggaaaagtatctttggtcagaagctgattcgatgtggtatgattacaacacgaagttagaaacgaagagtacttatgaaagtgctactgctttctgggccttgtgggccggtgtggcaactccccgtcaagccgcaaaatttgttgatgttagtcttcccaagtttgaagttgctggaggtatagttgctggtacaaagagaagcttgggtaaagtgggtcttgataatcccagccgtcaatgggattatcctaatggctggagccctcagcagattttagcttggtatggattgattcgatacggatatgaagaggagactcgtagacttgtatatcgttggctatatactattactaaatcgtttgttgattttaatggtattgttgttgaaaaatatgatttgaccagaccagttgatccacatcgtgttgaagctgagtatggtaatcagggtgtcaatatcaaaggcgttgctcgcgaaggttttggatgggttaatgccagttacgaagtcggccttacattctgtaattcgcatatgcgtcgggctcttggtgcttgtacgactcctgatgttttctttgccggcatcaaggaagaatctcttcctgctttcgaaaacctttccattcataaaaat

SEQ ID NO: 26016 - DNA, 1896 bp, Schizosaccharomyces pombe
atggctgagcgattatccgtgggtgcacttcgtataatcaagtaagttaactgtccaaattatatactcaaaagatttcgacaaattgggatgttaacacgtttctttagtacatccgatgcttcgtcttttcctcctaatccaattctccaagtcttaaccgtgaaggagctaaactcaaatccaacttctggtgctcctaaaagatatcgtgttgtcctttccgattcaatcaattatgcgcaatctatgttaagcacccagctgaaccatttggttgccgaaaataaacttcaaaaaggagcgttcgtacagcttacccaattcactgtaaacgttatgaaagaaagaaaaattttgattgttcttggtttgaatgttttaactgaacttggcgtaatggataaaattggtaatcccgctggtttagaaacagttgacgctttacggcagcagcaaaatgagcaaaacaatgctagcgcaccacgaacaggtatttcgacaagcactaactcattttatggaaacaatgctgcagctacagcaccggctccacctcccatgatgaagaagccagcagcgccgaatagccttagcacaataatctacccaattgaaggtctctctccatatcagaataaatggactattcgtgcccgtgttactaacaaatctgaggttaaacattggcataatcaacgaggtgaaggaaagctttttagcgtaaatttactcgatgaaagtggggagattcgtgcaacaggctttaatgaccaggttgatgctttttatgatatcttacaggaaggttcggtttattatatatctcgttgtcgtgtgaacattgcaaaaaaacaatataccaatgttcaaaacgagtatgagctgatgtttgaacgtgatactgaaataaggaaagctgaggatcaaactgccgtccccgttgcgaagtttagttttgtttctctacaagaagtcggcgatgttgccaaagatgctgttatcgatgtaattggtgtactccaaaacgttggaccagttcaacaaattaccagtcgtgcaacttctcgtggatttgacaagcgtgatatcactatcgttgaccaaacaggatatgaaatgcgtgttacgctttggggaaagacagctattgaattctctgtttctgaagaaagtattctcgctttcaaaggagttaaagttaatgactttcaaggacgctctttgtcaatgttaactagcagcaccatgtcggtagatccagatatccaggaatctcatttgttaaaaggttggtatgatggacagggtagagggcaggaatttgccaaacatagcgtaatttcatctactttatctactactggaaggagtgctgaacgtaaaaatattgctgaggttcaagccgaacatctgggaatgtcagaaacacccgattattttagcttaaagggcaccattgtttacattcgaaagaaaaacgtgtcatatcctgcttgccctgctgctgattgcaacaaaaaggtttttgatcaaggtggctcctggcgatgtgagaaatgtaataaagaatatgatgctcctcaataccgttatattataactattgctgtaggtgatcatacgggacaactctggctcaacgtctttgacgacgtcggtaaattaatcatgcataaaacggcagacgaattgaatgatctacaagaaaacgacgaaaatgcctttatgaattgtatggcagaagcttgctatatgccatatatctttcaatgtcgtgctaagcaagacaattttaaaggtgaaatgcgagtacgctatacagtgatgtcaattaatcaaatggactggaaggaagagtctaaaagattgataaatttcattgagtctgctcaa

SEQ ID NO: 26017 - DNA, 1350 bp, Schizosaccharomyces pombe
tatttggctaacggttctttttcttcaggtaaatctattgttggtgctcactcccttgaggaatttgtttccaagcttaagaagcctcgtgtttgtattttgcttgttaaggctggtaagcctgttgattaccttattgagggattggctcctctcctcgagaagggcgatatcattgttgacggtggtaactcccattaccctgatactacccgccgttgcgaggagttggccaagaagggcattctttttgttggttccggtgtttctggtggtgaagagggtgctcgttacggtccctctttgatgcctggtggtaatcccgctgcctggcctcgtatcaagcccatcttccaaactttggccgccaaagccggaaacaacgagccttgctgtgactgggttggtgaacaaggtgctggtcattatgttaagatggttcacaatggtatcgaatatggtgacatgcaattgatttgcgaaacttatgacattatgaaacgtggccttggtatgtcttgtgatgagattgccgatgtttttgagaagtggaacactggtaaacttgactctttcttaattgaaatcactcgcgatgttttgcgttacaaggctgatgacggcaagcccttggttgagaagattctcgacgctgctggacagaagggtactggtaagtggactgctcaaaacgctttggaaatgggtacccctgtcagtttgatcaccgaagccgtttttgctcgttgtctttcctccttgaagagcgagcgtgttcgtgcctctaagaagcttactggccccaacaccaagttcactggtgacaagaagcaattgattgatgatttggaagatgccttgtacgcttccaagattatctcttatgctcaaggtttcatgcttatgcgtgaggctgctaaggagtacggctggaagcttaacaacgccggtatcgctttgatgtggcgtggtggttgtattatccgttccgtcttccttaaggatatcactgaggctttccgtgaggatcctaacctcgagtctatccttttccatcctttcttcactaatggtgttgaaaaggctcaagctggttggcgtagagttgttgcccaagccgctatgttgggcattccagtccctgccacttctaccggtctttccttctacgacggttatcgtagtgctgttttgcctgctaacttattgcaagctcaacgtgactactttggtgcccatactttccgtgttttgcctgaagctgctgataagagcttacctgctgacaaggatatccacattaactggaccggtcacggtggtaacatcagtgctactacctatgatgct

SEQ ID NO: 26018 - DNA, 2697 bp, Schizosaccharomyces pombe
atgagtgttcaatatgatgcattcagtgttgagcaaacttgtgcggatttagaaactgacatgtataatggcctctctagtctccaggagatcacgcgacgtaacaaggttcatggagataatgatttgaaggtagaagatgaagaaaacatggtggttcaatttcttaagcaatttgttaaagatcccctaattcttttgctttttgcaagttctgcaatttcggtgacattgggtaatatagatgatgctattagcatcgctttagctatagttattgtcgtgactgttggatttgttcaagagtatcgatctgagcaatctttaaaggcgctgaataaccttgtacctcattattgcaatgttatccggtccggaaaaacggagcatattgttgctagtaaattggttcctggagatttagttatcttacaaattggtgatcgtgttcctgctgatctgcgaatcgttgaagctaccgagttggaaattgatgaatcaaatctaacaggggaaaactcgccacgaaagaagagtagcgaagctatatcttcaaacatatctcttactgaaagaaataacatagcttttatgggtaccctcgttcgtcatggtcatgggagaggaatagttgtcgctactggatctgatacggaattcggtcgtgttttccttactatgcagcaaactgaaaaaccaaagacgccattgcagaacagtatggatgacttaggcaagcaactctctttaatctctttaattggtattgccgtcattgtgcttgttggttttttccaaggtaaaaattggttagaaatgcttacaattggagttagtttggctgtcgccgctattcctgaaggtcttccaattatcgtaacagtcacccttgctttaggcgtgttacgcatgtctaagaagagggctattatccgtcggttacccagtgttgaaactttgggaagtgttaacgttatttgttcggacaagactggtactctaacaatgaaccatatgacagttactaaaatttatacatgtggaatgttagcagctttctccttaccagaaagtgaacatatagagctaagtgttaggcgcactgttggtatcgaaaaggcacttctagctgctgctttatgcaacaatagtaaagttcataacaaagctgattctattttggacactacttgtccctgggctggatttccagttgatgtcgctttaatcgaatgttctgagcgattcgggttgaaggatcctcgtgaaacgtacagtcgtatatctgaggtttcatttagcagtgagcgcaaatacatgtctgttgctgtccaatacaactctagcaaaatgaatttcatgaagggagccactgaacaagtgctgtcaagttgtgcatattttagcgatcaggatggtgttcaacacgagcttactgcggaaatgaaggagaacattcaacgtaacgagtttgaaatggctgcttcgggactcagaattatagctgttgccagtggtataaataccaataaacttgtatttcatggtctttttggcatcaacgatccccctcgaccccaagtccgcgaaagtgtacaatatctaatgactggaggggttcgagttattatgattacaggtgatagcgttgttactgcaataagcatcgctagaagtttgggtatggctattcctagtaatgacgaagaagcaattcgtaactatgcgctgactggagctcagttagatgatcttgattcttcctctttacgtgatgccgtttcccgtgtagtagtctttgcaagaactacacctcaacataaaatgaaaattgttgaagcccttcaaagccttggtgatgttgtggctatgactggtgatggcgtaaacgatgcacctgccctcaaacttgcagacattggtatagcaatgggtcgacaaggtacggatgttgccaaagaagcggctgatatgattcttaccgatgattcttttgcgactattttgagtgctgttgaggaaggtaagggaatattcaataacattaaaaatttcattactttccaattgtctacgagtgtggctgctctttcattaatcgccatttcgtctgttttcggcttccaaaatcccctcaatgccatgcaaattctttggatcaatattctaatggatggaccccctgcacaaagtctcggagtagagtcagttgatgaagacgtgatgatgaaacctcctcgtccaaggaatgctcctattatatcagttcagcttttacaacgtgttttactcagtgcatttataatagttactgtcactattgtggtatttagagtacaaatgcaagacggcaatgtaacagctagagatactactatgacttttacttgttttgttttcttcgatatgtttaatgctttagcatgtcgttccgaaacaaaatcggttttcaagcttggtattttctctaatagaatgttcaatatcgcagtcggaggctcattaattggtcaagccttggtagtttatgcttccccctttcagcgtatttttcaaactgaagctattggacttaaagatgttctaatattgttagcttgtaccagttctgttctctgggttgacgaaattcgcaaatggtatcgtcgccgtaaaggtcttgttagaacaaagagcaattatctgctaaggaatgta

SEQ ID NO: 26019 - DNA, 1347 bp, Schizosaccharomyces pombe
atgagagagatcatttccattcacgttggccaagcaggaactcaaatcggaaatgcttgttgggaactgtattgtttagaacatggtattcaaccaaatggttacatgaatcctgagactgcatcccaaaatagtgatggcgggttttctacttttttctcagaaactggtcaaggaaaatacgttcctagaagtatttatgtagatcttgaaccgaatgtgatcgaccaagttcgtactggcccataccgtgatcttttccatccagagcaattaattacgggcaaggaagatgcatcaaacaattatgctcgtggtcactacactgttggaaaagagctggttgatgaagtaactgacaagattcgtcgtattgccgataattgctccggccttcagggctttctcgtcttccattcgtttggaggtggtaccggttcaggctttggtgcccttttacttgaacgcttggccatggaatacacgaaaaaatcaaagcttcaattttctgtgtatccggctcctcaagttagtacttctgtagttgaaccttataactccgttttgactacccatgctacgttggaccttgctgactgtacatttatggttgacaacgaatcgtgctatgatatttgccgtagaaacttagatattgagcgtccttcctatgagaatctcaatagattgatcgctcaggttgtttcttccatcaccgcctctcttcgcttcgagggcagcttgaatgttgatttggcagaattccaaacgaatttggtaccttatcctcgtattcatttccctctcgtcacttatgcaccaattgttagtgccgccaaggccttccatgaatctaacagcgttcaagaaatcaccaatcaatgttttgaaccctacaaccaaatggttaaatgtgatcctcgtgccggtcgctacatggcaacgtgtttgctgtatcgtggtgatgttatccctcgcgatgttcaagctgctgtaacgaccattaaggccaagcgtacaattcagttcgttgactggtgtcctactggattcaaaatcggtatttgtgatcgtccaccccaacacattgaaggtagtgaaattgctaaggttgaccgtgccgtctgtatgctctccaatactacctctattgcggaggcttggtcaaggctcgatcacaaatttgatctcatgtatagcaagcgtgcttttgttcattggtatgttggtgaaggtatggaagaaggcgagttttctgaagctcgtgaggatcttgctgctcttgaacgcgattatgaggaagttggtcaagattcgatggaagtcgattacatggaagaagagtac

SEQ ID NO: 26020 - DNA, 2259 bp, Schizosaccharomyces pombe
ttgtctgcggaagagcaaaccgcttttgaccaactgtttaaaattgcagataaacaagacattggcgttatcaccggagaagaagctgtaccgtttttggaaaaatcgggcttagctcctcaagtccttggtcaaatttggcaaatcgcagatgctgagaatcgaggatttcttacattttctggctttgtaattgccatgaggttggtggctctcgcacaagaaaagctaccttttgattacaaaaaatcggggaaaattccatattttgccgatatccatatctctggcgttgattcttcaaagtttgttcagctgaatcgaccaaataacgtttcttctggtgatggatctgatggttctttcttacctcctatttcttcagatgaaatgacacggtatcaacaaatgtttactacagtctgcccaactgacggtctgatggatggtgacagagctagctcaatctttggtcgtgcacctcttagtactgaaattcttgcgcgagtctggaatttagttgatactcataaacgcggggctctggatattcgcgagtttaataccggtatgcatataatcaaccttttattaaacggttccttaaagtctcctcctgtttctatttcaccatcatttatcgcttccgcagcttcaacctcatcagtttctgcaccctctcagtatcccggcctcagccgaagtccacctgtgcaagctccaaacatccctgtttcagatccatgggccattccatctcaagacttgactagcttctgtcagttgttttccaacgttgataaagcgcacaaaggatacgtttctggtagcgaggcatattcgtttttccttgcttctaaacttcctgaagatgtcttagcacaaatttgggaccttagtgacactaatagtaacggtaaattaaacattggtgagttttgtatatctctttatttaattaagctcaaattatccggaaaagagctacccaaagtgctcccttcttctatgctctcttcggttgctccattaatgcaaaagagcaaaagcgtgccaacttctatcccttccgttgttcctgctaatatttcgtctcctaatcccaaccctacgttggctcctaatcctacgggcccatcccgagtaacttcaggaactgaggatttactaagcttggatgctactcctttctctcctacccttgctcctcaacatacatcttcgaatgctacaaagcattcagcccccccagtaactaaaagtgcaccgttccctgttgtttcacctctccaacttaaccatactccagggtttcccacttctccagctgctaaacctaattcccctacatcaacattctttcctcaatccagttttgggcagacgattgccaaaaacaccatggacaaaccttcagcagttcgaacttctgttccctcacaacttgctgcccctattcctcaggttgcgtctgccgaacaactaaaattagctgcagaggtacccaagttagaatcgcaattatcccaagtaaagaaatctaatgatgatttacaaaagtcatctcgcgatgttgccgcaaacttaagcgatgtcaaagccaaggtcagtgaaatacgaaaggcctatgatgaggaactagcaaaagccaagcagatcagtttggacattgaaactaataaagctcaaactgagcaagttaatcgggagtactcaattttggaagccacgcttaatgcattgcaaaaacagaataaacaaaagggtgaagttttagagcaagtcgttgcagaatctgaagcggccaagaatatggtagagtcatctaatgcttcaattcaacaacttaagtccgaggttgctgataaagagcagacgctcgcccagttgcatttacaattggatgaaatgactcaacgtctggttagtttggacgaagagagtaaggctgtttcgcaaagaaaacttgacctagagtacaaaattaataactctaaaacgcaactagctaccgcaaccgaagaatatcacgaacactctaaacaattggaagctgaaaagcaagaactcagcaaattagaagatggattgaaatccgttaacctgactgaagaagctccgaaacccgaagtggattcgacacctcgtttcccatcttttaccagcaatggaattaccactgataagccaacccttcctgatactacttcctcggtgcccactcaacataattcttttgatgcaatgcataatactctc

SEQ ID NO: 26021 - DNA, 1377 bp, Schizosaccharomyces pombe
atgactgaaactgtaactactacgtcgagcgacaagtctgaaaaaaagaattatttgttctatacttctcctaatcacaggcctcccactgtggttcgtgctgaaggcgtttacttatatttggaagatggtacgaggattatggatgctactggaggtgcagcagtcgcctgtcttggacatggaaacaaggaggtaattgatgctatgcataagcaatcagaaaaggtttgctacatacacagcatggggttttcaaatgaacccgcagacaaacttgcaaatttgctagtatctgaacatcccgacgtttttgcccgagcttattttgccaatagtgggtcagaggccgttgaaacatgtttaaagcttattctgcagtactggcagctcgtgggtgaaaaacagagatgccatataattgcccgtaagcaaggataccatggaaacactttgtttgctctttctgttggcggaatgaaacctcgcaaacagccttatgaaggtgtgttttctcacacaacttcccacgtatctccttgttttgaatacaggtataaggaaaacggagagacaaccgaagaatatgttgctcgattagctaaagagcttgaggatgaaattcttcgcgttggtcctgaaaaggtggcagcgtttgtggcggagacagtatccggtgcttgcacaggttgtgctacccctgtccctggctatttcaaagcaatgagaaaggtttgtgacaagtacggagtgatcttttacctcgacgaggttatgtcgggtattggccgtacgggaacaatgcatgcatgggagcaagagggtgtgacacctgacattcaatctattgccaaatgtttaggaggtggttatcaacccatttctggagcgcttgatggtcatcgtattatgaacgtgtttgagcaaaaagatgctgccatggctggtttttttacatatcaagcccacccaattgcttgttctgctgccctggcggtgcaaactattttaagacgagatcatcttgttgaaagggcagcagaaatgggtaaatacctttcggaaaaattacatgagacttttgactctcatcccaacgtgggaaatattcgaggccgcggtttgttttggggactcgagatcgttaaagacaaagctaccaaggaatgtttccctcctgaatacaaagttggttctctcgccaacaaaataggttgcgagcatggtgttttcgtttatccaggcatgggtacaattgatggcaccagaggagaccacgtattgctggctcctccgtatattatcactcgcgagcaaatagatgaactagtggaggctcttagcaaaaccattacatctacagttgcggcccttcct

SEQ ID NO: 26022 - DNA, 1029 bp, Schizosaccharomyces pombe
atcgaggatcgtcctggtcagactttgactgatgaccatcaagtcaaagtcgccatcaaggctactggaatttgcggtagcgacgttcattactggaaagaaggcggcattggagacttcattctgaagaaacccatgatcttgggccatgaaagcgcaggtgttgtcgtcgaagttggaaagggtgtctcttccttaaagcccggtgatccagttgcggttgaacccggttgcgtttgtcgtttatgcgattactgtcgttctggtagatacaacttgtgtcctcatatggagtttgctgctactcctccatacgacggaactcttcgcacttactacattaccacagaagacttttgcaccaagctacctaagcagatttcagttgaagagggtgctcttttcgagcccatgagtgttgccgttcacgctatgacccgcggtaacctcaagtgtggttcgcgagtccttgtgatgggatgtggtacagttggcctcttgatgatggctgttgctaaggcttatggggcaattgacattgttgctgttgacgcttccccctctcgtgtagagtttgctcaaaagtatgttggtgcaaagccctttactcccattgctgccaaggagaatgagtcattacccgactacgcgcagagatataagcaagcaatcatcgaaaagtacggtgagtttgattttgctgtagatgccactggcgttggcatctgcattcacactgccgtattggcactcaaacgaggtggtacatttgtgcaagctggaaatggaaaacctgtgattgattttcccattaaccacatcattaattatgaaatcaacgtcttaggtagtttccgttacgcccatggatgctacaaacaatctctatttctggtatcaaacgggctggttgacgttaaaccactcattacccacagattcgctttcaaagatgccctaaaggcttacgaaactgtcgcaagcggcgaagaaggtgtgctgaaagtaatcattggtggtcccgatgcg

SEQ ID NO: 26023 - DNA, 1377 bp, Schizosaccharomyces pombe
atgactgaaactgtaactactacgtcgagcgacaagtctgaaaaaaagaattatttgttctatacttctcctaatcacaggcctcccactgtggttcgtgctgaaggcgtttacttatatttggaagatggtacgaggattatggatgctactggaggtgcagcagtcgcctgtcttggacatggaaacaaggaggtaattgatgctatgcataagcaatcagaaaaggtttgctacatacacagcatggggttttcaaatgaacccgcagacaaacttgcaaatttgctagtatctgaacatcccgacgtttttgcccgagcttattttgccaatagtgggtcagaggccgttgaaacatgtttaaagcttattctgcagtactggcagctcgtgggtgaaaaacagagatgccatataattgcccgtaagcaaggataccatggaaacactttgtttgctctttctgttggcggaatgaaacctcgcaaacagccttatgaaggtgtgttttctcacacaacttcccacgtatctccttgttttgaatacaggtataaggaaaacggagagacaaccgaagaatatgttgctcgattagctaaagagcttgaggatgaaattcttcgcgttggtcctgaaaaggtggcagcgtttgtggcggagacagtatccggtgcttgcacaggttgtgctacccctgtccctggctatttcaaagcaatgagaaaggtttgtgacaagtacggagtgatcttttacctcgacgaggttatgtcgggtattggccgtacgggaacaatgcatgcatgggagcaagagggtgtgacacctgacattcaatctattgccaaatgtttaggaggtggttatcaacccatttctggagcgcttgttggtcatcgtattatgaacgtgtttgagcaaaaagatgctgccatggctggtttttttacatatcaagcccacccaattgcttgttctgctgccctggcggtgcaaactattttaagacgagatcatcttgttgaaagggcagcagaaatgggtaaatacctttcggaaaaattacatgagacttttgactctcatcccaacgtgggaaatattcgaggccgcggtttgttttggggactcgagatcgttaaagacaaagctaccaaggaatgtttccctcctgaatacaaagttggttctctcgccaacaaaataggttgcgagcatggtgttttcgtttatccaggcatgggtacaattgatggcaccagaggagaccacgtattgctggctcctccgtatattatcactcgcgagcaaatagatgaactagtggaggctcttagcaaaaccattacatctacagttgcggcccttcct

SEQ ID NO: 26024 - DNA, 1080 bp, Schizosaccharomyces pombe
atggcacctgcagagaaagcattcgtcttgcgcaagaaaatggacactgcgatcgaggatcgtcctggtcagactttgactgatgaccatcaagtcaaagtcgccatcaaggctactggaatttgcggtagcgacgttcattactggaaagaaggcggcattggagacttcattctgaagaaacccatgatcttgggccatgaaagcgcaggtgttgtcgtcgaagttggaaagggtgtctcttccttaaagcccggtgatccagttgcggttgaacccggttgcgtttgtcgtttatgcgattactgtcgttctggtagatacaacttgtgtcctcatatggagtttgctgctactcctccatacgacggaactcttcgcacttactacattaccacagaagacttttgcaccaagctacctaagcagatttcagttgaagagggtgctcttttcgagcccatgagtgttgccgttcacgctatgacccgcggtaacctcaagtgtggttcgcgagtccttgtgatgggatgtggtacagttggcctcttgatgatggctgttgctaaggcttatggggcaattgacattgttgctgttgacgcttccccctctcgtgtagagtttgctcaaaagtatgttggtgcaaagccctttactcccattgctgccaaggagaatgagtcattacccgactacgcgcagagatataagcaagcaatcatcgaaaagtacggtgagtttgattttgctgtagatgccactggcgttggcatctgcattcacactgccgtattggcactcaaacgaggtggtacatttgtgcaagctggaaatggaaaacctgtgattgattttcccattaaccacatcattaattatgaaatcaacgtcttaggtagtttccgttacgcccatggatgctacaaacaatctctatttctggtatcaaacgggctggttgacgttaaaccactcattacccacagattcgctttcaaagatgccctaaaggcttacgaaactgtcgcaagcggcgaagaaggtgtgctgaaagtaatcattggtggtcccgatgcg

SEQ ID NO: 26025 - DNA, 1173 bp, Schizosaccharomyces pombe
atgggatacaaacaactaatttataaacttaatcatcctcctcttagacggattgatgaaaggaatgatcctttgttttcaaatggctgtaagaacgttcatttggaagcacagttgcatccgagaatgaatgcaacttttgttatgcttgctcgtaattcagacttgccaggtgttgtttcttctatcaattcattggagaaacactttaatcgacattttaattacccttatacatttttaaacgatgagccctttgatgaaaaatttaaggaaaccattcttaaacttacatctgcgaacgttgaatttggaacgcttgaaaaagatacttttggatttcctggtaatgttgatgtagatgcagcgcgtgaagctattgcaagtcaaggagatcgaggtatcatgtatggtgatacagaaagttaccatcatatgtgtcgctttttttcggggttcttttataagcatccgttgctactcaaatatcaatggtactggcgagttgaacccgacgtagctttcacatgcgatatatcttatgaccctttctactacatggaagaaaatgggaaaatatatggttatgttgtagcattaaaggaattagaagacactgttccaaacttgtttcgatatacctcggcttatcgtcgaaataataatttaacctctaacatgtggaaattctttttggatgctcctaaaaaggaaaactacgatatttcaagaaaagaccctacagtaggtctctccttttcctctcatttaaatgctatgattgactcatcatattcagcagaaacatcttcaatggaaggggagtcctataatatgtgtcatttttggagcaattttgagattgcaaatttcaagttcttcagaaatgaacagtatgagaacttcttccgtacaatggatgcgacaggaggcttttggactgaaagatggggagacgctccatttcactctctagctgctggactgttcttgtcgaaagaacaggttcattattttcgtgatttaggatatcggcattctgacattcatcattgtggacaaagtctgggttgcaattgcgaatgcattcctgagttatcagaaatagaatctacttctggaggttgtgtcacccaatgggtgaatttaataggtgatggattcttagatgaa

SEQ ID NO: 26026 - DNA, 1383 bp, Schizosaccharomyces pombe
atggcagaaaaatcaagcaaaaaactatggggaggtagattttcaggagctactgatccactgatggcagaattcaacaaatccatctatagtggaaaggaaatgtgcgaagaagatgttattggttccatggcgtacgcaaaagccttgtgccagaaaaatgtgatatctgaagaagagctgaatagcatcctaaaaggattggaacaaattcaaagagaatggaattcgggtcaattcgttttggaaccatccgacgaagatgttcacacagcaaacgagcgccgattaactgagataatcggtgatgttgctggcaagctacatactggcagaagtcgtaatgaccaagttaccaccgatttgcgtttatggctatgcagaaaaatcaaagaggttgaagtctatgtcattaacttgcttaaagtttttaccaacagagctgagatggagattgatgtaataatgtcaggttatacgcatttacaaagggctcagcctgttcgttggtcccattttctcatgtctcacgccttgcctttattaggtgaccttggcagacttcgtcagctgtatactcgtgtaagtcaattaccgctgggtgctggtgctttagctggcaaccctttcaacgtcgatcgcgagttccttcgtaaagagcttggattcgaaggcattatcatgaattccatgaatgctgttggtgatcgtgattttgtcatcgaatttatgttttgggcaggcatggtaatgcttcacatttctcgctttgctgaagatcttatcatatattcgagctcggaatttggattcgtcacactctccgatgcgtattctacgggaagtagtattatgccccaaaaaaagaaccctgattctttagagctacttcggggtaagagcggtcgtgttttaggtgatatgattggcctcatgataactgttaaaggcacacctacaacctataacaaagatttgcaagaagacaaggaaccactatttgatgcctttaagaccgtctctgactctttgcaaattttgactggcgttgtctcaacccttaccatcaatcctacaaagattgccgaaagcttgacccccgatttactagctaccgatttggctgagtatcttgttcgtaaaggtcttccatttcgccaaactcatcatatttcgggatccgcagttcgcatggctgaagagagaaacactactctcgacaagttatcagtttctgatttgcaatcattgcatcctttatttgatgaagacgtttcaaaagtctttaattacgaagaaagtgttgaaaaaagatgttcaattggtggtactgctaagcattgtgttcaagaacaaatcgagcatatacgatcagcaattctt

SEQ ID NO: 26027 - DNA, 815 bp, Schizosaccharomyces pombe
gtttttcctctttctacaataattactcgtgttcagtcttcactatcttttcagcaagctggaggttttcaacacctttatcgtggcttaagtagtgtattagttagcacacttccttctggtaagacaaaagcagctgtttgggggagtttttttatttaactaaaaagttttatattcctcaatttacagcagagctttccataatattctactaactttttgttatagcatcttccttcttttttgtgtacgaatatgcgaaggcgcgacaaaaacctggagtccgaaatcatctggtctctgcttcggtagccgaagttgtttcttgtggcattctagctcctgcagaagtcgttcgtcaaagagcacaaatatcaaaaacctctgtgtctcaaatatttcaatccatgatacataattatcgggatttgtggcattccttcaaaggcatgtgtggacgcaacgtccccgctacggcatttcaattcgtactttatgaacagtttaaaaagaagttctcggctacggatcacgtatttggagccccgaaaggggccgcccttagcggcgctattacagcagctgttttgactccgttagatgttataaagacacagatcaatttacgtcctgagtcatatcgtaaggttgttcgtcgaatatacaaagagaatgggatttttgggttcgaaaaaggtcttggcttacgggtttttgcttcttcattgggcctttctatttatttgggaacatatgagcatgtgaagtctcaccttcatatccgtaaagctggagaagtcagtgtagcataa

SEQ ID NO: 26028 - DNA, 1335 bp, Schizosaccharomyces pombe
atgcaaaccaaaatttttgcacgtcttgctggcattggtcgggctcggtttgttggtacgatgcccgacaagaccaaattcatcagtaaatctggaacgtatccacaaggtttcagcttaaatggtattgcttccggcgtaaaagccaatggaaaaaaggatttagccattttattttcctctcgaccatgcaacgccgcagccgtctttactaagaatgcatttcaagctgctccagttcaagtttcacgccaaactctgaacggctgtggcggtaaagatattcactgtgtcgtgttcaatagcggttgcgctaacgctgttactggtgagggcggtttgatggatgcccaactcattaccgccgaagctgataatttgactcgtccacattggacttcgtggactgagaattcagaggaatttccctcgtcgttggtgatgtcgactggtgttattggacaacgtttgaagttagacaagattcaaagcggtttggaacacgcggttgaagacctcgggtccactcatgaatactggatgagagcagctgaggccatttgcactacggatactttccctaaactcgtttcccgtgaacttagtattgcaggcaaagtctacaggattgcaggttttgccaagggcgcaggtatgatcaatcccaacttggccactcttttaggtttgtttgttacagatgccccaatctcagttgatgcagtccgatctatacttcgtcatgcaattaacaacagtttcaattctatcagtattgatggtgatacgagtacaaatgatacaattgccttccttgcaaatggagctgctggtggatccgagattaccaagtcttcccctgcatacaaggagattcgtgatgctgtaacggatattgctcaacaacttgcaaagctggttgtccgtgacggtgagggtgctacgaaattcgttactgtgcaagtcagaggcgctagatcagagaaagacgctgcgttggtggcatcaaccattagtaactctgcattggtgaaaacggcattctttggtgaggacgctaactggggtcgtattttgtgtgccgtcggttattcaggtgctgctgtcaatcctcctgctacgaccgttagttttattcctgcagacggaactgaaccattgaagcttttagtaaatggtgaaccacaaaatgtcgatgagacccgtgctagcgaaatattatcgcaagacgaactcactgtagacgttgatcttggatgtggtccttatgccaaaacaaattggacttgcgatttttcgtatgactatgttcgtattaatgctgattatcgcagt

SEQ ID NO: 26029 - DNA, 2058 bp, Schizosaccharomyces pombe
atggcttttttgtctgcatgtacatcatggagacatgttcataatgcaggttttacttttattacaaaattccctttcgttcgcaatgtgcataaactctcatatcatatctctcccctctctagccgattttctttagctgatatatcagtgaaggaaaacaatcatcctaatggtcctcagttacgattacaaactcatttctttcattcatcatctccaatgcatgcaacaaagggttttcggtttccaaaatcctctacccctttgactcttcctgcagttttgtcagtcgcttcatttgccaatttactacaaatacctactcgtagaattttgcgcgaccttaatcgtctcggtataaaagacgtgtttcctgagtatcttatcacttatgagtattcaagtcttttagctgaggaatatggatttgatgttcaggaagcagcggcctactcagcaccatcacctaagtctcttaactccaaaaaggattcaggtcctcttcgaccaccagtagtgactttgatgggtcatgttgatcatggtaagaccactttgttggatgcttttcgtaagtctactattgcatccaccgaacatggaggaatcactcaaaaaatcggcgctttcactgtcccatttgataagggatccaaatttatcacttttttggatacacctggccatatggcttttgaagctatgcgtaaacgaggcgcaaatattgccgatattgtggtgcttgtagttgcaggagatgatggtgtaaaaccccaaacagttgaagctattaagcacattcagtctgccgatgttcccgtcgttgttgctcttacaaagtcagatcgtccgggtacccctatccataaaatctatgaacaactattaaacaatggtattcaagtcgaagcattaggaggtgaaactcaaattattcccatctcagctaaaactggcaaaggtatacccgaacttgaggccgctatcttgactttggcggaaattatggagatccgtgcttcaccaagggacccttttcaaggatggattgttgaatccagtgttaccaaaggtgttggttcctctgctactgttgtcgtaaaacgcggaactgtaaagaaaggaatgtaccttgtggctggaaaatcatggtgcaaggttcgctctttagttgatgtaaataagaaatctataaagcaggttttgccaggacaagctgcccaggtgtatggttggaaagaccttccaattgctggcgacttagcatacgaagtgaaaagtgaatccgaagccaagcgtatcctttctgatatatatcgtcagtctaatgaacaaaatttttatgagctagcagagtctcaaaatgaacaaagggtatcagctcttgcggccaaaaagtctggtcctgcggcgattcaagaagagacttcggtatctaaatcctttaatatcattgcaaaatgtgaagacactgggtccatggaggccctgtcagattatctcaaaccattacaatttggaaaggtaaaatctcgagtcttgtatactggggtgggtccagtaaccgaaactgatattgagagagctgaaacatccgatgccatcattatatcgttcggtgtttccgttccgaaagctacttttcgtttagcagaaaaacacaatgtaaagctgttgtttcacaacgttatttatcatttaatggatgatgtacggaaactttttgctttgcgattaccgcccatattggttcagcgtgttaccggagaagctattattagtgcaatcttcgacatcaaagctaaaagagcagttgttcatgtcgctggttgtcgagttactaatggaactattgaaaaatcccataaaatacgtttagtacgtaatgacaaaattatttggtctggtgaaattgacagtctaaaacacttaaaagaagaagtcaccagtattaaaaaaggcagggaatgcggtatattattaaaaaattttgacgaaatagttacaggggataagctacaaacatttgttgaggaatacaaacctcctgatttt

SEQ ID NO: 26030 - DNA, 2545 bp, Schizosaccharomyces pombe
atggaaaaagcgtctaaaaataaggaaagtggggttaaaaaagcgaataactcttttttacaaaatttcggtgtaaatacagcagggaaagaaaatgaatctacttcattaccaaggttgcccaaaagcgaagatgaatccatcccaaaacaatctataaaatctaagaataaaaagaaaacccaacattttctttctgatgcttttgaaagcttaaagagacaggagatagatacaaacgaaaaggaagtaatcgtctccgcgcctataactagtaaaccagctcaggttttttatagtaaaaaattggaacgtaaggatgagggaataaggaaatgggagaaagatccatttgcccctatctcagtaaaatctggtgcgtggaagaaaccatataccaaggttcctgaagtctcaataaataaagcaacttcgaaaagaacggacttgataaatgataagcctattgtgattccaattcccagagcttctacttcaacgctatattttggtaagcacaataaaccaacttctgaaaatagaaaaggccccataggtatacccactgaagaaatcttaacttcccaaaatactcaagcaatgctacataaactgtttgagaataatgtgctggacaatgttaaggacgattcaatgcagaggcagtcctcgtttattcctggcatgcatatacgtctactagatcatcaagtccaaggacttacttggctcaaatcaagagaaacggtgtctaaatcttcggcttccggcggaattctagcagatgatgtaagtcatgaaaatattatttgttgttattcagtgctaataatttttttagatgggattgggaaaaactattcaaatgatcgctttaattctttcgcatcccttaccaaagaagaagcattcaatcaaatccactttggtagtagctccactcagtttaattaaacagtgggaatcagaagtgcagacgaaaagcaagttgacagcaatcgtttatcatggagcatccagatataaattacttaaagtaattcacgaatacgatgtagtaataaccacgtatcaaatactagtttcggaatgggtgtctcacaatactacaggtacagacggcaaatcgcctactgaagctaaaagttatgaaaagaaaaagccaagcttgtttgccttctattggtggaggataatactggatgaagcacacactataaaaaataaatcttctaaatcagctcttgcctgttgcgcattacagggcatcaatcgctggtgtctcactgggacacctttacaaaacaatgtagatgaactttactcacttgtgaaatttcttcatattaatccatttaacgaccaatctgtttggaaagatcaaatttctttacctttatgtcaaggagaggaaaacttggtttttaaaagacttcgaatgcttctgagtgtaatcatgttacgacgaacgaagactttgttagaggcaaacgcgggcaaagatggtacaggtggtgctttaaaactttcaaagcgtttggtgtataaggttatttgtaaatttgaagaaagtgaacgtgacttttacagtaacttggcacgaaacatggaacgaacgatgtcaaattttgttaattcggggaaattaggcaagaactatactaacatactgtgtcttctcttgcgtctacgacaggcttgcaatcatcctcagtctttaaattttcaatttgaacaagacgttgatgcatttaatgcgttggatggggcagcaaacacgaacaaattagcttccgatcaagatgttgatgatttggcaaacctattagaaacagttgaaataggaagccgtaaaaagtctttttgtacaatttgtatggccgagcttcctcccgattttcatgaaaaaaaatgcaaagattgttctcgaaattttaaagaattggataaaggaattcaagaccctaatgataagacgctatacaagtcatccaaaattagggaaatcctcaaaattttatctctagatgaacaagaagaggatgatacagttcgggggttacgaaaaacaataattttttctcaatttaccacttttttggatatcattgacttacatttgaggaaagccggtataggttttgttcggtatgacggtcgcatgaacaatcgtgctagagaaaaatctttggacctccttcgctctgatagtggaactcaagtactattatgctctttaaagtgcggtgctcttggtttaaatttaacatgtgcaagtcgtgtaatactttgcgatgtttggtggaaccctgcaattgaagaacaagctatcgatagagtacatcgtattggacaaagacgtgatgtacttgtttataagctagtggttgaaaatacaattgaagaaaaaattgtcgaacttcagaatcttaaacgagaccttgccaagcaggctctcggagatggcaaaaagtcggtttttacctccaaaaaattaacacttaatgatcttttgtttctatttaacaagcgtgccgcggcttaa

SEQ ID NO: 26031 - DNA, 1446 bp, Schizosaccharomyces pombe
atgactacccgtcgtttaactcgccagcacctattggcaaataccttgggcaacaatgacgaaaatcatccttcaaaccatattgcccgtgcaaaaagctctttgcactcttcagaaaattctttagtaaatggcaagaaagccactgtgtcttccaccaacgttcctaagaagcgtcatgcgttggatgatgtttccaattttcacaacaaagaaggtgttccattagctagtaaaaacacaaatgtcagacacactactgcttctgtcagtacccgtcgtgctctcgaggaaaagtctataatccctgcaacagatgatgaacccgcttccaagaagcgtcgccaaccttctgtttttaattcatcagtcccctcgttacctcaacacttgtcaacgaaatcacactctgtttcaacccatggggttgatgctttccataaggatcaagcaactattccaaaaaaattaaagaaagatgttgatgaacgcgttgtttcgaaagatattcccaaacttcaccgtgatagtgttgagagtcccgaatctcaagattgggatgacttggatgcagaagattgggctgaccctcttatggtttctgaatatgtcgttgatatttttgaatatttgaatgagttggaaattgaaactatgccctctcctacttatatggatcgtcaaaaagagcttgcatggaagatgcgtggaatacttaccgattggttaattgaagtgcattctcgtttccgactgcttcctgaaacattgtttttggccgtaaatattattgatagatttttatcattgcgggtatgctctcttaacaaactacaattggttggcattgctgccttgttcatcgctagcaagtatgaggaggtgatgtgcccttcagtccaaaactttgtatatatggcggatggtgggtatgatgaagaggaaattcttcaagccgagcgctacattttgcgtgtcctagagtttaatcttgcttacccgaatcctatgaatttcctacgtcgtatctcaaaagccgacttttacgatattcaaacaagaactgttgcaaagtatcttgttgaaattggtcttttagatcataaacttttaccttatcccccttcccaacagtgtgctgccgctatgtaccttgccagggaaatgcttggacgtggaccgtggaatcgtaatcttgtgcattactcaggttatgaggagtaccaattaatttccgttgttaagaagatgattaattatttacaaaagcctgttcaacatgaagcttttttcaagaagtatgcctccaaaaagtttatgaaagctagtctttttgttcgtgactggatcaagaagaattctatccctcttggcgatgacgctgatgaagattatacttttcacaagcaaaaacgtatacaacatgacatgaaagatgaagaatgg

SEQ ID NO: 26032 - DNA, 958 bp, Schizosaccharomyces pombe
atgtcgggatatgatcgtgcattatccgttttttcaccagatggacgcttgcttcaagtagaatacggacaagaagcagtccgccgtggtaccactgcagtacgttgtaaaccagagtagaattggatggaataaattgcttacatatatcattaacagattgctcttcgaggaaatgagtgtattgtaataggtgttgaacgaaagaatgttcctaaacttcaaaacgtttctaatttccaaaaaattgctatggttgataaccatgtttgtctagcatttgcagggttaaatgccgacgctagaattttaattgataaagctcgtgttgaagcacaaaaccataaattgaatttggcagatcctgtttctattgagtatttaactcgctatgtcgctggtgttcagcaaaaatacactcaatctggtggtgtacgaccttttggtgtttctacccttattgctggattcgacgttggtgataacactccacgggtttaccagacagagcctgctggtatctataatgcatggtatgtccgttatatgtttctgtaaaatcagcattgctagtttacctttatggatgcttttttttttttttttttgctttcttccttcctaagaccaatttgttaacaaagaatataggaaagccactgcaatcggccgtgctagtaaggctgctcgtgaatatcttgaaaaaaattggaaagaaggactatctcgcgacgagacaattcacctcgccgtttccagtcttttagaagtagttcaaaccgcttctggaaacattgagttggccatcatggatccaggcaaagatgtagaattcttgcattccgataaaatagacactattgttaaagagattcaagatgagaaagaagctgaagctgctcgtaaaaagagtggccgttctgcccctggagtctctacaacttctacgattcaataa

SEQ ID NO: 26033 - DNA, 807 bp, Schizosaccharomyces pombe
atgagttcccaacaagagaaaaaggattatgatgaagaacaattaaggttgatggaagaagtttgtatcgttgtagatgaaaatgatgtccctttaagatatggaacgaaaaaggagtgtatgtttgattgttggagatttataatgaaattgaaggaaacccattctaacaagccttttaggtcatttgatggaaaatataaataaaggtcttttgcatagagcattctctatgttcatctttgatgagcaaaatcgccttttacttcagcagcgtgcagaagagaaaattacatttccatccttatggacgaatacatgttgctcccacccattggatgttgctggtgaacgtggtaatactttacctgaagctgttgaaggtgttaagaatgcagctcaacgcaagctgttccatgaattgggtattcaagccaagtatattcccaaagacaaatttcagtttcttacacgaatccattaccttgctcctagtactggtgcttggggagagcatgaaagtatgtggttgatccgtgtttctctttattgaacacttgactaacggacattctagttgactacattcttttcttcaaaggtaaagttgagctggatatcaatcccaatgaagttcaagcctataagtatgttactatggaagagttaaaagagatgttttccgatcctcaatatggattcacaccatggttcaaacttatttgtgagcattttatgtttaaatggtggcaggatgtagatcatgcgtcaaaattccaagataccttaattcatcgttgctaaagt

SEQ ID NO: 26034 - DNA, 1581 bp, Schizosaccharomyces pombe
atgtcgaaagcagcaacggttcccgtggcatttcaagaccgagaaaagcctcaagaggttcggctttcaaatattatggcggctcgctcagtcgccgatgcgattcgaactagtttgggaccgaagggaatggacaaaatgattcaaacaggaaaaggtgaagttattctaacaaatgatggtgcaactattttgaagcacttgtccgtccttcatcccgctgcgaagatgctggtcgacttaagtgccgcacaagacgttgaagctggtgatggtacgaccagtgtagttatcttagcaggatccatgctcgcatgcgctgagaagcttttaaaaaagggaattcacccaacagttatcgcggaatcttttcaaagagcagcaggttttactgttgattgcatgaaagagaatgctttggccattgagctgtctgatcgtgaatcactcttaagggcagcaaccacatctctaaattccaaaattgtttcacaatacagtaaccttttagctccaattgctgtagatgccgtattaaaggtcattgaccctcgtgttgcgacaaatgtggatctgaaggatattcgtattgttaaaaaattaggtggtattattgacgataccgagttaattcccggattggctttgacacaaacggcagtcaagagcgctggcggtcccacaaggattgaaaaggctaacattgcgcttattcaatttcaattatctcctcccaaacccgatatggaaaatcaagtagtagtcaatgattacagacagatggataagattcttaaggaagaacgtcagtatcttttgaatatgtgcaaaaaaataaaaaaggcaggtgccaatgttattctcatacaaaagtcaattctccgggatgctgttaatgatcttgctttacactttttggccaaactcaaaattatggtaattaaagacattgagcgtgatgaggtggaattcatttgtaaatctactggatgcaaacctattgctgatattgaatcctttgcagaggataaactaggacatgcggatttagtagaagagacatcttcttctggtgaaaaaatcgtaaagtttagtggtgttaagaatgctggaaaaacagtctccatattatgccgaggtgctaatctgttgactttagaagaggcagaacgctctcttcacgatgctctttgcgttatccgctgtcttgtcaagcagcgtgctttgattgcaggtggcggttctcccgaaattgaggccgctcagcgtcttttggagcatgcacgtcagcttgaaggacgtgaggccatttgtatccgtgcattttcggaagctttagaaatcattcctgttacactagctgagaatgcaggattgaatgctattcaggttgttactgagttgcgtagtcgtcatgctaacggtgaaaagactgcgggtattaatgttcgtaagggtatagtgaccaatattttagaagaaaacgttttgcaacccttgctcgtcaacattagtgcaatacagctggctgctgaaacgaccaagatgatcatgaagattgacgacattaccttagctcgt

SEQ ID NO: 26035 - DNA, 4374 bp, Schizosaccharomyces pombe
atgctagaattaaaaacaaatgttattcaagaccctgaattaaaggattcattagatttgcaagagaatgatcgggttgaaatcattggagatgctgtgcattatattgtgaatgaccatttaaatcgtgtatttaattataccgtagatcaacaaaagatacatgctgcccttattactacatttgcatctggaaaaaaggcaattgttgtgattctggacgacattggatatgtatactatgtgggcgacaataataatgattcttatattataaacgttcctttttcaacagaaagcgcatggagttcaccaagtggactatatcttcagcgtcatcgttcgagcgatgagaatctgaatactgacttgcctcatattttttgtctaaacgatcctttagatgaacttacgttaataaaatttgacggaaaaaaaatactatctctgtttgattcaatcgtttatgtcgtgggagagatcgtcgtaacacataataaaaaagaaaaaaaattgagtttttggaggagtcgctttattgatccagagtcagaccagtcaataaaaagctcacgtaacagaagaagggaaagctctttttctcgtgaaaagaatcctgacttaactcgctctgattctatccattataccgccaatactcgtctttctgaaaaattcgaggaacaaggactcgcttattcgaccatattttctcacatagagtcttttcctatcaccggaagtacttcgtttgattcaatccttggaaatggtgttttggtcatcaccactttagtgaaagagcttgaaaaaggctacatgatgttgtttcgccttgttcgtgacagatctccttacttcttagattcgcttcaactacatgcaataaatttgagtgctattaaatctaagcatttgcaaaaaattgttgttctgtcttcaaaggggaaggtgagtctcgagtctccaatgtcgccatctttgcctattgagggtacctttcgttcatttcgtgtgcatggtgccacactttacttagaggacaccgatggagtgcagaggtatatatctctagataacagagcatccaatagcttggtaaaatggtgtttaagtgttattcgttatgttttgcccttgcgtgaatatgaaattttttatactggacatctttacgcgctttttgcttttaagcttagccatgatgaggctttcatatcttcaatactcgcctgtttcactttcttttctcgagataaagttcatgttgaaccaattgaagattgcaatgaagcttacagtctgtcctctaagtttcattttaaaaaagaaatacttattgcttctcagctctcatctcatcttgattactcaacattcaaaaattacttgatgcccttagctattaccttacattttatatctgaagaattgcggttggattcggttgtaaagcctcgtaaagatcagcttgtagctttattacttcaaatcaccacgtggttgaagtggccacggtattgcgagtattataactttgatatcgctgaaacatttctatctatacccttatcgattcaagttgatgttgaggaacctgttggtccaacatcgattttacagtggattattgaatgtttaaggtcgcaatctacagtacctttttatggcttggaaagttatgggctaccacattcttgctctactatgtttccccaaaccctttctttaatgcagttactcgattgcttgctaaatcctaatatgacccttcaaaacttagttgaagaaatggtacggttaggaatttcaagaaagaggtgtgaaagatacccatttggaattttatgcattatttttacagtactcgagattgccgctgaagagtattctccgaattgggaaagcgaagagcttcgattagtcaatcgccttgacgttgattcattcttacatccaaagacacctaaatgggtttttaataagcaggatcaagaagtcaaagaaataaaagcactcactagtacagttaccgattctacacttgttgacacgcagtcgtttcatccttataaggttgtaacggatatgatttttagagaggatcgacgactggcagaagtgaataaacttttaaattattcaagtcaaatcaccataatgactgaacactttgatgtcgacttgagttcagtaccaatgcaacaaaaagttgctcaatgcatttgcgttagaacattgtccgtgccaattggagcgggtatgcttacgtatggtagtaaaaatcctttacctacggaaaaggtcactccacgattatttaattttacattgcacttgcatcctggaactttaattatacaacctaataaagagttcgtaacacaggaattaaccgagtggccagagtttaatgttggcgttgcattaggattatcgatatctaagttttcaaaggaaataaacactagttggattatgttcaatcgacctgaaactttgactgcttaccatgcgggatttctttttggtctagggctaaacggtcatttaaaggcccttgctacctggcattcttttatttatcttactagcaagcatgatacaaccagtataggccttttacttggacttgcatcctcgtatttggggagtatggatgcaaaggttacaaaattgctaagtgtgcacatttcagcattactgccagttggatctaatgaattgaatatttcaccattaactcagactgcaggaattctaggaattggtttattatttcatgattcgtgtcatagacgcatgtctgaagtgaccatggaagagattttggcttctaatgaaagcgaactaaagaatgaaggctataagttagctgctggattttctcttggtttaattaatttagggagaggatctaatcttccaggcatgtctgatttaaaactcgtttcaaggctacaagtgggaatatctagtcaggctacatttcagtctttagaagccggttctcccggggccattatggctttgactatgatatatatgaagactaatgatttggaagttgcgaaaaaaattgatattcctaaatcgcgatatcttcttgatttctatcgtccagatctaatacttttgcgagttgccggtaaaaacttaattatgtgggatgaagtcaaagcagattatgaatgggtgaaatatcaaattcctgatataatgctctcacaatttgatttacaggaaaaaaaggttctctcttctgacgacttgctgctttataatgtcttagcagggatttgtttttctttaggtttaaggtttgctggaacgggtaatccgaaagccaaggaaattctcatcaactttttagatagcttcattcggttgtgtcatctgcctgctaaaacacacgatgaaagagtaactgcagtgactgtaattcgctgtacacaaattgtcgctttgtcttcttcttgtgttatggcgggttattgtgatctagatgttttgagaaggttaagagtactacatgggagaatggagcctgtgaactacggggctcaaatggctactcatatggcgctcggaattctttcgctaggtggaggaaggtatagtttgtctcgcagtaatttagcaatcgcggctttgttaatatcattttatccgcaatttcccaggactactcaagataatcgtgcacatttgcaagctgctcgaaatttgtgggctttagctgtggaagaacgttgtattatcccgagaaatcaagataccaaacagccatgcatagtgccattaaatgttgttcaaaaaagcggcgcagttcaaaaactagaagcgcctatacttttgccgccgtacgatagcattagttcagtgtcgacgttgggtgataagtattggaatttaaaaattgatttggacaataacagtgattaccgtgaactattaagggaatcacaaacactgacactgatgccttatgaccgaacaagttcaaaagaagagccacttaatctattccctaagcttaaagatacctcaagcccactttggaacttggtaaaaacaagcaggttgttccaaagctcgaatagccccttaaacgttgcatcgttacaagaatcaaataataaaacttctctaggcgttaaattactcctgtctatggactttgataatttaactagagaccgtttattaagtttgcaaatactgttacaattttttgagtcttgttggactggtgtgctcttgaataagtttcactcccgtcaatatcttttcctttctcgtgatttggtagaagatttgagtttgagagtatgggagtatgtgtattctcataatcataatgaagaatctgta

SEQ ID NO: 26036 - DNA, 1536 bp, Schizosaccharomyces pombe
atggatacgactgccgttgcttccaaaggaagtactaacgtgggttcttcaactgacactctatctacaagtgcctctttgcatccatctatgaatgccggcagcgttaatgaatattcggaacagcagcgacatggaacaaattcttttaatggcaaaccctctgttcatgattctgttggtagtgatgcaagtgtaagcaatggtcataataaccataatgaatcaagtctgtggacttcgggcatccctaaagctttggaagaggccacgaaaagcaaaaaacccgacagcttggttagcaccagtacgtctggctgtgcaagtgcccattctgttggttaccaaaacatcgataatttgatcccttcacctcttcctgaaagcgcgagtagaagtagtagccaaagcagccatcaaagacattcgcgggacggtcgtggtgaactaggttcagaacacggagagagacggtcagctatggatgggctacgcgatcgccatattcgtaaagttcgggttagtcagctgctcgatttacagcgtcgaaggattcgtcctgctgaccacaccacaaaagatcgatatggaatacaagatttcaatttcttacaaacattgggcactggctcgtttggtcgagttcatctcgttcagtcgaatcacaatcgcctgtattacgccatcaaggttttagaaaagaaaaaaatcgttgatatgaagcaaatagagcacacttgcgatgagagatacattttatcccgtgtccaacacccgttcattaccattctatggggtactttccaagatgccaaaaatctgtttatggtcatggattttgctgaaggaggagagcttttttctttgcttcgtaaatgtcatcgatttcccgaaaaagttgccaaattttatgcagcagaagtgatccttgctcttgattatcttcaccacaatcaaatcgtatatcgagatttaaaacccgaaaatcttcttcttgaccggtttggtcatttgaaaattgtggactttggttttgccaaacgcgtctctactagcaactgttgtactctttgtggtacccccgattatttagccccggaaatcatatctttaaaaccgtacaacaaagctgcagattggtggtcccttggtattcttatctttgaaatgcttgcgggttatcctccattttactctgagaatccaatgaagttgtatgagaatatccttgaaggcaaggtcaactatccatcgtacttttctcctgctagtattgatttgttgagccatttacttcagcgagacataacctgccgctatggaaatttgaaagatggtagcatggatattattatgcacccttggttccgtgatatcagctgggacaagatccttactcggaaaattgaggttccgtatgttcctcccattcaagctggaatgggtgattccagtcaatttgacgcttatgctgatgtagctacggattatggaacatctgaagatcctgaatttacttctatctttaaggacttt

SEQ ID NO: 26037 - DNA, 1314 bp, Schizosaccharomyces pombe
atgggattgggattttcttcgaaaaagcaattacctgcctactgtggtcccttgcctgtggggtctttagtcttagagctgagtgttccagaggaatttcgatgtgaatataaaaccattgaacacaaactaagaaccgtaaaagtacgcattttttatccattggacccaacaaaagatgtagagcctcgcaccgatgagctttggttaccattccatgagggtatacccgaagttgcgaaaggttttcgttggtggcttcttcgtgcgttcgcttctggtttgaccaacttagctttgcccgtctacaaaggagagttgtttcatccaccgaacaatgggaaactgccagtatttatcttcagccatggattggttggctcgagaaatgtgtattcttcgttatgtggtacaatcgcttcctatggtatcgtcgtcttggccatggagcatagagataactcggccatcatatctacagtgcgtgatccattacatcctgaagaacccccgtacgttgttcagtatcgcgagataagcgacttttatgcagacgctacggttgtgcttcagaatgaacgacttttatttcgacagcaggaaatccaaatagccctccagatgattcgaaatatcaatgaccttggaactccggacgaaaacttaccctttctttgctctgtggactcttctttttataattctgttttccaatccatgaagggtaatttgaataccgctcaaggagaattgattgttgctggtcattcttttggtgccgctacttgcgcattcatttccggttcttctaccaagtccttatataatgactatatgtttcacactgagtttaagtgctccattttatacgatatatggatgcttcccgtacgccagctccatttgagtacgatgaggtatcctacgctcatgattatatcttacgaatttcgtcggtttgtcgacaattttcaagctctcgaaagttggcttgtaaacaaggattcagaaaaccaaaacgcaggcgaatccgctgatgagaaaatgtctgtcgttcctttaaaaaaatattcccacgtgtttgtttatgatggaacagtacatgctaaccaaagcgatttaccgattttgctccctcgcatggtactaagggtattgaaaggaaaatttgaagcagacccttatgaagctttacgcattaatactcgttcatctgtacaattccttcgtgaaaatcatgttgaaaatgttcagggagataatgatccttcgtcgttgcaaacaaatattattcctgggtgggaaagaattatg

SEQ ID NO: 26038 - DNA, 807 bp, Schizosaccharomyces pombe; identical to SEQ ID NO: 26033

SEQ ID NO: 26039 - DNA, 958 bp, Schizosaccharomyces pombe; identical to SEQ ID NO: 26032

SEQ ID NO: 26040 - DNA, 1446 bp, Schizosaccharomyces pombe; identical to SEQ ID NO: 26031

SEQ ID NO: 26041 - DNA, 2545 bp, Schizosaccharomyces pombe; identical to SEQ ID NO: 26030

SEQ ID NO: 26042 - DNA, 1389 bp, Schizosaccharomyces pombe
atgaagttaagtggtatttctctatggcttttggccgcatccatcgttcatgctggtaaatctcaatttgaggcatttgaaaatgagttttatttcaaggaccatcttggaacgattagtgtatatcatgaaccctactttaatgggcccactacctccttccccgaatcttgtgcaattaaacaggttcatttgcttcagcgtcatggatctcgaaacccgactggggatgacactgccactgatgtctctagtgcgcaatatatagatatttttcaaaacaagcttctaaatggctcaattccggtaaattttagctatcctgaaaatcctctttacttcgttaaacattggactcctgtgataaaggctgaaaatgccgaccagttgtccagcagcggtcgaattgaactttttgacttgggccgtcaagtttttgagcgctactatgagcttttcgacactgatgtctacgatatcaatactgctgctcaagaacgtgttgtcgactctgcagaatggtttagttatggaatgtttggcgatgatatgcagaacaaaaccaacttcatcgttcttccggaagacgattctgcgggtgcaaactccttagctatgtattactcttgtcccgtttatgaagacaacaatattgatgaaaacactactgaagccgcccatactagttggcgtaatgtttttctcaagcctatcgccaatcgcttaaacaaatactttgatagcggttataatcttacggtttcggatgttcgcagtctttactatatttgtgtatacgagatcgctctcagagataacagcgatttctgttcactctttactccctctgaatttttgaattttgaatatgacagtgaccttgactacgcatattggggtggtcccgcttcagaatgggcttccacattaggtggggcttatgttaataaccttgcaaataatcttcgtaagggtgtgaataatgcttccgatcgtaaggtattcttagcgtttacccacgactctcaaattattccagtcgaggctgctcttgggtttttccccgacattactcctgagcaccctctaccgactgacaaaaacatttttacatactcattaaaaacctcttcgttcgttcccttcgcaggaaacttaattactgaacttttcttatgttctgataataaatactatgtacgccatctcgtcaaccagcaagtatacccccttactgattgcggttatggtcctagtggtgcttcagatgggttatgcgagttgagcgcttacttgaattcttcggttcgtgttaattctacctctaatggtattgctaattttaactcgcaatgtcaggcgcattccaccaacgttaccgtctactac

SEQ ID NO: 26043 - DNA, 1230 bp, Schizosaccharomyces pombe
atgccccaagaagtaaaacgttgcgttctcgcctattcaggtggtcttgacacctcctgtatcctcgcctggcttattgaagaaggttgggaggtcatctgctatatggctaatgttggtcaagaggaagattgggatgcagcccgtgaaaaggccttgaaggtgggtgctaagaaggtttacgttgaggacttgcgtgaagagttcatcaatgacaccgtcattcctgctgctcaagctaacgccatttacgaaaatgtttatctcttgggcacttctcttgctcgtcctatcattgctcgccgtcagatccaaatcgccgagaaggaaaactgtatcgctgtctctcacggttgcactggtaagggcaacgatcaagttcgtttcgaattggcatattacgctttgaagccagacgttcaagtcattgctccttggcgtttgcctgtatttttcgagcgcttcgccggtcgtaaggatttgctcgaatatgctgctgctaagggcattcccgttactcaaaccaccaaaaagccttggtctatggatgaaaacattgtacattgctcgtatgaagctggaatcctcgaggatcccagtatgactcctcccaaggacatgtggaagctcaccgttgatcccaaagacgctcctgatgaggttgaagagctcagcattcactttgaaaagggtgctcccaccaaattagagtgcaaggatggtacctttagcggagtcgtttccatcttctaccaattgaacgctatcgctcgtcgtaacggtgttggtcgtatcgatattgttgaaaaccgtttctctggtttgaagagtcgtggttgttacgaaactcctggcttaaccattttgcgtactgctcatatggacttggaaggtttaacaatggaacgtgaagttcgtgctctccgtgaccaattcgttactttcaatctcgctaaaattttgtacaatggacaatttttctctccctgcactcgtatgcttttagcagctaacaacgtttctcaagaggtagtaaacggtgtagttaaactttctgtctacaagggcaatgtcactgtcctcggtcgtaaatctgatactgctcatctttatgacgagaaattgtcatctatggatgagcttggtggatttgaccctacatggacctctggtttcatccaaatcgagtctatgcgtttgcgtaactctgatgaaggaaaacattggatg

SEQ ID NO: 26044 - DNA, 2253 bp, Schizosaccharomyces pombe
atggctctcatctttgacagatttcctgatctgtttcccactgaaatttccaaagttaaattttttacaaaggatttctccaagaaggataaattaactgctttggatacctataggtcgttcccgggttctacttggaaaacgatcgtgacttttgctacacaagaagttttctatctgccggaaggactggagcctttaaaaagagatttttcttctatggataagcttaaattgattggaaaaatcacatataaacttaggttgaagggggatacagccctgaaatttgcctatcttcacgctccctctgacgtaagagacaaggttttcgacgatgcgttttggcaagagattataactcccaaagcctccttggaacagcaatcaaataatattcctacgggaatccaggattcgagcaagtatactgttaacggacctacggaaagagacaacaagtctatgaaatcgtttgtacgatcgttctttacgtcgacggattcatctgttgctgatactacaattattccgtcaatgactcaacagtttgacaaagatccatcgactctcgtccaaagcagtattgataaagaaattcaggtaaaagaagacggtactacctcttccgttgccgttaatgctgaaacagcggttcagaacgtaaacggaaccatcaaggaatcacaaggcactgaatccatttcgtttgcttcgaaaaacaattccgcaccttcggcagatgccaacaacggtaatatgacaaagttagtatcaaaggaaaaagctttcctcaataccgttactaccccaaatgctgatttgattatttccgaggaagatgagctaacggaaatgactctccgtactgctaacggctccgaacctaccaagaaatctaatagaagtgagcagagtaaaactgttgccaataccaatgttggtagtaagaacggcactactccccgttcttttgctcagaaatcatctaaaaggattaaaccgacagaaggctcggctaaccttaatactgttaccgagttgacaggaattggctcacgaattgcgatgaatggtagctccgttaaggcgtctaatatctcgactgaaaagagcaaaacgattgcgaagccaaaaccagctaaagagttatccccccaagcgacattaaatagtccaatacaatcggcagaagcagggaatgttgaattgaaactacatccccaaactcctgacaggatagtaaaagtagaaaggaaggtacattctctcaatatgacattgagatcaccgaaagctggtagtgcaggtaaggaaaacagttggagatcgaaatatttaagcgaagggaaaaattcgaaagccaaatacacggccaaacagccaagttatgaccgagctggttcgtctctcgcttcccctaccaaatcctcagcttctccattagtaaaagcaccaaaagagacacctgaaagactttgtaccgaaaatcaatcaaccgagaatgaagaccaagccaaccttaaagaatccgaattgccaaaggagaagagtgacatacaacccaaaaattccagaagtactatcgagtacattgaaacaagtacccgtgtttatgagatgccaaaagatactattcctagtcgtttcaagacaagtatcagcactgaagtacacgatggtagattgaaaaagtatccatattatcatgtaaaaacgcccgaaaaaggtactaccgttgttagtcgcacagtaacctcacccaaaagtggtgcgtacgcgtcaccgtccaaggcttcatacaatcaggattcttctccaaatgcatctttggagcaatgctttgttcagagaagtccaagtaaaatgctaactacattaagaaacaattcctcaacttttcctagtcttcgtaaaaacgcgatgattgcccggaagagtactgctgattctcttagctctccgaaacgtcaaagtgtaccttcgacaccgaaagcttctttgtcacctcgcgtccacaaatctatgacatattctcctagcgaagcttctccattgtacgcaaacaagtcaccgaaatcgtcaactatggttccacttatgaagtacaaatcgggtctcaatgaaggaatgcggactagtagtatctactcaagtacttcttcaccttacattcgcgaccaatatttcttaaatcgcatgttgacgaatgggtcgcacaatggctctccttcttggagggatggcttactt

SEQ ID NO: 26045 - DNA, 1287 bp, Schizosaccharomyces pombe
atgccagtcgagagtgaacatttcgaaactttacaattacatgctggccaagagcctgatgctgctaccagctctcgtgccgttcccatctacgctactacttcctatgttttccgtgattgcgaccatggcggccgcttgttcggattacaggaaccaggttacatctactcgcgtatgatgaatcccaccgccgacgtttttgagaaacgtattgccgccttggagcatggcgctgctgcaatcgctactagttccggtacttccgctctcttcatggctttgaccacgttggctaaggccggtgataacattgtctccacttcttacctttatggtggtacttacaacctcttcaaggttaccctgcctagattgggaattactaccaagtttgtcaatggtgatgatcctaatgatcttgcagctcagattgatgaaaacacaaaggctgtttacgttgagtccatcggcaatcccatgtacaacgttcccgattttgagcgtatcgctgaggttgctcatgccgctggtgtgcctttaatggtcgataacacttttggcggcggtggttatttggttcgtcccattgaccacggtgccgatatcgttacccactctgccactaagtggatcggtggtcatggcactactattggcggtgtgattgttgatagtggtaagtttgactggaagaagaacagcaagcgtttccctgaattcaacgagcctcatcccggttaccatggcatggtctttactgaaacttttggtaacttggcatatgcttttgcttgccgtactcaaactctccgtgatgttggtggcaatgccaatccattcggtgtctttttgcttcttcaaggtcttgaaacgctttctcttcgtatggagcgtcacgttcaaaatgcatttgctcttgcaaaatatttggaaaagcaccccaaggttaactgggtttcttaccctggtcttgaatctcacgtctctcacaaacttgccaagaagtacttgaaaaatggttacggcgccgttctcagctttggcgctaaaggtggccctgatcaaagtcgtaaggtagtcaatgccttaaagcttgctagtcagttggccaatgttggtgatgccaaaactttggttatcgctcctgcctataccactcatttacaattaactgatgaggagcaaatttctgccggtgtcactaaggatcttattcgtgtggccgtcggtattgagcacatcgatgatattatcgccgactttgctcaagctttggaagttgcc

SEQ ID NO: 26046 - DNA, 1050 bp, Schizosaccharomyces pombe
atgacatgcagaattgcgattcgcaagtattcattcatattatgtttggctgttggttcagttaccatttatacctcggaagttattggaactcctctgtattttgtcaacaaggagctttataacaaatatattgcttttacaaaatcattcgccggtattctgtttaccgctttggtccagctttttagtccgactcctgtaactctcacctatgatcccgagcttcgaaatttgttttatttggatagaaatggttgcttggaaacaattgctgctgaacgcaacatagttatcgcaaaccatcaactttactcggactggatgtacgtttggtggttatcgtacactgctaaacagcatggtcatgtttatattatgttaaaaaactctctcaaatggttgccagttataggttggggtatgcaattgtttagattcattttcctttctcgcaaatgggacaaagactacgagactatgtctcgtcatttcaagttcattcgcaatgtacgtgattccgtcagtctcattctcttcccagaaggaaccaacttggttgaaagcacatatcaaaggagcagggtgtatgccgataaaattggagtcaaaatgccaaagcatttaatgctcccacgtgtgcgagggctcttttatagtatcagtcagcttcgtgattcgatgacttatttgtacgattacacattttatttttctgatccctctcctaagaaatatgccgccgatgctttctctttacctaagctcttttttgaaggagtccccatcaaaaggcttcatattcacgttcgtcgcttcccaatttcggaaattcccactgaagaagatcagtttacggattggctttatcaaagatggtatgagaaagataaacttatcgatacgcttcttgaaacagggaattttccgggccctaagaaattgcatacgactgttcgattgaagcacagacttgaaattctttctttgttttccgtacttttcacgtgcattgttgctgggttgttcctcaaactattcatttctcac

SEQ ID NO: 26047 - DNA, 671 bp, Schizosaccharomyces pombe
atggctcctattaaatctcgtagaattgctgttcttggcagtcgttctgttggaaagtccaggtaagcgtttgattgaagtttatgcgcaaataggtttactaaccattttttttaaatagtttaacggtgcaatatgttgaaaaccatttcgttgaatcgtattatccaactattgaaaatacattcagcaagaacatcaagtataagggtcaagaatttgctactgaaattatcgatacggctggtcaagatgaatacagtatcttaaattctaagcattccattggaatccatggctatgtactcgtttacagcattactagcaaatcttcttttgagatggttaaaatagttcgtgacaagatattgaatcacactgtatgtcaaattattagaatttttaaattttttactaacctacttgctattaagggtactgagtgggtccccattgtggttgttggcaataagagcgacttgcatatgcagcgtgctgttaccgctgaagagggaaaagcattggccaatgaatggaaatgtgcatggacagaagcttcagctcgccataacgaaaatgttgctcgagcattcgagctaattatcagcgaaattgaaaaacaagcaaatccttcccctcctggtgatggaaagggttgtgttatcgcctaa

SEQ ID NO: 26048 - DNA, 2322 bp, Schizosaccharomyces pombe
gttcgtgtacgaccgtttactgaaagagaaaagggattgctcgcggaaactccgaaatccaaagaatttcttggagatggaagtttggcagtgtcaaatacatcttcgaatactttttgtacgaatggaattcgaaaaattgtgcgtgttttagacgataacgtgctaattttcgatcctcctgaagaaaatccattggccaaagtccaaaaatcgctattacctgcagggaaacgctttcgggatgttcgatatgcatttgatcgtctttttggtgaagaagcctcacaggaggatgtttacaagggtaccacagagccgttgttggacagtgttttgcagggatataatgccactgtgtttgcatatggtgctacaggatgtggtaagacacacacaatcagtggtagaccagacgatccaggcattatttttttaacgatgagggcattgttagatagagttgaaggactcaagcgaacgatgaacgtcgacattagtgtctcatatcttgaaatatataatgaaaagattcgagatcttttagtacaggatcccctttctatggaaaaaccaaaatcgttaaatatttgtgaagatgctgagcaaaacgtatccgttcctggtctctcatattttacaccaactaatttggaagaagtaatggagattattattcgtggaaacagtaatcgaaccatgtcaccaacagaagccaatgctgtttcgtcacgctcgcatgccgttttacagatttatatcacgcaaactccgaaatcgggtgagaagcaggaggaatcagagtcccaaaattcccataaagtccgttccgtattctcttttattgatttagcaggctcagagagagcgagtgcaacgaaaaatagaggcaaacgtttagtagaaggagcaaacatcaatcggtctttactggcattgggaaattgcatcaactcgttgtgcgaacctcgtcgtcgacaacatgttccatatagagactcgaagttgactcgtcttttaaagttcagtttaggcggaaattgccgcacgtgtatgatagtttgtatctcaccgtcgtcggagcattatgatgagacacataataccttaaagtatggcaatcgagccaaaaacatcaaaacgaaggtttcgagaaacgtggtgagcgtagataggcatgtaagtgaatatgtacgcaccatttacgaattacgacaaaaggttagcatacttcaaaagaggattgctgaagagtctaagcaattggctttaaataaggaggtacgaaaaatttcttctcgagaaattaaaatgttagatgctagaagcatgctcaaaaactcatttgatggttcaagggatctgcagaaatcactaattgaacatgtacgtacattgagaaggattgaagatgaaatcacattaacaaagatgtggatttccattgctaaggaaagtgatgctatgtcggggcataatataaaatctgtcgaaacaagacttgcaaagttatacgatcaaagaagcttgattactgccaaagttaatccagaagaaatctgcaaaacttttcaaaacagtatttctcatatagtgtcttcgttcaaaggtgagggggctgatatgtatgctgacatgttgcaagacgacgtcgatttgttgaaatctattatcgaaaaccaaattcttgatgccaagcatgagtctgaaacattctcttcaacgtctcgtaagcttatccagaacctattcctactattccccctgttaccaggaaatgccattgatgttaatgaatcccttgcaagggcctttgaccaattggttggaatagtaccttcagagccaaccattcaagttcccaatttaattgaaaaaggaaaagcacctctattatcaatgtttgaaatacctcgctctcctagtcgattcaaggctcgctcaccatccaaagctgctcgagttctaaagaagcctttgaagaaacgagttcgatttagtgaagttcccactactagttccgtacctcctgttgaaataaagaataaagattcgaaaccgaaagtggaaaaatctttagataaacataatatgaacaacgatcgctcttttcttgttccttcgagagatgcccgaaatagcttaacgtcattgtcattgcattctaatgtcgcgaaaaacaaaagttctcattcttccaaatggccaactcatactctgagtcctataattacaactgcactgaaacaaccagtacgccgtatatcgcttgtttcacaacctttacaaaaaactggcgggactgagaatactcctaatgct

SEQ ID NO: 26049 - DNA, 1190 bp, Schizosaccharomyces pombe
attcaagagattgaagctgaaatgcgccggacgcaaaaaaataaggcgacggagtaccatcttggtttggtaagtttttttaattcatttctaactggaatgccttttattttatagcaaatattacaatgttgttccaacttataaagaatcaactctaaattaaactaacctagtcctttagttgaaaggaaaactcgccaagctgagggctcaattacttgaacctacttcaaaatcggggccaaagggggagggcttcgatgttttgaaaagtggtgatgctagagttgcatttattggatttccatctgttggtaaatctactttgctgtctgctattacgaaaacgaaggtttgctatttctttttaaatactttatttttttactaacaatggtaatatagtcggcgactgcatcttatgaattcactactttaacggctattccaggtgtactcgaatacgatggagcagaaattcaaatgttagatcttccaggtatcattgaaggtgcctctcagggaagaggtggccgccaagcagtatctgctgcacgcacagctgatttaattttaatggttttggatgctacaaaagctgccgatcagcgagaaaaaattgagtatgaacttgaacaagttggcattcgtttaaatcgacaaccaccaaatgtgacccttaccataaaaaaaaatgggggcattaaatttaatcacactgttcctctaactcatatggattacaaaatggcatacaatattttacatgaatacagaatccacaatgcagatatcctaattcgtgaagacatcaccgtggatgactttattgatcttgttatgggaaatcggcgatatatcaattgtctgtattgttatagtaagattgatgccgtttcgttggaagaagtggaccgacttgctcgtttaccaaagtctgtcgttattagctgtaatatgaagctgaatcttgactttcttaaagagcgcatttgggaagaactcaatctctacagaatatatactaaacggaaaggagaaatgcccgacttctctgaagccctgattgtgcgcaagggatcaacaatcgagcaagtctgtaataggattcacagaacattggctgaacaattaaaatatgcacttgtatggggtacttctgcaaaacatagtccccaggttgttgc

SEQ ID NO: 26050 - DNA, 1140 bp, Schizosaccharomyces pombe
atggattccacagctcaacaatttcctttgaaccacgacctgcaagtacaaaaagaccagaaaggtgttgtagaggaagatgaggagcaaatacataagcgcattcgcaattatgaatcacattcaggattctctgaatattgtactcttttcggtcatgagaaaagtgttacatgtgtcagcgtttcccctaacaaacgatggatcgctacctcttcatccgatggaactataaagatttggagcgcacttacgtttcgacttgaatgtacacttttcggccactaccgaggaatatctcaagtaaaatgggcaactggtagtaagtatctagctagcgcttctgacgataagaccataaggatttgggattttgaaaaacggtgcagtgtgagatgtttaaaaggtcatacaaattacgtttcatcaattgactttaatccattgggcacgcttttggtgtcaggatcatgggatgagactgtccgtatatggaatcttcaagatggaacttgccttaggatgctacctgcacattcagaacctattatatctgtttctatatcagctgacggaactttatgtgcgactgctagttatgatggaatggcacgaatttgggatgttctcagtggccagtgtttaaaaacattagttgaacccattaatgttcctttgtctaatctccagtttacagaaaatcgaaaatatctgcttgtaagtaatcttaactcacagatccgtctttgggattatcgccgaaaccgtgtggtacgaatatttgatagccacgtgaatacaagatattctatgtcttgggattgctattcttctaaaaatattcctaaaaatactgaagctttacccaataatgactcttcctaccctgatgatgcagaatctttcatgcacgatgcttatcttttaattcctagtgaagatggaacaatccaaattacagatccgagtacaaaaataattattgacgattcaattaggcattccgatgatccagaaacatcacttttaaatgtaaccagtttaggtcctttcataatcacatcaggaactgatccttatgtacgagtttgggctccttctcttctattgtcgaagcacgagaaagatggcttttcacct

SEQ ID NO: 26051 - DNA, 1005 bp, Schizosaccharomyces pombe
atggcaattcctaaagttggtatcaacggtttcggtcgtattggccgtatcgtcctccgtaacgccatcctcactggcaagatccaagttgtcgctgtcaacgatcctttcatcgatcttgactacatggcatatatgttcaagtacgactctacccacggtcgctttgagggctccgttgagaccaagggtggcaagcttgtcatcgacggtcactccatcgatgtccacaacgagcgtgaccccgccaacatcaagtggtctgcctctggtgctgagtacgttattgagtccactggtgtcttcactaccaaggagactgcctctgctcacttgaagggtggtgccaagcgtgtcatcatctctgctccttccaaggatgctcccatgttcgtcgtcggtgttaacttggagaagttcaacccctccgagaaggttatctccaacgcctcttgcaccaccaactgtttggctccccttgccaaggtcatcaacgacaccttcggtattgaagagggtctcatgaccactgttcacgctaccactgccacccaaaagaccgttgacggtccctctaagaaggactggcgtggtggtcgtggcgccagcgccaacatcatcccctcctccactggtgccgccaaggccgtcggtaaggttattcccgctcttaacggtaagcttaccggtatggctttccgtgtccctacccccgatgtttccgttgttgacttgaccgtcaagttggccaagcctaccaactacgaggacatcaaggctgctatcaaggctgcctctgagggtcccatgaagggtgtgttgggttacaccgaggactctgttgtctccaccgacttctgtggtgacaaccactcctccatcttcgatgcctctgccggtatccaactttctcctcaattcgtcaagctcgtctcttggtacgataacgaatggggttactcccaccgtgttgttgacttggttgcctacactgcttccaaggat

SEQ ID NO: 26052 - DNA, 2274 bp, Schizosaccharomyces pombe
atggagaagagtgcaaggcaattatcagtagccgaacagaatggtgaatcgggaagattaaataatggatatacttcaaacaatattcagcagtataaagatgaaactaatcgtcatcagttcgagtataaccaaaataggaaccaattgttaagatccatccatattattcaaaatctgttaaatgaactggataattatgtagatcgatctgactgtttgttccacagtgtttggagaaccgataaagaaaaatctaaattttcaggaaattactatccatttagtccgtccaaaatgaatgtgatcaccattgatctatcactgcggtcgtcgtcgactgctgatgaaaaattaatcagtcaattgggcgaggaagctcatgaatctctactaaaagtacacatagagaaagcaaataagcatctcttttcacttttttctagagtagaagatacctcttcgaaaatccttatcaccggggatttaaacgcaggtaaatcgaccctttgcaatgctttggtacacaaagacattctaccagaagatcaacaaccttgtactgaggtattttgtgaagtgcacgatgctgaactcaatgatggaaaagattgtgttcacgctattcctcatggactcacgtatagtcatactgactcttcaacatataaagtttttccaatcgaggatttgaaacgccttgtttatgagacggaaaattggagcatgctaattgtatatgtcaatgatggaagaccggcacatgagagtttgcttcacaatggaattacagatattgcacttattgatgctcctggcttgaatactgattccatgaagacaacttcagtatttgcttgccaagaggaaattgacgttgtcgttttcgttgtaaacgctgaaaatcattttaccctttctgctacagatttcttaagaaacgcctccactgagaaatcccacattttcattattgtgaacaaatttgataacatcagagataaagagagatgtaaacgattgatccttgaacaaattcataccctttctcctggtacttttgctgacgctaaagacttggtacattttgtgagctgtcgtgtcgctcgtgatccaaataatcgagaggatgctctatattcttctttttttcagatggaaaactctctccgtagcttcattctcgaaaatcgctcaaaatctaaacttgccccggtacgtagatacttgtcagggttagtcggtgatatacttaatatctgcgaatataacataaaacttatcgattttgatattaatcacttgcaacaacgtttgacggatctttctccaaaatttcgtaaggtaaaacatgagcagcaatttacctatcagaagaatgaatctttagttgaagcgactgtgcaatctatttctcagcatacacattccgaattagaagatgctattgactcattaggttcttttgcttctgtcaagtattctggttttttctttgcctaccagtatgcgatatccgtaagagacgccatgcaacaatatttagaagaaaaattgttggagtcagaagattatgctcgaaagaggaccgaagaagctgtcttatgtattcaaaaagatgtaaaagataattttgactccgccgtccttccagtctttcatgccaaccaaatgtttattaagaaacatagattgcaactgcagaagcattttcgatttgaacttggcttgcttgattttatagatctagaccttactgagagattaggaacctggagcgcttcattgagtactattctcttggtccttggaaaaacaaccccttcatttacaacgcttggtgcatttactggaaatcttggttatccaatatttaaatattttcaaaataactcgcttcaacacttattggtcccggtacttggtttagcaagtatttgcgtttttgggtatgttatttacgatatacctagagcacttcctcttaaagttgcggaaaagataaaaaaatctttaagggagacagatttttgtcacaatgctagtatttggataggtacagagagtcgtaaagttctcaatattccgttgaatgatttacgaagaatgtttcaccaacaatgggataagcagcgcgagactatatctgtcgctgagaatgacttacgaatttgtcaaaaagcaagaaagttttttggtgaaatagaaagccgaactcgtgaagctaagaagaagataatgatggttcaattggagggatgtgatataaattat

SEQ ID NO: 26053 - DNA, 2118 bp, Schizosaccharomyces pombe
tccatccatattattcaaaatctgttaaatgaactggataattatgtagatcgatctgactgtttgttccacagtgtttggagaaccgataaagaaaaatctaaattttcaggaaattactatccatttagtccgtccaaaatgaatgtgatcaccattgatctatcactgcggtcgtcgtcgactgctgatgaaaaattaatcagtcaattgggcgaggaagctcatgaatctctactaaaagtacacatagagaaagcaaataagcatctcttttcacttttttctagagtagaagatacctcttcgaaaatccttatcaccggggatttaaacgcaggtaaatcgaccctttgcaatgctttggtacacaaagacattctaccagaagatcaacaaccttgtactgaggtattttgtgaagtgcacgatgctgaactcaatgatggaaaagattgtgttcacgctattcctcatggactcacgtatagtcatactgactcttcaacatataaagtttttccaatcgaggatttgaaacgccttgtttatgagacggaaaattggagcatgctaattgtatatgtcaatgatggaagaccggcacatgagagtttgcttcacaatggaattacagatattgcacttattgatgctcctggcttgaatactgattccatgaagacaacttcagtatttgcttgccaagaggaaattgacgttgtcgttttcgttgtaaacgctgaaaatcattttaccctttctgctacagatttcttaagaaacgcctccactgagaaatcccacattttcattattgtgaacaaatttgataacatcagagataaagagagatgtaaacgattgatccttgaacaaattcataccctttctcctggtacttttgctgacgctaaagacttggtacattttgtgagctgtcgtgtcgctcgtgatccaaataatcgagaggatgctctatattcttctttttttcagatggaaaactctctccgtagcttcattctcgaaaatcgctcaaaatctaaacttgccccggtacgtagatacttgtcagggttagtcggtgatatacttaatatctgcgaatataacataaaacttatcgattttgatattaatcacttgcaacaacgtttgacggatctttctccaaaatttcgtaaggtaaaacatgagcagcaatttacctatcagaagaatgaatctttagttgaagcgactgtgcaatctatttctcagcatacacattccgaattagaagatgctattgactcattaggttcttttgcttctgtcaagtattctggttttttctttgcctaccagtatgcgatatccgtaagagacgccatgcaacaatatttagaagaaaaattgttggagtcagaagattatgctcgaaagaggaccgaagaagctgtcttatgtattcaaaaagatgtaaaagataattttgactccgccgtccttccagtctttcatgccaaccaaatgtttattaagaaacatagattgcaactgcagaagcattttcgatttgaacttggcttgcttgattttatagatctagaccttactgagagattaggaacctggagcgcttcattgagtactattctcttggtccttggaaaaacaaccccttcatttacaacgcttggtgcatttactggaaatcttggttatccaatatttaaatattttcaaaataactcgcttcaacacttattggtcccggtacttggtttagcaagtatttgcgtttttgggtatgttatttacgatatacctagagcacttcctcttaaagttgcggaaaagataaaaaaatctttaagggagacagatttttgtcacaatgctagtatttggataggtacagagagtcgtaaagttctcaatattccgttgaatgatttacgaagaatgtttcaccaacaatgggataagcagcgcgagactatatctgtcgctgagaatgacttacgaatttgtcaaaaagcaagaaagttttttggtgaaatagaaagccgaactcgtgaagctaagaagaagataatgatggttcaattggagggatgtgatataaattat

SEQ ID NO: 26054 - DNA, 3111 bp, Schizosaccharomyces pombe
atggtaaccattaatatctcgaatcccgtttatttctctgacattaaagatgttgaatcagaattccttacgtctatccccaatggacttacccatgaagaggctcaaaatcgtctttccgaatatggagaaaatagactggaagccgactctggtgtctcagcctggaaagtcttgttgcgccaggtattgaacgcaatgtgtgttgtcttgatcctggccgccgctttgtcttttggtaccactgattggattgaaggtggtgtcatttctgcaattattgttcttaatatcaccgttggctttatccaagaatataaagccgagaaaactatggactcattgcgaacattggcttctcctatggcgcatgtcacacgctcgagtaagactgatgctattgactcccaccttttagttcctggggatgtagtcgtgctaaaaactggtgatgttgtacccgctgatcttcggttggtggaaacggtaaactttgagacagatgaagcattgttgactggtgagtcgcttccagtgataaaagatgcacacgctacttttcaaatgaacgaagatgttcccattggtgatcgtatcaaccttgcatattcctcttccattgtgactaaaggtcgtgccaagggaatttgttacgcaaccggtatgcaaacgcaaattggagctattgcagctggtttaagacaaaaaggaaagctctttcaacgtcctgaaaaagatgagccaaattaccgtcgtaaactgaacaagtactatcttaaagtcacttcttattatgttcaaagggttttgggcctcaacgtaggaacacctcttcaaaggaaattaactgttcttgcttatattcttttttgcattgccattatactggccatcatcgttatggccgcccacagtttccatgtgaccaacgaagtttctatttacgctatatcccttggtatttccatcattcccgaatcactcattgctgtattgtcgattacgatggctatgggccaaaagaacatgtcaaaacgtcgtgtaatcgttcgaaaactagaggcgcttgaagccttaggaggtgttactgacatttgctctgacaagacaggtactattacccagggtaaaatgattactagacgcgtttggattccctcatatggttatttgagtgttgatacttctgacgccaataatcctacaattggcactgtatctggccttgaagctgcgatgcaagatgtgttgaaagaaaagaagcaagagatgaaaaacattgacccttcaaaccagccttctgaccagttcatcccattactaaaaacttgcgcgttgtgcaaccttagtacagtgaaccaaactgagacaggtgagtgggttgtaaaaggcgagccaacagaaattgctttacatgtattttcgaaaagattcaattatggtaaggaagatttgctaaagacgaatactttcgttcgtgaatatccatttgactcggaaattaagcgtatggctgttatatatgaagaccaacagggtcagtacaccgtgtacgccaaaggtgctgttgaaaggattttggaaagatgttctacttcaaacggatctacgctggaagaacccgatcgtgaattaataatagcacaaatggaaacacttgcagcagaaggtttgcgcgtcttagctctagcaacgaaggttatagacaaggcagacaattgggaaacattgccgagagatgtagccgagtcttctctagagtttgtatctcttgtaggtatttacgatcccccaagaactgaatcgaaaggtgcagtggaactttgccatcgcgcaggtattcgagtccacatgcttactggagatcatccggaaaccgcaaaagctattgcaagagaagttggaattatacctccatttatctctgatcgagatcctaatatgtcatggatggtgatgaccggttcacagtttgatgctcttagtgatgaagaagttgattcattgaaagctctttgtctagttattgctcgctgtgctcctcagacaaaggtgaaaatgattgaagccttgcatagaagaaaggcgtttgtagcgatgacaggtgatggcgttaacgattctccatctttgaagcaagctaacgtaggaatcgcaatgggtcaaaacggaagtgatgtagccaaagatgctagtgatattgttttaacggacgacaatttctcgtccattgtcaatgccattgaagaaggacgccgtatgtttgataacatcatgaggtttgttctgcacttgcttgtttcaaacgtgggcgaagtaatactcttggtggtcggcttggcctttagagacgaggttcatctttccgtgttcccaatgtctcccgtagaaattctttggtgtaatatgattacctcctcttttccttcgatgggactgggaatggagctagctcaacctgatgtaatggagcgtctccctcacgacaacaaagttggtattttccaaaagagtctaattgttgacatgatggtgtatggatttttccttggagtcgttagtcttatgacttgggttgtcataatgtatggattcggtacaggcaatttatcatatgattgcaatgcccactatcatgctggatgcaacgatgttttcaaagcacggtctgctgtttttgcagttgtgaccttttgcatccttattatggcagtcgaggtgaaaaactttgacaactccctattcaaccttcatgggattccttggggtgaatggaacttccgttattttctccatacgttggttgaaaacaaattcctcgcttgggccattgcccttgcagctgtttcggtgtttcctaccatctacattcctgttattaatagagacgttttcaagcatacgtatattggatgggaatggggagttgttgccgttgcagtgatgttttactttttttatgtcgaaatttggaaaagcattcgaagaagcttgaccaatccacagaaaaaaggaaagtttagaagaacgctcagtaatacgattaccactgaatccaaattgtccgaaaaggatttagagcatcgtttgtttttgcagtctcgaagagcc

SEQ ID NO: 26055 - DNA, 1380 bp, Schizosaccharomyces pombe
atgggaaaggaaaagggacatattaacgtcgttgttatcggtcacgtcgattctggtaagtctaccaccactggtcacttgatttacaagtgcggtggtattgacaagcgtaccattgaaaaattcgagaaggaagccaccgagttgggtaagggttccttcaagtacgcctgggttttggacaagctcaaggccgagcgtgaacgtggtatcaccatcgacattgccctttggaagttcgagactcccaagtacaatgttactgtcattgatgcccccggtcaccgtgatttcatcaagaacatgattaccggtacttctcaagctgactgtgctatccttattattggtggtggtactggtgagttcgaggctggtatctccaaggatggtcaaacccgtgagcacgctttgcttgcttacaccttgggtgtcaagcaacttattgttgccgtcaacaagatggacaccactggctggtcccaagctcgtttcgaggaaatcgttaaggagacctctaacttcatcaagaaggtcggtttcaaccccaagaccgttcctttcgtccctgtctccggtttccaaggtgataacatgattgagcccaccaccaacatgccctggtaccaaggctggcaaaaggagaccaaggctggtgtcgtcaagggtaagactcttttggaggctattgactccattgagccccctgcacgtcccactgacaagcctcttcgtcttccccttcaagatgtttacaagatcggtggtattggtacagttcccgtcggtcgtgtcgagactggtgttatcaagcccggtatgattgtcaccttcgctcccgctggtgtcactaccgaagtcaagtctgttgagatgcaccacgagtctctcgacgctggtcttcccggtgacaacgttggtttcaacgttaagaacgtttccgtcaaggatattcgccgtggtaatgtctgtggtgactccaagaatgatcctcccatgggttgtgctagcttcaccgctcaagtcatcattcttaaccaccccggtcaaatctctgctggttactctcctgttttggattgccacactgctcacattgcttgcaagttcgctgagctcattgagaagattgaccgtcgttccggtaagaagattgaggagtcccccaagttcgtcaagtctggtgatgcttgcattgctaagatggttccttccaagcctatgtgtgttgaagctttcactgactacgctcctcttggtcgtttcgctgtccgtgacatgcgtcaaaccgtcgctgtcggtgtcatcaaagctgtcgagaaggttgctcctggtgccgctaaggttaccaaggccgctgttaaggctggtgctaagaaa

SEQ ID NO: 26056 - DNA, 1308 bp, Schizosaccharomyces pombe
tcattaagaaccacatccaacatttgccatagactgaatgcggatgttttaggccagttaattaagaagtattattcttttgataattctttaaaaaatgaattattggaacttattgatatgccacaaaatggtgatgattcttccacttctattacaaatggaaatggcaacacaatttttccggaagtggatatgtacttacaactgcttcttagcatgacactttattataatgaaaaatatgaggtaggcgctgaatatattaagaaggtaatcgcccgtttgcaatcctatgatcgacgaaccttggatcaaattgcagccaagttatatttctattacatactattctttgaaaaatgtaataggtctgtagaatgcaggaacactcttttgtccgttcatcgtactgcatctttacgtcacgactctgaaactcaagctatggttttgacattacttcttcggaattatattcagtttaacctatatgatcaagcagaccgtctcgtttcgaaaacatcctttcttacgaatgctagtaataacttggcaattcgctaccaatactatttgggtcgaattcgcgccattcaacttgactacacgaccgctcatgaacatttagttagtgctatacgtaaggctcccaacacagtatatgccgttcaatttctggaagctgtttacaaattgcacatcgtcgtacaattgcttatgggagaaattcccgaacgccgcattttccgccaaaaatctctcgaaaaaactttagtgccttacttacgtattagccaggcagttcgtattggtgacctttgtgctttcactgacgcgctttccaagtatgaggctgaatttcgcttcgatggattgtatactttgatatgccgccttcgccataccgtcattaagactggattgaggatgatctccttatcttattcccgtatttcccttcgtgatgtttgtataaagcttggtttggacagtgaagagagtgccgagtacattgttgctaagggcatccgtgatggagttattgatgcaagtatcgatcatagtaatgcctttatggctagtaacgaagccatggatatttattccaccgagcagcctcaacaagcttttcatgaacgtattcagttttgtcttgcccttcataatgacagcataaaaagtatgcgatatcccatggatgctcacaaaagtgaactcgaaggtgtggaagaggcacgtaggcgtatggataaagaaatggctgaggcagatttagatgacgatgagcctgatttgggcgaattt

SEQ ID NO: 26057 - DNA, 897 bp, Schizosaccharomyces pombe
atggctttgaaaagaattaaccgtgaattagctgatcttggaaaagacccaccgtcttcttgttccgccggccctgttggcgatgatttattccattggcaagctacaatcatgggtcctgtaagtcgcggctgtaatagtgccttgcgcactgccaaaattttgcttgctaggattgtgcagctaacatgatatataggctgacagcccttatgcgggtggtgtcttcttcttgtccattcatttccctacggactacccattcaagccaccaaaggtatgtaactatttagtcttgtgtagattatgtaaatacgcattgtaagcttgtgaatcggaggaggaagtttgttatatacaatatgaattgaagagttgattgcatcttgtttttctggaaaaatcggtatggttgacagtgatgcaaaattttttaagtgttatggtgaaagagtatacgcagaagtttttttataattgtttactcttaccttttatcttcatttctttatgttttaccagcggaactttatcgatttttatacgattgcgtccatccaagtgaagcgagggcaattacattgcgtagcattacgaatctgattgatagtcttttttttttaatgataactaacagcatattcgtaggtaaactttacaaccagaatctatcatcccaacatcaattcaaacggtagcatttgtttggatatccttcgtgaccaatggtctccagcgttgactatatcaaaggtattactgtctatctgctcattgttgacagatcctaatcctgatgatccgcttgtgcctgaaattgcgcacgtctacaaaactgacagatcccgttatgaattaagtgctcgtgaatggactagaaaatacgcaatctagagt

SEQ ID NO: 26058 - DNA, 1727 bp, Schizosaccharomyces pombe
atggaccgtcgacatcgtgtttaccgtgtgtttaaccaggagatgtatgtcgagcctaattttaaggtatgagatatttgggtaactgctgcatttgcaaaacattttgtttacttgacagaaaatcgcatctgcttgaacttttaggaaaactaacatagtttaggtagtgaaggagttgggtcaaggcgcttacggcattgtttgtgcagcaagaaacgtggctagcaaagatcaagaggctgtagccataaaaaaaattacgaatgtgttttctaaatccattcttacaaaaagagctttgagagagataaaactgctgattcattttcgtaatcatcgtaacgtaagtcttttatgcaaaaacggcttcctgtgattgattactcatcatcaccgggatgtattaacgaggtgcattttgatgaaaatgcaaatttttatacaatgaaaagtcttctatgagaaatgagttctaatcatccttgaaaagtatttcctttataaatcttgatataatgtttggaattcggttgattaaaaaatttgaactgctcattgtcttacatttgcatagtgatgtctttcctattttttataaactttactaacatggtagattacttgcatttacgatctcgacattataaatccatacaattttaatgaagtttacatttacgaagagttggtatgttacgcgatgatccacatatggtgtctgttttagtcacggaaatatttgtataattacttactaactattataatagatggaggccgatttgaatgctattattaaatccggtcagccattaacggatgcgcattttcaatcattcatttaccagatactttgtggtttaaagtatattcattctgccaacgttattcatcgtgacttaaagccaggtaatcttttagttaacgctgattgtgagctgaaaatttgcgattttggcctcgctcgcggatgttctgaaaatccagaagaaaatcctggttttatgacggagtatgtggcaacgcgctggtacagagctccggaaattatgctttcgttcagcagctatcataaaggtattgatgtttggagtgttggttgcattttggcagagctattaggtggaacccctttgtttaagggaaaagattttgttcatcagttaaatttaattttgcatcaacttggcacacctgatgaggaaaccctgtctcatataagcagttcccgtgcacaggagtatgttcgaagcttgccaaagcaaagacctattccttttgaaaccaattttcctaaagccaatcctttggctcttgacctgcttgctaagctcttggctttcgaccccaacagacgtatttcggttgacgatgctttagaacatccctatttagctgtttggcatgatccctctgacgaacctgtgtgtgattccgtctttgatttcagctttgaatacattgaggatgcaaatgagttacgccgtgtcattttagatgaagttttaaacttccgtcagaaagtccgacgccgctctcatccaacaaacccaacagtcaacatcccgcaaccagcccaaaccgttccatctaatgacaatggttctttcaatgttagtagctcttcatcctctcaaacctctaacaaaaagcgccatgatcattcttataatgaaactgctgctatagaccataagtctgatgataatcgccataactaatac

SEQ ID NO: 26059 - DNA, 1528 bp, Schizosaccharomyces pombe
atgggctcgctacctgatcaatcgtcttgtgaagagtttactgattcgcaacaggataagatgacaaaactgcttgctatgcaacttggcccagagtatatttctcgccgaagtggtccaggaggaggatctgttacatacttagaagcatggaaagcaattgagctcgcaaatgaaatatttggatttaatgggtggtcttcttccattcaagacattcatgtcgattatgtaagtgttaattttgcgtcaaaattctacgaaaaaagtgcaaatcgtatcaattcttgagcctatatttatttatttttactaatcattattaaaaggtagaagaaacgaaagagaaaaagtttaatgttggaatcagcgttattgtacgcgttacattaaaggatggctcctttcatgaggtaaacaaaacatgtcctcagtaatatttcgtgataccggttaaattaattatagcaaatggtatttttttcgaaataattcataactttttcgttcttaactattccatatcagattgtggccaatttcttgctaacaaatggtttttctaggacgttggatatggatctatagagaattgtcgagtgaaggcattagcttacgaaaaatgtaaaaaggaaggaactacggacgcattaaagagagctcttcgaaactttggaagtagcatgggtaactgcctttacgacaaacgctatattcaaaaaatcttgaaaatggcacctgcccaggtaatatggaaacacataaaatttaaaaataattaagctgacagaaatgcaaaattaggctgagttcaactacgacaaccttttacgcgcaaacaaaagaccctatgcacggttcgctcagaaagtatctacccctatagaaagccatgcaaataaaagtgttaagctagaacataaaaattcaatagagaagaaaatttccaatgtggataaacctatatcagatctcattgagaatgacattcatgaaagtctgccagctctgcaaaatccccccattcaaagccattcagaaacagacctttacgcaggtataaaaaatttattaatgaccaaattgaaaaactaaacataaaaatatagatgaagaactggacagcatccttatgcatcacgagcgcccgcctattcctgagtcacctagggtagaagaattcgaggagtaagacagaccgatcaatgcgtgcgaatgccgactaactaatagattattaaaccaatttgaaggagatgaaaaagtttctgttgacaaaattgacgcacacgataaaatgaccgaagctcaggttgtcaagattcccccagtacaatttatgaatgcacgtgtagcagcagcagaaaacccacatataaagcacgagggaatggcatttcagttgcacaaaaagagtaattctatactaaaatcatctaatatagaccacaacagatccatgcctatacgacgtccttcgttaacttcaaacaactctgcaaacacgttctcaacgaaataaaaaaaa

SEQ ID NO: 26060 - DNA, 786 bp, Schizosaccharomyces pombe
atgagttttttagaattaacagaggtttggggaaagcctcaaaaagacattttttttcctagtggctcggaagttgaagaatcaaccgatgcaccaattcaacgcactgttcaaccgatagtaactggatcatcagtccttgctttgaagtttgcagacggtgtaatgattgctgctgataacctggcatcctatggatcattagcgcgcttttatgatgttgaacggttgacaaaagtaggtgataatacgattgttggcgccggtggggatatttcggattatcaacaaatccagcgcctattagaaaaattagaaataaaagaaggaaattatggtgacggctatgccttacaaccttcgtatattcatgaatacttgtcgaaggtgttgtacgctcgcagaaacaaacttgacccatattggaatcaactcattgtagccggggtggatggggaaaataaggaaccatatgttgcttttgcagatcttcgaggaactacttattctgccccggcaatcgcaactgggtttgccatgcatttggctcttcctatgttgcgtaaagccactgacgatgatcgctggaaaacgctttctaaagaaagcgctcgtgctactatcgatgaatgtatgcgtgttttgttttatagggatgctagaagtttaaacaaatttagtgttgctaccattacacctgagggcatcgaattccagactgatcaatctgtctcctccaaatgggcatttgctgaaaagcagtatggttacgggactcaaaccgta

SEQ ID NO: 26061 - DNA, 966 bp, Schizosaccharomyces pombe
atggctacttcatctgctgccgctgctgctagcacccccgtgaatgcaaacaccatcactgaaacaaagaactctactttcttctttgatttcatgatgggtggtgtttctgctgctgtatctaaaaccgctgccgctcccattgagcgtgtcaagcttctcattcaaaaccaagacgaaatgattcgtgctggtcgtctttctcaccgctacaagggtattggtgagtgtttcaagcgtactgctgctgaagaaggtgttatttccctttggagaggtaataccgctaatgtcttacgttacttccccactcaggccttgaactttgctttcaaggataaatttaagaagatgtttggttacaagaaggaaagggatggttatgctaaatggtttgccggtaatttagcctctggtggtgctgctggtgccgcttcccttttgtttgtctactctcttgactatgcccgtacccgtcttgccaatgatgccaaatccgccaagaagggaggtgaacgtcaatttaacggtttggtcgatgtctatcgtaagacctatcgttctgatggtttacgtggtttgtaccgtggttttggcccttctgttgtcggtattgttgtttaccgtggtttgtacttcggtatgtatgataccttgaaacccgtcgttttggttggtcctttggagggcaacttcttggcctccttccttctcggttgggccgttaccactggttctggtgttgcttcttatcctcttgataccatccgtcgtcgtatgatgatgacatctggtgaagccgtcaagtatagctcctcctttgaatgtggtcgtcaaatcctcgccaaggaaggtgctcgttctttcttcaagggtgccggtgccaacattcttcgtggtgttgctggagctggtgtcctttccatttatgaccaagttcaacttttgatgttcggcaagaagttc

SEQ ID NO: 26062 - DNA, 1380 bp, Schizosaccharomyces pombe
atggcagaaaatgagaatcatgtactttcaatacgaatgtcacacccatactattcagaaaaagaaataagtcgaattttgtcgacgcgagatcccaaagaaaataatttgcgaatgcaggcgttcgcttggatatcaacactttcaaaaactttaaaattgtatgcttttcctcaaaattatctagaatctaacttttttttagccctgtaaggaccagcggccttgcaatgcttttatacagtcgtttccaactattttttcccgtgaatgaaattcctttgctggtatgttatttggatgtctttcgcacatgagtatgctgtgctatttgaaattttacgtattctgatataagaatattctgaatgctgtacattggtcatactattaaaaaagactacagtttttaataatgttagctcagctactccaagttataaacatcatattctcttgatttaggctctttttctttcaaaaataactaacacatttaggagtgcgctactgcttgcttagtagttgctagtaaaatcgaagatacggccaaaaagtttcgtgatattcttttagcacattatcttcaaaagcatccaggttctgaggtcgatgctcattcacaagtatgttacaaggtgcgcaataattgttttttgtttataaggagacttgcttacaggtgtattagctaatcgaagagaacaagaagaggattctaggtttagaaagaatgacactggaattgatttgtttcgattttcgagtccgacatccacacaattacatggtaaaatttgcaaaatcactgaaatgtatgactgctattcattttaccttataattttcgagttaactaatttactttcagtttcatcttccacggcaagtatagcttggaatgtctgcactgatgcttataaaacatacacaatgttaaaatatccagcccatattgttgccgtcgcatcgatttctattgcttgcaagttacagcaacttcctcaacctataattcccagatcgttcttcgctccaccagcactaacggaagcagtgattgcggatatactcgatctatatatgcattatcagcctcacacttgcattggtaatatgtatacaacggaaaaattacttggattatgtgttgacttccaacgagcccaaaaaaactctggccgtcctcaaaaaccaccccaaattgaccctcattcttcttctttagcagatgaataccgtgagtcaaataagagacttcaagaatccaaagaaagttgtgccagatttattttagactgcgatagaaagtattttaataccgaatttgaaaaacgaatgctggaagaaaggagaaataaaggtacggtttaatctaat

SEQ ID NO: 26063 - DNA, 1632 bp, Schizosaccharomyces pombe
atgggaagtgacgggtcgagtttgtcaccgaaagtgtcacaaccgggacacactgaaatagttgaccatgtcagtgaaaaggtgatcacgaatggaaaaaatgttaataaaaaggtcaatgctgaagtagacggaaaaagcatggtggaaaaggtaaaaacgcacgaagaaaatgcagaggactatcactatggtggataccacccagtctacattggtgaagaatttcatcaccgtcgatatgtcgttgaaagaaaattaggctggggacatttttcaacggtttggcttgcatatgatcgagctgccaaacggagagtagctttgaaggtggtgcgttcagcagagcactatcgagagacctcaattgatgaaattcgcattttgcagaaaattagagaaggggacgaaaagcatttgggcaaaaagcatatcatttctttgctcgattattttgtgcatcgtggtcctaatggagctcatgtctgtatggtattcgaagttctcggtgagaatcttttaagtttgatacagtcatacggccatcgaggagtacctgtgggtattgtaaagcaaattgcctaccaattactcatcgctctggattacttgcatcgagaatgcgggatcattcatactgatcttaaacccgaaaatgttttaatatgcattgatcaggatgccttgcaacatattgaggcacctgcaacaacttcctcccccacttctaatacctcttcttcaaaaacaagaaataacactggttatacagccaaagctccaattattaaacgtggccaatctgtagataactctgcccaagaacgcaagacatttgcaaaaaatccaactaagaattctaagcctgctggccaggtcattcctagcagtccttttacttccactttgagccgctttccttcattagaaggtgctgtttcagaaatcagccttcgtgactctcaaaagcataattctcatcctaattctccgttttctagtggagataattctcttatacttgatggtgttaacggttctcaggaacccgttccaaaaatcactgttaaaattgccgatctcggtaacgcgtgctggacacggaagcatttcaccaacgatgtgcaaacccgtcagtataggtctccagaagtaattctaggatgtcgctggggagcttccgctgattgctggagttttgcctgtatcatttttgaattgctaaccggcgattaccttttcgatccacggaatgggaattcttattctaaggaggatgaccacattgcccaaattattgagttattggttaattatcctaagcaaatggcactttcaggaaagcactcccgcgatttatttaaccgtcgcggtgaactccgaaatattcataaattgaagttttggcctttaaaagatgttttggagcaaaaataccatttttcagccgagttggctcaacaaatatcagactttttatctcctatgttatgttttgatcctgccaagcgaaccaatgctggttacatgagcaattctccatggttgcgcgaagtggctgatcctacgttcaaaatcgagactactggagcaaccggtgaagatgtacccggatgggctactgaaattcgt

SEQ ID NO: 26064 - DNA, 1865 bp, Schizosaccharomyces pombe
atggggttcgggaagaaaaaggtttcttatttctatgatggtacgtgtaaactagtaagatcctagctaatttttgaaatagaggatgttggaaattatcactatggtcctcagcatccaatgaagcctcatcgcgttcgcatggtatgatataaagctataactatttatcatcattaacctacttaggttcataatctggtcgttaattacaacttgtatgagaagttgaacgttattgtaagttctatttctcctttttatactaataaagtatacaagacacctgttagagcaacaaggaatgacatgactcgttgtcataccgatgagtatattgaatttctttggagagttacacctgacacgatggaaaaatttcaaccgcatcagctgaaatgtaagatttcatttcgattatttataaataaccgtgattttagttaacgtcggtgatgattgtcctgtttttgagtatgtgcgtttatcaaattttttatactaacaattgtttagtgggctgtacgaattttgttcaatttctgctggcggttcaattggtaagataaaagtttttcccaaaaaaggggctttgaagcatccgctgaatttgtgaatggagtataggactttaactaacattggtttaggtgctgctcaagaacttaactcgggaaacgcagaaattgctattaagtatgttattgaggattttttagtactttgaagatcaactaaccacttaattaagttgggctggaggcctacatcacgctaaaaaacgtgaagcttctggtttctgctatgttaatgatatcgcgttggctgctttagaattgctgaaatatcatcaacgtgttctttacattgatattgatgttcaccacggagacggtgtagaagaatttttctacactacggatcgcgttatgacttgttcattccacaaattcggtgaatattttccaggaaccggtcatatcaaggtatgcatgcggctttatatttggatttacttttctaatattttaggacaccggaattggaacaggaaaaaactatgctgttaacgttcctttgagagatggtattgacgatgaatcttatgaaagcgtatttaagcctgtaagtcttttttataaatttctttgttctaacaatctgaattaggttataagtcacataatgcaatggtttcgaccggaagctgttattttacaatgtggaacagattctctcgctggtgatcgactaggctgcttcaatctgtcaatgaagggtaagtaactactgtttctcgtttttactaattcccctcaacaggacattcaatgtgcgttgattttgttaagagctttaatttgccaatgatatgcgttggaggaggtggatatactgtacggaatgttgcccgtgtctggacttatgaaactggtcttttagccggcgaagagcttgatgaaagtaagtaccaatacgtaaattgtttattaacccatccaagaccttccttataatgactatttacaatattacggtcccgattacaagctcaatgttctttcaaacaatatggaaaaccataacactcggcagtatcttgattcgataacgtatgctaccttttgagttttattcttacgaggctgaccaaatttagctctgaaatcatcgaaaatttgagaaacttatcttttgcacctagcgttcaaatgcatagtaagtataagcggttatcgaaaaatgtgctaacaaatactcttacattagaaactcccggtgactttacgtttgaaaatgccgaaaagcagaacattgcgaaagaagagattatggatgagcgcgtatagacctatataaaattt

SEQ ID NO: 26065 - DNA, 1219 bp, Schizosaccharomyces pombe
atggtcaacgattttaatgaaaaaaatggcattaagaaaagacttctagatttcttcccagtcgttctcgaaggaattcgtgaaatcttagaaagcatgcaatacttccccgaagaaaccgagaagctgttatatgtaagttgattatcttgcctttataacgcgacagctaaccttcatttagtccataaagagaaatacgttaggaggaaagaataatcgaggactggcagttttgcaatctttaacaagccttattaatcgagaacttgaagaagcagaatttcgcgacgctgctctcctaggttggctaattgaaattgtaagtaaactggttttttaattcagatttgtttacgtaaaatcactggggtactgacggatgttcagttgcaaggttgctttttaatggcagatgatattatggatcagtctatcaaacgacgtggtttagattgttggtatttggtagttggtgtacgaagggcaattaatgagtcacaattactagaagcatgtattccacttttaattcgaaagtatttcagaaatatgccatactatgtcgatttattggatactttccgagaggtatgttacaataaattcaactaaaaagcttactttcaaggttacttttctcaccgagttggggcaacaagaagatttgctttcatcacgagacggagaagcctcgttacgatcttttgatttaatgaaatatgactttattatcacttataaaacatcattttattccttttaccttcctattaaatgtgctttattgttgtctcgcaattcgaatcaaaaggcgtatgatacgactataaagctttcaaaacttcttggttattatttccaagtccaagatgactacttagattgtttcggtgattacacggttttgggtaaagtgggaatggacatacaagacaataaatgcacatggctagtttgttatgctgaaaaatttgcctctgcggatcagctgaatcttcttcgtgctcattatggaaaagcagggtctgaaaacatagctgtaataaagcagctttatcatgagcttcaaatacctgaattatatcacaaatttgaagatgacatggtggattctatatccaaagaaattgatttgattgatgaatctactggattgaaaaagtgtatatttactaagttttttcagctcatttacaaaaggtcacggtagcagtca

SEQ ID NO: 26066 - DNA, 7158 bp, Schizosaccharomyces pombe
atgagccaacacgcaaaaaggaaagctgggtcactcgatctttcacccagaggcttagatgacagacaggctttcggacagcttttgaaagaagtattagcattagacaaagaacatgagttaggtagaagtaattctttaccatctatgacctccgagcttgttgaagttttaattgaagttggtcttctagcttttaaacatgatgattcaaaatctgaatttatctctcctaagatgctaaaagaagcccatctctctctacaagcgttaatgctaatcttaaaaaggtctccgacagttttgcgggagattaaatcatctgttactcttttggattggattttacccaggactatatcattgtttgctgatattcgttttattaagttatttgactcattaaaagagtttcataagctaatttatcagctaatcagtgaaaagtcattcctatgggacttatatgcttcgtttatgcgttattggaaatattatattacaaacgtttcttctatagttctccaaatcactaatgctacattcccttacaagatgccctcacccaattctcaaccattgcagagtatcaccccaaattatccaacccatcgagaggacaaatttgatttacttatcattaatatagaggaggcttgtacatttttctttgaaagtgcccatttttttgcacaatgctcatatttaaagaaatccaattttcctagtccacctctctttacagcgtggacttggatcaagccatgtttttttaattttgttattttattaaaacgaatcagcatcggagactcacagctctttctacatttgcattcacgtatagtccaaactttatgctgtttttccttgaattttatatatcatggccttcccatttgtgaaaaatctaaacatattttaatgtcctccatcaacttaacattgggatcattgaagaaaacttatacagttgctaatactgctatatctcttttttttctctctttatttgttttacccaaaactgtagctggtctattctatccttttggggtttccttactttctgacttcaaggtattagagcaacttgaaccagattctgatctcaaaaaggcaataatattatttaagtgcagataccaaagttcagaaatagatcaaacaactctccgtgcttttggcgaaatttgtactggtaaacttgaaaacacgttgttttctaactctgaattaaacctttttcttttacattatctttccttggacaatgacttgtcaaatattcttaaagtggatttccagaatggtcataacatatgtacatttgcaaaatggtgtataaacaacaacttagatgaaccgtctaatttaaagcactttcgtgaaatgttagattattatagctctcataatgttacaataagtgaggacgacctgaagaacttctctttagttttgtgtactcatgttgcaaaggtgaatgagaaaacaaatagtattttccgcacatatgaagtacatggttgtgaagtttgtaactcattttgtttactatttgatgagcggtcgctctttaaaattccttatcacgaattgttttgtgcattgctaaaaaatcccgacataatttcctcttctgttaaacaatcattgttgcttgatggcttttttcggtggagccagcattgctcaaactttaataaagaatcaatgttaagtttaagagaatttattatgaaagcattagccagtacttcaagatgtttacgtgttgttgctgcaaaagttttgcccattttcattaagggacctaataatcttgatatagttgaatttcacaaggaaagtaaagccttgatttttaatacgttgaaaatattggcggtggaaaatacagctattttagaaacggtcattctttcctggatctccttatctagagtggtagaagaagaagaattacattttgtactattggaagttatatcttctgtgataaacagcggaatattttatcaaggcattggtctcagcgctctgcaacaaattgcctcgacgcgtcatatatccgtttggcaattactttctccatattggccaacagtgtccgttgcgattgtccaaggtatgggtaaaaaaccgaacatagccagtttatttgctcagcttatgaatatttccgagggcgattttcttattcgaacacaggcgtacactttaccattccttgtacttactaaaaacaaagcgttaatagtacgtatagctgaactttcacaaagtgatgttgctactttgtgccttaccaatatgcataaaatccttgcttcgctacttactacggatcatcctaatttggaagagagtgtgatgcttcttctttcactggccacttctgattttgaaaaagttgatttaacgtctttgttacgctctgatcctatttctattactgtggagttgttacagctttatcagaatgatgttcctcatgaaaaaattgaaaatgctttaagaaaggtagcaatgattgtctctcaagtggttaatgacgaagacttgagcaataaggaattactttatgatttttttaataatcacattttgggtatcttagcagaattttctaatatccttaacgacctgaaaggaaagacttcaattaatgaaaagattaagacaattgtcggcattgaaaaaatgttatctttatgtggaggtgcagtcaaacttggattaccacagatactttctaatttacaaagtgcttttcaaaatgagcacttaaggttttatgcaatcaaagcttggttcagtttgatattagcaaccaaggagcccgagtatagttcaattgctggtttaagtcttgtaattttacctcctttattcccttatttagaaccacaagaagcagagctagtaattcaaatatttgattttatttcttctgacacacacaagtgcctacaaggattaaagtgggctatccccaccagtctggattcagcgtgctttagccttaaggctaaagaaatattctgttcgcttcaaaatgaagatttttactctgagcttcaaagtataattaagtgtttaactaacgaaaatgagccagtttgttatttaggtttacaaaaattagaacttttttttcaagccaaggtggacgagttacatgacacactaaatttggacatatccaacgaagttctggaccaattactaagatgccttttagattgttgtgtaaaatatgcttcaacaaatatgcaaatatcatatcttgctgcaaaaaatcttggtgaattgggtgcgatagatcccagccgcgccaaggctcaacatattattaaagaaacagttgttcttgataactttgaaaacggagaagaaagtttgaagtttattctagattttatgcaatcgcagttaattccagctttccttgttactactgatactaaagcacaaggttttcttgcctatgctctgcaagagtttctaaagcttggtggattcaagtccgcagtgattaataaaaaaaagggactaactgtggtaacagaacattggatgtctttgcctgatttatccaaacgtgtgcttataccatttttaacttccaagtatcatttaacaccaatccccaaaattgacattcggtaccctatttataaagaaaatgttactattcatacttggatgcagttgttttctcttaaattgatggagtacgcccattcgcaaaacgctgaaaaaatatttggtatttgttcgaaagtagtgaaagaccaagaggttaacattccctgttttcttcttccctttcttgttttaaatgttattttaaccgagtcagaactggaagttaataaagtcattgaagaattccagcttgttattaatcaaccgggacctgatggattaaattccgtggggcaacaaagatacacctcatttgtagatgtattttttaagattgtggattaccttaacaaatggcttcgcatgcgaaagaagaggaattgggatagacgttctgccattgcaaggaaagagaaccgttatatgtcggtggaagatgctacctctcgagaatcatcgatctcaaaagttgagtcatttctttctcgatttccttcaaaaacattaggtattgtctctttaaattgtggatttcatgctcgtgcattgttttattgggagcaacacatacgtaatgctacagctccatatgcagctttagagtccgattatagagttttgcaggaaatatatgctggaattgatgatccagatgaaatcgaagcagtgtctttaaatttccatgattactcgtttgatcaacaactccttttacatgaaaattcaggaacatgggactcggctttgagttgttacgaaattattattcaaaaggatcctgaaaataaaaaggcgaaaatcggtttgcttaacagcatgctgcaatcggggcattatgaatctcttgttttgagtttagattcttttataatcaatgacaaccacgagtattcgaagatgttaaatttgggtattgaagcttcatggcgttcgctatctattgattcgttaaaaaagtgtctttcaaaaagcaacttggaatctttcgaagctaaattgggtagcatattttaccaatacctacggaaggattcttttgctgaattgacggagcggctgcaacccttgtacgttgatgctgctacagcaattgcaaacacaggcgcccattcagcctatgattgttatgatattttatctaagctgcacgcaattaatgactttagtaggattgctgaaactgacggaattgtttccgacaatcttgatattgttcttcgccgtcggcttagccaagtagctccgtacggtaaattcaagcaccaaatcctgtccactcacttagttggctatgaaaaatttgaaaacacgaagaaaactgctgaaatatatctcgagattgcaagaatatctcgaaaaaatggtcaatttcaaagagccttcaatgccatcctcaaagcaatggatttagataaaccgctagcaacaatagagcacgcacaatggtggtggcatcaagggcaacatcgtaaagctatttctgaattgaatttttcgcttaataacaacatgtttgatttggttgatgagcatgaagaaagacctaaaaatcgtaaagaaactttaggaaatccacttaaaggaaaagtgttcttgaaacttacaaaatggctcggaaaagctggccaactgggattgaaggatttggagacgtattatcataaagcggtagagatttactcagaatgtgagaatacgcattattatcttggccatcatcgagttttaatgtatgaagaagaacaaaagctcccagttaatgaacagagcgaacgatttttaagtggtgagttagtaactcgcataattaacgaatttggtcgatctttgtactatggtacaaatcatatatatgaaagtatgccaaaattgctcacactgtggcttgattttggggccgaagaacttcgcttatctaaagatgacggcgaaaagtactttcgtgaacacattatctcttcgagaaaaaaatctttggaacttatgaattcgaatgtttgtcgcctttctatgaaaattcctcaatacttttttctggttgcattatcccaaatgatatccagagtatgccatccaaataataaagtttataaaattttggaacatataattgcaaacgttgtagcatcttatcctggggagacgctatggcaattaatggcaacaataaaatcgacttctcaaaagcgctcgcttcgtggaaaaagcattttaaatgttttacattctaggaagctttctatgtcttccaaagttgatataaaagcactcagtcaatctgcaattctcattactgaaaagttaatcaatttgtgcaatacaaggattaacagtaaatctgtaaaaatgagcttaaaggatcattttcggctttcttttgatgatccggtagatttagtcattcctgctaaatcatttttagacattactttaccagctaaagatgctaacagagctagtcattatccatttccaaaaactcagcctactctgttgaaatttgaggatgaggtggatataatgaactctcttcaaaaaccaagaaaagtgtacgttagaggtacggatggcaacttatacccattcttgtgcaaacccaaagatgatcttcgtaaggatgctagattgatggaatttaataatcttatttgtaaaatattgaggaaagatcaagaagcgaacagaaggaacttgtgtattagaacttatgttgttattcctttaaatgaagaatgcggatttatcgaatgggtaaatcatactcgtccatttagagaaattttgttaaaaagctatagacagaaaaacattcccatatcatatcaagaaatcaaagttgatttagactttgcactgcgaagtcctaaccctggtgatatatttgaaaagaaaatcttaccgaaatttcctccagttttttatgagtggtttgttgaatctttcccagaaccaaataattgggttactagtagacaaaactattgccgaactttagcagtaatgtcaatagttggctacgttttgggtttgggagatcgccatggcgaaaacatattgtttgatgaatttacaggtgaagctatccatgtcgatttcaactgtctttttgataaaggtcttacttttgaaaaacctgaaaaggtgccgttcagattaactcataatatggtagatgcaatgggtccgacaggttatgaagggggtttcaggaaagctagcgaaataacgatgcggcttcttcgctcaaaccaagatacattgatgagcgtactagagtctttcctacatgatcctttagtcgagtggaatagaaagaagtcgtcaagcaagtacccgaataatgaagcaaatgaagttttggatataattcgcaaaaaatttcaaggctttatgccaggggagacgatacctttatctattgaagggcaaattcaagaattgatcaaatctgctgtcaacccaaaaaacctggtagaaatgtacattggttgggctgcttatttc

SEQ ID NO: 26067 - DNA, 5919 bp, Schizosaccharomyces pombe
tctatagcactaggacaagccttttcaaactatgcgtatgacctctttgacttaatatttgcaagcggactttctgaggcttcttaccgtgctctctcagatctggcccataatatacctccattattaccagtcatacaggaacgactattagatatgctcagcaaaattctaagtggtcgtccttttattcctccaggatgtcctccccaatatgtagcaagatctttaaaatcttcaaagagtgcttccctgaagacaggattttttcccaatgacgtctatattttggctctaaaagttttgggaaattttgacttctccggttatattcttaatgaatttgtgaaggattgtgtagttgtataccttgaaaacaatgacccggaagtacgcaaaaccgcctccataacctgctcccaactatttgctcgtgatcctattttatcgcagactagtgatcatgcgattcaagtagttgccgaagtgctagaaaagcttctaacagttggtatttgcgatactgttccagatattcggctaactgttcttaattctctcgattctcgctttaacaagcatttagcccaagcagataaaattcgtttactttttattgctattaatgatgaaaactttgctgtacgagaatctgcattacggataattggaagactaaatgtctataaccctgcctatgtgatgccatatttaaggaaaataatgttaaaaactttaacaatattggactattctacaattatcagaactaaagaagagaatgccaagttattgtgtttattaattgcagcagctcctcgcttaatagagtcacatgtggaaccaatactgcaaatacttttacccaaagctaaagattctagttcaattgtggcagctagtattgttaattcgcttggtgaaatatgccaaatcagcggtgaggttattgttccttttattaaagacttaatgccgctaataattgaggctttgcaggaccaaagttctcctattaggagagcagcggctttaaaggctttgggtaatttatcaagcagcaccggatatgtaattgatccgtatattgaattcccttctttacttgatatacttattggcataacgaaaaccgaacaagatattactattcgtcgagagactattaaactaataggtacacttggtgctttagatcccaataggcatcgtgttttagaaaagggaacagaaaaagtagttccagaacagaaaaacattcctcctgacatttctttgctgatgtcgggcattggtccatcatccgatgaatattaccccacagtcgtgattactgctttgatgagtatattaaaagacccgtccttaactattcaccatactgctgttattcaagctgtaatgtatatattcaagaccatgggtctcagatgtgccccctttctttcccaaattattccagaatttatcgcagttatgagaacgtgtcctacgaacatattggagttttattttcagcaactaagtattttggtccttattgttcgtcagcacatacgaagttttttaccagatttatttaagcttatcaaagatttttggaacccgcattctaatttacaatttacaattttgtcgctaattgaatcactggctagagcaatgcagggagagttcaagccatacttaccatctttattagtaatgatgctacaaatatttgactctgatgtatcagtggactcagtcagtacaaaaaaggtattgcacgcattcatcgtcttcggtgatacattagctgattattttcatatgctcttggatccaatacttcgactgtatgagcgaaatgatgtttcaatcggtataaaagaaagtataatgattacaattggacgactttcaatggttattaatctctcggaatatgcatcaagaattatacatcctgttatgcgtatgctttcgtgcaacaatgcctctctcattcgcgtgagtatggatactgtatgtgcgcttatatatcaacttaatgttgattttgctattttcattccaatgattgataagtgccttaagatgaatggcgttactcatgaaacctactcgatacttgttgaacaatttttacaagaacagcctcttcctataaaactcaacccttatgaaaaatacgataagcctaaattagatgtggtagcttccgctgctgatataacctctaaaaagcttcctgtaaatcaagaaatcctcagaaatgcgtgggaagcatctcaacgatcgactaaggatgactggcaagaatggatccgacgattaggcgtagctctcttaagagaatcaccttcacatgccttacgagcatgtgctgctttggctgctgcctatcaacctttagccagggacttatttaacgctagttttgtttcttgttggtctgaattatatgatcactttcaagaagaattagttaagtcgattgagatagctttaacgtcgccacacatatctcctgaaattattcagattttactcaatcttgcggaatttatggagcatgatgataaaccacttccgattgatattcgtactttgggtgcctatgcagctaaatgccatgcgtttgctaaggctttacattacaaggagctagaattcattgaagaagaattggtgacaaaaccttcggttgatacaattgaggccctaatttcaatcaataatcaactccaacaaccagacgcagctattggaatacttaaacatgctcagcagcatgacaaaatgaatcttaaagaaacttggtacgaaaagttacaaaggtgggaagatgctctgtcagcttatgaaaaaagagaagctgctggcgctggcaatttcgaaataacgatgggcaaacttcgttgtttacacgctttgggtgaatgggatcgattatctcagttagctcaagaaaattggattcatgctggtcatgatgcgcgacggtatattgcaccgctttccgtagccgctgcttgggggttaggtcaatgggagcaaatggatgaatatatttctgttatgaagtctgagtcaccagataaagctttttttaacgcgattgtggctctacatcgatcacaatttgaagaagcagcttcttatatcaccagagctcgagatttacttgatactgagcttactgcgcttgttggtgaaagttataatagggcttacagcgttgctgtccgtgttcaaatgttatccgaattagaagaaatcattacctataaaaaagccgaggacaaacccgaagttcgtgaaatgataaagaagacatgggttagacgtttgaaaggctgtcagagaaatgtggatgtttggcaaagaatgttaagaatacgatctttagttatttcaccccgtgataacatggagatgtggatcaaattcgctaatctctgcagaaaatctggtaggatcagtctagcgaaaaaatcacttaatttactccttgaagacgacgaaaacttagataattcactcgtcttaaagaagactcacccttcaattgtctatgcaaatctaaagtttttgtgggctgttgacgataaaaggaaggctcttaatagcatgcaagagtttacttctcagctaatttctgacattaatgttgaccctgctctttttgttcaatctacatcagttaatactcaaaaatcacaagaagaaattcaatattattttcatcttctagctagatgttatcacaagcaaggtcaatggcagcaagaaattgagaataattggtcagaaggatcttttgatggagttcttcaatcatatatgtatgctacgcaatttgattctaaatggtataaagcttggcactcttgggcattagctaatttcgaagctgtaaagtttttggagcaatcagaggagcaaatcccaagtgctgcatatgagcagtatattattccagcagtcaaaggcttttttaagtcaattgctttaagcaaaggtaaccttcaggacaccttgcgccttcttaatctttggtttaaattcggcaataatagcaatgtaattaatactttgaacgttggtatatccactgtgaacatcgatatctggctggacgttatacctcagcttattgcgagaattcatgcctcctctttgagtgttcgtaaatctgtgcatcagttgctttccgatgtaggtcgcgcgcatccccaagctcttgtttatcctttaactgtagcagcaaaatcgcagagttctgctaggcaaaacgctgctttagcaattatggattccttgaaaacacatagtccacgtctagttgaacaagcaagacttgttagtcatgagcttatcagagctgcaatcctttggcatgaacaatggcatgaaggattggaagaggcttcacgattgtattttggtgatcataacattgagggtatgtttgccgtgttgagaccattgcatgaaatgttggaacgtggtccggaaacgcttcgtgaaatttctttccaacaagcctttggacgtgacttagtcgaagcaagggattgttgtatccgttttgagcaaactggtgatatatcagacttaaatcaggcctgggacttatattaccaagttttcaagaaaattcgtaaacagctacctcagttgacaacattagatttacaatacgtttctcctaaactcttacatgtacatgatcttgagttagctgttccgggaacatacgttagcgggaaacctgttataagaattgtaaagttttaccctacattcaacgtgataacatctaagcaacgtccgagacgactgagtattaaaggcagtgatggaaaagattatcaatatgttttaaagggtcacgaggacatcagacaagatgaacgtgttatgcagctatttgggctttgtaacaatctgttactagctgacccggaaacttttaagcgcttactttcaatccaaaggtatccagtgattcctttatcaccggattcaggccttttaggctgggttttggatagcgatactttgcatgtcttaattcgtgactacagagaaagcagaaagattttactcaacatagaacataggttgatcattcagatggctccagattacgatcgtctcactctccttcagaaagttgaagtctttgaatatgccctacttagtactacggggcaggatttataccgcgttttatggctgaagagtcgtagctcagaagcttggcttaataggcgaactaactattctcgtactcttgcggtgatgtcaatggtagggtacatcttaggtttgggcgatcgtcatccttccaatttgatgctggacaggtatacaggtaatatcatccatatcgattttggagattgttttgaagtagcaatgcatcgagaaaagtttcccgagaagattcctttccgccttacgcgaatgcttgttaacgcaatggaagttagtggtatagaggggacgttccggataacatgcgaacatgttatgcgagttcttcgtactaataaggagtctgtgatggcagttttagaagctttcgtttacgatcctcttattaactggcgccttgctcctgcatattcaccttctatcgatgaaaagcaatctaacgaacctaatacacttctcggtgagacaattgatggtttacaccggaaacgcttaaacgaagaaggaattacacttgaagaacgtcaaaaacccgagatactcaatcaaagagctataaccgttcttaatcgtgtgtccaataaacttactggtcgggatttcaaaccccaacagcaattggatgtaccaagtcaagtagagaagctgattttacaagcaacctctatagagaacctatgcttgtgctatattggctggtgtagtttctgg

SEQ ID NO: 26068 - DNA, 1380 bp, Schizosaccharomyces pombe
atgagtttagctaaccgcattgaagaaatccggtgcctttgtcagtacaagctttggaatgaccttccttcttatggagaagacgaaaatgtgcctcaaaacatccgccgttgttaccaattactcgatatgacctcgagatcctttgcagtcgttattaaagaattgccaaatggtattagagaggctgttatgattttttatcttgtccttcgtggactggatacagtagaggatgacatgacgttgcctttggataaaaagcttccaatcctaagagatttttataaaacaattgaagtcgaagggtggacgtttaatgaatctggtcctaacgaaaaggatcgtcagcttctcgtagaattcgacgtggttataaaagaatatcttaacctgtcagagggttatcgtaatgttatttcgaacattactaaggaaatgggtgatggtatggcttattatgcctctcttgccgaaaaaaatgacggattctctgtagaaactatagaagactttaacaaatattgtcattatgttgccggattggtgggaattggactatctcgtttgtttgctcaatctaagctagaagatccggatttagctcatagtcaagctatttccaattctcttggactctttttacaaaaagttaacatcattcgtgattatcgtgaggattttgatgataatcgtcatttctggcctcgtgaaatttggtccaagtatacttccagtttcggtgatctctgtcttcctgacaactctgaaaaagctcttgaatgtttatctgatatgactgctaatgctttaacacatgctactgatgctctcgtttatctttctcaattgaagactcaggaaatatttaatttctgtgctattccacaagtaatggcaattgccacattagctgcagttttcagaaacccggatgtttttcaaactaatgttaagataaggaagggtcaggctgtccagattattctacattctgtaaacttgaagaatgtttgtgatttattccttcgttacacccgtgatattcattataagaacactcctaaagatcccaactttttgaagatttcaattgaatgtggaaagattgagcaagtatctgaaagcttatttccacggcgcttccgtgagatgtacgaaaaggcctatgttagtaagttgtctgaacaaaagaagggaaacggaactcagaaggcaattttaaatgacgagcaaaaggaattgtatcgaaaggatttacagaaactaggcattagcattctttttgtattttttataatccttgtatgccttgctgtcattttctatgtgttcaatattagaatacattggtcagacttcaaagagcttaatttgttt

SEQ ID NO: 26069 - DNA, 1832 bp, Schizosaccharomyces pombe
atgttgtccttattgaatcccaaagcggaatcaattcagagagcgcaggctcttcaggttggtctataatatttgtttaagcagtatcgctaacgttggcaggttaatatctcagcagcaatcggtttgcaagatgtcttgaaaagcaatttggggccaactggaacaacgaaaatgtaagttacttttatagtttagcaactcataattttaggttggttgatggcgctggtgctattaagcttacgaaggacggtaaagtcctgcttacggaaatggtaagtgattaagaacacattaactgcaaatgcttttttctttctttccttttttgataattttggaatttttttgactactttaggtctcatgttgcttttaataatgagtattgagttgtgtactaactttattggtagcaaatacaaaatccaactgcctcttgtatagccaaggctgcaactgctcaagacgatgccacaggagatggtacgacttccgtatgtcttttggttggtgaattacttaagcaagctgaactttatattcgtgaagggcttcacccctctttaattagcgatggatttaatttagcaaagaatgaagcccttacatttttggatagttttaagactgattttgaggtcgaccgtgaggttttgttaaacgttgcgaaaacctccttaagtacgaagatttcctcaaaagttgttgagtcacttgcacctgctgttgttgatgctatattgacaattcgtcgtcctgatgaacctattgatcttcatatggtcgagattatgaagatgcaaaatcgctctgcttcagatactcaattgattcgcggtttacttctcgatcatggagctcgtcaccccgatatgcccaagcaagtgaaaaacgcttatatattaattttaaatgtttctttggaatacgaaaagagtgagataaactcgggatttttttatagtacttcggaacaacgtgaacgattagtcgaaagtgaaaggaaatttgttgacaataaattgcgcaaaatcgttgaacttaagaaggaagtttgtgaaagagatcccactgcgaattttgttattatcaatcaaaaaggtattgaccccctttctcttgatgtattagctaagaatggtattatggctctgagacgagctaaacgtcgtaatatggaacgacttcagttagcatgcggcggggtagcccaaaacagtgtggacgatctcaatcctgaggttttaggatgggctggatcggtttatgagagaacattaggtgaggaaaaatacacttttgttgaggacgttaaagatcctaaaagtgcgactattttaattcatggacccaatacatatacaatacaacaaattcaagatgcaactcgggatggtcttcgtgcggtaaaaaatgctgtagaagacaactgcttgatagttggagccggtgcttttgaagttgcttgcgctgctcatcttcgcaacaagtttgctgctaaagaagttaagggaaaggctaaaatgggagtatatgcttatgccgatgctcttttgataattcctaaaactctggctgcaaattctagttacgatactcaagatgcgattgttgctttgcaagaagaagcatctgaaggatataaagttgggttggatttaaagacaggtatgccttttgatcccgaggtagaaggaatatatgataactaccgcgtcattcgtcatatgcttcattctgcaacagtgatcgctagtaacttgattagtgtcgatcaaattcttcgcgctggaagaagtagtcttaaagaaggcccacctcagtaa

SEQ ID NO: 26070 - DNA, 1464 bp, Schizosaccharomyces pombe
atgcatttgtatcagttggaagacgaattaaaaaagaatgtcttttgcagggaagatcaaataaagaaactttcatgtttactttttaataaggattgtcgtgttccaagcattgtgctttacggagttgctagtacagcaaagacttttttattgcggaccgcttttgatttgtcaaaagaagaaaatgtttggattaatttgcaagactgttttacagtcgctcatttctggtaccggatccttataaaagtcggtgttgacaaagatatagcattaaaaaaaggcattaatatcagtggatttatttatttactggaacaggcaatgtccaaaagggactatcatacatttttggtacttagttcctctcctattttattactcttaaatactaatatgagttataggtgctggatcaaatagatgatttcgctgaggcttctactattctattctcacaattagctcagcttccgattgttgtaagtaaatatttacagacccactgattaactattttaggcaaacattcccaatctgtcaatcatttttgtacttcattctcaccctgctcaatacttgggaacattgtctattgcagtgatttttttcccacaatatacccaagcggaaatattagagatatgccaaaaaacacctcctaatttagattttttggatagatctggcgatagtgtttttgaagacgaaattgagctcagcgtctggatgcaatattgctcgtttctttggagtgtttttggagtgcagtgcttaaatgactataggtcttttcgtagtgttttggatagatattggccaaagttcattcaacctatagttgaaggagacatacatcctgctgattatgctcaacttcacaagctggctaaaaactttttagtgtcagatgctacggttactaaaagacttcacataatcaacccgactgaaataaaaaatcttcttgattccaaatctattaacttgtcgctcgtttccaaatatttactcgtttctgcattcctagcatcttataatccaagccggttagacgcccaatttttttcattttctaaaacttcgaaacgacgtggaagaaaacgtaaacaaattcaagatgaaggggttttattttccaaaataccaagaaccgctgggagcaaaggccggtctgctgtaaaaatatcccaacttacattaggacctaaaccttttgaagtagaaaggttgattgctatttattatgccatttcttccccggtagagaaagttctgaccgctgatgtttttgttcaaatagctacactcgcctccttaaaaatgatactttcggcttccaaaggtgtgcttcgctctttggatagccctagatacattgtcaatgtctctcgcgaatatgtattaaaaatcgcagattcactttcgtttcctctcgatagttatttggcgggatagctt

SEQ ID NO: 26071 - DNA, 732 bp, Schizosaccharomyces pombe
atgtctcaagcacgcggatttgataggacaattaccgtcttctcccctgaaggacgtctttatcaagttgaatatgcattcaaagcgtttaataacgcagggattacatctgttggtgtaacaggtaaaaattgtgcatgtgtaatctcccaaaaaaaagtacctgacaaacttattgatgcctctaccgttaaacatgtttttcctattactaaaggaatcggctgtgttatgacaggctctatcgcggacgctcgcgcgcaagttagccgggctcgaagtgaggctgctgaatttgaatacaaaaatggataccctatgccctgcgatgttctagccaaaagaatggctaatattgctcaagtttctacccaacgtgctgctatgaggcctttgggagttgcaatgacccttgtagctgtggatgatgagattggaccttccctatttaagctcgaccctgctggtttctatattggttataaagctaccagtgctggaccaaagcaaacggaaactataaactggctagaaaaacgattcaaaaaggacggaataccttcaaaccttactgataccgttgaaaccggaattcaggctttaatgagtagtttaagtactgattttaagtctactgagcttcagattggtgttgttgaagacgacaaaccatttcgagttttatcagtagaagaaatagaagcccatttacaaagtattgccgaaaaggat

SEQ ID NO: 26072 - DNA, 1498 bp, Schizosaccharomyces pombe
atgaattcccaaacgagcgtagtaggggttcactatcgcgtgggtcgtaaaataggtgagggatcgtttggtgttattttcgatgggatgaatcttttgaataaccaacttattgctataaaatttgtatgttctttgttaggatgagtatatggacaatactaacaatggacgttaggaacccaaaaagtcggaggcacctcagctccgtgatgaatacagaacttataaattactagttggaaatggtatgtttttattttgctacccaaaacatatggtcaagactttggtactaaccgtatttgcaaatagctggcattcctaatgtttactatttcgggcaggaaggactacataatatccttgttattgatttactgggacctagtttagaggacctatttgaatggtgcggtcgtcgattcagtgtcaaaacggtggctatgacggcgaaacagatggtaagtttcctaagttgttcctataaggttttcaatttgtttaaattttctctgacatttcaaagctttccagagttcagacgattcatgaaaaaaaccttgtttatagagacatcaaacccgataatttcctaataggccgaccttcctctcgaaatgcaaacatggtatatatggttgattttggtatggccaaatattaccgtgatcccaaaaccaagcaacatataccatatagtgaacgtaaaagcctctcggggactgcgagatatatgagtataaacacgcatcttggacgtgaacaatcccgtcgcgatgacttagaatcgttgggacacgtctttatgtattttttgaggggaagtttaccttggcaaggattgaaagctgccaacaataagcacaaatacgaaaagattagtgaaaagaagcaatctacctccattagtgagctttgtgctggatttcctaatgaattcagtaaatacatgacttatgtgcgttcgttagaatttgatgaagaaccggattatgcgtttttacaagagttatttgatgatgtacttcgagcaaatggtgatacgaatgatggggtttatgattggatgttattgaatgacggtaaaggttgggagtcaagctcttctcatttttctgttgttgctatgaagcgacgaaagaattaccttggcttaaatgttgttcaaaatgatgattccagaaaaaagaacagtactttgcaaacacagaacatgcgatttaaatcctcatatggggtgagaggtcctagaaattactcatcgttcgatgcgttgccgagcaaaaacgctccattggtgcgtcaagaacagtctgcttctaaaaaaacaatttatgctcattcttctagaggttacgatagggttcgacctatgtatgtatctcagccctcgaataatgcagtcggagtaaatcatcctaacgataattctgattcggaagcaaaaggaggattttttgatatgatatgctgtcgttgcttttcttagtttcga

SEQ ID NO: 26073 - DNA, 1022 bp, Schizosaccharomyces pombe
atgaactttcaatttataaattcaaatataaacaatgaagataaattgccgatggagtcgttgaaaaagaaatttttaaaacaaaatcgtgaaattataaagtaaggtcaaagtacaccatttttgaatcccttgtggtaaataataaacatctaactttcagaataaatactcagctttctataaaaattagagaatctgaaaacgaaattcaagatttgatacaagaaaatttcactttgaaaagttatttggttaaacttgaagctcgatttcgcaatcaatctcaaactgaggacttgttaaaaaacttctttcctgagatacaaaccattcacaaaaagatttcacaagtgcaaagtttactgaagattatagagaaaaagtgttcatcagatttcctcgaagcgaatgtaaaaagtcaatttacaacctgtgaaaataaagattcgaaagaagattatcagattttgcataataaacgcttggagtatgtatcatttaatgatgaacttaaaagtctcgaaacagggcaaccattgtattgttttcaagatttccaaaaaaaagtccatggtcctccggctctatctgaaaaacctggaaaatgtatattaaaagataaaaccaatgcccacgtaaacaaaataccacaagatgaggtgaattactcattgccgcaaaaaaatatcaccatcttttcaaaggaattaaaagaaaacgaatttgaatccatcaacgagggcgaaactgaagaagaaaaggctaaaacatcaaatgtttgtgtttgtattccttgtaaaagtgctgaacagataactgaccttaaaggacaagcaaccggagacagctccccatgtgattttgaagaatctcaaccaaggattaatggacgtgaaaaactaagacgatcagtcaaagtgataaactatgcaatacccagtttgcgaactaaactacgacgagactttgacttaccatctgatagaaaacgcaaacgacatcccagaggcaaagcataa

SEQ ID NO: 26074 - DNA, 732 bp, Schizosaccharomyces pombe; identical to SEQ ID NO: 26071

SEQ ID NO: 26075 - DNA, 1464 bp, Schizosaccharomyces pombe
atgcatttgtatcagttggaagacgaattaaaaaagaatgtcttttgcagggaagatcaaataaagaaactttcatgtttactttttaataaggattgtcgtgttccaagcattgtgctttacggagttgctagtacagcaaagacttttttattgcggaccgcttttgatttgtcaaaagaagaaaatgtttggattaatttgcaagactgttttacagtcgctcatttctggtaccggatccttataaaagtcggtgttgacaaagatatagcattaaaaaaaggcattaatatcagtggatttatttatttactggaacaggcaatgtccaaaagggactatcatacatttttggtacttagttcctctcctattttattactcttaaatactaatatgagttataggtgctggatcaaatagatgatttcgctgaggcttctactattctattctcacaattagctcagcttccgattgttgtaagtaaatatttacagacccactgattaactattttaggcaaacattcccaatctgtcaatcatttttgtacttcattctcaccctgctcaatacttgggaacattgtctattgcagtgatttttttcccacaatatacccaagcggaaatattagagatatgccaaaaaacacctcctaatttagattttttggatagatctggcgatagtgtttttgaagacgaaattgagctcagcgtctggatgcaatattgctcgtttctttggagtgtttttggagtgcagtgcttaaatgactataggtcttttcgtagtgttttggatagatattggccaaagttcattcaacctatagttgaaggagacatacatcctgctgattatgctcaacttcacaagctggctaaaaactttttagtgtcagatgctacggttactaaaagacttcacataatcaacccgactgaaataaaaaatcttcttgattccaaatctattaacttgtcgctcgtttccaaatatttactcgtttctgcattcctagcatcttataatccaagccggttagacgcccaatttttttcatcttctaaaacttcgaaacgacgtggaagaaaacgtaaacaaattcaagatgaaggggttttattttccaaaataccaagaaccgctgggagcaaaggccggtctgctgtaaaaatatcccaacttacattaggacctaaaccttttgaagtagaaaggttgattgctatttattatgccatttcttccccggtagagaaagttctgaccgctgatgtttttgttcaaatagctacactcgcctccttaaaaatgatactttcggcttccaaaggtgtgcttcgctctttggatagccctagatacattgtcaatgtctctcgcgaatatgtattaaaaatcgcagattcactttcgtttcctctcgatagttatttggcgggatagctt

SEQ ID NO: 26076 - DNA, 3972 bp, Schizosaccharomyces pombe
atgtctgacaagggcatctttcgaacgtcttcaacaccctcgattgtggatgttacgccagatcgtggtgaaaggccacgaaagttggttcgctcagtgctagaatctccttctcagaaagatgtcgcatcaattgtcaagatagagcaaacaccatctcgcccatttttcaatgactttttaaaaaaaagaattaccgattctttaaacgaacgccctaatttgctcaacaaatttatgtctgctcaagatggcactccatctaaatcaacaggtttcaatgaacggagttcacaacttgtgtcagaatttactactacagaggatattgagaattgtgaagaaaccactcaggttcttcctcctagactggttgtttacgagctacgcctaacaaattttaaatcatatgcaggaactcagatagtgggtccgtttcatccttctttttcttcaattgttggaccaaatggctctgggaaatctaatgttatcgatgctttactttttgttttcggttttcgtgctagtaaacttaggcaatccaaagcgtctgccttaattcataaatctgcaactcatccttctctcgatagttgtgatgtcgaaattacttttaaagaggtaaactctgactttacttatgttgatggaagcgaactaacagttcgtcgtactgcttataaaaataatactagtaaatactttgtaaatggggttgagagttccttttctgcagtttctaatcttttaaaggagaaaggaatagacttgaatcataagagatttttaattcttcaaggagaagtcgaatcaatagcgcaaatgaagccccgggctatatcagaaggtgatgatggtcttcttgaatatcttgaagatatcatcggaacctcgaaatataagccaattatagaagagaatatgcaagaactttcgaattctgatgatatctgtgctgagaaagaatctcgtttaaaactggtgctctctgaaaaggcgaaattagaagatagcaaaaattcggttctttcttttctcaaagacgaaaatgagttgtttatgaaacagaatcagctttaccgtactattctatacgaaacacgcaataaaaagacgttagttcaaaacttgcttaatagtttggaaggaaaattacaagcacatttagagaaatttgaacaaaccgagcgagatatttcggaaaaaaatgaagaggttaaatcattgcgtgaaaaggcagcaaaagtaaaaaacgattgtacttcagagaagaaaactcgccagtcttatgaacaacagactgtgaagattgaagagcagttaaaatttttacttaataaagaaaaaaagttaaagaaatccattgaggctctttcattcgaaaaatcagaagcagaaaattctttaagctctcatgatattgattcccaaaagttgaattctgaaattgccgatctcagtttaagacttcaacaggaagaattgagtttggatgacattaggaaaagtctacagggaaaaacggaaggtatttcaaatgctattgaagaaaagcaaaaggctatggctcccgccctcgagaaaataaaccaattgacatcagaaaaacaaattttacaggttgagttggatatgttattaaataaagaaaatgatctaattaacgatgttgagtcctctcaatcttcgcttgataaactgcgtaatgatgcagaagaaaatcggaatatcctgtcttctaagcttaaagtgctttccgacctaaaaggagagaagaaagatgttagtaagaacattgaaagaaagaaggaaactgttcacaatacttaccgaaatcttatgtcaaacagaacaaagttggaggagatgaaagcttctttaagttcttctagatctcgtggaaatgtgttagaaagtcttcaaagacttcatgaatctgataatttaaatggtttctttggacgtcttggtgatttggctacaattgacgaggcttatgatgtggccatttcaactgcctgtcctgctttaaatcatattgtagttgacaatattgaaactggacagaaatgtgtggcttttctgcgctccaataacctaggccgtgctagttttattattctcaaagaactggcgcagaaaaatttagctcgtatccaaacacctgagaatgttccccggctcttcgacttacttcggtttaatgatcagaaattcgctcctgcgttttataacgttttgcagaataccttagttgctaaaaatttggaacaggctaatagaattgcgtatggcaaaacacgttggagagttgttacactaagtggtcagttaattgataaatcgggcacaatgactggaggtggtactcgagtaaagaaaggcggaatgtcctcagctataacgagtgatgtatcgccggcttcagttgagacttgtgataaacaagtgcaactagaagacactcgatatcgccaacacctaagtgagctggagagccttaatcagcgatttactgaaatttcggaacgtattccatcggcggaactagagatttcaaagctgcagcttgacgtttctgcttgtgatagattggtagctggagaagagaggcgaatcttgcagcttaaatccgatttaaaaagtattagaaacaacaatgaacgtaaacggaatctccaaaacaaaatatcaaatatggacaaggaagttgaggccataaatattaacaatgaaggccttgtcactgaaattaagacgttacaagataagatcatggaaataggtgggattcgatatcgtatacaaaaatcaaaggtcgacgatttgcatgagcaactcaaatttgttaaagacaagcttaacaaaatgagtttcaagaagaagaagaatgagcaacgcagtcaatctttccaagttgaactatcaaaccttactagcgagtacgatacaactactgaaagtatagccactttaaagactgaactacaatcgttaaacaagtatgtggatgaacacaaatctcggctccgcgaatttgaaaatgctctatgggacatcaattcctctatcgacgaactagtaaaatttattgaatttgaatctaagcaaatgaattccgttaaagcagaaaggattgaattggaaaatcaaattcaagagcagcgtacggcattatcagaggtcggcaataatgaaaataaatatttaaagctcatgtcaaatctgaagttacacaatttgactgaattttgtgaccagacaacaatggactcaacttttcccgaatattctgaagatgaactgagttcagttgataaaagcgagctggtctctaatatttcagtcttgaaaaagaaaactgaagacagagaagtagatatcaatgttttgtctgaatatcgtagatgtaacaaggaagcagaaaagcgtgattctgattaccaaagtgaattgcaaaaaagaaccgatttgaaaaaagtcgttacagatcttcaatctcagaggctcgatgagtttatgtacggatttggaattatatctatgaagcttaaagaaatgtatcaaattattactatgggcggaaacgcagagcttgagttagtggatagtttggatccgttttctgagggggtattgtttagtgtgatgcctcccaaaaaatcttggaagaacatatctaacctttcgggaggagagaagacgttaagttctctagcccttgtctttgctctacataattacaaaccgactcctttatacgttatggacgaaatcgatgctgcattagactttaaaaacgtttcgattgttgcgaattacattaaggaaagaactaaaaacgcgcagtttattgttatttctttaagaagtaatatgtttgagttatcttctcgtttggttggcatttataaaacggcgaatatgactaagagtgtcacaatcaacaacaaggaaatacttacagat

SEQ ID NO: 26077 - DNA, 3648 bp, Schizosaccharomyces pombe
gccatccttaagagaacaaaccgcgcgaaagctgcgactgcagctgctcccaatagcactgggaaaagcaatggtattaaaaaggctgtttataccagcacacgcaaaaagactgtgggtgttgatgatttaaccctactttcgaaaattacagatgaggaaattaacaaaaacttggaactgagatttcgcaatggagagatttatacatatattggacatgtgttgatttctgtaaatccatttcgagacctgggtatttatacgatggatattttgaaatcatatcaaggaaaaaaccgtttggaaacgagccctcacgtttatgcaattgctgagaacgcttactatcaaatgaagtcttatcatgagaatcaatgtattatcatttctggtgaatcgggtgctggtaagactgaggctgcaaaaaggatcatgcaatatattacacatgtttcaaagtccgttggcactgaaattgaaagagtttccgaaattattttagctaccaatcctttattggaaagttttggttgtgcaaaaactcttcgcaataataattcttctcgtcatggaaagtatttagaaatgatttttaattccggaggtgttcctgtcggcgctaaaattacgaactacttattagaaaagaaccgaattgttaatcaagttcgcaatgagcgtaatttccatattttctatcaattcaccaagagcgctcctcagaaatatcgtgatacatatggcattcaaggtccggagaattatgtttacacttctgcttgtcaatgtttgtcggttgatgggatttcagatgagaaggacttccaaggaacgatgaacgccatgaaggttattggtatcaccgagccggagcaagatgaaatatttaggatgctttctatcatcctttggttaggaaatattcaatttcaagaaggccaagatggtggtagcgtgatttctgacaagagcatcaccgaatttttaggctatttgatcggtgttcctgttgcggctattgagcgtgccttgacaattcgtattatgcaaactcagcatggtgcaaggcgcggatctgtatatgaagtccccttaaatccaacacaagctttggctgttcgtgatgctttgtctatggcgatttataactgtctttttgattggattgtcgaacgtgtcaacaaagctttggtcacatcagacaacagcgtttccaattcgattggtattttagatatttacggctttgaaatctttgaaaacaactcttttgaacaattgtgcattaactatgttaatgaaaaattgcaacaaatttttatagaacttactttgaaaactgaacaggaagaatacgtgcgtgagcaaattgcttggactcctatcaaatatttcaacaataaagttgtatgtgatttgattgaatccaaacgacctcctggtcttttcgcagcaatgaacgacgctatcgctaccgctcatgctgactctgctgcggcggatagtgcttttgctcagcggttaaactttttatcctccaatccacattttgaacagagacaaaatcaatttatagtcaaacattacgctggtgatgtaacctacagcattacaggaatgaccgataagaataaggatcagttagcaactgatattcttaaccttattcattcttccaacaacgagttcatgaaatctattttcccagtggctgaagagagtaactcccgtcgtcgtcctcctacagctggtgatcgtatcaaaacttctgctaatgatttagtagagactcttatgaaatgtcaaccatcgtatatacgtacgattaaacccaatcagactaagtcgcctaacgattacgatcagcagatggttttacatcaaatcaaatatttaggtttgcaagaaaacattcgtattcgtcgtgctggttttgcttatcgtcaagctttcgatacgtttgctcagcgttttgcagttcttagtggtaaaaccagttatgcaggagaatacacttggcagggtgatgataagtctgcttgcgaacagattttgaaagataccaatattccttcatctgaataccaaatgggtactagcaaagttttcattaaaaatccggagaccttattcgcgctcgaagacatgcgtgataagttttgggatacaatggcaacccgtatacaacgtgcttggcgttcttatgttagaagaagatctgaagctgctgcttgtattcagaagttgtggaataggaacaaagttaacatggaacttgaacgtgttcgtaatgagggtactaaacttttgcaaggtaaaaagcaacgcagaagatatagtattttgggatcccgtaagttttatggagattatctatcagcttcaaagcctaatggtactctatggaacacatgcggcctctctcaaaacgatcacgtaattttctcaatgagatgtgaggtccttgttcataagctaggccgcacttccaaaccttctcctcgtcaactggttcttaccaaaaagaatttatatttggtgattacaaaaattgttgaccaaaagctcacacaacaggtggagaagaagttcgctgtatcttccatcgattctgttggtcttacaaatttgcaagatgattgggttgcaattcgtaataagtccagccaaaatggagatatgtttttgcgatgctttttcaaaacagaatttataactaccttaaagagaatcaatcgtaatattcaagttatcgtgggtcccaccattcaatactgccgaaagcctggcaaggtacaaactgttaagacggcaaaagacgaaaccactaaggattatgactactacaagagtggaactattcatgttggtactggcttgcctcctaccagtaagagtaagcctttccctcgcttagcaactggtggtagtacagcagctgctagagggcctcgcccagttgtgcagaacaaacctgctgctacaaagcccgtatctatgccggctgcgaagagcaaacctgctcctatggctaatcccgtaagtactgctcaacaaacccaaaatcgtccccctgctcctgctatgcaagctcgtcctaatacaactcaagctgcagccccagttacaagtacgactacaactattaagcaagcaaccactgtttctgcttctaaaccagctccttccacggtaacttctgcagcttcttctccaagcaatatctctaaaccctctgctccagttgctaataacgtcagcaagcctagtgctgttcctcctcctcctcctcctcctcccgctgaagtcgaaaagaaagacttgtacttggccttatatgactttgcgggacgcagtccaaatgaaatgactatcaagaaagacgaaattatagaaattgttcaaaaggagccaagcgggtggtggcttgctttaaagaatggtgctgaaggatgggttcccgcaacctatgtgacagaatacaaaggttctacacctcaaaccaccgcttcttcgactaatgttgcagctcaagcgaataataatgctagtccagctgaagtcaacaacttagctggttcacttgctgatgccttgcgcatgcgagcatcagctgtgcgtggtagtgatgaagaagaagattgg

SEQ ID NO: 26078 - DNA, 2071 bp, Schizosaccharomyces pombe
ttttaccaagacataaaggctttcgtaaacaaaatggctttgcgagttccaaaggcctctgggcctcaactgtttcgcgaaggatatcggattatgcagggcgtagaggatgcagtaatccgtaattgtaatgctattcgtgaactttcagaaatcgtaaggacctataatttattaagcaagtttcattcatttactgatacttttagacccgtacctctttgggtccaaatggaaaaaataaaattggtatgttgactcaaacagttatttcatttcttattctctaacacacacatagttgtcaatcatctgcaacagacgtttttgacgaatgatgctgcgaccattatacgtgaattggaggttattcatcctgctgctaaactagttgtcgatgctacccaacaacaggagaatgaggtaagttaattcattaactgtacaattttttttgagatacacttgtttgaacattaaataagcggattttttttctttgcggactttattttaagcttcctttaccttttgatccactcatgtgccttacaaaagggcattttagaaagcactttgattacccttttatcaacgttttcatgttttatataactctatcgtattgacgcttactttgtttatttatacttcaaatatttgtacattgatttgctcttaaaaccattttctgtttactaaccattagcttggtgatgctgcaaattttgtggttgtatttacaggtgaacttttagccaaggctgaaaacatgattcgcatgggtctcactcccttggaaattgctaaaggatacgaaatggctttatcacacactatggaggttttggaggaaatttgtgctgataaaattgagactgttgaaagtgagaaggagcttattaaagcaattcgaacttgtatatcttctaagcaatatggaaatgaagatttcctttcggatttagttgctaaagcgatcctcacagttcttcccaaagatccatccaagtttaacgttgacaatatccgtgtggttaaaattatgggaagtagcctttataactctcaggttgtaaagggcatggtatttcctagagagccagagggcaccgttacacgttcaaaagaagctaaagttgctgttttttcatgccctttggatatttctcaaaccgaaacaaaaggcacagtattgttgcataatgctcaagaaatgcttgacttttctaaaggagaggagaaccttattgagtctcacattaaagaaatttacgatgctggtgttagggtagttgtcactagtggcaatgtcaatgacttagttttacattatttgaatagatttgaaatccttgttattcgtgtgccaagcaaatttgaattacgtcgcttatgtcgggtggttggcgctaccccgttggctcgtatgggtgttcccatgcctgaagagatgggatccgtcgatgttgttgagacgattgagattggtggtgatcgtgtcactgtattccgtcaagttgaggatattacacgtactgcaacaatcgtgcttcgaggggctactaagacatacttggatgatttggaaagagcgattgatgatggtgtaaatatcgtaaaagctttggtcaaagataaccgtttaatctttggtgctggagctagtgatatgcaactctgtattcgtctaatttcagttggtgaaaaaactcctggtatatatcaacatgcaatcaaacagtatggagaagcatttgaggttgttcctaggactatttcagaaaacgctggattagatcctactgatgttattagcaaactttatgctgcccatcataaggaaaacggtgaatcaattggagttgatgttgaatgtgaaaatgatggaacattagatgcgaaagaagctggtatatttgatgttttattagcaaaaaaatcagcaattagattagcaactgaaactgtactcactgttttaaacgttgatcaagttgttatgtctaaaccagctggaggtccaaaaccacctggccccaaccctcattgggatgatgattaaaattta

SEQ ID NO: 26079 - DNA, 1674 bp, Schizosaccharomyces pombe
atggcttacaataaatctctaaagtctttagtatttatccttttggcttctcagatcgtatttgtattattcctttgctacggaaaaagttctagagaacttggagtgaaatggaattcagatattcgatcttggatgaccagttacgttgggtttaatggcgagactgcggccatatcagaagaacagttaatttgggccgaaaaaattcctgattataacgaagaaatagtagtccgtttgcatttggaagaagaaaataatttgagcgatatcttgcagaaagctcaaagtcaaaaccttgatatttgggactacaatttcgatcatgtggatttacgtttaaaagaagaaaattttgatttttggaagagtcaatatcgtagtgacatacttataaacaatctgacagagaccttatttgaaagcattgttccagatactacgaattcccctttttccacagaagctttccttcaagccgttgaaaatggtcatttaaatcacgaaatgtttacttcctttacggatatttttttcaagtcatatcagaatttagaatcgattaattcctggttgaggttgatggcgtccctttacaaagatttaagtgaactagttccagttggaattacagcggaaggtcgaacgattttaggcctaaaattgaacggtcgacatccttccgacaacggggaaaagattcgtaacaagaaagtgattattattcaaggaggatctcatgctcgtgagtggataggtattccatctgtttgctatgccgcatggcaattgttggcaaaatatgattccgatggtcatgtccgaaagcttttggataaatttgaatggatttttattccagttttaaacgttgatggttatgaatatacatggtcaaacgatagactggtaagtggtttgtaatgaagcatatactaattatttgtcagtggtcaaaaaacagacagcctcttaataattccgagtgttttggcataaatctcgatgcgaattgggcatttggcttcaacggtaatattgatccttgcagcaacggtaagcgaactattttttttgatgacttattacaactaacaaactcaagaatatggaggattatcaccttttcaggctaacgaaactatggccttgttcaatctgataactgaatccttgtcgcaagagcagaaaaaggtcgttggatttcttgatgtgcattcgtattcacaatctggtatgtttcgacagtctattttcatttactaattaagttagttttgtggccttatgcatatacctgcgacttgtttcctcctgatactgagaattttgaggaattagcaattggcttagttaaagagttgcatcgcgtaaatagtagatactacacatatcaacaagcatgtataccgtatgatggatttcataaacattacctacctggaactgccattgactgggtttattttgctgctgatgtagcatggcctttcaatattcgattacgagacatgggtgattatgtaagttgatatctctaaaattttttactaattaaacaagggatatttattacctgctaaacagattgtccccacagctaaggaattttttgcgatgattctttactatggagagtttatcgctgagtatgcattttagtccaagaaa

SEQ ID NO: 26080 - DNA, 721 bp, Schizosaccharomyces pombe
atgagcttgattctttaccccaaaccaacttcgtatttatatcaaccttttataaaagcatatttttcgctaaacatggccatttttgaaatcaataattcttttttaatttgtgctgtatctattgctttgaaccctctgctatggaatattgctgcacgttcagaatacaatcataagactttgaccaaattggcaaatggcgactctaagaaggcctgttacatgctagcagcttgtatttttgttgccggaatagttcgtgacttaatttatcagaatgctttaaaacaacaacctacgctaggtatcttcatgaaccctcttgtgcagggtatagctaagctcattttttgttttggcagcgtccttgtcttatcgagtatgtataagctaggacttgttggtacatatcttggtgattactttggatttctgcttccagagcgtgtttctggtttcccatttaatgtcaacgataacccaatgtacaacggttctactctttgtttcctttctacagctctgcgttatggaaaagttgctggcctccttttaactttggaagtctttttcgtttatagaatagctttgaaatttgaagagtaagttgccaactgtttaaatttttaaatttttctttactctaaccattaatagaccttttactgctaaaatttacgctgctcgtgatagcaagcaagctaaaaaatccgagtga

SEQ ID NO: 26081 - DNA, 985 bp, Schizosaccharomyces pombe
atgcttcgtcaaacgctaactcaggcgtctcggatgcgtccttgtatatctgtagttggatttcggggttttcacgctaggtatgttgtttaggtttactttttgtgattcacaaacatattcgaagttgaatgcattttttctaacgattttttatagttctccttgtgaggcaacgctaaaagagattgaacaaaggctgaagtctattaagaacattgaaaagattaccaagaccatcaaaactgtagctcaaactaagcttactagggctcaacgtgctatggaagcttctaacaaatactatcgtgtatctgatgaagtgtttaaggaggctggaactaaagcacctgaggagggtaaaactcttatggttgcttgctctagtgacaagggtctttgtggtggtattcattcttcaatctctcgtcttatccgtagagaactacatgatcctaagacatttgagaacacaagtttgtgtattttgggagaaaaagttcgcactcaattacttcgtttctgtcccgaatctttctacttgacttttgcacacattggtggagctagtccttcttttgaagaagctttacaaatttctagtaacattttggaacatgctaaagactatgatagaattgttctcgtctataacaagtttgcttccgctgtctcgtttgaaactgtgatgaagaacttgtatacaactaaggccatcaatgaatcccccaatctctctgcatacgaggtaagtgatgaagtccatcaaccactcatggaatttgcatttgccaatgctattttttctgccatggcggaagctcattgcagtgaaatgtcatctcgtcgtaacgccatggaaaatgcaagcaagagtgctggagatatgattaacaagttttccatccaatataatcgtcaacgtcaagcctccattactaacgaacttatcgatatcgttactggtgcaaactctttggcttaa

SEQ ID NO: 26082 - DNA, 508 bp, Schizosaccharomyces pombe
atgtcgaaaagtggtgtgccacgtcttttaactgcttctgagcgtgaacgtctagagccattcattgatcaaatccattattctcctaggtatgatgatattgttaaagaaactgccatactttgggaattctctaggttctttgttttcccctaaaacgagactcttgtatcttatttgagcaaatgctaatcgatgaaatagatatgctgatgatgaatatgaatatcgacatgttatgttaccaaaagcaatgctaaaagcgatacccaccgattatttcaatccagagactggaacgcttcgaatccttcaagaagaagaatggagaggacttggaattactcaagtaagtaatcaaggattttaactgctcaaaaacaaactgacatttatttagagtctgggatgggaaatgtatgaagtccatgtcccagagccacacatcctgctatttaagcgtgaaaaagattatcaaatgaaatttagtcaacaacggggtggttaa

SEQ ID NO: 26083 - DNA, 2828 bp, Schizosaccharomyces pombe
atgagttttcagaatcccagctatattaatgctaaacaccggtccttcttgcaacctaaggacactcaagattcgcaggatttacgaaactgggtcagtcacagtagtgtagatgaagaaacagcatattctagttcgaccctcagttcgagttcttctaaaagctttccttgttacgatgagtatgatgagataaaatctcctgacgatcaaaaagtcgagtatatgaagacgttaaggaccttggaagaagatgctttttcttacacagattcagtttacgattttgaggagcgttcatttgatgaacacgagccacctatccctccacttcacaaaactggagtttttagcgttcctcttcaaccaacccatactgtgaatagtaactcagacgacggttatgaaaattcctccaagaatgagtatctggactttaattcagaaatctctgcttcgcccgtcaatgaaccaatgacgcacagtcagtcatacacctcgattgatcgcttgaattcatcaagttcgcactattccaaagatgttccattattatgtggaagcctgactattgattgcccaacgccaatagacttacgtggcatgcttggtccatttatgcaaaaaaaccccgatgaagcaagtttcctgcggtattcggccattacctgccaaccagaagatatgaataataatgggcttcaactacgaacatggtccacgggtcgcgacattcaaattgctgtttgtctaacacttagcgatgaggatttggcatcttttgccatttctctttctagtatcatgaataatttaaaacatctttgctcacggtctaagtcgcgggtatggggaaatgagagttgggaaaaggttttagtatgtgtcgtaattgatggccgtaacactgttcaccaaaacgtcttggacttgcttgcatctataggagtgtatcaacctcacattgctaaagggagagtaaacggaaaaagaactttatcccatatgtatgaattcacaagtaccatcaacgttgatgagaaactcaatcttacaacagcgactggtgacggaaacgttccaatgcagatgttactctgtgttaaggaccgtcgtctaggcacttataactcgcatcgctggtttttaaatggtatagcatcgcttgctcgtcccaaggtttgtctctttgttcgtaacggtgcaaggcttggcccaacatctatttatcatgcgtggaaagcttttgatgttgattccactattggaggaatgtgtggtaaaacttcgattgatacaggaaagtttggctttagactgttaaatccattcattgcttctcaacattttgaccaaatgatccataacaatcttcgcttaccgtacgacagctgcatgggttatatttcaaatgcgcttaacgcaatttatggatttcgatacgtcgctttgcaagattcatatccaaaccctggaccactagccgattatttcgagcaagaccaatatgaaattcctaggagaggtatcttacaatccaatgcttttttggcacaagaacaactccttttctggaaagtaatcacccgaaaagatgcaaaatggcatttgcaatatgtacctgaagcttgtgctactattgaagcgcccaattcaatggctggaatactagagtctaaaaaatctgaaattaacagtagctttagtcttgctgtctatgttatagttgattttttttctttatggactacccggcacaagttctttcgattccttttgctcaccgttcaatcgctcgtctttgcaattgagaagttggtgaattttttctcaatggcaaatttctttttggccttctactttgtatgcaatgccacttcatacagctcattgaatccgtatggtaattgggcccgacctttatttctggttttcgaatatattctaatttgtttaattttttcacagtttatgctagcaatgggcaatcgaccacggaggtatgaatgtttgttttaaaaatttctcatattaactaattgtttagctgtcgagttttactgttcattagtactgcattgttttccattattatgatttatttcgttttttgtgttttttatatttcattgataccattacacaactcagataattctgaaattgttttaggcaacaattatttcacgaccttaattttctcttctttattaattctagcatgttatgctttcgtttctttaatttgtatggatcctttttttatctttacttgtattgtgcaatacattctgctgatgccaactcgcatttatactgagcaaatatatgcactttgtcatcttgatgatgcttcaatttcgaaggatgataaccagcaagaatttaattttgacacaggtattacccattgttcaatgaacgacgaaggctatactacaatcagtattccaaaagccaacgtgttgaattctgtatataactcttctttaaaaaatttcagttcttctaatgatacttcggtttatcacgatgttcaggaccattgctatcggaagccacaatcctatgaggatcactaccaagacattcgtactcgttatgtgctagtttgggctgtaagcaacttaattttagccattgttctgattcaggtattcgatggcatgcgttttattaataatggctacatgaagtatatattttggagtatcgtagccttcactgcttggaaaaccatgggagctgttacattcatagctaccaagatcatttcacgaattgctaattgtgtgaaatcaaaactttacatttttaatgatccttaa

SEQ ID NO: 26084 - DNA, 1839 bp, Schizosaccharomyces pombe
atgagtgaagtttatgaaggtgctattggtatcgacttgggtactacctactcttgcgttgctgtatgggaaaccgccaatgttgagattatccccaatgaccaaggtgcacgtaccactccctcatttgtcgctttcaccgaaactgagcgtttagtcggtgatgccgccaagaaccaggctgctatgaaccctcgtaacaccgtttttgacgccaagcgtcttattggtcgtcgttacgaagaccctgagactcaaaaggatattaagcactggccctttaaggttattgacaacaatggtatccctaccattgaggttaactatttgggcgagaaaaagcaatttactgctcaagaaatttccgctatggttttgactaagatgaaggagatttccgaagctaagttgaacaagcgtgtcgagaaggctgtcattaccgtccccgcctacttctctgactctcaacgtgctgctactaaggatgctggtgccatcgctggccttaacgttcttcgtatcatcaacgagcccaccgctgctgctattgcttacggtcttgatgccaagtccgacaagcccaaaaacgtcttgattttcgatcttggtggtggtacttttgatgtttctcttttgaagattcaaggtggtgtctttgaagttttggctaccgctggtgacactcacttgggtggtgaagattttgataacgctttggtcgagcactttattcaagaattcaagcgcaagcaaaagattgacatctctgacgatcctcgtgctcttcgtcgtcttcgctctgcttgtgagcgtgctaagcgtgccttgtcttctgttactcaaaccaccgttgaggtcgactctctttccaacggtatcgacttctcttctagcattacccgtgctcgtttcgaggacatcaacgctaccacattcaaggctaccattgatccagtcgctaaggtcttgaaggactccaaggtccctaaggctgatgttcacgacattgtccttgtcggtggttccacccgtattcccaaggttcaaagactcgtttctgatttctttgatggccgtgctttgaacaagtctatcaaccccgatgaggctgtcgcctacggtgctgctgttcaagccgctgtcctcaccaacaaggctgactctgacaaaactcaagatttgcttttgttggatgttgtccccctttccttgggtgttgccatggaaggtaatgttttcggtgttgtttgccctcgcaatactcccattcctaccatcaagaagcgtactttcaccactgttgctgacaaccaaaccaccgttactttccctgtttaccaaggtgaacgtgtcaactgtgctgaaaacgaacctcttggtgagttccaacttactggtatccctcctatgccccgtggtcaagctgagttggaagctactttcgagttggatgccaatggtatcttgaaggttaccgctgttgaaaagaccactggtcgctctgctcacattgaaatcaccaactctgttggtcatctttcttccactaagattcaagagatgattgaaaacgctgacaagttcaagcaacaagacaaggatttcgccaagaaattagaggctaagagccaactcgaatcttacatttctaacattgagactaccatctctgagcccaatgtcatgatgaaattgaagcgtggtgacaagtctaagattgaagcccaattggctgagtgcatgtctcaattagaacttgaggacactaacactgatgctctccgtaaggctgagcttcgtcttaagcgtaccgttcaaaaggcctttgcatcccttcgt

SEQ ID NO: 26085 - DNA, 1873 bp, Schizosaccharomyces pombe
atgcacactgccaaacccgtcaagaggtatttcaaccttaaaagttctcgtattggcatgaatccacaaaccaagactttcgaggtattagttttccttttgtttatcacttactaactaatgctttaagggagctatcaatcggctaaattctttgcaatccaatgcaaaagtgctggaagtgcttaggaaaaggggaaagatcccaaatgatcagtcgatggttgaaatgagacattggcttagatgcattggatatcaggtaagttactacttataattaggaattacaaaagaatagcactcaaatattttaagccgctgcatatgattaaacgagattgaaacaagtatttgtatgtcctttatagtactcgattgtgatcctttctttaacttcaccttatttttaataataataatctcattgaaaggacagcacatcatgtctataaagggaaatatcaataggaattgttgacttggctggtttagcctgtatctctttacgaaatctttttgttaatagttctatactgtcatgcaacttttactaactaataaatctcagccatcagatttgaaccgactaaatgtcatccatgttgctggaactaaaggaaagggttctacatgtgcatttacatcctcaatattacagcaaatacagaagagtggagaaaggtcgattccaaaatgcattggtatgtacacttctcctcacctccgatctgtctgtgaacgtattcaattaaatggcaaacctatcagtcaagagttgtttactaaatatttttttgatgtatgggagcgcctagagaatgctgtcggtagtgattcggaaaagccaatgtatttccgattcttgacactaatggcatggcacgttttcatttcagagaatgtcgatgccgctatcattgaagttgggattggtggtgaatacgattctacaaacttaattgaaaaaccatatgccacagcagttacaagcttaggtcttgaccacacgtctttgttggggaacacaatagcagaaattgcttggcagaaagctggaatctacaaagaatcagctattgccttaacttgcgagcaagctcccgaggctatgaatgttttaaaaaaccgtgctgctgaacgaaatacatcacttaaggtagtcatacctcctgctgaattaacgccggatatgattggtctttcaggagttcatcagcttggaaatacatcccttgcagtttctttagtccaagaattctatgaaaaggccgggtgcccttttgatagagatccatatcaggatccagcaattttggacggcctcaagtatgtaaaatggcctggaagatgccaaattgaggaaatcaacaacataaaatggtgttttgatggagcccacaccaaggaaagtttggaggccactggactttggctcgcatccaagaagaatctttatgaggatgcagatgcccgtattcttctgtttaaccagcaaagcagggatgatccaattgctttacttaggtccttcttaaaaggattggaaagctcgggaactgggatttcgtttacgcatgttatattctcaaccaatgtcacctggaaggatgcaggctataatccagagctgttaagcattaataccattactgataataagcccgttttgcatgtacaagaggatttatgtaaatggtggaaagaatcgaagggcacgactagtgaagcaacagtagcccctaccatccaagaagctattgagacagtgatgtcaattaagcaaaaatccaggaatacttttgtttgtgtcaccggaagtctgcatttaactggtggtgtttttgtagtactagatcaagctgttttttga

SEQ ID NO: 26086 - DNA, 876 bp, Schizosaccharomyces pombe
atggcagatgcagaagactcgcgtcactcaaaaaatgagggttttcccaacacttccttaatcacagaaaaactagatctattggatttatttgggtcaccaaaagttaaaactgaaagagagggacgtccagcgcgccttcttgaaggtctatcggctgttaatgctgaaactgcatttgtaaaaacacacccccttcagcatgaatggacattgtggtttttgaaaccacctacacaaggtcttgaatggagtgatcttcttaaagagattatttccttcaagacagtggaagagttttggggcatctttaagacgatctcaaaagcttcgatgcttcccgccaaatcggactactcttactttttgaaaggtattcgtcctgaatgggaggatcctcaaaacatgaatggtgggaaatgggcctaccaaagcaagcacaaaggttcaaatctcgacgagttgtggctgtatatggtaagtcatggtctgttcattttaactgctgtgatatcgactttacagaatgttaatttttaagttgaaagtattaacgtatggaaataggtgctggcagccattggagaaacattagaccctactgggaaagaagttactggtgtagtttgcaatatgaggaaaggattctatagaatcgctgtatggacacgaaattgtaatgacaaagatgttttggaaaaaatcgggtatgtgaagttttaagagtaacgtgttggtagttgactggactaacaaacatgtagcctgcgctttaaagaagttttagggatttctgataaagagactatagaatatagtgctcatgaggattcatcaaaggctggtagtatgcgagcaaaaacccgtatgagtctt

SEQ ID NO: 26087 - DNA, 777 bp, Schizosaccharomyces pombe
atgttagtggagttactagaattcactcctctctccttcattgatgatgtgatcaacattacgaaccaactgttatataaaggtgtaaatggtgtggataaagccttttcacaaacgcggtttgctaaaaaagcgccacaggaaatagaagaaggactacacaagttcgaggttctctttgaaagtgtggtggatcgttactatgatggtttcgaggtgtatacacttcgaaacatttttagttatccaccagagctaaaaggctacatgcgtacgtttggaaaggatgtagactattcaatcacaacagagcaagacgccgccatggatcaagcaattcaagaggctgcagaaaaactcgtagtaaagatgcaactacgtcgtgaccttcgcatgcgtctcagcaggaaaagagaaaaaaaaacagaaatagaaaagcatttggaaagaatttcttttctcaacaaagtacccgaaaattggcaagttactttaccagaaactaccgatttccttcttgatcaacttggtaatctgcagcatgccgttaaaagagtagttgaagcctctcccactgtacactcacgagaggtggatgaaagaattacctacttagaaaaaggttacgaacgattatctaatcccatcgaccagcaaaaggatttttggtcacatcacttgtcaaaactagaatcgacagccaatactgaaactgcaaataacattcataagttgctattgtcatctgaaaaagacgtcggacatactgacgagcct

SEQ ID NO: 26088 - DNA, 661 bp, Schizosaccharomyces pombe
atgtccaaaatcaaactgatttcatctgacaatgaagagttcgtggtcggtatgtagaacggagaatgttttgaattgagtgaattgacaaactgtttatagatcaactgatcgctgagagaagtatgcttataaaaaatatgcttgaaggtatgatctatacaagcgcttgttgagtgcaataattattatggaccctgttactaaaatctcaatttcaatagacgttggtgagattaatgtccccattcctcttccaaacgtatcatcgaacgttttgcgaaaggtactcgaatggtgtgagcatcacaaaaacgatttgtattcaggaactgaggaggaaagtgacattagattaaaaaagtctaccgatattgatgaatgggatcgtaagtttatggccgtagaccaggaaatgttgttcgagatagttttggcaagcaattatttggatattaaacctttgcttgatactggttgtaaaaccgttgccaacatgattcgtggcaagagtcctgaggacattcggaaaacatttaacatccctaatgattttacgcctgaggaggaagagcaaatccgtaaagaaaatgtacgttccttggtactttattaacttaattctaaccgcttgcaggaatgggccgaagacagatagttt

SEQ ID NO: 26089 - DNA, 1054 bp, Schizosaccharomyces pombe
atgagttggactacaatagaatcagatgctggtgtatttacggatttaatagaaaatctgggtgttaaagatgtcgaagtagatgaactatacagtttagacgttgattcacttcgacagtttccgtaagtgatcatatttttgaaagcatagtcgtctatgctggggttgaaaattgtagtgttttttactcgcgttgtgattttctattgttctttatttatagaacttttatggattggaactggtcttactaactgatttccttgcaattagagatatttatggcatcatatttttgtttaaatggaacagtaaggttgacaagcctgatggaacgatggactatgatagtatggacaatatattttttgctaagcaagtaatcaacaatgcctgtgctacgcaagctctcttatcggtgctgctgaaccactcagacgaaattgatttgggaacgacactaagcgaattcaaagatttttcaaaaactttacctcctgaattaaagggcgaagcattgggaaattctgagcatattcgttgttgccataattcattcgcacggtctgatcctttcattagtgaagaggttagggctgcaactgacgaagatgaagtgtatcattttattgcatacactaatattaacaacgtcttttatgagttagatggcctacaagctgctccgattaatcacggatcttgtacgaaggaagagtttgctgagaaagcagtctctgtaatccaggctcgtatcgctaattatgaccctgctgaaattcggttcaatttaatggttatctgcaaagataaaaaggcatctctccttaccagggaagacttgacagacgaggagaaagctgcttccattgctgttgaagacgaaaaacgtttacgttggaagcgtgaaaatcagcttcgtcgtcacaatttcgtcggtctcttcgtagaactttccaaacttctggtaaaagatcgcattgacaagaatacttggaactctacccttgaaactgcaaaagcgaaatacgcatctcaaaagcgaccgtaa

SEQ ID NO: 26090 - DNA, 897 bp, Schizosaccharomyces pombe
atggaagcagtaggcaaacacgttaagttattttggaacgtttatagtgattatgccgtacttatagccatatctttaagctatttcgtatttgacgtactaatgttgccctttactcgccaattttccttagaagacataaccatttctcatccatttgcacttcatgagcaagttcccacaaagtatctcggtgtatgttgtttatcttgatgattatagacaattggtaaaattgcttagctaaccctctagattatttgtgttttctttcctgcacttgtcctctacggattcggcaaattaagaaataattcgttactattttggaaatctcttatgggtctcttatactctacaatggtctgcggtctttgcgtttctctacttaaaaatgcggtgggcaggccacgacccgacttccttgcacgctgccaaccttttgagtcaactccaaaaactggtttggtagatgttctatcttgttctgtgccatggtcggataaagtattgcaggatgggttccgttcttttccatctggccacacatcattttcatttgctggccttggatttctagcaatcttccttgcaggtcagttaaagatgttccgtaataaaacctcttcatggaaggtagtagtcccacttgtgcctttgagcattgcatcctggattggtctcagccgcagtcaagattaccgtcaccacaaagaagacattgcagtcggtgccctttttggttttgcaattgcgtatgtcgtttatcgtcaactctttcctcctttagatcatcataatgccgatatcttatatgtccaagctgagctcgatgaaggttataccaacgttcattcagccggtaactcatcagccacgaacgcagaacagatggtt

SEQ ID NO: 26091 - DNA, 576 bp, Schizosaccharomyces pombe
atggtgtcgatttacgttcccttgatatatattaccattttaatgggctctatgtatggagtttctcgttttgtgcgaaaatccaaaaatcaggaatcaaaaccagtatcagaagaatggtttggagaaaattattctagaaatatatttttcagtcttttgcagcagaatccacctgccgaggatacacttttgaaagctgctctcgttttacgggctacagaaggtcttcgtcgattgatgaagcttaaagtatcgagaatggcattgaataatttgctcaaccgcggcggcgttggtgacgagctaattcgtaagtttggtcgtttggaaaaggaaactgaattggagttgatggatattgccaaaactgccaattcattgcagcctggatggaatcagtttatattccaaacttgcaatgaaataattgaaaacgaaaaaattcacagcataattgataatattcccaaggacattgattctatttcgcaacgttggcaaaccgaaaaaattctgtatgaagccgctgatgaggaattgcgtattcaagcccaaaaagaacttggagtgcta

SEQ ID NO: 26092 - DNA, 2898 bp, Schizosaccharomyces pombe
  unsure (1)..(2898): unsure at all n locations
atggattcttttcggaanaaggggtncgccgcgnattctgaaagtttacctttntgaatcagaaaattcttctctcggtgctancacctctttnctttacctccttcttcacctccntccagaattctctgatgaagctgcagaagctctcgtggaggaggatattgaggatctggacggagaagctttagatgtagaggatgaagaaggntgaagatttgttcggagaaggaatggaacggtaagttttatagctatgcttgagacgtgtcttgtcaatgttgtgtatactaagtgttgcncatcaatatataaattacatactatttcttctccttncttgtaaataaatatatttattggattcctaggttgcggttnatattgacagaacaaatcttgattttcaaaagagtagtttcacatttcgcgtcaaataaggtacttttttctaactgtatagtgattatcaacaaaatttggagctagatcgttatgacattgaagaactagatgacgataacgatcttgaagaattagatatcggggcccgaagagctgttgatgccaggttgagacgacgtgatattgagctcgatgctgctgcaggtaganacaaaacctgctgcatttttacaagatgaagatgatgatttggactccaatcttggcacaggcttcactcgtcatcgacatcgaatttacgacgaantattcacctaatgttggcgcattggacgaatctggtgaacttcctcttgaantcaattgccgacgtnaanaggccgantagtattgccgaatgggttnacntcttgatccntgttcggncgtacaattgctcgagaattcaaaaatttccttcttgaatantacagatgaaaatggncacctnctngtatacggntaaccgtatntcgcacanttgggtgaggttaatgctgagtcgttgatggnttaanttatgcccatcnttggtgaatctaaacccattttggctntatttctntggccaatgcgcctgcacctatttttcgcatatttgatcgtgttgctttggaagccactcttttgcattatccnagactatgaaagaatacactctgatattcatgttcgtatcactaatcttcctacttgttttactttacgcgatctacgancaatcccatcttaattgccttgtacgggtatctggtgtcgtaactaggcgcactgggctttttccacaattaaaatacattcggtttacatgtaccaaatgtggtgctactttgggtccatttntttcaagactctagcgttgaagtaaaaatttcttntctgtcacaactgttccagccgtggtccgtttgtaatcaactctgaacggactgtatataataactatcaaaggatcactttacaagaatcacctggcanccgtcccctcaggtaganctgcctcgancaccgtgaagttattcttttagcggacttggttgatgttgccaaaccaggcgaagagattgatgttactggcatataccgcaataacttcgatgctagtctgaantaccaaaaacgggtttcctgntcttcgctacaattatagaagcaaatcacatatcgcaacttgacggcagtggtaatactgatgatgatttctctttaagtcggcttactgatgatgaggaaagggaaattcgggcattagcaaagtcgcctgatattcacaacagaattattgcatcgatggcgccttctatttatggancatcgctctatcaaaactgctattgctgctgctttattcgngtggtgtccccaaaaatnattaacggtaagcataaaattagaggntgatatcaatgttttattgttgggagatccaggaaccgccaaatctcaatttcttaagtatgttgaaaaaacggcacatagggctgtcnttcgccacaggtcagggtgccagtgctgttggntctaactgcatccgtccgtaaagaccccattancgaatggatggnactttggaagggggtgctttggttttagcagataaaggtgtttgtttgattgacgagttcgataaaatgaatgatcaggatcgtacttctattcacgaagccatggaacaacaaagtatttctatttctaaggcgggtattgtgactaccttgcaggcgaggtgcactattattgctgccgctaatcccatcggtggacgtntataacactacaattccttttnaatcaaaatgttgagctgaccgaacctattttatctcgttttngacatccttcaggtcgntcaaagacnacggttaatcctgaaattgatgaacagctagctaattttgttgtatcaagtcatattcgatctcatcctgcatttgatccgaatatggatgtcttgaagaaagtccctactgaganctggtattgatgccaaacccattccccaagatcttcttcgtaaatatatccatttcgctcgtgaaaaagttttnccntcgattacagcaanatggatgaagaaanagatttcgagactttatagcgatatgagacgcgagtcactggctactggaagttatcctattactgtgcgtcatctggagtctgctatccgttntaagtgaagcatttgcaaaaatgcagctcagtgagtttgtgcgcccttcacatatagacaaagccattcaagtganttattgattcctttgtgaantgcccaaaaaatgagtgttaaacgaagtttgtncaagaacatttgctaaatatcttatttaattttttgacacaatcagtttatggagtccagtgattttgatttccccgttctttgaccctccttttgttactgcatcntgttgcatatatctatccttntaataatttgcaatcaaaatttgc

SEQ ID NO: 26093 - DNA, 1399 bp, Schizosaccharomyces pombe
  unsure (1)..(1399): unsure at all n locations
ggacaagcacaatctgggaatttttctaatttcggcgatggtgccaacggcgacaatanaaaaagaccaaaagaaagataagcccaaatacgaaccntccagttcccactcgaactggtcgtcgtaagaagaaggctncaaagtggtcctgatgcatcggcaaaactacctactgttatcccaacgactcgttgtcgtttaaggttgttaaaaatgcaaagaatccacgatcatttgcttatggaagaagagtatgtgcaaaaccaggaacgtcttaagccacaggatgaacgaactcaggaagaacngcaatcgtgtagatgaaattcgtggtactccaantgtctgtaggnaactttagnaggaaattatagacgacgatcatgccatcgtttccacagctggaccagagtactatgtttccatcatgtcatttgtcgataaagacatgttagangcctggttgcagtgtacttctccatcacaaagccatgagtatagtaggcttacttcttgatgataccgatccaatgattaatgttatgaaactcgacaaagcacctacagaanagttatgccgatanttggtggtcttgaatctncaaattcaagnagatcaaagnaggctgtagnagcttcctcttacccatcctngaactctatgaggaaatgggcataaaaccccctaaaggtgtcattttatatggtgctncccggtactggtaaaactttactagcgaaagctgttgctaatcaaacttctgctacgttcttgcgtgtcgttggttctgaacttattcaaaaatatttaggtgatggtccccgtcttgtgagacaattatttaatgctgccgaagaacattcgccctctattgtttttattgatgnaaattgatgctataggtacaaagcgttacgatgcccagtcgggtgctgaacgagaaattcaacgtactatgcttgagttactcaatcagttggatggattcgatacgagtcagcgtgatattaaggttattatggctactaaccgtatcagcgatcttgatccggctcttattcgtccaggtcgtattgaccgcaaaattcttttcgagaatcctgatgaagctacgaaacgtaaaatttttaccattcacacttccaagatgaatttgggcgaggatgttaatttagaagagttaattcaatgcaaagatgatttatcntggtgcagaaattaaagcaatcgtttctgaagctggtttgcttgctnctgcgtgaacgccgaatgcgagttgttatggacgactttcggcaagctcgtgaaaaggttttaaaaacgaaggacgaaggtggacctgctggtggtctttatatctaagtccaactttggttatgactagttttactcgcataa

SEQ ID NO: 26094 - DNA, 1402 bp, Schizosaccharomyces pombe
  unsure (1)..(1402): unsure at all n locations
atgttggccaggaatttgcgttgtttgcatccaaatacatttgcatcgttaaaaaccaacgtttncctaccatggagtaaaatgcttggcaagtcagnagcaagcgtggatntcaaggtttgggcagatgtacctatngggaccaccggatcccantctttnggtattacangnaggcctataaaaaggatggagatgttaagaaaatgaacttgggtgctggtacatatcgtgatgatgccggaaagnccttatgttctgcccagtgttcgtcaggncagaaactgagctgttgagtcagaaactcgacaaagaatatgcacccantcacaggaattcccagtttccgtngtgcaagcaacnaaaattggcttatnggcgatgtttacnnnnnngagtctataaaggataggctggtttctgctcaatccnattagnnnnnntggtaccggtgccttgtgtatagcagctaatttccttgcttcattttatccatcaaagactatttacgtatctganccctacttggggaaatcacaaggatgtattttctcgagctggcttgacncgttaagtcctacaagtatntatgatcctgctactcgtgggtaggacattaaaggcatgttgtccgatttaacttcagctcctgatggctctattatattattgcatgcttgtgctcacaatccaactggtgtagatcctacgaaagctcagtgggatgatatcctcaaaacaatgcaaaagaaaaaccattttgctcttttagacatggcttaccaaggatttgccagtggtgattttgctcgtgatgcttatgccactcgtctgttcgcctccagcaatgtccccatgttactctgccaatcctttgctaaaaacatgggtctatatggtgaacgtgctggctgctttagcattttagccaacgatgctgaggaagccgctcgtatcgaaagccaaactaagattctcattcgtgctttgtattccaaccctcccgtcaatggggccagaattgccaaccatatattgagcaaccctgcacttcgtgaacagtgggctggtgaagttgtaggcatgtccgaacgtcttaagagtatgcgtaaggctcttcgcaacatccttgaaaaggaccttaagaataaacacagctggaagcatatcanctgaccaaattggtatgttttgttatactggtttaaatccccagcnaagttgatgttttggctaaacagtatcacatttacctcactaagaatggtcgtattagcantctccggtctcaacacttccaatgtaagatactttgccgaagctantcaatgccgttacttcgaattagtcggtggtgaaattgaagtgaaaagattttggtttattatatagacagatggat

SEQ ID NO: 26095 - DNA, 731 bp, Schizosaccharomyces pombe
  unsure (1)..(731): unsure at all n locations
gatcgggaatttgacacagaggaaagacgttatagaactatggaatcagctgcaaagaagcttcaaaaagaagccaaaggttatctcgatgctttgagagccatgactgcgtctcaaactagaatncgctaacacaatcgatgcattttacggtgatgctggatcgaaggatggtgtcagtgcatactatcgacaagtcgtcgaagacttggacgccgataccgtaaaagagttggacnggtncctttnccggacaacggtgtntggatcccatctcaaggttctgcagttactttcccgatattaatgccgctatcacgaagcgtaatcacaaattacttgatcatgatgctatgagggctaaggttcaaaaactggtcgacaagccttccaacgacactactaagcttccccgtaccgagaaagaagcagccatggcgaaggaggtctacgagacactcaataatcnaactggtcagtgagcttccgcaactaattgctncttcgtgtgccttatttggaccctagctttgaagcccttgtcaaaattcagctccgcttttgtagggagggatatgagaaaatggctcaagttcagcaatactttgacaactctgtacgcgaagactattccaatggtttgttggatgataaagttgaacaagttnttacagagtatgcgggatctttccatcgccggtttgcacaacagtcagtagacatcggttttt

SEQ ID NO: 26096 - DNA, 1311 bp, Schizosaccharomyces pombe
atgttggccaggaatttgcgttgtttgcatccaaatacatttgcatcgttaaaaaccaacgtttcctaccatggagtaaaatgcttggcaagtcagagcaagcgtggattcaaggtttgggcagatgtacctatgggaccaccggatcccatctttggtattacagaggcctataaaaaggatggagatgttaagaaaatgaacttgggtgctggtacatatcgtgatgatgccggaaagccttatgttctgcccagtgttcgtcaggcagaaactgagctgttgagtcagaaactcgacaaagaatatgcacccatcacaggaattcccagtttccgtgtgcaagcaacaaaattggcttatggcgatgtttacgagtctataaaggataggctggtttctgctcaatccattagtggtaccggtgccttgtgtatagcagctaatttccttgcttcattttatccatcaaagactatttacgtatctgaccctacttggggaaatcacaagaatgtattttctcgagctggcttgaccgttaagtcctacaagtattatgatcctgctactcgtgggttggacattaaaggcatgttgtccgatttaacttcagctcctgatggctctattatattattgcatgcttgtgctcacaatccaactggtgtagatcctacgaaagctcagtgggatgatatcctcaaaacaatgcaaaagaaaaaccattttgctcttttagacatggcttaccaaggatttgccagtggtgattttgctcgtgatgcttatgccactcgtctgttcgcctccagcaatgtccccatgttactctgccaatcctttgctaaaaacatgggtctatatggtgaacgtgctggctgctttagcattttagccaacgatgctgaggaagccgctcgtatcgaaagccaaactaagattctcattcgtgctttgtattccaaccctcccgtcaatggggccagaattgccaaccatatattgagcaaccctgcacttcgtgaacagtgggctggtgaagttgtaggcatgtccgaacgtcttaagagtatgcgtaaggctcttcgcaacatccttgaaaaggaccttaagaataaacacagctggaagcatatcactgaccaaattggtatgttttgttatactggtttaaatccccagcaagttgatgttttggctaaacagtatcacatttacctcactaagaatggtcgtattagcatctccggtctcaacacttccaatgtaagatactttgccgaagctatcaatgccgttacttcgaat

SEQ ID NO: 26097 - DNA, 852 bp, Schizosaccharomyces pombe
cttttccatatcacaaaaatgagttggcatggattcaaaaaggccgttaaccgagcgggtacctcggtatgtatttgagtgttgaagaattgtctaacattgtggtaggttatgatgaagacgggtcatgttgagcgaacggtggatcgggaatttgaaacagaggaaagacgttatagaactatggaatcagctgcaaagaagcttcaaaaagaagccaaaggttatctcgatgctttgagagccatgactgcgtctcaaactagaatcgctaacacaatcgatgcattttacggtgatgctggatcgaaggatggtgtcagtgcatactatcgacaagtcgtcgaagacttggacgccgataccgtaaaagagttggacggtcctttccggacaacggtgttggatcccatctcaaggttctgcagttactttcccgatattaatgccgctatcacgaagcgtaatcacaaattacttgatcatgatgctatgagggctaaggttcaaaaactggtcgacaagccttccaacgacactactaagcttccccgtaccgagaaagaagcagccatggcgaaggaggtctacgagacactcaataatcaactggtcagtgagcttccgcaactaattgctcttcgtgtgccttatttggaccctagctttgaagcccttgtcaaaattcagctccgcttttgtagggagggatatgagaaaatggctcaagttcagcaatactttgacaactctgtacgcgaagactattccaatggtttgttggatgataaagttgaacaagttttacagagtatgcgggatctttccatcgccggtttgaacaacagtcag

SEQ ID NO: 26098 - DNA, 1500 bp, Schizosaccharomyces pombe
atgcaaaaaccttcattgtcacaagaccttatttggatattgaaatcagtccaatctcgtaggtctacgaaagggtttttgcaaaaacattcttcgcttaaggatggctctcccaacaagaaatccttcgctcagccaatatcgagttcgtttttaaacagaatttctattaccaaaattgatgatgtggattctttaagtgataataccctatatggaattggtcgaagtataaatagcctggcacgtttagggattcaatcagtgattgttcccacttccaatccaattggcatgacatctccttttaaatatttggagaatggtacggtcgtagcgaaaaaacgtaaactttcaatctttgaggagctacagcaacagcaaaatagagtcattcgagtttcggaaattttttcgaaagcgggagtgttaacccgtcctagctactcctctgtatgtcaattgggccctgaaggccctagtgttgagaatgtgcaaggtatttttcaagcgctgtcttcactttacacggtcatagtgccaagctcgattttaatgcccaacgtcattgaggttccaattgatggtaatgaggttcttgctggtttaacttactcgttacacaagccaaactttgggttttgggtagaccgaatcgtcattcttgataaaaatggtggcatgccatgttctaaacgacaaactggttctagtcatgttctcatcaatctggctcaagagtttgacgagttagcgaaaacacttccaccttatcatagaaaaaatttgattttggtaagacgctgtttgaaaatgttaccggatgatgcctctgctctaatcactacgcctgaggatgctatgcttacaaatcctgtcttagacaaaaatccgttaattcacaatgttttgacggatcgctctattatttcatgttccttgccgcgcgatcgatctcctattacgaaaacaactgttttgcgtagcggtgtaccggtatatacattcctaggtccgaaatgtctaactgatggctccgtttcgtgggaaaggctttgggttttaattaatgactcctttaagcgaacgcttgatatggacgcatatttagataggttgaagaattcgctagctgcagtcattattgcaggggactatttagggacagccattgtaacttatgaacaaccagatggaacaacgaatgaaaaggtcccttatcttgataagcttgccgtctcacaaggagcccagggttcagcagcaatatctgatgttatgtttaatgttatgactgatttatttcccaaagagttgatatggcgctctcgcctgactaatccagtcaataaatggtactttgaaagaagtgtaggctccttaaagtcaagcaaaacaccttggaaacttttctggactggagactcacatgtcagaaatttggatcgagtgaaccagtatatgagcgttattgataaaattcagccaacatggttgaat

SEQ ID NO: 26099 - DNA, 2041 bp, Schizosaccharomyces pombe
atgtataacgaccaaatacataaaatcacctattcaggagtggaagtatttgagtatacgatcaatggctttcctttaatgaaacgttgtcatgataactggcttaatgccacgcaaatccttaaaattgcagagctcgataaacccaggaggacaaggattctggagaaattcgctcaaaagggacttcatgaaaaaattcaaggtggttgtggaaaatatcaaggtttgtgttaacttcttactatatcaataggtttaaaactacttaaataacataaaatttttgtctctgttgtttttatttatcaatttatacttttttggatgcctgttactaactattcattcaggaacttgggtaccctctgaaagagctgttgaacttgctcatgaatataatgtttttgatttaatacaacctctgattgaatactctggctctgcgttcatgccaatgtctacgttcactcctcagagcaatcgtaagcctacagaagcatatcgacgaaacagtccagtaaaaaagtcattttcccggccttcgcattctttactctacccttacacatcttccaataatatgacatctacttctagaatgtcaggaatccatgatgctttgtctcttcaatctgatttcacgcgctctcccgatatgccttctgattcctttacgggatctttgcacgatatcaaagcttctccgttttcttcaaacaattatgcgcagtctctcttggattactttttattaccaaatactacacaacctcctgatttcgtatatgatcggccatcagattgggatgttaatgctggcattgatgaggatggtcatacagcacttcattgggctgctgcaatgggaaatttggaaatgatgcatgcactattgcaagcaggcgccaacgtagttgctgtcaattaccttcaacaaacatctttgatgcgctgtgtaatgtttaccatgaactatgatttacagacttttgaggtagtttcggagttgcttcaatctgctatctgcatgaacgactcttttggccaaaccgtctttcaccacatcgcattattagcttcttctaaatcaaagatggaagccgctcgttattatatggatatcttattgcaaaatttaactgcaacacaatccgttgatgtcgctgcccaaattataaaccttcaggatgatcatggggataccgctcttttgatctgcgctagaaatggtgcaaagaaatgcgcgagattattattatccttttatgcatcatcctccataccaaataatcagggccaatacccaacagattttttgtcttcgaaagacatgtcttttcccgaaaatgatgattcccccttaaattccaaaatcgaggataatttgatagataacttaaaatatccgcaatcacttgatgaccacttatcgtccaaaaaacctatttcttacttttctaataaacttactcaccaaacccttcccaatgtcttcactcagctgagcgaactttcaaaatgccatgaagcatctcttgctgaaaaacaactaacctataatttggcaatggaggcgttggagcaaacagttcgggaaactgaaacttgccaaagattatggaatgaacgtaccaataatgacgagaactacttggtaaatcagcgggaggatttgattcaccagtgtaaaaaatttctgcatacattgaaaactgctagatattaccttgaaacagttcagcttcatcaattaaaaaaatacgtaacttacttttctcaaatatggagtactgatgagttagctgatatctcggagaccaaaaaccttgttggtcatgatactaaaacgaaccgttcgtctttaagctcaaaacacgaagttgatctttttacagctgaaaacgaagctgctcgtgaaaagctcgttgagcaattatgctcattgcaagcgcaacggaaacagaaaattaacgaaattttgaacttgctttctatgggaatgtataatacgattaatacagatcaaagtggatcttaa

SEQ ID NO: 26100 - DNA, 4191 bp, Schizosaccharomyces pombe
attcctaagaggataaagcatcttcagtttggaattaatggtccagaagaatttgttaaagatggaaccgtagaagtttctaggagagatctgtatacgatgacagaccgatcaccagcagaacatggtgctttagatttacatatgggtaccagcaataagcaaattaattgtgctacttgtggtgaatcaatggctgattgtatgggtcattttggttatgttaagcttgctttacccgtttttcacataggatacttcaaggctacgttgaccattttacaaaatatatgtaaggattgttcttcagttcttctatcagaccaagaaaaacgccaatttttgaaggacttgagacgtcctggcattgataatctgcgtcggtcacagatatgtaagagaattaatgatcattgcaaaaaaatgcgccgctgttctaaatgcgacgcaatgcaaggtgtggtaaaaaaggctggtcctttgaaaataattcacgaaagatttcggtatgttcgcaaatcacaagatgacgaggaaaattttcgacactcgttcgatgaagctttgaaaactatacccgaactgaaaatgcatctctcaaaagcccatgatgatttaaatcctttaaaggttttaaatcttttcaaacaaattactccagttgattgtgagctactgggaatggatcctgaacatggtcgtccagaaaatttactttggcgttacgttcctgctcctcctgtttgcatccgtccttcggtagcccaagagggtgctaccactgaagatgatttaaccgtaaaaatcactgaaattatttggactagttcgctaattcgtgccgccttaagtaaaggcactcctattagtaatttaatggaacaatgggaatttatgcaactatccattgcaatgtatattaatagtgagatgccaggtctccgtccttctgacatgccctcaaagcccattcgggggttttgtcaacgtcttaagggtaaacagggtagatttcgtggtaatttgtcgggaaagcgtgtagacttttccggcagaacagttattagcccggatcctaatttacgaattgatcaagttgccgttccatatcgcattgctaaaattttgacatttcccgaaagagtcacaactcaaaacaagaagcacttacaggattgcatcagaaatgggcccgatgtgcatccaggtgcaaactatgttatagatcgagaaagcgggtttaagcgctttttgaggtttggcaatagaaaccgtattgctgatgatttgaaaattggtgatatcgttgagcgtcatctacatgataacgatgtagttttgttcaatcgtcaaccttcactccataagttatcaatcatggctcacttggtaaaggtacgaccatggcgtaccttaagatttaatgaatgtgtatgcggtccctacaatgccgattttgatggcgatgaaatgaatttacatgttcctcaaactgaggaggcaaagacagaagccttggagttgatgggcattaaaaacaatcttgtaagtcccagaaacggtgagcccattattgcagcaactcaagatttcattacagctgcctatttgctttctttaaaagatacgtttttagatcgtaaaagtatctcgaatatatgttgttatatgatggatgcttcgactcatattgatttacctccacctgccattattaaacctcgctgtttatggactggaaaacaagtgtttacagtattgatgaaacctaatagatttagcaaagttttggtaaatctggatgctaaaactcgatccttctctcgaattaagtcaaagacccctgagatgtgtcccaaagatggatatttaatgattagaaatagcgaaattatagctggtgttgttgataaatcagttgttggcgatggcaagaaggattcactattttatgtgattttgcgggattatggagcactagaggcagccgaggcaatcactaggctttccaaaatgtgtgctagatttttaggtaatcgaggattttccataggtattgaggatgttcaacctggcaaaagtctttcttctcaaaaagaaatattggtcaacaaagcctatgctacttctgatgatttcattatgcagtatgcaaagggaatccttgaatgccaaccaggaatggatcaggaggccacgcttgaagcaaaaatttcctcgacactttccaaagttcgtgacgatgtcggagaaatttgtatggatgaattgggtcctgctaattcacctctgattatggctacctgtggttccaagggttcaaagattaacgtttctcaaatggttgcttgtgtcggtcaacagattattagtggtaaacgtgttccagatggtttccaagatagatcacttcctcatttccataagaattcaaagcatccgttagctaaaggatttgtaagtaatagtttttacagtggattgacacctactgagtttctatttcacgctatctctgggcgagaaggtctcgtagatactgcagtcaaaaccgccgaaactggttacatgtcacgtcgattaatgaaatcgttggaggatttatcttctgcgtacgatggtactgttcgaagctcaaatagtgatgttgtacagtttgtttatggtgatgatgggttggatccaacgtatatggagggagatggtcaagctgtcgaatttaaacgtacgtggatccactctgtcaatttgaattacgatagacacgactctgcgatgttgccatatgaaattatagattatgttaatcgggcccttgatgatccaaagtttctgaccaattgcaacagagattttattgaaactatacgtacatttgttatagaaaatatcgcaaagtatttggcttctgttcgtgagcgtcgtgacctcgcccccatgcttgaagaaccagacatggatgacctggatgacatggaaggggatgaatttgcacccgttgcgaaaagaaaatctgttgagaacattatcagggtgactgagaagcagctacgctcatttgtagaccgttgttgggaaaagtatatgcgtgccaaggtagagcctggtacggctgttggtgccattggtgctcagtccattggtgagcctggtactcagatgactcttaaaactttccattttgctggtgttgctgcccaaactactctaggtgtacctcgcatcaaagaaattattaacgctgccaaaacaattagtactcccattatcaccggacagcttatcaatgatcgtgacgaaagatctgcacgtgtcgttaaaggtcgtattgagaagacatacctgaaagacgttactagttatattgaggaagtttatggtccggtcactacttacttatctatacaagtaaattttgatactatttcgaagttgcagctagatattacattagctgatattgccgcagcaatttggaatactccaaaacttaagattccatctcaacaagtcactgttaacaacacacttcagcagattcacgttcacacctcttccgatgggaagagtagcgaaacagaagtttattacagattgcaaacgtataagcgcgttttaccagatgttgtagttgctggaataccgaccattaatcgttcggttatcaatcaagaatccggtaaaattgagctcttcatggaaggtaccggtttacaggctgtaatgaatacagaagggattgtgggaacgaaaactagtactaatcatgtaatggaaatgaaggatgtcctaggtattgaagccgcccgttactccattatctctgagattgggtatacgatggccaaacatggtcttacagttgatcctcgacacattatgcttcttggtgatgtgatgacatgtaaaggtgaggttttgggaattacgaggtttggtgtcgcaaagatgaaagatagtgttttagcacttgcatcgtttgaaaagactacggaccatttgtttaatgctgctgcgaggtttgcaaaagattctatcgaaggcataagtgaatgcattgtcctcggtaaactggctcctattggcacgaatgtctttcagcttattagaagaacagaagaagaagaagagcaaaaaccgaaagaactattgtttgatactccatctcttcatcaattggaaattacggct

SEQ ID NO: 26101 - DNA, 831 bp, Schizosaccharomyces pombe
atggatcaagctatcgctggtcttgcagcaggaactgcttccacactaattatgcaccctttggatttggcgaaaatccaaatgcaggcgtcaatgaatcaagatagtaaatcattatttcaagtttttaaaagcaacattggcagcaatggatctattcgttctttgtatcacggtctgagtattaatgttcttggatctgctgctagctggggtgcctacttttgcatttacgatttttccaagagggtagtcatgagtatgactccttttaataatggtgaaattagtgtgctgcaaacactttgtagttctgggtttgctggctgtatagttgcagctttaaccaatccgatttgggtcgtcaaatcacgaattctttcaaagagagtcaattataccaatccatttttcggtttttacgatctcattaaaaatgaagggctacgtggatgttatgctgggtttgctccgtcattacttggcgtatcccaaggtgctcttcagtttatggcttacgaaaaattgaaactttggaaacagcgccggccaacatcattagattatatatttatgtcagcagcttctaaagtttttgcggctgtaaacatgtatccactgttggtgattaggacacggttacaagtgatgcgttctccacaccgttctataatgaatttggttcttcaaacttggagattgcaaggaattcttggtttctacaaaggatttttaccgcacttacttcgagtcgtccctcaaacatgcattacatttttggtttatgagcaagttggaatgcattttaaaacacagtcttcaaagtctcaa

SEQ ID NO: 26102 - DNA, 987 bp, Schizosaccharomyces pombe
atggatgtcgttttgcagtacgctgataaatatgtctttgacaccttttatggaaagattgctgaatcgttcgatagctcatcctcttttgctaatactgctgtaaattctaccaccttgggtcttgctgagaaagtaaactttgctatcacgtcgggattacttgatcgtaacaatgtgtggcgtcaattcaccagcctgttcctcattacctggattatgggcacattgtcttactttttgtctgccagttttgcatattatgtgtactttgatcgagaggaggccagaaggcaccctaaatttttaaaaaatcaggagcatctggaattgatggttgctttaaaaaatctacccggtatggctattctgacagctccttggtttcttgctgaaattcgtggatatggttatgtttatgataagcttgatgaatatggttacttttatcttttcttttccatcgcgcttttccttctattttctgattttttgatttactggattcaccgcgctttgcatcatcgttggctttacgctcctttgcataagcttcatcacaaatggattgttccaactccttactcttctcacgcttttcattatcttgatggatacagtcaatcccttccatatcatatgtttccctttttctttcccttaaataagtatgtttacttattgctttttggatcagtaaattattggaccgtactcatccacgacggcaaatacttttctaacaacgctgtcgtaaatggtgctgctcatcacgctgctcaccatatgtactttaattacaattatggtcagtttttcaccttgtttgatcgtctttgcagttcatatcgtcaaccagaccaagaattatttgacgccgaacttcgcaatgagaaattgcaagagcagcgcattcgctttatggagacagttcaatacaccgttgagggtaaagatgatcgcacttatgccagcaagaaggataac

SEQ ID NO: 26103 - DNA, 2120 bp, Schizosaccharomyces pombe
atgagctccaagctgacagtgtatcaagcgactacatccatggcggattctcctagggatccgttccaatcgcgttcacagttgcctagatttctagcaacaagcgttaagaaaccaaatttgaagaagccttctgttaattctgctaatggtatgtgaaacttatatttgacgtttgtttatggatctgacaccctgtagaaacaaaaaatcccaaactagcttctttagaatttcaactagaaaacctaaaaaatgatttaaagcggaaggaactggaatttgagcgtgaacaaattgagttgcaaagaaaacttgcagaagaacatgaacagaagaattcgttacagctgcgtctaactctagttgaaaagcaactggaggagcagtctacttcttatcaaaaagaaatagaagaagtaagaaatgaaaaggaagccactcaggtgaagatccatgaactacttgatgcaaaatggaaagagattgcagagttgaaaacccagatagaaaagaatgatcaagctttaagtgaaaagaatcatgaagtaatggtctcaaatcaagctttgcaaatgaaggataccaatcttacaaaccttgaaaaactctttgcggattcccgcgaacagcttgaaacgaagtgtaaggaacttgcggctgccgagcagcaattacaagagctttcagttcataatcagcaattggaagagtccatcaagcaggtttctagttctattgaactggaaaaaataaatgctgagcaacgtcttcaaattagcgagttggaaaaattaaaagctgcgcaggaagaacgaattgaaaagctatcatccaataataggaatgttgaaattctcaaggaagagaaaaacgatttggagtccaaactttatcgttttgaagaatatagggataaggttgctacccttgaactcgaaaatgaaaaaattcaaactgaattaaattcttggaagagtttaattactaacgagttaccaacccctgaagctgtttcaaacaaactcgtgtttctacagaataccaatgctaatctcggagagcgcgtttctagtttagagagtcaattgtctaataagcctgcaaaccagccgcttggtgcaaatgaaaaagacgccgctcatattaccgaacttgaaacaaagcttaaagaacttcatgagcagaaccgacgtctacaaagacaaaaatctttggcaacccaagaaattgaccttttaagggaaaaccttaaaagctatgatgatgaggaggcgattttgagtgaaaaaaatactgatatgaagaagttggaaagaattgaaggtctggtcaagctggttgatgaatataagctaaagcttgaaagtatgcctgtatctcttgatgtagatgagacttcagatgaggtctcattacaaaagagacgcaggaaaaacgaacataaagatgctggttacgtaacggagctatatcgtaagaatcagcatttgctttttcaagttaaagagaaaaccaacattgaagcctttctaagggagcagattattacattggaatcctccatagcaactttacgtcaagaactggcacaagttactgaaataaactcatgtcgagtattacagcatcgatccaatcctactttgaaatatgagaggattaaagctgcgcaattggagatgctgaatgctgagaactcagctttgaaagctcttttggaagataaaaaggttgattgtctacctatacaatcatttaaaatagctgaaagaaaggccttggatttaaagaaagaagtagccgagagagaaaagagaattcaacggttaaaggagattttttcagtaaagtctttggaatttcgcgaagctgttttttcgctttttggatataagctcgattttatgcctaatgggagtgttcgtgttacatccacatattctcgtgaagataataccgcttttatatttgatggcgaatccagcaccatgaaattggttggtaatccatcaggccccgaatttgagcgccttatacgattttggtgtgatgaacgcaaaacaataccaggcatgttagcggctctaacgttagagcttcttgacaaaaatgattga

SEQ ID NO: 26104 - DNA, 918 bp, Schizosaccharomyces pombe
agcaatggcgagacttcggtgagaattaagcagtccgttcgtggttgcgacgtttatattgttagtccagcatctggacaggtaaacgaccatttaatggaactgttaattatgatttctgcttgtaaaacagcatctgctaaaaaggttaccgccgtccttcctgtattcccatatagtcgtcaacctgatcaaaaattttccttttccggtgctcctttatctgacttgcaagatgcggttgttccatgcaaaaagcaaactggttatcacccatggattgcacaatccggcacgctagtagctgatttgcttatgtgctctggtgctgaccatataatcacaatggatcttcatgatccccaatttcagggcttttttgacatccctgtagacaatctttttggccgaccattacttaaacattacatttctcttaatatcccgaattatcataacgcagtaattgtatctcccgacgctggtggtgccaaacgtgctactgctattgctgatgctctgggtttggactttgctttaattcataagaatcgccgacatgaatacggaacatctttgatgcttgttggtgatgtacaaaacaaagtcgccatcctcatcgacgatcttattgataccgcttacacactagttcgagcagcagagtttgtcaaagaacatggagctagcaaaatctatgctctcgtcactcactgtgttttatcaggagatgctattgagcgtgtaaaactttcttgcattgacaagcttattgttacaaacaccgctcctcaaactattacaccaagtggatgttttgacataatcgatgtcgctcctacctttgcggaggcaattcgtcgcatacacaatggtgagagtatttcaatactgtatgaccacaatcaagtttgggtt

SEQ ID NO: 26105 - DNA, 1578 bp, Schizosaccharomyces pombe
atggtatcagacttcttctttcctcaacctggggggattgaaagccatatttttcagctttctcaaagattgattgatttagggcataaagtaattggtatgcgtttagccttatgataatgtcaacttgtacatgctctaacatgcattatattagttatcacacatgcttataaggatcgagttggcgtcagatacttaactaatgggctaaccgtttactacgtgccgttacatgtaagtttttaattgaaattttgatcgcgcatagcgttgaaactaaacaatgcagactgtgtatcgtgaaacaacatttccttcctttttttccttttttccaattttccgcaatatagtcattagagaaaatatcgaaatagtccacggtcatggcagtttatcctttctatgccatgatgctattctgcatgctcgtacaatgggcttgaaaacttgttttaccgaccactctttgtttggttttgcagatgctggcagcatcgttacaaataagttattaaaatttacgatgagcgatgtaaatcatgttatttgtgtctctcacacttggtaagtatctcatgagcaagtatttaaattattaactaagaagccgcgaaaatacggtgcttcgtgcagttctaaatccaaaaagagtatccgtgattcccaatgccttagtagcggaaaactttcagccagacccatctaaagcttcaaaagatttctgtgagttttttcgtttattaaggaaaaaatctaacatttttagtaaccatagtagtaatctcaaggctttactataacaaaggcattgatcttttaatcgcagttatacccagaatttgtgcgcaacaccctaaagtacgatttgttattgctggcgacggacccaagtcaatcgatttggaacaaatgcgagaaaagtatatgttacaggatcgcgttgaaatgcttggttctgtaagacatgatcaagttcgtgatgtgatggtcaggggtcatatttatttacatcctagtttgaccgaagctttcggcactgttttagttgaagccgcaagctgtggtctttatgtgatttctacaaaagtgggaggtgttcctgaagtcttgccttcccacatgacacgattcgcccgtcctgaagaggatgatttagctgatacactttcgagtgttattactgattatcttgaccataaaatcaaaaccgaaactttccatgaggaggttaagcaaatgtactcgtggatagatgtcgcggaaaggacagaaaaggtttacgacagtatatgttcagagaataatcttagactaatagaccgtctaaagctttattacggatgtgggcaatgggctggtaagctattttgtttactcatagctatagattatcttgtaatggttttactagaatggatttggccagcatctgatattgacccagcggttgaccgcgtatcctctactttcaaaatttctaagcagaactttgacgaatctctggtattaacggaccccaaaaaaaagacaaagataaaaactgcatgtttaaaagatgcacaatgattacta

SEQ ID NO: 26106 - DNA, 927 bp, Schizosaccharomyces pombe
tctgataatatagcatttgtagctatccgtaataatcaatgttattgcggtagtacacttactgctacagaagtttcaagttctctttgcacaacgccttgtccaggttatggttctcttatgtgtggtggtgatctgtactggtcggtttatctgactggcaatggggttttgcaaaccacggtttctagctcgtcagtgtcgtctacgacctcttcgtcttcatcatcatctccaagctcatcttcaactacaacaacaacatctccttcttcttcttcttcttcttcgtcttcgtcgtcttcctcttcttcttcgtcttcttcttcttcttcttcctcatcttcctcttcctcttcctcttcctcttcgtcttcgtcttcttcgtcttcttccagctcttcgtcttctagttcttcctcttccgtaccaataacgtcttccaccagttcttctcattcttcttcatcttcaagctcatcttcctcttcatcttctagtcggccatcttcgtcttcgtcgtttatcacgaccatgtcctcatctacttttatttctactgtcacagtaacaccaagcagttcctcttcttcaaccagtagtgaagttccaagcagtacggctgccctcgctctaaatgcaagcaaggcgtcaaaccatacgtccttgaatgcaggtgctattgtgggtattgttatcggttgtgtggcattcgccgtggtaatggcattgtgcattttcctatacttctatttcaggagattcaaaattagaatgagcgactcggcaaatgaaggaaaatatccctcctatgctagtgaattagattctcgcttggatcctgccatgatgaatcgcaaatcaagtgaatctttggctgacagtcaggattattcgagaaagatattgcgtgtcacaaatttgaac

SEQ ID NO: 26107 - DNA, 1032 bp, Schizosaccharomyces pombe
atgaacactcaatatggctgttatctcgtggatagtagcttaactgaacaaggcacgtttacctatcttgatccagcgtattgctataacaacatttgtggtggatctgataatatagcatttgtagctatccgtaataatcaatgttattgcggtagtacacttactgctacagaagtttcaagttctctttgcacaacgccttgtccaggttatggttctcttatgtgtggtggtgatctgtactggtcggtttatctgactggcaatggggttttgcaaaccacggtttctagctcgtcagtgtcgtctacgacctcttcgtcttcatcatcatctccaagctcatcttcaactacaacaacaacatctccttcttcttcttcttcttcttcgtcttcgtcgtcttcctcttcttcttcgtcttcttcttcttcttcttcctcatcttcctcttcctcttcctcttcctcttcgtcttcgtcttcttcgtcttcttccagctcttcgtcttctagttcttcctcttccgtaccaataacgtcttccaccagttcttctcattcttcttcatcttcaagctcatcttcctcttcatcttctagtcggccatcttcgtcttcgtcgtttatcacgaccatgtcctcatctacttttatttctactgtcacagtaacaccaagcagttcctcttcttcaaccagtagtgaagttccaagcagtacggctgccctcgctctaaatgcaagcaaggcgtcaaaccatacgtccttgaatgcaggtgctattgtgggtattgttatcggttgtgtggcattcgccgtggtaatggcattgtgcattttcctatacttctatttcaggagattcaaaattagaatgagcgactcggcaaatgaaggaaaatatccctcctatgctagtgaattagattctcgcttggatcctgccatgatgaatcgcaaatcaagtgaatctttggctgacagtcaggattattcgagaaagatattgcgtgtcacaaatttgaac

SEQ ID NO: 26108 - DNA, 987 bp, Schizosaccharomyces pombe; identical to SEQ ID NO: 26102

SEQ ID NO: 26109 - DNA, 831 bp, Schizosaccharomyces pombe; identical to SEQ ID NO: 26101

SEQ ID NO: 26110 - DNA, 1775 bp, Schizosaccharomyces pombe
aagaaccaaacacacatatttcgagaaatgagtggtaaataagaaaaatttaaaggatttcagtactaacgatgaatagatgactctcatttagaaactaaggtcgttactgatgggactaccggagagaagaaaacgatctcttacgaaccatgtcgagtactgggatcgggtagttttggagtcgtcattcaagcaaaattagttggcactccggggttcattgctgtgaagcgtgttttgcaggacaaacgctacaaggtacgttgttgaggtgtttgcatgcgcgaaatcgctgtaggaaggaggcggtgattgaaatgaggaaaggagcgtgcaagagtggagttttcatgtgtggttgaaagaaatctcttttggctgatctgcttttaatgccacctttctttgaaacagccggtgataaatatttgttgatactagcgttggttttcctttacacaaaagagaattctatctatttcacgttgcatcgagtggtttgctttttgagcttttgggtttacttcttttttaccttttatacttctttctgtactttttatctcttctttttgttccttaggttgatttgtatatggaatcttttttttaataaatcaattttgaaagggcaacggattatccttttcctattgcaatgagtttttattctcaccagattgcgcgtcgaggcgtctttaaatcattcggcgtctttttttttaacaccacttacaataaatgctctcttgcaacatctccttttttttttcatcttccttgccttttttgccagcatactaacctagttatagaaccgcgagcttcaaattatgcgagcaatttcccatccaaacattattaagcttatcgccttttttcacacccacaatccttcaaaggatgaaactcacctttgtctgctcttggaatacatgccagaaactgtttttgatgacatgcgttggtatactcggcggcgtaagtcaatacccaaccttagtataaaactttatgcgtttcaattattccgcgcgcttgcctatctgcacagtactggtgtttgtcacagagacatcaagcctcaaaatcttttagtcgactacaagacgggcattttaaagttatgtgactttggtagtgccaaagtcctcgtcccttcagagcccaatgtttcttacatttgctctcgctattatcgagctcctgaacttgtgtttggtgctactcattacaccaccaaaatcgatgtttggtcggctgcttgcgttatcgcagaattgtttataggccgtcctctgttccctggtgacagtagtgtcgagcagttggttgaaataattcgagtacttggtactccttcatatcatgaaatctctgtcatgaacccaaattatgttaatcattctttgcccaacgttcgacctcacactctcgagagtgtgatgccccataactgtacaaagaatgccatggatctactacacaaaatgctaacgtatgttccgtccaagcgtatatctgccattgaagtccttactcatcccttctttgacgagcttcgtgatccaaattgcatgtaccattgttcacgtgacgaaggtaccattgaaaggcatttgcctcctttattcaacttcaatttggctgaactatccattcgtccaaatctcaacaaagcaattttaccccctcatgtttacgaaagtctcgatgtggatattaataactttgaacctattgtagtcaaacaggctgacgcagactcataa

SEQ ID NO: 26111 - DNA, 1775 bp, Schizosaccharomyces pombe; identical to SEQ ID NO: 26110

SEQ ID NO: 26112 - DNA, 1299 bp, Schizosaccharomyces pombe
atggctactcaaaactacaaagttgctgatatctctcttgctgcctttggtcgcaaggagctcgaaatcgctgaaaatgagatgcccggtttgatcgctgttcgcgagaaatatgccaagtctcagcctttgaagggagcccgtattgctggttgccttcacatgaccatccaaaccgccgtcctcatcgaaactttggttgctttgggtgctgaagttacctggtcctcttgcaacatttattctactcaagatcatgctgctgctgccattgccgccactggtgtccctgttttcgcctggaagggtgagactgaggaagaatacctctggtgtattgagcaacaattgaagtctttccctagtggtaagcctttgaacatgattttggatgatggtggagatttgactgctcttgttcatgagcgtcaccctgaacttttggttgacattcgtggtatctctgaggagaccaccactggtgttcacaacttgtacaaaatgttcaaggagaacaagcttaaggttcctgctattaacgttaacgactctgttaccaagtccaagtttgacaatctttttggatgcaaggagtccttggtggatggtatcaagcgtgccactgatgttatgattgctggtaaagttgctgttgttgctggttttggtgatgttggtaaaggttgttcaacttctcttcgtagccaaggtgcccgtgtcattgtcactgaagtcgatcccatcaatgcccttcaagccgctatggacggtttcgaagtcaccactatggaagaggctgttaaggaaggtcaaatctttgttaccaccactggttgccgtgacattattcgtggtgagcacttcaacgaaatgaaggaggactctatcgtttgtaacattggtcattttgatgtcgagatcgatgtcgcttggttgaaggctaacgctaaggatgttgttaacatcaagccccaggttgatcgttatgaattgaagaacggtcgtcatatcattcttttagctgatggtcgtctcgttaaccttggttgtgccaccggacatccctcttttgttatgtcctgctctttcactaaccaggtccttgcccaaatcgctttgtggaccgataacaccagctatcctcttggtgttcatatgcttcccaagaagttggatgaggaggttgcccgtcttcatttgggtaaactcggtgtcaaacttactactttgacttctgttcaatccgactacttgggtatccctgttgacggtccttacaaggctgatcactatcgttac

SEQ ID NO: 26113 - DNA, 990 bp, Schizosaccharomyces pombe
atgagcaacaaaagtgcatggcaacctcagtttgatgaaattcactcatccgttcaagaagcagaagggtttttacagtctagcaacgatgtacagaaagctatagacgaggtgcattatcctgacagcctcaatgacttgtcggaaatatcaaaaaatttgtatattagtagttggaaaacggcgtcagagctagtgtctacttcagacaaagggatcgattatacattaagcgctatgagtattaatcccaatttgtcggttcctgaacaacaacacctttggttgcaaattgaagactctagttctcaaaatattctgcaatacttcgaaaagtcaaataaattcatcgcttttgcactatctaaaaatgccaaagttttggttcactgctttgcgggcatatcaaggtccgtaaccttagtggctgcatacttgatgaaggaaaacaattggaatactgaggaagcactctcccatattaatgaaaggcgctctggaatatctcctaatgctaattttcttcgtcaacttcgcgtatactttgagtgtaattaccaacttgatcgaagtttgcgcccataccgccaatggctgttcagaagatatggtgatttcgcggtgttgaatactagggtaccatctgaagtcgcttacgctgagactgtccgtgcccgtgcaggacaattagagcttcgctgtaaaaaatgtcggtttgtccttgccagctctgattatctggtatcgcatgaaccgaaagatgaaaataattattctcatacaagatgtactcattactttttggaacctattcgctggatgcagccagaattggagttgggaaatttggaaggtcgatttgattgtccaaaatgcaattctaaaattggttcttataaatggcaaggtttacaatgcagttgtcttcaatgggtttgtccagctttaagtattttacagtcgcgtgtagacgctgttaggaaactcggt

SEQ ID NO: 26114 - DNA, 1450 bp, Schizosaccharomyces pombe
atggcacctatttcaaaggtctttgattacctggtaattggtggtggaagtggtaagtacaattcgatactttcgggatttgatgggttaacatttatgaatattaggcggtttggcttcggctcgtcgtgctgccaaacatggagccaaggttgctttaattgaggcatctgggcgccttggaggcacatgtgtaaattatggatgtgtacccaaaaagattatgtggaatattgctgatctcgtcgcaaagatgaaaacagcaaagcaaaatggattccctaacagtcagttaggtagttttgactggggaatgattaaacgtaaacgtgatgcatacattggacgtctcaatggaatttatgaaagaaatgttaataaggatggtgtggcttatatttctggtcacgctagctttgtatcacctactgaggttgctgtcgatatgaatgatggttcgggaactcaggttttcagcgcaaaatatatccttatagctgttggtggtcatcctatttggccttcgcatattccaggagcggaatatggtatagatagtgacgggttctttgagcttgaaagccaacctaagcgcgttgctatcgttggtgctggttatattgccgttgaacttgctggtgtatttgctgctctaggaacagagactcatatgtttattcgccaaagcaaatttttacgtaaattcgatcctattatcagtgatggaattatggatcatttccaacatattggcatcaatgtccatacgaactctttagaattcaaaaaggttgagaagcttccttctggcgaattgtgtattcatcaacaagatggatctacctttaatgttgataccctactttgggcaattggtcgtgcccctaaaatccaaggtttgcgtttagaaaaggcaggtgttaagacactccctaatggtatcattattgctgatacatatcaacgcactaacgttcccactgtcctttccttaggtgacgtttgtggtaaattagaattgacccccgttgctattgctgctggtcgtcgtttgtctgataggctttttggaggcattaaggatgctcatttggattacgaggaagttccctctgttgttttcgctcatcctgaagctggaactataggtcttacagaacaggaagccatcgacaagtacggtgaaagtcaaattaaggtatacaacactaaattcaacggtcttaattactcaatggttgagcaagaagacaaggtccccactacttacaagttagtttgtgccggtcctcttcaaaaagtggttggcctacatttagttggagatttttctgctgaaattttgcagggctttggtgtagccataaagatgggtgcaacaaaatcagattttgatagttgtgttgccattcatcctacttctgctgaagaactagttactttagtttaa

SEQ ID NO: 26115 - DNA, 1450 bp, Schizosaccharomyces pombe; identical to SEQ ID NO: 26114

SEQ ID NO: 26116 - DNA, 990 bp, Schizosaccharomyces pombe; identical to SEQ ID NO: 26113

SEQ ID NO: 26117 - DNA, 1299 bp, Schizosaccharomyces pombe; identical to SEQ ID NO: 26112

SEQ ID NO: 26118 - DNA, 948 bp, Schizosaccharomyces pombe
atattagacggaatactggttcaatttctaaagatggattctgggtcaagagtaaacgtcaacattcaagggactcgagttctcaaaaacaagctgggaaaaattcctgacatcgacatatctacagatggaaagtacttattatctgcatcaacgaatgatgttctgttagtttgggatttgcacacttccaacaaagttgcgttctttgaagcaccaagcgtatggattatgacttgtgcattctcaccctccactaagagcatagcagctggagggctgaacaacttttgcgtagtatacgataccagtgttccagatgcggatccggtcgaattggttgggcatgcaggatttgtttcgtgctgtaagtatgtcgatgacggtcatttgcttacgggttctggcgataaaacttgcatgttttgggacatagagcaggcaaaagccattagcgttttgaaaggtcatgaaatggatattgtctctctagatttcctaccctcaaatcccaatttatttgttaccggaggctgtgacaaattagccaagctctgggaccttcgggctgcttattgttgtgccacatttcccggaaatacatcggatattaattccatttccttttttccttctaacgctgattttgttacgggtgcagaggatggtatcgctcggtgctttgacattcgtgcttctgctgagatattccagtattcatctccatcatcctcccccattaattcagtcttattttccaagtctggaaaacttctttttatcgcaaaagataaaacatgcgaggtttgggattccatctcaagcaaaaccatcacatcattaacaggccatgaaaatcgaattagctctttagctttaacttctgatggaacaatgttggcaactggctcttgggacgaatgtgttcgtctctggtcttcgtcaggg

SEQ ID NO: 26119 - DNA, 1419 bp, Schizosaccharomyces pombe
atgacagaagcaaaaaacatatcggatgatacagatgtactttctttgactacaaatagtcttagaacatcaaaaactctttttggagccgagtttgggtcagttaccagttttgacgatactgtagctcaaaatctcaaaagaacatacaaagaacatttagaatatggttctgttcttggaggaactgttggaaaacggaagaaccgacattacgaagaagacactattggtagtaatgctttgacggttagagcagacagtgaaaacccttcctcccaagtgatcaccaagttttcagatcctaataagaaaatagcagggcaggtttccatgcaatctttagaaaaaattaaaggagttcctgaagcagcacatagaattgccggagaatcccaggcttctctcgtaaagcgcactcttgccgaacagattcgccctgaatggcatgctccatggactcttatgcgtgttattagtggtcatttgggttgggttcgatgcgtagatgttgaacccggtaatcaatggttttgcacgggtgctggggaccgcaccatcaaaatatgggacttagcgtctggagtacttaagctaacattgactgggcatatcgccactgtgcgaggattagcagtatctccccgtcatccatatttattttcctgtggtgaagacaaaatggtaaaatgctgggacctcgaaactaataaagtgatccgccattatcacgggcatctttccggagtctatgccttaaaactccatccaacacttgacgtccttgttaccgctggtcgtgatgcagtcgctcgtgtttgggatatgcgcactcgccaaaatgtccatgttttatcgggccacaaatccactgttgcttctttagccgttcaagaattcgatcctcaagtagtcacgggttccatggattctactatcagattatgggatttagcagctgggaaaaccttgacgaccttgacacatcacaaaaaaactgttcgtgccctgtctttgcatccagatgaatttacttttgccagtggctcgtccgacaatatcaaacattggaaattccctgaaggcgcatttatgggtaattttgaaggacataatgcaatcgttaatactctttcaataaactcagataatgttatgttttctggtgctgataatggaagcatgtgcttttgggattggaagtctggtcacaaatatcaagagcttcaatctgttgttcaacctggttcattggatagcgaagctggaatctttgctagttcttttgataaaaccggtttgcgtctaattacttgtgaggctgataaaagcgtaaagatatacaaacaagtggacaatgccacacctgaaacacatcccaatttgccatggacaccatcaaatcttcgtcggcgatat

SEQ ID NO: 26120 - DNA, 1605 bp, Schizosaccharomyces pombe
atgaatatctcactgaaaggagctattttttcaactgttgggagatttaacttacccaaagttcaaggatttataagatggaactcgacaatgaaatcacagcaaccaacgctgttttcagaggttgcttctctttctagtactttcaaaaatagtttgtctcgcgcagggttcgagaaaatgactccagttcagcagcgggtattgaatgaagtttttcctaacgaagagaatgctgtagtgcaggcaaaaacaggtacaggaaagactttggctttcttgttagtggcctttaaagatgtgcttaagggaaagccacgtttgaattcctccaaaattcactccgtaatccttagcccgacaagagaattggccttacaaatttttgaagaagctagaaaattgacttatgggacgggaatccgcgtttcttatgccattggcggaaactcaaagatgagagaggaaaatgcaattcgtcgtggtaatgccaatcttctgattgcaactcctgggcgtttggaagatcaccttcagaatccaaggattcttgaatctttatctactgactctttcattttggatgaagctgaccgtttaatggatatggggtttgctgagtcaattttgaacattcatgaagctgtcacaactactaagaccaggaagttgtgttttagtgcaacaatgccgccaaaagtctctaacgtttttcgtggaattcttgggactgattttaagctcataaactgtctggatccaaacgagcctcctacgcatgagcgtgtgccccaatttgttatagaaaccaagctcgataaggtattctcttcttctctctcacttttacaacaactcacttcttcaaatccctcaagtcgtattatcgtttttcttcccaccataagcatggttgactttgttggcggagttttagaaaatcatttgaagattccttgctttattttacattccggtttaactactgcgcagcgtagatctattacagaaagctttaggaaatgtcaaagtggtattttatttgctacagatgttgtcgcacggggaatggatttccctaacattacccaggttgtccaaataactggtcctagcaataccgatgattacattcatcgaattggacgtacgggtagggctggtaaaacaggagaggcatatttaattcttctggaacaagagaaaccttttttaaatagtatcaaacatttacctttaaaacgggcaactatcgagcccttatcagatcaagctctctcaactttgaggtcggatattgaaaagtcatcgaaattttcccgtacaaatgctttgaaaactctgtatgggtctaaacctcatgtcttctctggttcgtcccaaagacgagccaccggtaagaacattcatgaatctgctattgctttattttctttacatgacgttcctggcttaatggaagaacttatatacaagtcaagaggtagaggttcaccaaaaggttttaggggatctcaattaaaatatccatcatcttcatcttcctcctttcaacgacgacctcgttcccttccttcaagaggtcgctatcaacaaagtcgtcgc

SEQ ID NO: 26121 - DNA, 1085 bp, Schizosaccharomyces pombe
ggaacctatggcgttgtttataaagcaagacataaattgtcagggcgtattgtggccatgaaaaaaattcgccttgaagatgaatctgagggagttcctagcacagctattcgtgaaatttcgcttcttaaagaagtgaatgatgagaataatcgatcaaattgtgttcggtaagtttttacttgacggatgcatgggaaatgtttacattgataaaactttgtttctaacccttttttaagacttttggatattttacatgctgaatcaaagttgtatcttgtttttgagtttttagacatggatttgaaaaaatacatggaccgaatttcagaaactggggccactagtttagatccgagacttgttcaaaagtttacctaccagctagtgaacggtgtaaatttttgccattctagaagaatcattcatcgcgatttaaaaccacaaaatttgttgatagacaaagaaggcaatttgaagctagcagattttggacttgcgaggtcatttggtgtccctttgcggaactatacgcatgaggtatattttttttcttacttggctgtatgactttattcccaaaaaatttggaatattgactgacggtctttcagcattaatttgtgtcgctaaccgtttagattgtcactttatggtatcgtgctcctgaagtattgttgggatcaagacattattccactggggttgatatttggagcgttggatgtatttttgctgaaatgattcgacgaagtccattatttcccggtgactctgagatcgacgaaatttttaaaatttttcaagttttaggtaccccaaacgaagaagtatggcctggagtcacgcttttgcaagattacaaatccacatttcctcgttggaaacgcatggatttgcataaagttgttcccaatggtgaagaggacgctattgaattactctctgtaagattttgcattaccatctatttaagactaattactaaccattttgtcaaggctatgcttgtttatgaccctgcccatcgcattagtgcaaaacgagctttgcaacaaaattatcttcgtgattttcattaa

SEQ ID NO: 26122 - DNA, 1145 bp, Schizosaccharomyces pombe
aatcttaatagaggtgtccttcttgatgccaatgaatgtgcttatggttcggttatttccgtggacggtgtggaattcaatcgttatccggatcctagacagatcgaagtaaagcaaagattatgtgatttgagaaacaaagagctttccattaccaagccactaacaccagataacatttgcatgggtgttggcagcgatgaaattattgactccttaattcgcatttcttgtattcctggaaaagataagattttgatgtgtccaccttcgtacggaatgtatacggtctctgcaaaaatcaacgatgttgaggttgttaaggttctccttgaaccagatttcaatttgaacgtcgatgctatttgcgaaacactttctaaagatagtgccatcaaagtcttttttgcttgttcccctggtaatccaacagctaaggctcttaaactcgaggatattaagaagattttggagcaccctacatggaatggaatcgttgtcgtcgatgaggcctatattgatttctctgctcccgatatgtctgccttaactcttgtcaatgaatatccaaaccttgctgtttgccaaaccctttcgaaatctttcggtctagcaggaattcggtaagttaatctaagcttttaagcattaatattatttctttactaactatgatgtttagtatcggattttgtttgacaagtaaacctattgctaccattatgaactcattaaaggctccttataacattagcgaacccacctctcgtttagctttggatgctttatcccctcagtcgattgataaaatgcatacatatagagatgctattatacagcaaagagttcgtctttgcaaagagcttactaccattaaaggaatgggcaagattataggtggttatgatgcaaattttatcctcattcaggttttagatagaccagaaggaggtaagcctagtaacgatgccgcaaaatatctttatttacaaatggccacgatgcacaaagtcgttgttagatttagaggtacagagcctctttgcgaaggagcattgcgtatcactgttggcacagaagaagagaatacgatattactaaaaactattaaacttgtattgcaggaatactatacaaaaaaatga

SEQ ID NO: 26123 - DNA, 1125 bp, Schizosaccharomyces pombe
atggaagaagaaatcgcagcgttggttattgataatggctctggtatgtgcaaagccggtttcgctggagatgatgcccctagagctgtattcccctcgattgtcggtagaccccgtcaccatggtattatggtaggtatgggacaaaaggattcctacgttggtgatgaagctcaaagcaagcgtggtattttgaccttgaagtaccccattgagcacggtattgtcaacaactgggatgatatggaaaagatttggcatcacactttctacaacgagcttcgtgttgctcctgaggagcacccttgcttgttgactgaggctcctttgaaccccaaatccaaccgtgagaagatgactcaaattattttcgaaacctttaatgcacctgccttttatgttgctattcaagctgttttgtctttgtatgcctctggtcgtaccactggtatcgtcttggactctggtgatggtgttacccacactgttcccatttatgagggttatgctcttcctcatgctatcatgcgtcttgatctcgccggtcgtgacttgactgactaccttatgaagattctcatggagcgtggttatactttctctactaccgccgaacgtgaaattgttcgtgacatcaaggagaaactttgctacgtcgctttggactttgagcaagaacttcaaactgctgctcaatcttcctcccttgagaaatcttatgagcttcctgatggtcaagttatcactatcggaaacgagcgtttccgtgcccctgaagctcttttccaaccctcagctttgggtcttgaaaacgccggtattcatgaggctacttacaactctatcatgaaatgtgatgttgatattcgtaaagatttgtacggtaacgttgttatgtctggtggtaccactatgtatcccggtattgccgatcgtatgcaaaaggagattcaagcccttgctcctagctccatgaaggtcaagattgttgctcctcctgagcgtaaatactctgtctggattggtggatccattcttgcttctctttctactttccaacagatgtggatctccaagcaagagtatgatgagagcggacctggtatcgtttaccgtaagtgcttc

SEQ ID NO: 26124 - DNA, 1473 bp, Schizosaccharomyces pombe
atgactgttgttcgtgcagacaagaagcatcgacgtcgtggttctatatatatggtgactccttatatggatcatgacctttcaggtttattagaaaatccaagtgtaaaattcacggagccgcaaattaaatgctatatgaagcaattgtttgctggaaccaaatacttacatgatcagcttatccttcatagagatcttaaagctgctaatttattgattgataatcacgggattttaaaaattgccgattttggtctcgcacgtgtgataacggaggagtcatatgcaaacaaaaatcctggcttgcctccacctaatcgtagagaatacactggatgtgtggttacacgctggtatagatcaccagaacttttgcttggcgagcgtcgttacactaccgctattgatatgtggagcgtgggatgcatcatggccgaaatgtataaaggaaggccaatccttcaaggaagtagtgatttggaccaattggataaaatctttcgcctttgtggatcaccaactcaagctactatgccaaattgggaaaagcttcctgggtgcgaaggcgttcgctcttttccttcacaccctagaacacttgaaactgcattttttactttcggaaaggaaatgacttctctttgcggtgctattttgacccttaatccggatgaacgtttatctgcttcaatggctttagagcatgaatattttacaacaccaccatatccagcaaacccttctgaactacagagctacagtgcttctcatgagtacgacaaaagaaggaaaagagaacagagagatgctaattcacatgcgtttgaacaaaccgctaatggtaagagacagttccggttcatgactcgtggacctagcgatccgtggtatggaattcgtcggccaaattataactcacaaccgcaataccaacgtggttcgtacaatcgtgaaggcggtaacatggatagaagtcgtaatgttaattatcagcctaagcgtcagcaaaattttaaacctttaacgtctgatttgccacagaaaaattccgaattttctgaaactaacgctatgaatcaaacttctaatcattctcatgcagacggtcaacgctactaccggcctgaacaagaccgatctcaacgattaagaaacccctcggattacggccgtcaaggaagacaatcttcccagtctcaacaaccagcatggaatgtgtcctccagataccagaataatagcaaagtacaaacgacatctcgagcaagcgaaaatgcggataccaacaaaacacaacacaatattaagtacattgactcatatgttcctgaatactcaattgctagacaatctgccaaccaaaagaccaacgagcaacatccatcttctactagcttgcaccaacaatccacatctgatctgaagtcaccctcttttcatgaaaattccaacgttgatgacactcctaaa

SEQ ID NO: 26125 - DNA, 1338 bp, Schizosaccharomyces pombe
atggtatatatcaagtgccgttacgtatgtttttgttgtgcctttataaggtgaaatggtggtctgattgattctaactattgtagtaatacaacttcaaaaagtattttcaatgaattacgctgcccggttacattgaccttccttcaatttgggttcgttgcatttttcagtgccgtttgccttctatttagaaagcaatttcttggtggcacaggtattcaaaaacccagtaaatacgttttatatacgactcttccattaagtattttccaaataggaggacacgtatttggaagtttggctactacgaaaattcccgtctcaactgtacatactgtaaaggcattatccccacttttcactgttttagcttatcgcttcatgtttcgccatgtttactctgccatgacttacttctccttagtgcctctaacatttggcgttaccttggcctgctcttttgaactgtctgctgatatagtggggcttttgtacgctctaatctcgacttgcatttttgtctcccaaaatatttttggcagtaaaatatttatggaggcaaaatctcatagcactcacacgaaaaaacattacaacaaactaaatcttttactttattcttcaggagtcgcatttatcgttatgattcctgtatggctataccaagaaggatttgcctacctccctgaagtcggatcaccggttttcctaaatttgatctacaatggtctttctcatttttttcaaaatattctggcttttaccctattaagcataatttctcctgttgcatattccatagcaagtctcatcaagcgcattttcgtgattgtagtttccatcatttggtttcaacaagctacaaattttacccaaggaagtggtatctttttgacagctatcggtctctggttgtatgatcgcagtaaaaagggcaatttatacgagtcttgtaaagtaaaggagtttgaaaaggatgcacttgaattagaagagcaaacaatggaagatgaaaagtcctatccttctagtggaacacaatcaccattttatggaaagaatttccttcctcaaatcaccccacgtcttgatagtgtggtacctcttatttcagactccccaatgacccctaattcagtctattctaatgaaggagttacttcttctgtctcgggtaatgctacacctgcttctgtgcgtcaaagtacgcaaaatgacttttcaaactccaacatacatgacaggcgttccagctatacatttcaattaaacaatttcaaagcccctcaaccctctagactctgggccactgaaactgtcccaacattgaaaatt

SEQ ID NO: 26126 - DNA, 1283 bp, Schizosaccharomyces pombe
atgctttggttagatcaataccgtccaaagacgcttgcatctttggactatcacaaacaactctcagaacgtcttatttccttgtcgtctactaatgagtttccccatttgttagtgtatgggcccagcggagcaggaaaaaaaactcgggtggttgctatattacgagaattgtatggacctggctcagagaaggtatgtttcttcatagtctgactttcatttaattaaatatacatgctcacaatgaatgtagttgaaaatcgatcaaagaactttcttgactcctagtagtaaaaaattacagatcaatattgtatcaagtcttcatcatttggaaattacgcccagcgatgtcggaaattacgaccgagtcattatgcaggagcttttaaaagatgtggctcaatctgcacaagttgacttacaagctaaaaagatatttaaaggtatgtcttcactgtaaagtgaaatcaatatggaatttttgtgctcttttttgttcctaggtgtctcatgttatattctggttggtgaactttcaattcttttccttatttttatctgcgctcgtactaacatgctccttagtcgttgtaatcaatgtggctgacgaattaactagagacgctcaagcggctcttcgtcgtaccatggaaaaatattccaataacattcgtctgatcttaattgccaattctacgtcgaaaattattgagcctattcgatctcgtacgttaatggttcgtgttgcagcccctacgccagaggaaattatcctggtaatgtctaaaatcttgacagcccaaggccttgaagctccggattctctgcttaataatatagcgaataattgtgatcggaatcttagaaaagccatcttgctcttagagaccgttcatgcaaaatctccaggcaacaagcaactaatcgatactggtgcgcaactccctttgcctgattggcaaacatttatccagcaggtcggtgattccatgcttcaagaacaaagccctgcacgtatcctggctgttcgctcaatgctgtatgatcttctttctcactgcattccccctaccacaattttgaaggaacttctgtctttttttctttcaaaagtggacactaaattgcatccatacttaattcaagctgcagcgaattatgaacataggactcggatgggcaacaaatcaatttttcacctagaggcttttgttgcatattttatgaaagtttatgctatgttacaactaggtatggagttaccttcttattagctt

SEQ ID NO: 26127 - DNA, 828 bp, Schizosaccharomyces pombe
  unsure (1)..(828): unsure at all n locations
atgaaaccattttctccttctcaaaccaattttgaaaaggaacaactttgctttggtgtatatcaacttaaggattgctaccagcaagtaattgaggcactctcgcttggtattcgcgtaattgattcagcaattacatatcgaaatgaaaaagaatgtgaacaagccattcaagatttctgccatcaaaatgtgaatattaaacgtgaagatatcaccttaataactaagattcctgactccttacaaggatttgaacgtacctggaaagcggtcgnacagtctcttcgcagaacaggtcgtccnaagttagacgtcgtgctaatacattcaccnaagtggcccgtacgccgtattgagtcttggcgagcactattgcagcatcaaaaagaaggaaggataaacaaaattggagtttccaactataatattcatcatttggaagaaattatcagtcttgggttgccccttccagctattaatcaggtcgaattttctgcattcaataacaggcctacttttctttcttactgttttaatcacggtattttagtacaggctttttcaccgctaacaagaggatatcgtcttagtgatattcgactcttagatttatccttaaagtacaataaaacaccggcgaatattcttcttcgttattgccttcagaaaggggtttcaccaatatccaaagcttcgtcgtttgttcatatccatgagaacgtgaaggctgagcaattcatgcttgacccatcagatatggatgtcatggatacttgggatgaagaattcgtgagtaaacctacttggaatcctattatacttcct

SEQ ID NO: 26128 - DNA, 1470 bp, Schizosaccharomyces pombe
  unsure (1)..(1470): unsure at all n locations
atgactaaagctttgttgaaagatcttaacgccagagatgctcctctgagagaacaactggaacaggaggctactagccttcccaaaattgtactatcggaacgtcanttttgcgatgtggaactcattttgaacggaggtttcagtccattagacggattcatgaaccaaaaggattatttgaatgtcgtcgagaatttgcgtctcagcactggcgaggtctttcccatccctatcaccntggacctcaatgaatcgcagcccgattctttgaaggccggtgatcgtgttgcattaatagatcctagggatgggcaaactgttattgccattttgactgttgaggacaagtataccccagataaggcgaacgaagctgaaaaggtatttggtgctaatgatcgcgcccaccctgccgtcgactacttgtttggtcgtgctggaaatgtgtatgttggtggtaaacttcaagccgttactcctattcgccatttcgatttcgtagagtaccgctactcacctgctcaacttcgctctgacttccagcgtaacaactggaatcgcgtcgttgctttccaaacccgtaatcccatgcatcgcgcccatcgtgagcttaccgtccgtgctgctaagcaacacggtgcccgtgtgctcattcaccctgtcgtcggtatgaccaagcctggtgatatcgatcacttcacccgtgtgcgtgtttacgaggctattctccaacgctatcctaagggttccgccaagctctctcttcttcccttanccatgcgtatggctggtcctcgtgaagctttatggcacgccatcattcgtaagaactacggtgcttctcatttcatcattggtcgtgatcatgctggtcctggtaagaacagtcaaggcgaggatttttatggtccttacgatgctcagtaccttgttgaacaatacgctcaggaaatcggtatcaccattgttcctttccaaatgatgacttaccttcctgatgaggacatctacaagccagttgacaaagtcgaacccggtacccgtactttgaacatcagtggtactgaacttcgtcgccgtcttcgcgtcggtgacaacatccctgagtggttctcttatccagaggttgtcgctattttacgtcaatcctatcctcccaaatactctcaaggatttgttttggctgttcctgccacctccgataaacttctccccagcgctctagtttcagccttgaacgaggatggtcgncgccatgtcactcttttacctcgcttagatgctatttcagtgttttacgcccaagaattgcaacgtgctggtgctgccgttgttgtttctctggctgatgctgatgcatctgttaaagtacctgctgagtggactaccgtaaacatcaagcccaaagactctgtttctgaggttacttttgctgtcctttcacaattgtctgacgaaggctatctt

SEQ ID NO: 26129 - DNA, 2214 bp, Schizosaccharomyces pombe
  unsure (1)..(2214): unsure at all n locations
atggttcacgaattgaattacccattgattgagcaatttccagtatacggctcatacgctctacaagctgctcaatttcctcattgttcattatttcttcatctcgatgatccaagtatgccatgcaacaccattcgcatgtggaccattggtctcatctattccaccgttggtgccgccgtcaacatgttcttttcccttcgaaacccaaccgtcactttgagtgttttgatttccgagcttctcgcatacccagcattacagatttgggacttgattttccccgatcgcgaatttcgcattggacgtttaaagtttaattttaagcctggtccctttaacgttaaagaacatgctctcatcgtcgttatgtcgagtgtatcgtttggtaatgccnacnnnannnanntcatcctcgcccaacgtgtacactacaaacagcgcttcggctttggctacgaaatctgtttgactttggccactcaacttatcggatacggattggctggtttatccagaagacttttggtccgtcctgctagtatgttgtggcctgtgaatctcgtacaatgcaccttgaacaagactttacatcgcaaagacttacgaaacgccgttgccaatggctggagaattccccccttccgtttctttttgtacggttttattgcntcattcanttggaattggttcccttcctacattttccaagccctttccctatntgcttgggtcacntggattcgtcctaatagtccaactgtaaatcaaatctttgntgaatccaccggaatctccatccttcccatgacttttgantggaatcaaatttccgcatacattctttcccccctcatggctcctgccgatgctttgatgaacattcttgtgggcgtcattctattcttgtggatcgtcactccagcccttaactttaccaacacgtggtatggtgattacctaccgatcagtagttctggtattatcgatcactttggtaatagctataacgttactcgcatcctcaccaaggatgctacgtntgatttggatgcctatcaaaactattctcccatttncatgtccaccacctacgctttggcatttggcctttccttcgcntncntcanttctgtcattttccacgtgatcctataccatggaaaagagatctacgacaggttacgcgatccacccgcacctgatatccatgaaaaactcatgaaagcctatgatgaagttcccttctattggtatttgagtgttttcttggcctttttcggcatgatgatgggtactatttatggttggaaaacggaaaccccttggtgggttatcattgtcggtgtcattttctctgctgtatggttcattccaattggcatcgctcaagctataaccaacatccagctaggcttgaatgtattcaccgagtttatcgttggttatatgtatcctggtcgtcctttggccatgatgatttacaagactgtcggttatattacaatgactcagggattggctttcgctgccgatctgaagtttggtcattacatgaagcttcctcccagaatcatgttttacacccaaatgattgccaccatatggtcttgctttgttcagatcggcgtattggattgggctttgggtaatattgataatgtttgccaggccgatcaacctgataattacacttgtcctaatgcaactgtcttttttaattcttccgttatttggggtgtaattggtcccaagagaatgttttctggaaaaaacacctatacgggattgcagtacttctggctcgctggcgtgctgggtacaattntgttctgggctctatggaagaaatggcctcaaaaatggtggggtcaattgaatggcccgctaatttgtggaggtactggttatattcccccagctactcctgtaaactatctggcttggtctggaattggtctgttctncanttattatctgaagaagatatncgcagactggtggcagaaatacaatttcacgctttctgctgctcttgatactggtacgcagttgtcggncattatactnntctnnngcttacagttgcctatggttaatntcccagattggtggggtaatgatggngcctnnaatacgctggatgctacaggtgccgctgttaggaaactcgtcantgagtcagcaggtgaattctttggncccgccgaatgg

SEQ ID NO: 26130 - DNA, 1698 bp, Schizosaccharomyces pombe
  unsure (1)..(1698): unsure at all n locations
atgtccccgtctcccgtcaatacttccacagaaccagcatctgttgccgctgtttcaaatggtaatgctactgcttccagtactcaggttccggaaaacaatcaatctgattcatttgcaccaccaagcaacaattctcagcagaatcaacagtcttcaactatcgctcctaatggaggggccggatctgtcgctaatgcgaatccagctgaccaatccgatggtgtaactccgtctttcgtaggctccttgaagctggattacgaacccaacccctttgagcattcatttggctctaccgcttcggttggacaaggaaatccttctcttaatcgtaatcctagccttagtaacattccttcaggtgtgcctcctgcgtttgcgcgaactctcttacctcctgtttcttccatagcatcacctgatatcttaagtggagctccaggtattgcctcgccgttgggctatcctgcttggtctgcttttactcgtggtacaatgcataatcccctttctcctgctatttatgatgctactcttcgtcctgactacctaaacaatccttcagatgcatctgcagcagctagattttctagtggaactggatttactcctggtgttaatgaacccttccgatctcttttaacccctactggagctggatttcccgctccttcacctggtactgccaatttattagggtttcatacgtttgattctcaatttcctgatcaatatcgttttaccccaagggatggtaaaccgcctgttgtaaatgggacgaatggtgaccagtctgattatttcggtgccaatgctgcggttcatgggttatgcttactctcccaggttcccgatcagcagcaaaagcttcagcaacccatctcctctgaaaacgatcaagcagcatccaccactgccaacaacctcctgaagcaaactcagcaacagactttccccgactctatccggccatcttttactcaaaatactaacccccaagctgttacaggtacaatgaaccctcaagcatctcgtactcagcaacagcctatgtactttatggggtcgcaacaatttaacggcatgccatctgtttacggcgatacagttaatcctgccgacccttcattaacattacgccaaaccacggacttttccggacaaaatgccgagaatggatccacaaatctaccgcaaaaaacttctaattctgatatgccaacggcaaattcgatgccggtcaaactcgaaaatggtactgactattccacttcgcaagagccttctagtaatgccaataatcaatcctcacccacttcttccattaatggtaaggcttctagtgaatctgccaacggcacttcgtatagcaaaggttcatctcgccggaattccaaaaacgaaactgatgaagagaaacgtaaaagcttcctggaacgcaatcgacaagctgctcttaaatgtagacagcgtaaaaaacaatggctttctaatcttcaagcgaaggttgaattttatggtaatgaaaatgaaattttaagtgcacaagtcagtgcattacgtgaggaaattgtgagtttgaagaccttattgattgctcataaagactgcccagtggccaagagtaatncggctgctgttgcaacaagtgtcatcggaagcggtgatcttgctcaaagaatcaanttagggtac

SEQ ID NO: 26131 - DNA, 828 bp, Schizosaccharomyces pombe
atgaaaccattttctccttctcaaaccaattttgaaaaggaacaactttgctttggtgtatatcaacttaaggattgctaccagcaagtaattgaggcactctcgcttggtattcgcgtaattgattcagcaattacatatcgaaatgaaaaagaatgtgaacaagccattcaagatttctgccatcaaaatgtgaatattaaacgtgaagatatcaccttaataactaagattcctgactccttacaaggatttgaacgtacctggaaagcggtcgaacagtctcttcgcagaacaggtcgtccaaagttagacgtcgtgctaatacattcaccaaagtggcccgtacgccgtattgagtcttggcgagcactattgcagcatcaaaaagaaggaaggataaacaaaattggagtttccaactataatattcatcatttggaagaaattatcagtcttgggttgccccttccagctattaatcaggtcgaattttctgcattcaataacaggcctacttttctttcttactgttttaatcacggtattttagtacaggctttttcaccgctaacaagaggatatcgtcttagtgatattcgactcttagatttatccttaaagtacaataaaacaccggcgaatattcttcttcgttattgccttcagaaaggggtttcaccaatattcaaagcttcgtcgtttgttcatatccatgagaacgtgaaggctgagcaattcatgcttgacccatcagatatggatgtcatggatacttgggatgaagaattcgtgagtaaacctacttggaatcctattatacttcct

SEQ ID NO: 26132 - DNA, 5464 bp, Schizosaccharomyces pombe
ccgtttactaacagtattagccgggtggaggaggttcaatttggaatcttgtccccggaggaaattcgttcaatgagcgttgcgaagattgaggtaagtgtttgttttgttcttatcacttatcgtttttagtttcctgagaccatggatgaaagtggacaacgcccccgtgttggtgggctcctggaccctcgattggggactattggtatgaaattcagaaaaagattagtattctcacacattttgtaagatcgacaattcaagtgtcaaacctgtggtgaaactatggcggattgtcctggtcattttggtatgtgttacaactgtttggtttgttataaaaacacctttttttttcagcaaccttctaaactcaataaaaagatagctaacacctttcaggtcatattgaacttgcaaagccagttttccacatcggtttcctaagcaaaataaaaaaaatattagaatgcgtttgttggaattgcggcaaacttaagattgattctgtaagtcaactgttgagcttatccattgtgttactaacattataaagtcaaatccaaaatttaatgacacacaacgttatcgtgatcccaaaaatcgattaaatgcagtttggaatgtctgcaagacaaaaatggtttgcgatactggcttatctgcaggctcagataatttcgaccttagtaatccctccgccaatatgggacacggtggttgtggggctgcccaacctacaatacgtaaagatggcctgagattatggggttcttggaaacgcggtaaagatgaatcagatttaccagaaaaacgccttctgtcgccgttggaggtgcacacaatattcacacatatttcttcagaagatttagctcacttaggtcttaatgagcagtatgctagacctgactggatgattattacagtcttacctgttcctcctccgagtgtccgtcctagtatttcggtggatggaaccagtcgtggcgaagatgatttaacgcacaaactttccgatatcataaaagcaaatgccaacgttcgacggtgtgaacaagaaggagctcctgcgcatattgtctctgaatatgaacagttacttcagttccatgttgccacgtatatggacaatgaaatagcgggacagcctcaggctttacaaaaatctggcagacctcttaaaagtatccgtgcacggctcaagggaaaagagggtcgattacgtggcaacctgatgggtaaacgggttgatttttcagctcgtactgtgattaccggtgatccaaatttgtcgttagatgaactcggtgttccacgtagtattgctaagacacttacttatcctgaaactgttacaccttataatatttatcaattgcaagaattagtacgaaatggtcctgatgagcatcccggtgctaaatatatcattcgtgatacaggagagcgtattgacttgcgttatcataaacgtgctggtgatattcctcttaggtacggttggcgagttgagcggcatattcgtgatggcgatgtcgttatttttaacagacagccatcccttcacaaaatgagtatgatgggtcataggattcgcgtaatgccgtactcgacattccgattaaacttgtcagttacgtctccttataatgctgactttgatggtgatgaaatgaatatgcatgtccctcagtcagaagaaactcgtgcagaaattcaggaaattactatggtacctaagcagattgtttctcctcaatcaaacaagcctgtcatgggtattgttcaagatactttagcaggtgttcgtaagttttcgttacgtgataactttttgactcgcaacgctgtaatgaatattatgttatgggtaccagactgggatggaatactcccaccacccgtcattcttaaaccaaaggttttatggacaggaaagcaaattttgagcttgattatacccaagggaattaacttaattagagacgacgataagcaaagtctttcaaatcccaccgactcaggaatgttgattgaaaatggtgaaattatatacggcgtggttgacaagaagactgttggtgcttctcaaggtggtttagttcatactatctggaaagagaaaggtcctgagatttgtaaaggtttcttcaatggtattcaacgagttgtaaactattggcttttacataacggttttagcattggtataggagatactattgccgatgcggacacaatgaaagaggttactagaactgttaaggaagcccgtcgtcaagtcgcagaatgtattcaggatgctcagcacaatcgcttaaagcctgagccaggaatgacccttcgagaatcttttgaagctaaggtatcaaggattctcaatcaagcgagagacaacgctggtaggtcagctgagcatagcttgaaggattctaacaatgtcaaacaaatggttgctgctggttcaaaaggttcatttattaatatctctcaaatgtctgcttgcgtcggtcagcaaatcgttgaaggcaaacgtattccttttggatttaaatatcgtacattaccacattttcctaaagacgacgactctccagaatctcgtggatttattgaaaattcatacttaaggggtttaactcctcaagagttctttttccacgcaatggctggacgtgagggtttgattgatactgcggtcaaaactgctgaaactggatacatccaaaggcgtcttgttaaggctatggaggatgtaatggttcgctatgacggtactgtgcgcaatgccatgggtgacattatacaatttgcctatggtgaagatggcctggatgccacattagtagagtaccaggtttttgactcattaaggttatccactaagcaatttgaaaagaagtatcgaattgatttaatggaggataggagtttatcattgtatatggagaactctattgagaacgattcttcagtacaagacttattagatgaggagtatacacagctggttgctgatcgtgagttactatgcaaatttattttccccaaaggtgatgctagatggcctttacctgtcaatgtacaaagaatcatccaaaatgctttacaaatattccatttagaagctaaaaaacccaccgatcttttaccgagtgatattattaacgggttaaatgaactaattgcaaaattaacaattttccgcggaagtgaccgtattactcgtgatgttcaaaacaacgctaccttgttattccagattttattaaggtccaaatttgctgtaaaacgggtaataatggaataccgacttaacaaagtcgcatttgaatggattatgggtgaagtggaagctcgtttccaacaagctgtcgtaagtcctggagaaatggtgggtactctggctgcacaatctattggagaaccagcaactcaaatgacactcaatacattccattacgctggtgtttcttctaagaacgttaccttgggtgttcctcgtttgaaagaaattttgaatgtcgctaaaaatattaagaccccttctttaactatttatcttatgccctggatagcagctaatatggatcttgctaagaacgttcaaacccaaatcgaacatacaactttgagcactgttacctctgcaaccgaaattcattacgacccagatcctcaagacacagtgattgaagaagataaggattttgttgaagctttctttgctattcctgatgaagaagttgaagagaacttgtataagcagtctccttggttgcttcgtcttgaacttgaccgtgctaagatgttagataagaagttgagtatgagtgatgttgctggtaaaattgctgaaagctttgaacgtgatctttttactatttggtctgaggataatgcagacaagcttatcattcgttgtcgtatcattcgcgatgatgaccgtaaggcagaagatgacgataatatgattgaagaggatgtttttttgaaaactattgaaggtcatatgcttgagagtattagtcttcgtggtgtgccgaacattactcgtgtttatatgatggagcacaagattgtgcggcaaattgaagatggtacttttgaacgtgctgatgaatgggttttggaaacagacggcataaatcttactgaagcaatgactgtagagggtgtagatgccaccagaacttactccaattctttcgtggaaattttgcaaattcttggtattgaagctacgagatctgctttacttaaagaattaagaaatgttatcgaattcgatggttcttacgttaattatcgccatctggcccttctttgcgatgttatgacatctaggggccatttaatggctattacccgtcatggcattaacagagctgaaaccggtgctctaatgaggtgctcttttgaagaaactgtagaaatccttatggatgctgctgcgagtggagaaaaggatgattgcaagggaatatctgaaaacataatgctaggacaattagccccaatgggaactggcgcatttgatatttaccttgatcaagatatgttgatgaattacagtcttggtaccgccgtccctacgctcgctgggtcaggaatgggtacttcccaattaccagaaggagccggtacgccatatgaacgctcaccaatggttgattctggatttgttggatctcctgacgccgcagcattttcccctctagtacaaggtggatccgaaggtcgtgaagggtttggcgattatggattgttgggggctgctagtccttataaaggggtacaatcccctggttatactagtccattttcgtctgctatgagtcctgggtatggacttacttcaccaagctatagtccatcatctccgggatattccacgtcacctgcttatatgccatcgagtccttcctattctccaactagtccttcttattcccctactagtccttcttattcccctactagtccttcctattctccaacaagtccttcatactcagcgacaagtccatcctactctccaactagtccctcctattctcctactagtccttcttattcgcctacaagcccatcatattctcctactagtccctcttattcaccgactagtccttcttattctcccacaagcccatcatattctcctactagtccctcttattcaccgactagtccttcttattctcccacaagtccttcttattctcctacgagcccatcgtattcgcctactagtccttcctattctcctacgagcccgtcgtattcaccgactagtccctcttattcaccgactagtccttcttactctccaactagtccctcttattcccctactagtccctcttattctcctactagtccttcatattctcctacgagcccttcttactctcccacgagtccctcgtattcccctactagcccatcttagcta

SEQ ID NO: 26133 - DNA, 1074 bp, Schizosaccharomyces pombe
atgggaattctcgatattgtacctactggtgttattacaggtgacaacgttttaaagttgttcacctacgctcgtgagcacggattcgccatccctgccattaacgtcacctcctcctccactgctattgctgctcttgaggctgctcgtgaggctcgttcccccatcatcttgcaaacctccaacggtggtgctcacttctttgctggtaaggaatcctccaacgagggccaaaaggcctccattgccggttccatcgccgctgcccactacatccgttccatcgctcctttcttcggtgtccccgtcgtcatgcactctgaccactgcgccaagaagcttctcccctggatggacggtatgttcgaagccgatgaggcctacttcaagattcacggtgagcctcttttctcttctcacatgcttgacttgtccgaggagcccaagaaggagaacattgctcaagttaaggagtactgcaagcgtgccgttcccatgaagatctggatcgagatggagatcggtatcactggtggtgaggaagacggtgtcgacaactctcacgtctcccacaccgagctctacactcaacccgaggacatctgggatgtctaccgtgagctctcctccgttaccccttacttctccattgccgccgctttcggtaacgtccacggtgtctacaagcccggtaacgtcaagctccaacccgctcttttgggtcaacaccaagcctatgttaaggagcaactcaagaccaccaacgacaagcccgttttcttcgtcttccacggtggttccggttcctctgtcaacgagttccgtactggtatcaagtgcggtgtcgtcaaggtcaacattgacactgatacccaattcgcctacgtcgagggtgtccgtgactatgtcttgaagtacaaggactaccttatgacccccgtcggtaaccccgagggagctgacaagcccaacaagaagaagttcgaccctcgtgtctggatccatgagggtgagaagaccatgaccaagcgtgttcttaccgctcttgaggacttctacactgtcaacactctc

SEQ ID NO: 26134 - DNA, 1086 bp, Schizosaccharomyces pombe
gatcctccacttactgtatcttctactcagcgtatttctagaccaccatcgcttcaaaaatccataaccatggttggtgtggaacctttataccagtccaacggaaatgaaaaatcgtcgaagtataatgttttttcagaaagcgcgcatggcaaccatcaagtactttccttttcacctggttcatccccatcatttattgagcaaccatccccaatttctccaacttccactacaagtgaggacacaaatacacttgaagaggacactgatgatcagtctatcaaatggatacgtggtgcgttaataggttcaggatcgtttggacaagtttatctcggtatgaatgcatctagtggtgagttgatggctgttaagcaagtgatcttagattctgtttctgaatcaaaagaccgccatgccaaacttttagatgcattagcgggtgaaattgctcttctacaggagttgtctcatgagcatattgtccaatatctcggttctaacttaaattcggaccacttgaacatttttttggaatatgttcctggggggtcggttgccggattgcttacaatgtatggaagctttgaggaaacgctagtcaagaactttattaagcaaacccttaaaggcttagaataccttcattcacgcggcattgtacaccgtgatataaaaggtgcgaacatcttggttgataataaagggaagattaaaatttcggactttgggatatcgaagaaacttgaactaaatagtacctctacgaagacgggtggtgctcgcccttcttttcaaggctcttctttttggatggctcccgaagtggtgaagcaaactatgcatacggagaaaacagatatttggtctttgggatgtttggtaatcgagatgctcactagtaagcacccttatccgaattgtgatcaaatgcaggccattttcagaattggggagaacattctgccggaattcccttctaacatttcttcatcggccatagatttccttgagaaaacgtttgccatagattgtaatcttagacctacagcatcagagttgttgagccacccgttcgtttca

SEQ ID NO: 26135 - DNA, 1206 bp, Schizosaccharomyces pombe
atggcaccctcagagaaagacattgaagaggtatcagtccctggagttttagcaccgcgcgacgatgtgagggttttaaagacacgaattgccaaattattaggaacaagtcctgatacatttcctggatcacagccagtttctttttcaaagaaacatttacaagcattaaaagaaaagaactatttcgtatgtgaaaaaagtgatggaattcgttgtttactttatatgaccgagcatcctcggtacgaaaatcgacccagtgtatatttatttgatcgtaaaatgaatttttatcatgttgagaaaattttttatccagttgaaaatgacaaatctggaaaaaaatatcatgttgatacacttttggacggtgagttggttttagatatctatccaggtggtaagaagcaactgagatatttagtctttgattgtttggcatgtgatggaattgtttatatgagtcgattgcttgacaaacgcttgggaatttttgctaaaagcattcaaaagcccttagatgaatatacaaagactcatatgcgcgaaactgccatatttccttttctcacatcgttaaaaaaaatggagctgggtcatggtatcctaaagttatttaatgaagtgatcccccgacttcgtcatggtaatgatggacttatctttacatgtacggaaactccttatgtatctggcactgaccagtcgcttttgaagtggaaaccaaaagaaatgaatacaatagactttatgctaaagctggaatttgcacagcctgaagaaggggacattgattattcagccatgccagaatttcaacttggtgtatgggagggtaggaacatgtactctttttttgccttcatgtatgttgatgaaaaagaatgggaaaaattgaaaagctttaatgttcctttatcggaaagaatagtagagtgctatctggatgatgaaaatcgttggagatttttacgttttcgtgatgataaacgagatgcaaaccatatcagtacagttaaaagtgtattgcagagcatagaagatggcgtttctaaagaagaccttctcaaagagatgcctattatccgtgaagcttattacaacagaaagaaaccctcagtaacgaaacggaaattagatgaaacctctaatgatgatgctcctgcaatcaaaaaagtagctaaggaaagtgaaaaagaaatt

SEQ ID NO: 26136 - DNA, 2619 bp, Schizosaccharomyces pombe
gtccgtgttcgcccatttagtacagctgaatctgcaaatttaattgcatcctcagatcgtttatcatttggaacatcttcttccttaaggaaccctggttcaggacgtcaaattcgacgagtagtaaaggtacttgatggacgtgtcttggtatttgatcccccggatgaaacaacggctactttgagtgccacaaaccgcagactttctacttctcaacagagtctcgctagattatctagaaagtcaaacaattctgcgggatttggccgtgatcttcgttatgcttttgatagggtttttgatgaaactgctactcagcaacaggtgtatgagagaactgccaggccgttattagacaatattttggatggattcaatgctactatctttgcatatggagcaactggatgtggtaaaactcacaccattagtggaacaatgcaagatcctggtttaatatatttgacactaaaagaactttttgagagaatggatcatttaagagatgaaaaaatttttgaccttcgcctttcctatttggaaatttataatgaaactattcgtgatttattagtatcaccgaccccaaatcaagcaaagccattaaatttacgggaagatgcagaccgtcgcattactgtaccaggtcttacttctttgtctccagaatctttggaagaaatcattgatattatcatgaagggaaatgctaatcgtactatgtctccgacagaagctaacgctgcttcatctcgttcgcatgctgtattgcaggttacgttgatccaaaaacctcgtacagctggcatcaatgaggaccacactttggccactttatcaattattgacttggctggctcagaacgtgcaacagctaccaaattaagaggtagtcgtctttttgaaggtgctaatattaataaatctcttttagccctaggaaattgtatcaatgccctttgtgatccccatcgccgtgcgcatgtcccctatcgtgattctaaacttactcgcttacttaagtttagtttaggcggaaattgtcggacagttatgattgtttgcgtatctccgtcttctgttcattacgaagaaactcacaatactctaaaatatgctaatcgagcaaagaatatcaaaaccgaagtgttaaggaacatgatcagtgtagatcgacatgtaagccaatatgtaaaagcaatcgttgagttacgtgagcaaatttcagagttggagaatcgtctcgcacagatcgatttgtcatcgcaatcaaatggttctgatcaggacgctgtaactcaatcttttgctcatgaatcgaagcttgcagaagccagaaatttattgcgtatgacatttgaggagactttaccactgcaaaatgatactattaataaggtagaaaaggtgaaacattttgatgattcaattcgcgtacttaagtactggttatcctgctatgagcgaatacttccgaattccgcagatgaacgagtatttttagttcgttcaaagttagaatcattgttaactcgtcgtgcagagatcattgctgatatagatcctgaacttgtataccaaaagtttcagagaagtgtttctcacattatcaacacatacaaacaagaaggtgctaccatgtacgctgatgtgttacaggatgaagttgacttgctaaaatcaattattgagaatcaggttctagatgctcagaataaagttgatgagttcactcctgttttagaatcccttcttagaagttctttcaaagctagttcattgctaaaagagggaggtatgcaagagctattctcgatactggaaaagtggttgttgggcattggtcttggcgagaaacctaatatatctgtcttatcagaaagttataagctcaactcaacatccgatgattcacgaactatcaatcgtgatagagttcatagttttcccactcaacccttgcttaataataacttgcctcgaatgtttttcgtgaagtctccaaaaaaaccagttgtattttcaaaacgttctccaaaaaagagggttcgtttcgacgattcaatgtctacgtctgactcaggtgcctccgcgtataactcacccattcaaacctctaagttaaagaacatgaacttctttaatactatgcatatgccttcaactcctgcacataaacggcctgaaaataagaatcagatagatgttgaaattaatcttacttcgcctgtctccccgatgttggaagataaaccagaacctggacttttgataaaaagtcctttggagaaaaagcaagaagttaatagtgaatccacacagcttgatcaactgctggccgaggactcgtcaactgacgatgtttctttacctcatctggacactattgatctggatggtagtccagtcccaaaagttcctgatttgaatttttccagagccaatatggactcaccaacattcatcctcaacaatgaagctattcacaactttgatttttctaaaccgaagactcgacaaagcctcagttcattgactactcttcatctttcaaatccagctaacattattaggaaatctttaagcatggctgaaaacgaagaagagaaagccacc

SEQ ID NO: 26137 - DNA, 1907 bp, Schizosaccharomyces pombe
atgtctgcctttaagccttatactgaagctttggaagtccttaagaagtatgagaagaaggatggattaagtattgacgacttgattcgtcacaattttcaaggtggattaaccttcaatgatttcttgatcttaccaggatacattgactttgtccccaacaatgtctctcttgagactcgtatttctcgtaatattgttcttaagactccctttatgagttctcctatggatactgttactgaggatcaaatggctatttacatggctcttttgggtggcattggtgtaattcatcacaattgcactcctgaggaacaggctgctatggttcgcaaggtcaaaaaatacgaaaatgggtttattttggaccctgttgttttctctccccaacacacagttggtgatgtgttgaagattaaagaaaccaaaggtttcagtggtattcccattactggtaagtaaattgattaagagaaagagaagaatgaaattttgttgaaagaattacattcatagatgggtggactagtgagtcattatttatactgactctttcctctttactactaatgaatgttgcctactttgtgatttttgtggagactaagcatgtaccgttaataccttatgatgctctttgattaactttcgttcttccgcaatgacttaattgtcatggggtcaacttttttattttactgaagatattgtattgcatgctttttctttcatcttcttcttgatatcgtattccttatataaatatgttagtttactaacctttagaaaatggaaaacttcgtggaaagttggttggtattgttacttctcgtgatgttcaattccacaaagacaccaatactcctgtcactgaagttatgacccctcgtgaggaattgatcactaccgccgagggaatcagtttggagcgtgccaacgaaatgttgcgcaaatccaaaaagggaaagcttcctgttgttgacaaggatgacaacctggttgctcttttgtctttaactgacttgatgaagaacttgcacttccctcttgccagcaaaacatcggatactaagcaacttatggttgccgctgctatcggtactcgtgatgatgaccgtactcgtttggccttgcttgctgaagctggtttagacgctgttgtcatcgactcttctcagggtaattcctgcttccaaatcgaaatgattaaatggattaagaagacatatcctaaaattgatgttattgctggtaatgttgtgactcgcgagcaaaccgccagcttaattgctgctggtgccgatggtttacgtgttggtatgggtagtggtagtgcatgtatcactcaagaggttatggcatgtggtcgtcctcaggctaccgccattgcccaagttgccgaatttgctagtcaatttggtattggtgtcattgctgacggtggtattcagaacgttggtcatatggtcaagagtctcagcttgggtgctactgctgttatgatgggtggtttgttggccggtaccaccgaatctcctggtgaatactatgtccgtgagggacaacgttacaaatcataccgtggtatgggttccatcgctgcaatggaaggtactggtgttaataagaatgcttctactggccgctatttctctgaaaacgatgctgtccgtgttgcccaaggtgtctctggtttggtcgtcgacaagggctcgcttcttcgctttttaccttatctctacactggtttgcaacacgctcttcaagatattggtaccaaatctcttgatgagcttcatgaagctgtcgacaagcatgaagttcgcttcgagttacgttcgagcgctgccatccgtgaaggtgatatccaaggttttgctacatacgaaaagcgtctttactag

SEQ ID NO: 26138 - DNA, 1977 bp, Schizosaccharomyces pombe
atggaatattatacctcgaaggaggtagcagaatggttgaaaagtatcggattggagaagtatatcgaacaattttcacaaaataacattgaaggacgacacctaaatcatttaaccttgcctttactgaaagacctaggcattgaaaacaccgccaaaggcaaacaatttttaaaacaaagagactatttacgagagtttccacgtccatgtatactgaggtttattgcctgtaacgggcaaactcgagcagttcaatcacgaggagattaccagaaaacactcgctattgctttgaaaaagtttagccttgaagatgcttcaaaattcattgtatgcgtttcacagagtagtcgaattaagctgattactgaagaagaatttaaacaaatttgttttaattcatcttcaccggaacgcgacaggttaattattgtgccaaaagaaaagccttgtccatcgtttgaagacctccgccgttcttgggagattgaattggctcaaccggcagcattatcatcacagtcctccctttctcctaaactttcctctgttcttcccacgagcactcagaaacgaagtgtccgctcaaataatgcgaaaccatttgaatcctaccagcgacctcctagcgagcttattaattctagaatttccgattttttccccgatcatcaaccaaagctactggaaaaaacaatatcaaactctcttcgtagaaaccttagcatacgtacgtctcaagggcacaatcttggtaattttggtcaagaaattttgccaagaagctctcggcgggctcgcccttccgaattggtttgtcctctttcctctctgaggatttctgttgctgaagatgttaaccgacttcctaggattgataggggatttgatcctccacttactgtatcttctactcagcgtatttctagaccaccatcgcttcaaaaatccataaccatggttggtgtggaacctttataccagtccaacggaaatgaaaaatcgtcgaagtataatgttttttcagaaagcgcgcatggcaaccatcaagtactttccttttcacctggttcatccccatcatttattgagcaaccatccccaatttctccaacttccactacaagtgaggacacaaatacacttgaagaggacactgatgatcagtctatcaaatggatacgtggtgcgttaataggttcaggatcgtttggacaagtttatctcggtatgaatgcatctagtggtgagttgatggctgttaagcaagtgatcttagattctgtttctgaatcaaaagaccgccatgccaaacttttagatgcattagcgggtgaaattgctcttctacaggagttgtctcatgagcatattgtccaatatctcggttctaacttaaattcggaccacttgaacatttttttggaatatgttcctggggggtcggttgccggattgcttacaatgtatggaagctttgaggaaacgctagtcaagaactttattaagcaaacccttaaaggcttagaataccttcattcacgcggcattgtacaccgtgatataaaaggtgcgaacatcttggttgataataaagggaagattaaaatttcggactttgggatatcgaagaaacttgaactaaatagtacctctacgaagacgggtggtgctcgcccttcttttcaaggctcttctttttggatggctcccgaagtggtgaagcaaactatgcatacggagaaaacagatatttggtctttgggatgtttggtaatcgagatgctcactagtaagcacccttatccgaattgtgatcaaatgcaggccattttcagaattggggagaacattctgccggaattcccttctaacatttcttcatcggccatagatttccttgagaaaacgtttgccatagattgtaatcttagacctacagcatcagagttgttgagccacccgttcgtttca

SEQ ID NO: 26139 - DNA, 1383 bp, Schizosaccharomyces pombe
atgtcgtttccttatcagcacacttcacgttctcaagttcagcctcctttggctgcccccggcttgagtatgtttgctcctgtttcgtccagcaatagtgcaaactctgcttcttcggttgctgctttgttgagtcatgctcctatgtatggtcttggccagcgtcgtccgtccttcttacctggcgtttctgtgcccgatacgctttcggtaaggtcgggcttctccatcccttcctcctctcatcatccttccgctgttccttcccttctgtcgcagcaccgtttacagcaacctcaaccacgtctctacccttctgcgcctctaaactattactggccatcttatcagtcggttccatctgccgcacctccaccaccctcccagcaacgctatatgcctgactctgccgttgcctataatcctaaccaagatcaatttggcaattcggtgaatgtatcagctgcatgtaacaacgtttccgcccctttgattgctaacaattgtgctccttccttttatcagtctcgacatcccgtagcagatgtgcctgtaaccaacaataccgccactactacctccgagactgataatacaatcccaggtaatcttaacatgccttcggttgctaacgttcaacaacgtatttctcctgtctgcaaaactaacatggaggatcaggaagaaaccgtttataccggaggtgttgctgctaaactggattacaagatggatcaaatggtggaatacttgtctatcatgacttgtaagttgtatgctcgtttcctgaataatgctcaaatgcattctcttgctaactctttacctggtcttgtgttttctttccgtaaggtcgttacacaaattttgacgtctacgcgtttacctcgtgcctcttgcttgcttgccttgtcatacctttccgatcgtcttgacgccgcatctcaaacgactgattttgtaaaccagtggactaaggagtcgttattcttccaaatatgtgctcttttaacgaccgccttgattttggctaataagtttttggatgacaatacgtttaccaatcaatcctggtcgcaagttactggtttccgtactgccttgttgaacagctttgaacaagactggctagctagcatgtcctggaatcttagtcccggtcctcgtggtcaaaaggcatgggagtggtggagtgcttcttattctttgtttacttcctcaaacgctacatactctggtgaacaaaaaacttatagccctactacgttgagcaccaacgcaccaccatcgccctcttctggacgttcttgctctaattgcaactactattatccctatacacccgtgggatattatccagtgtacaatcgctatgcaatgact

SEQ ID NO: 26140 - DNA, 2010 bp, Schizosaccharomyces pombe
gctatctcgaagccgaaagaacatgagtcagcaatctatagaaatgcgaattttcccgatcatttagtagaaacatatagcgatgatgttcatactctattcgacgtttttagacattctgtcaagcaatttggtaacaagaaggctatgggatatcgcaacttggtgaaagaacatgttgagacaaagatggtcacgaaagtggtggacggtgaaaaaaaggaggttcctaagtcctggtcttattttgagctttcagattacaattatctttcctttaatgatatttatgacaaagcattgcgttacgccggtgctttacgtaaacttggtttaaataagggagacaaattcgaactgtatgctcctactagcgctttttggcttctcactgctgaggcttgtttatctcaatcaatgacgatcgtaacggcatacgatactttgggtgaagagggtttgctccattctttgcgcgaatccggtgtccgaggaatgtatacagaaggacatctcttaaaaactttggtcaatcccttgaaggaaattgaatcacttgaagtaatcatctaccgcaacgatgccaaggaggaggacataaagacaattcaggagattcgtcctaacctcaaattgattaaatttgctgattttgagaaaatgtctcctcccgttgagcctgatccaccttcacctgaagagatctgctgtattatgtacacttctggtagtaccggtttacctaagggtgtaattttgagtcacaagaacatggttgcaattgtcactgctattgtcaagcacgttcctgaagttacctctaaagattatcttttggcctaccttccattggcacacattctcgaatttgcgtttgaaaacatttgtttggcttggggtggtaccattggctatgccaacgtccgtactttggtcgatactaattgcagaaactgcaagggtgatatcaataccttccgtcccactatcatggttggtgttcccgctgtatgggaaatggtacgtaagggtatcatgagtaaattaaacgctgcctctgctgttaagcgttcagttttttggactgcttattacactaaagcaaagttgatgcgtcacaatcttcccggttcttgcgtattggataccgctgtattcaataaaattagatctatgggaaccggtggtcgtttaagatacactttatctggtggttctgccttatctcctgacaccaagcgcttcctttctatcgttctctgtcctatgttaatcggttatggtttgaccgaaattagtgcagctgctatggttcagaaccctgcttgtttcaatttggacgattcagctggatctcttttgccttgtactgagatgaagttagttgactgtgaagagggcaactacaactctcacggacaccctcctcgtggtgaaatctggcttcgtggtccctctttgactcggggatatcttaaccgtgataaagaaaataaagaaagctttactccagatggttggttccgtactggtgatgttggcgaattgactccagaaggattgcttagaattattgatcgtaagaaaaacctcgtcaaaactcaaaatggcgagtatattgcactggagaagcttgaatctcgctatcgtacgagcagtcttgtttcgaatatctgtgtatatgcagatcagaccaaggtgaagcctttggcaatcatcgttcccaacgagcccgtcgttcgtaaacttgccactgaacaagccggtcttagtcctgatgcctcttgggaggaagtttgtcataacaagaaagttcgtcaacttgtttatgacgaccttattcgtattggtcgtagtcatcatttcgctaatatcgaacttattcaaaacgtcgtccttgttcccattgagtttacacccgaaaatggattggtgactgcagctcagaaattacagcgtcgcaaaattttggatcgtttcaagaaggaaattgacgccgcttacgccgag

SEQ ID NO: 26141 - DNA, 1255 bp, Schizosaccharomyces pombe
atggcaggctccaagtgggagacagaagaaacgaatcaattcgcaattgaaaatcaaaaattagaagaggaatggcgtaaaaagcgacggttagaaaaaaaaagaaaaagaaaaatattagaggaagaagagaaagctgaagaaagaaacattgatgcttgcaggctctacttgatggggaatacacctgaacttaagtcttgcaattctattgatgattatgaaatattggaaaaaattgaggagggatcttacggaatcgtttatcgaggtcttgacaaaagtacgaataccctggttgcactcaaaaagattaagtttgaccctaatggaattggattccctattactagtctgcgagaaattgaatcactatccagcattcgacatgataatattgtagaattggaaaaagtggttgttggtaaagatttgaaggatgtttacctagttatggagttcatggaacatgatctcaaaacattacttgataacatgcccgaagatttcttacaatctgaagtcaaaacactgatgcttcaacttttggctgccacggcatttatgcatcaccattggtatctacatagagatttaaagccttctaacttgctaatgaataacaccggcgaaatcaaactcgccgactttggattggcaaggccagtatcagaacccaaatcctctttgacacgcttagttgtgactctttggtatcgtgctcctgaacttttgcttggtgcaccaagctatggtaaagaaattgacatgtggagcattggatgtatcttcgctgaaatgattactaggactcctttgttttctgggaaaagtgagttagatcaattatacaaggtatgcgatttttgattttttattcttaccttaaaaaattcctaacaataatattaagatattcaatttgctcggttatccgactagggaagagtggccccaatattttcttcttccttatgcaaacaaaattaaacaccctacggtccctacccactctaagattcgtacttctatccctaatttaacgggaaacgcgtacgatttattaaatcgacttttaagtctaaatcctgcgaagagaatatctgccaaagaagcactagaacatccttatttttacgaatctcccagacccaaggatcctaaattttttcctacttttcctagtaaggccaaaggtgaatcaaaagaaaaaaacgtgtttcaaagttttcgtagtgcatctccaaagaagtga

SEQ ID NO: 26142 - DNA, 3199 bp, Schizosaccharomyces pombe
atggcaagacttttaactaaatcaagtcaagtatttgattttttggcagatagattatcagtacgaaaatccagacgattttgggaaacacaggaaaatttagagtcttccacacctttattacaagaaccacaacaaagttatcgtagtaatagttttaatgaattacctccgttgtctagaagtgtaacgtttgctgagaatgaacaaccaaatgaagcggtgaaattgggaacgtttgaaggttgtttcattccaactactttaaacgtactctccatccttctttatttgagatttccttggattattggagaagctggtgttcttaaaacattgctgatgttatttattagttatgcggtaggtatatttacaagtctatcgatctctgcaatttgcacgaacggtatggtacgtggcggaggtgcatattatgcggtttctagatctattggccccgaattaggaggctcaattggtttgatattctatgttgggcagatactgaatactggtatgaatatttctggttttgttgagcccattataagcatttttggaaaagaatcaggcactatttcacaatttttacccgaaggatattggtgggtctttttgtatacaacttgtgtcctcgcaatgtgttgtattttatgttgtttaggttctgccatttttgctaaggcctcaaacgccctttttgtggttataatactctcaacaatatcgataccaatctcttcgatatttgttcatcctttcaaagatccttccttactcgttcattttacgggattaaaatggtctacgctgatgaaaaatttagcatctgcttacacagaaaatgagaaaggaacaggttatgaatcttttaaatctacatttggcgtattttttcctgcaacggcaggtctactggctggcgcaagcatgtctggtgatcttaaagcaccttctcgttctatccctaaaggtactatatcttctcaagcaacgacctttttgctttatttgctagtaattttatgtgttggtgcctctgtaactcgtacgggacttttacttgatatggacgttatggaacatattagtttacatcctttattcatcatttctggaattctttctagtggcgcctttagctcgtttatgggtatatttggagctgcaaagctattacaggcaatcgcgcgagatgatttaatacccggaatgtttttctttgcaaagggttctagctacgatgatattccttatgttgcaattggagtgacttacttaattacgcaaatcagtttattttgggacatcaatatgctttcttcgatgattacaatgacttttcttctgacttttggctttatcaacttatcgtgttttctgttacgaattagtagtaccccaaattttcgacctacctttcggtatttcaatagacgcactacactggtgggtaccatcttgtcatttggcgtaatgttttacgttgatcgcttgaatgcctttatctcatttttaattgcaggaattttggtggtagtcatatatttcacatgtcctcctaaaaattggggtgatgtgtctcaaggcatcatttatcatcaacttcgaaaatacttgctgcaaactaataaagcaagagaaaatataaagttttggaggcctcaaattttacttttgattaacaacccgaatcggtcagaaaatgttatccgtttctgcaattcattaaagaaaggcatgtataccgacattttttgacaatactaacccataaattataggttccctctatatcttagggcacgttattgtatccgatgattttcaggctagcatggatgatttaagaaagcagcaacgtctttggcatcagtttgtccttgatcgaggtatcaaagcatttgttgaactaactattgctccagacgaagtttggggtatccgtggtcttatatcttctgcaggcttggggggaattcgtccaaacatagctgtgctaacatttattaatacgaattatcgtagacatcgtatatactcgggttcttctttctctcttgagaatactagtgaagaatcagaatctgacagtaaaaaagaatttgtggagcatgatatactacctgtgaagtgggtacagatattggaagacatgcttgttggttcggtggacgttatggtaactaatgggttcgatagacttaattggccaaaaagaaagggagaaaagcaatatatagatatgtttcccattcatagaatatcaggtgtggggtcagaagtcaatgaaagtacaccaacgtttgcgacgaatttcgagacgtatactatggtttttcaacttagttggatccttcatacagcttcagattggaaacaaggttgtaggctacggcttatcactcttgttgaattcgagaatgaaatagaggcagaacgagaaagcatgcatcaaatgctagaaacgttccgtatcaaagccgacgttgtagtgctctgtcttgctgcaatgaatttggatgcatataggtacattgtcaaaaatgagcatgtgagacctagcaagtcttccgagcttgaaaacttactgaaagatgactcgtggtggcaggaagaaaagaaaagaagaggaaatactgtagattccttaggacctattcgttttccacgtcgtatgtctggttataactttagatctgccagctttgataagagtgctccacctttaagtgtgccattgagtttccgccttgggccacatatgcattcagtaaagtcgtttgagactgaatcttctttcggaaaccgttctttatcaccaaaacaagaaaatagaagaacttattctgacagtactattgagtcatctctgatgcccaacgtggtccgagaagatagttcatctgatagactagcaccaaagaaaaaaataggaagggactattctaaagagaagttgacgtttaacgatttatcctcgagatctcaatacataattatgaatgaaatcgtgctgaaacatactaaaaatacttctgtattgtttactgttttaccagcacctttggccgacactcataagagctttcgaaaaagcgaggaatatgttgatgacttattaatatttatggaaggattacctccttgtgcattaatccactctaagagtttaactataactaccgctctttaa

SEQ ID NO: 26143 - DNA, 3999 bp, Schizosaccharomyces pombe; identical to SEQ ID NO: 25836

SEQ ID NO: 26144 - DNA, 687 bp, Schizosaccharomyces pombe
atgtctcaatttccggctttagaagactttgacgacggtttggttaccgctcctgttgatgactctaaaaataatactgatttcttggaacgcgaaaagttggcacttggagaggatgctggacaattcgaaacaccggaggataaagacgcgttgttgaattttgaaaatgattcggaagctgaacaaactagatttgaacagaactttcctcccatagatgctgaaatgcaagcctctggtaccttttccgctccgaaagctccttacatgggtcaagccgaagttcatccccctgaagacgaaagcggtgaccccgaacccgttcgcaagtggaaagaggatcaaatgaaaaggatccaagaaagagatgagtcttccaaaaagttgcgcgaatctaatatcgagaaggcccgcaaggctattgatgatttttatgagaattttaatgataagagagataaagtcattgccaagtcgagaaaagaacaagaaaaactgttggaagaaaatgaaagcaaatctactggaactacgagctgggagcgtatcctgaagcttattgatttatccgataagcctgaggctcatggccgctctacagaacgctttcgtgaacttctcatcagccttgcaaaagatagcaatgctcctggtgctgccggcacaactgtatcctcttcttct

SEQ ID NO: 26145 - DNA, 2178 bp, Schizosaccharomyces pombe
atggatccaatacgttttggactttcgagagtaccattcgctcactgctacaataaacgcgtaatatttcgagcaaactatttagtaccgttgacttggttgaaaaacaacgtggcttacaaaagtacgaatactctattacttcccacgccaaatgcagaatattatagtaccagtaagttatcttcacaggttaatgtgagcctaaactcgttatctcaaaaggcctcaagtggttctaagatatatccttttaaaaatagttttccgttacctttttctagatctattcttcctatacgatcacttgcttttttaaagttgtgtgtgcgacataattctacagttccatcaaaagatgagcaagcacaggatatctcaaaaataaatacaaatggtacattacaaacaccaaacaagaaagtcaatgtttttcgtctcttcacactagcaaggggtcagggatggaatttttttattgctggatctcttctcttagtttcctccggcgttacaatgtccattccctacattgttggcaaaatcttagacgctggctcgtcaggcgattcttctgtcacgcatatcatgggaattccttctggtacgttttatattggtttgttgggtttatttttccttggttcagcttgtaactttggtagaatcatcaccttgcgtctactgagtgaaagaattgtcagtcgtcttcgagcacgcttgtttgctaaatgcatgtcattagatggagcattttttgactttcataaacatggggatctcatatcccgtcttacgacggattcgagtattgtcggtaagtctttatcaatgtacttaagtgatggtcttcgtagctcagttagtgcaattgctggaatagggatgatgctctacgtatccatgagactcactggatatatgtccctaattgtacccccaattgcattgggagctttcttttatggagagtatgttcggaaactttccaggactacacaagatgctctcggtgatttaacaagggtttcagaagagaaactcgcaaatgttcggactacacaggcttttctaggagaaagacaagaagtaaatcgttacaacgattacattcgaaatctctttgtcctggcaaagcgagaggcttttgctagcggtattttcttcgggtcaacagggttccttgggaacgcaactgtaatcgctattcttgcgttaggcggaagaatggttgctgcaggtgatataactgtaggacagctaagttcatttttgctgtataccgtttatgccggtggaagcattgttggcttatcaggatgttttactgatattatgaaaggtctgggagctgctagtcggttatttgaacttttagatgctaaaccgaagatagctccaaccgttgggattcccgttccagtcacagtcggaaaggcaatactttcgttcagaaatgttgggtttgcatacccaactcgtccttcagcttcaatatttgataacttatctttcgacattcatccaggcaccaatgttgctatagtcgcacctagtggcggtggaaaatccaccatctcacagctccttttgcgcttttacgcacctagtagtgggaaaatattagctgacggagttgacatctctacatataatgttcatcaatggcgcagtcattttggtttagttggacaagaaccggttttattttctggtacaattggcgaaaatattgcttacggtaaatctaacgcatctcaagaggaaatcgaagatgctgccaaacgagcgaattgtagttttgtgctttctttcccggagaaatggtctacgcaagtcgggactcgtggtttacaactaagcgggggacaaaaacaacgcattgcaattgctagggcacttcttcgaaatccagcatttttaattttggatgaagctacttcagcattagacggtgaagcagaagtaatggtggataaaacgattcaatctttgatgcataatcgtagtatgactaccattacgattgctcacaaattggctactattcgccgagctgatcaaataattgttgttggagacgggaaagttttggagcaagggtcttttgaacgattgtctcgtcctggtaccaacttttacaagttaatgagatggcagcttggaaaagttgaacct

SEQ ID NO: 26146 - DNA, 1422 bp, Schizosaccharomyces pombe
cgttttgataaattcatgctaacaacatttagtgacattgaaggtttgttacgggttgtattcatattaaattaaccacatgcagttcatccaaatgtcgataaaaagtcttttattagatggcgccaacgtgatatccacgaaaaacgggctgttagaaagcaaaaaatggaagatatcaaaggtgcaatggcgatgaatcgtagactcttgtctcgcatctccgaaatggagactgttcttgagaaggaatctccttcggatccttatgttttattgggttcatttttagaggcaaaaaagtctgaagatatggatagtgccattcctggaggcatgtcgtatcatcatatgcctatgtctttattaaaagtaattaaagatgccgaagacactaccgaagaaaaatctatggatgattcggataaatgcttgagacgattaaagtcacacaaagagcgtcttctgaagttgctagaagatgcacaaaaggagtatgatactttagaggctgagagtaaaaattacatcacttctgaagacttgcatttgggctttgattccacctatgttcagaaaaaggagcctgaaaaacctaaaaagactaaaaccaaaaaggagaccatccaggtcattgaatctcttaataaccctacacctcctactgattttcccggcgctaaagagcaagcttctactggtaatgcccctaaaaatcctgtcaatgagaatgagtcggaagatgaagaagggttgtctctttctgaagatggtaagaagtttgccaatattgattttggtgattattcttcatcggaagagtttttgaaagaacatttaaatatcttggcagatgaggaagaatctgatgctattcttttggaagcctttaatgctgaactagaagggaagccgtccttagcaaaacaatatgttcatcaagcccttttgatcagctattgcagacagcttggaccaaatggtttatcaatattttttcaaaaaattaaagacccaaatcaccaatctcagcggctatttttagaggatgttcataatacatatgtccgaatccatgaacgttctgctgccatcagcaaagaacaagctgaaagcggtgaaggagtagaacaaatccagctctgtgcagttgatcctaatacgaaactttccatcaccatcccggaggcaggttctactgatccagagacacaaaaagctcgtgcagcttttgagtcttttcctcctaacctccaaaaagctcttatgaccaatgatttagacaagattaatgtagttcttggaaaaatggcagttgaaaatgcagaagaagttgtggaaaagctcagcagtactggtatgttgagtatcgaagaaggaatcatcgacacaacgaaaggtgagactattcctcaattgtct

SEQ ID NO: 26147 - DNA, 3147 bp, Schizosaccharomyces pombe
atgaattcgggtacgacacttcatctggacagacttagtttggagacgccatccgaacgtacttgtttttgtattaaatgttgggaagtatgtgaggttcaaaatttaatcgccgtgtccggagagcggtcttttcacaaaacgagaccctgtcttgaaattggacactgctcttttattttttcccagctgtaatgaacggcatttactaacttttgctctagagtgttcccagtacctctcaagtttggttcggtgggaaatgttggcattccgattggtatgattgaaaatgcaaacgttgggatttttggatcttttttttttcttatagattgaataaaaaaatataaaatgctccaaagattacccttgtttgtgcttcttgttgttttgatttactaattaagacggtttgctagttttaaatgtgtgaactgcaacaaaaaattagacccttcctctgaagatttttctcaagacgatcaaaagcaaatattctgtaaattatgtgttgatatctgcaacggttgctcaactcctatttgcgagttcaacgcagtaagcaatagtcaagctaatcatccttgttgctccaattgtcgagctttcattaattcaaatgcttttggcaagttcaaaggtcaacattactgccttccttgtttgcgtaaacaagatgaagagaatcaaaaggctgttatggaaagcgcatcagggtttattcctcttaggaatatcgcacaaactgcggaaaacacttctttaactggtaagtttgttgcttatgtagtatttattgatattgtctttatgtttctaactttaattttagggcaaaaccaaggctttcaaaacccgcattttatagcgtctgattctccatcctccgtattatctggtcgaatgcaaaataccagctctcctacaaactctctccgtcctcaattaaaagttcaaactaatggttatgaaacacctggtgatataaactccgcaaaatcttacaaagacatccaaaaggacttcttacttaaacccaaaaattctttcgttaaaacctctccctctccactagctaatggtccctcatttcgttcagctaatgcctctccatttgattcgtgtgactcttttcattctggaagttcgataccaattgaaccagtttcttcaaggcaaagctcagtagtaaataataatagcgtgcagcaacctgttgcttatcacgcctttgttcaatcaccaaccgaaaatggtacgcttcctcaacttcctaaaaatgaaagcgttgttaatcctcctccacttcgccgctcttctactatgaattacaaatctgtttcgacaacaacatcaccatctaaatatggatatgtgtctggcagaatagctctatctcctatccatttaaggggtgctcttcgtgatgtcacaaataaatgtaatttaaaggttcctagaaatcgaaacagtttatctaatcttgacgaatattacgttaacggattggaaagcgacgaaactcctacaaaggctagatttcctagatatcctacggtatttaataagttagatgacaaacgacttagtagcgaaccaaacggcttgaagaaaagattgacgaactcttcaaattatgaggcttccccgcgggccaaaagtttaaatttgtcgcaagttagtttgcatcaagcatgtgaacctgaatacaatcgaagttctttggttagagcaagtgatgtgtttacttcaaacgtatttgatgctacagaggaaagcgcaaatgaactcgccattcgtatttcagagcttcaagctgaggttggaaccttattgttggaagcgacttcgttggcttctatcatagagcagcagactcccgtgtcccccgaagctttcaagcaagagttggttgcagatttaaattatagattagattatttacggaaatcttttcaacctgaactgtctaccttacttttgaggcgagacgctttgtctacgactgtctctaaattgcaaaacgcttacagcactgtaatggaagaaaccgcatatctgaatgttaagaacacagaactggtaagccttaacaatcaattggagagagaattggcatacttgagggagcagcagcataagaagcgaacttcttcctctttcggaatatttaataatgataaaaaatccaaccgaacgatttcaaccccgtctccgcgagaatcgttttcgcgtctacaaatggttgcatctagccttggatttagacccaaagacaataaagacaaggagagtggagggtataacaaacggaactctaaaatagatcttaagaagtcattttctaaacggtttcattggaaaagagattctcctcacatgtcgagtactcccagtatttctgaagaacatttagcttctgaagaacaagaggatttcgttccagcggtcggtcactgcaaactttgcggtaaatactccaatgagcttagagcacattatcaggattgcgttagttctactatagatcgtcagtatcaatctaaaaaaagcgaatctcctgtttgggctttgaatcctgacgacttcgatcaaaacaggctaacactcttgagagtcccgacgcttatcgtttcttgtataaattttatcgagtcatacggcatggattttgaaggtctgtatcgcaaatcaggggcaacttctcaaatgaaaaaaattgttgcgttactaagaaatgaagatacggtacttgatccaagtgaggatatttctgctgtcacttctgtattcaagcaatatcttcgcaaccttcctaatccaattattacctatgaccaatactttccgttcatcacagcagcaaattgtgcctctttccaagataaattagacggttttataatggtcatcaaaagtcttcctccagctcatgctgaaattttgcagctcattattagacatttagcaagggttgctgcatatagtcatgcaaatcgaatgacatccaagaaccttgcagtagtattttccccaacattaatacgcgaccccgataattccagagacgttattgacatgactgttaagaattacagtcttgcgtttttgatagatcatgtacatgaagtctttgcctaaatt

SEQ ID NO: 26148 - DNA, 3027 bp, Schizosaccharomyces pombe
atgcttcgtttcataccctcttcagctaaagcaagggctttacgtcgtagcgccgtaactgcctaccgtctcaacagattgacgtgtctttcttctcttcaacaaaatcgtacctttgctactcaacctactgatgattttttgactggaggcgccgccgattacgtagatgaaatgtatgatgcatggaaaaaagatcctaacagtgtacatgcatcttggcaagcatatttcaaaaacgttcaggaacgtggagtttccccttccaaagcttttcaggctccacctttgctggactatgctgattcttatactgctttggactcttctctcattaatggtaataactatgctgatatcgatgttggtatttacatgaaagttcagctcttggttcgtgcctatcaatcccgtggtcatcatttggccaagctcgatccgcttggcatcaacgttaaccacaaccgtccttccgaattaacacttgaacattatggttttacggaatctgaccttaatcgcacaattcatctgggtcctggtattttgcctaactttcgtgaagctggccggaaaaccatgactttacgtgagattgtggaaacttgcgaaaaaatttattgcggaagctttgccgttgagttcactcatatttcctcacgtaagcgctccaattggatactgtctcacttagagactcccactcctttcagatactctcatgatcaaaaaattatgatttttgatcgtctgagttgggctgatagttttgaacgtttcctgttcaccaagtttcctaacgataagcgctttggcctcgaagggtgtgaagccatggttcccggtatgaaagcgcttattgatcgttctgttgatgagggtattagtaacattgttattggcatggctcatcgaggtcgtctgaatcttcttcacaatattgttcgtaagcctgctcaagctatcttctcagaatttcgtggtacccaggatcctgacgatgagggatctggtgacgtaaagtaccatctaggtatgaattatcaacgtcccacaccatctggtaaacgtgttagcctgtctcttgtagctaatccttcacatttggaagccgaggatcctgtggtacttggtaaagttcgtgctatccaacattatactagtgatgaggctagtcacgaacagtctatgggtattttgattcatggtgatgcggcttttgctgctcagggtgttgtatatgaaacatttggtttacatgctttacctggctacagcactggtggtactgttcacattgtcattaataatcaaattggatttactactgatcctcgttttgctcgctctaccccctactgtacggacattgccaagtctatggaggctcctattttccatgtcaatggagatgatgtagaggccgtcactttcatctgccaacttgcagcagattggcgtaaagctttcaaaacggatgttgttgttgatattgtttgttaccgtcgacatggtcacaatgaaaccgatcagccttctttcacgcaaccaagaatgtataaggctattgccaagcatccccctacgtttaaaatatacacacaacaacttttacaagaaaagacggtttcaaaagcagaagttgacgcacaagagaagagagtctgggacattctcgagagctctttcgagagcagcaaaaactacaagtctgaccatagggaatggttatccaatccttgggttggttttgcatctcctaaagatttaatgactaaaatccttccttcttatcctactggtgtaaacatcgatacattgaagcaaattggcaaggcattgtatactcttccggaaggttttgatgcccacagaaatcttaaaaggatcttgaacaatcgtaacaagtcaattagctcaggtgaaggtatcgatatgccaaccgccgaggcattggcctttggtactcttttagaagaaggtcatcacgttcgtgtgagcggtcaagatgtcgaacgtggcacattttcccaaagacacgctgttttacacgatcagagttccgaaaacgtttacattccattgaatcatctaagccctaatcaagcaagctttgttattcgtaactcttctctgtctgaatatggtgttttaggttttgagtatggttactctttgtcatcacctaatgctcttgtcgtctgggaagctcaatttggtgattttgctaacaatgctcaatgtatcatagatcaatttattgcagctggtgaaactaagtggcttcaacgtaccggtatcgtactttctttaccacatggttatgatggtcaaggtcctgagcactcttctgctcgtatggaaagatatttacaattatgtaatgaagaccctcgagagttcccttccgaagagaagttgcaacgtcaacatcaagattgtaatattcaagccatttatgttactaagccatcgcagtatttccatgctcttaggcgtaacattcaccggcaattccgtaaaccattagttatctttttctcaaaatcattacttcgtcaccctgctgcccgttccactatcgatgagtttgacgaaaagcatggatttaagctgattcttgaagaggaggagcatggaaaatctattttaccacctgaaaagattgaaaagctgattatctgctccggccaagtttgggtcgccctctctaaagctcgtgaagaaaacaaaattgataacattgctattactcgtgttgagcaattgcatccttttggctggaaacagatggcagccaatatttcgcagtatcctaatttgaaggaaattatttggtgccaagaagagcccctgaatgcaggtgcttggacttacatggaaccacgtatttatacaattttgaagcaccttggacgtgatttgccagttcgctatgctggacgtccgccatctgcaagtgtcgctgctggaaacaagcagcagcatttggctgaacaagagcaatttttgaatgatgccctactt

SEQ ID NO: 26149 - DNA, 1220 bp, Schizosaccharomyces pombe
atggctttggacctccggattgggaacaagtatcgcattggtcgtaaaattggcagtggatctttcggagacatttatcttgggactaatgtcgtttctggtgaagaggtcgctatcaagctagaatcaactcgtgctaaacaccctcaattggagtatgaatacagagtttatcgcattttgtcaggaggggtcggaatcccgtttgttcgttggttcggtgtagaatgtgattacaacgctatggtgatggatttattgggtccttcgttggaagacttgtttaatttttgcaatcgaaagttttctttgaaaacagttcttctccttgcggaccagctcatttctcgaattgaattcattcattcaaaatcttttcttcatcgtgatattaagcctgataactttttaatgggaataggtaaaagaggaaatcaagttaacataattgatttcggattggctaagaagtatcgtgatcacaaaactcacctgcacattccttatcgcgagaacaagaatcttacaggtactgcacgctatgctagcatcaatactcatttaggtattgaacaatcccgccgtgatgacctcgaatctttaggttatgtgctcgtctacttttgtcgtggtagcctgccttggcagggattgaaggctaccacgaaaaagcaaaagtatgaaaagattatggagaagaagatctctacgcctacagaggtcttatgtcggggattccctcaggagttctcaatttatctcaattacacgagatctttacgtttcgatgacaaacctgattacgcctaccttcgcaagcttttccgagatcttttttgtcggcaatcttatgagtttgactatatgtttgattggaccttgaagagaaaggtatgagatatcttggtaatagtgctttttttattttctgggtttccgagttattgaaaaccaatgtaatatgatattttatgaagtttacatagtcacatttactaacatttaaattgtagactcaacaagaccaacaacatcagcagcaattacagcaacaactgtctgcaactcctcaagctattaatccgccgccagagaggtcttcatttagaaattatcaaaaacaaaactttgatgaaaaaggcggagacattaatacaaccgttcctgttataaatgatccatctgcaaccggagctcaatatatcaacagacctaattga

SEQ ID NO: 26150 - DNA, 1134 bp, Schizosaccharomyces pombe
atgagttctactgcccttcttccccctaacactgaccaggttttgtctcgccgtcttcacggcaaagctgccgagaaaaagactggtttggccgccattgcttccaaagacgttgatgagcaaagtaggaaacttcaagaatattttgagttttgggatcgcaatcatgaaaacgaatctgaggaagatagagcacgtcgtattgatggctataagtcggtagttaacagttattacgatttagctaccgatttgtatgaatatggctggtcgcaaagtttccatttctcccgtttttataagggagaagcctttgcccaaagtattgctagacacgagcattacttggcgtatcgtatgggtataaaacccggttctcgtgttttagacgttggatgtggtgttggtggacctgctcgtgaaattaccgagttcactggttgcaacttggttggtttgaacaacaacgattaccaaatttccagatgtaacaattacgctgtcaaaagaaatcttgacaaaaaacaagtttttgtgaagggtgatttcatgcatatgccctttgaggataacacatttgactatgtgtatgccattgaggctactgtacatgcgcccagtctagagggtgtttatggtgaaatattccgtgttttaaagcctggtggtgtcttcggtgtatatgaatgggttatgtcagacgactacgacagcagtattcctaagcatcgtgagattgcatacaacatcgaagttggtgatggtatccctcagatggtgcgtaaatgcgatgcagttgaagccatcaagaaagtaggctttaatttgcttgaagaagatgacttgactgaccatgacaatcccgaccttccatggtattatccattgactggtgacattaccaagtgtcaaaacatttgggatgtcttcactgttttccgcactagccgcttaggaaaactagttactcgttacagcgtccagtttttagagaaaattggagtcgctgccaaaggaactagtaaggttggtgacacccttgctatcgctcaaaaaggattgatcgagggtggtgaaactcatttgtttactcctatgttcctcatgattgctaagaaacccgaaacggacgca

SEQ ID NO: 26151 - DNA, 2509 bp, Schizosaccharomyces pombe
atgagaaggtctggtacatcgcttagtcgtgatttggagcggaaaattcatgaacgtttggtttctttgaaagataccattcaacaaacagaaattgaagagtggccagtttctactcgtcgggctattcaatttgttcaagaaagggacatgtctcttcgaagaattaagaagccaatccttgaaaaagttgtcgaaaaagttttagacacattgaaggccgaagtggaggaaaaattagcttcctctcaggatttagtacttgttgatagcgacatggaagaacaatctgactcaaacttgatggaagttaaggtatgctttgctgctcttttgcatttttatgaaaaccatttttactaagtattatttacaggataccaatgtgattaacaaaagcatcactagtctttggagctctccaaacttgaaagaaatagatggagaagatgagaaaaagtctgttggtcaggaatcgattactggatctgccaaaagaaaagatcgtcgatccaagactaatggttcaaagcgtcaaaaaggtttgttagaatttattttagtggaaaagtgatttatataaactaacacttttttaaagcggaagcgaatagagaaccaccaagtgacatttctttgagtgatataggaggactagatgattgtattaacgaattgcttgagctagtcgcaatgccgatcaagcatcctgaagtataccaatatactggaattcatcctcccaggggtgtactgttacatggtcctcccggttgtggtaaaactatgttagccaacgcattagccaacgaattgggtgttcccttcatctctatatctgctccctctattgtttctgggatgtccggcgaatctgaaaaaaaagttagggaggtctttgaagaggctaaatcgttagccccctgtttgatgtttatagatgaaattgatgccgttactcccaaacgtgaaagtgctcaaagagaaatggaacgtaggattgtcgctcaattccttacatgcatggacggtatgtatttaatatcgttttttctagcttactaacagttcagaactttcttttgagaaaactgatggcaaacctgtcttggtaattggtgctactaatagacctgattcgttagatagtgcattacgccgtgcaggaagatttgacagagaaatatgcttgaccgtcccaagtcaagacgctcgcgagaaaattttacgtactatggcaaagggtttgaaacttagtggagattttgacttccgtcaattagcgaagcagacgcctggttatgtgggtgccgacctaaaagcactcactgctgctgccggcattatagcaataaaaaggattttcaatgaaatttctccgctgaacaaattggaccttaattctgatcccagatttaatgaacttgacagtgatatggccttagattcaaacgacagcttaccccttgatcattcttctataattcaaagatatttgaatgctcatcctgatccactatctccagaggaacttgaaccactcgctatttgtccacaagattttattgaagcactcgccaaagttcaaccttcgtctaaacgtgaaggatttgctaccgttccaggtgtttcttggaataatattggtgcactaaaatcaattcgtgtcgaattacaaatggccatcgttcagcccatcaaacgtccggagctttaccaaagcgttggtatcagtgcacctacaggcgttttactatggggtcctcctggatgtggtaaaactctgttggctaaagcggttgcaaatgaaagtaaagcaaattttatatccattcgtggtccagaattgcttaataagtatgttggtgagtcagaacgtgcagtgcgacaagttttcctcagagcacgtgcatcttctccatgtgttatcttttttgatgaattagatgcgatggtacccaggcgtgatgactcactgtcagaagcctcgtcaagagttgtaaatacccttcttactgaactggacggtcttagcgatcgttcaggagtttatgtaattgctgctaccaatcgaccggatattatagatccagcaatgctgcgtcctggtcgtttagataaaacattgcttgttgatttaccggatgctcatgaacgggtggagattttaaaaacgttgacaaaacagacgcccttacacgaagaggtaaatttggatgtacttggtcgagatgaaagatgcagtaatttttcgggtgcagatttggctgcccttgtgcgtgaagcagctgtgacagctctgcgatcagccgtttttgcagatattgcttcaaatgaaccagaaattacacaacattcagcattagagccaattcgtgtgacaaatgctgactttgagttagcattcaagaatatcaagccaagtgtctccgatcgcgatcgacaaaagtaccaacgactggcaaagcgttggtcttcggcaagtacaaatgatgctgactagattgaa

SEQ ID NO: 26152 - DNA, 1294 bp, Schizosaccharomyces pombe
atgaactctaacaacaaaagagttgcgcttcaagaaataagcaattatgtttccaaatcattgaacgtaaaaggctgggtgaacgcacaggtacgagaaatatcccttcaaaatgggtgtagcccatcagataaacattttccgtcacagagctggcatggaattagttcaattgaagagtcgcaaatacaaaaggactatgatagttttttagcgtcacctttagaggaagagatagtctttacggagaaacagcttttggtagatttggatgtttgctcgatcagtaacgttcaaagtcctaattgcagtgtttcggaatttggcatagcgattgaagaatcaaatgacaattgtgcagaggaggatgaagaggaggaattacagatgagatattcagcagatgaatcggtgtctgtggaatacgcaaaagaaatcctatcgcacatggagaaattggaggtatgaaaaaaatgggaagaaaagggggaaggaaaacaagaagatgaaggagttgaagaagtttttatttattaacattttttagattcgatttatgcctgattaccgacatatgtcggctcaaccatattatgttacagagatgagggctagtgtgatcaattggattgtgggggtgcatacatgtataaacctgcttccagaatccttattcctatcgatcaatgtattggatagatttctatctctacaaaatgtgccagcatcgaaaatgaaactttgcggcgcaacggcgctgtttattgcttgcaagtatgaagagatccatcctcctacagtgaaagatttggaaatagtgttggagggagaatggataggagaagatatttgcggaatggaaaagtatatgcttatggttcttcaatatcaacttgggtggccggggccagtatcgtttttgaggctattgacgattgtcaacaaatgggagtcgcagctgcgaataatgataaaatattttcttgaagtatcgctagtggaacaaagattttcaagtctaagggcgagtcaattggtagcgacatgcgcctacaccggccaatctatattgcaagaggaaaactggagcaatacgttgcctcaaattacgggatatgattatatgagtttagtttcgtatgtgcatctactgttgaaatgtctagaaaatccgtttgatcaccactatgcgatctattcaaagtatgcaacaccgtatttccatgggattagtcgacaagtgcatgactggattgcgacaaatacgaacttgatggcgatggatggtagttga

SEQ ID NO: 26153 - DNA, 1083 bp, Schizosaccharomyces pombe
cttaccactttaccattacgaactctctcgcgttggtggggatatgttaatcgtattgagattcctctatggatgagagtgccagcgtttggcctttattctaaaatatttggttgcaacttgacagaagctgaccccgatgatgtccgccaatacaaaaatctggccgagtttttcaccagaaagttgaaacctggagcgcgcgtaattgatcccgatgccccaattgttattcctgcggatgggaaaatcttgaattatggtgttattgaaggaggtcagcttgaacaagtaaaaggtataacctattcccttgatgcactattgggcgatgagaagttagctcgtttgaagcgcagccatgctattccctctcccgatcatatccctcacattcgtcaagaggagtttgccaagttaaatggtatacattacagtttacaagatttaatgggtcatgatcatggtgaacgaccaagccatgtcaaagatgctagcgcacaacatattgatttgttaagctcaacaaaagtggcagccaaatcacagtttacgttgttcggatcaagagaaacgaattgtttatactacgcagttatttacttggcaccaggtgattaccatcgatttcattcgccgactgattgggtcgtagaacgaagaaggcatttttccggagagctgtttagcgtttctccttttatggctcgtcgactcggaaatcttttcatcttgaacgaaagagtagctttgatggggagatacaaatacgggtttatgagtatgatacccgtcggtgctacaaatgttggcagtatccgaattaaatttgataaagatttatgtacgaatcagtttggaaaactaggcccagtaggtacttttgatgaggctgtatacacctcatcttcttctattttgcatggtcacccattacttcgtggagatgaggtcggaaattttgagcttggtagtacagtggtattggtgtttgaagcacctgcggattttgaatttttggtcaaacaagggcagaaagttcgtgtgggattacctttgggtcgagttgtcccatcttcccat

SEQ ID NO: 26154 - DNA, 4001 bp, Schizosaccharomyces pombe
atgtcctacgcaaattatcgttatatgaaagcaagagcaaaacgatggagaccagagaatttggatggaattcaaacatcagacgaacatttaataaacctttttgcaaaaatattatcgaagcatgtaccagagatagggaaattcgatcctaataaggatgttgaaagttacatttcaaaacttgatcaacactttactgaatacccttcattattcccaaatgagcatactaaaagacagtatacattgaatcacctagaagaattagagcaacaattcgctgaacgcatgttttctgagaatggaagtcttacatggcaagaattactcagacaaacagggaaagtacaaggatccaacaaaggtgatcgtttaactaaaacatttgaaggttttagaaatcaattggacaaagttcaatttataaggaaactcatgtcaaaagcaaatgttgatgatttccatactcgcttgtttatattatggatgctgccatattccttaaggaaattaaaggaaagaaattactggaaatcagaaatcagtgaaatttatgactttttagaggacaaaagaacagcttcgtatggtaaaattcacaagcgttttcaactgcaaaataaaaatctaggaaaagagtccctttcaaagaaaaataacaccactaatagcagaaacctgaggaagacaaatgtttcgagaatagaatactcatctaacaaattcctaaatcatactaggaaacgttacgaaatggtattacaagctgaacttccagacttcaagtgctcaataccctgtctaatcgatacgggcgctcaagcaaatattataacagaagaaactgttcgagcacataaactgcctaccagaccctggtcaaaaagtgtgatatatggtggagtttatccaaataagattaatcgcaaaacaataaaacttaacataagtctaaatggaatatcaatcaaaacagaattcttggttgtaaagaaattttcgcatccagctgctatctccttcacaacattatatgacaataacattgaaatatctagcagtaaacacacgctctctcaaatgaacaaagtttcaaatattgtcaaggaacctgagttaccagatatctataaagaattcaaagacattactgcagaaaccaatacggaaaagctaccaaagccaataaaagggttagaatttgaagttgaactaactcaagaaaactacagattacctatcagaaattacccgctaccaccgggaaaaatgcaagctatgaatgatgaaattaatcaaggattaaaaagtggaattatacgagaatctaaagccattaacgcctgtccagtaatgttcgttccgaaaaaggaaggcaccttgagaatggtggttgactacaaacctttaaataagtatgtcaaacccaatatatatccgttaccacttattgaacaattacttgctaaaatacaaggttctacaatttttactaaacttgacctcaaaagtgcctatcacttgatacgagtaagaaaaggagatgaacataaacttgcttttcgctgtcctcgtggagtttttgaatatctagtaatgccttatggcatatctacagctccagcacattttcaatactttatcaatacaatacttggtgaagccaaagaatcacatgtagtatgttatatggatgatattttaattcattcaaaatcggaatctgaacatgtaaaacatgttaaagacgttctacagaaattgaaaaatgcgaacttaattatcaatcaagcaaaatgtgaatttcaccaatcacaagtaaaatttatagggtatcacatttcggaaaaaggatttacgccttgtcaagaaaatatagacaaagtcttacaatggaagcaacctaagaatcgtaaagaattacgacaatttctaggttctgtcaattatcttaggaaattcattccaaagacatcacaattaacacatccactcaataatcttttgaaaaaggatgtacgctggaaatggacaccaacacaaacccaagcgatagaaaacattaaacaatgtttagtttctctccggtgctacgacactttgatttcagtaaaaagattctactggaaactgatgcttcagatgtcgctgtaggagccgtattgtctcaaaaacatgatgatgataaatactatcctgttggatactattcagcaaagatgtctaaagcacaattaaattatagcgtatcggacaaagaaatgcttgcaatcattaagtctctcaaacattggagacactatttagaatccactatcgaacctttcaaaattttaacagaccatcgaaacttaattggtcgcattactaacgaatccgagcctgaaaacaaacgtttagctcgttggcaattatttttacaagacttcaactttgaaattaactacagacctggatcagcaaatcacatagctgatgccttatccagaattgttgacgaaacagaaccaattccaaaagattcagaagacaatagtatcaactttgttaatcaaatctcgataaccgatgattttaaaaaccaagtggttacagaatatacgaatgatacaaaattgttgaatttactaaacaatgaagacaaacgagtggaagagaatatccaactcaaagatggcttactaattaacagtaaagaccaaatcttattacctaatgatactcagctgactaggacaattattaaaaagtatcatgaagaaggtaaattgattcatccaggcattgaacttcttacaaacattatattacgtagatttacgtggaaaggaataagaaaacaaatacaagaatatgtacagaactgccatacatgtcaaataaacaaatctaggaatcataaaccttatggacctttacaaccaattcccccatcagaaagaccttgggaatctttatcaatggattttattacagctttaccagaatcatctggttataatgcacttttcgtggtagttgaccgattttcaaaaatggcaatcttagtaccttgtacgaaatccattacagcagagcaaacagctcgaatgtttgatcaacgagttattgcttatttcggcaatccaaaagaaatcattgcagataatgatcatatttttacttcccaaacgtggaaagatttcgcacataaatataatttcgttatgaaattttcgttaccatacagaccacaaactgatggacaaactgagcgtacaaaccaaactgtggagaaattactaagatgtgtatgtagcacacatccgaatacatgggtagatcatatatccctagtgcaacaatcttacaacaatgcgatacattcagcaactcaaatgacaccttttgagatagtacatcgctattcaccagctttatcacctttagagttacctagctttagtgacaaaactgacgaaaactctcaggaaacgatccaagtatttcaaacagttaaagaacacttgaatacaaacaacataaagatgaaaaagtatttcgatatgaaaatacaagaaattgaagaatttcaacctggagacctagttatggtcaaaagaacgaaaacaggttttcttcataaatccaataaattagcacctagttttgcaggaccgttctatgtgttacagaagtcgggtccaaacaactatgaattggatcttccagattcaatcaagcacatgttttcatctacttttcatgtttctcacctagaaaagtatcgacataattcagaactcaattacgctaccattgatgagtctgatattggaacaattcttcatatcctagaacataaaaacagagaacaagtactctacttaaatgtcaagtacatttcgaatctaaatccgagtactattatgtcaggatggactacattagctacagcgctacaagcggacaaagcaattgtcaatgattatattaaaaacaataatctaaatatctga

SEQ ID NO: 26155 - DNA, 702 bp, Schizosaccharomyces pombe
atggcgcaaattcgacaagaagcattgaaaaaacaaaagtctgagacgcaaaaatcaacagaagggttcgttgatattggaaatttggctcaatggacctgctcgagcgaaaaatccggatttcctatacgcttggtgcgggatgataatatcgatacatattggcagtaagtgtatttgtataaatatagtcagggaagaaaatgttttactaactataattttctttgtctttaaggtctgacggctctcaacctcataccatccatattaaatttgtaaagcgagtatcgattaagtatgtgagtatgtaccttcaatacacccttgatgaatcttatactcccagtactttgcgaatatcagctgggacagggtttcaagatttggaaattgttacaacagttcaagtcgaggaaccaactggttgggtacatgtgccagttggtgattttgggcgaaatggcttgttagatgtgcatttaatacaaatcaaaatacttgcgaaccatcaaagtggaaaggatagtcatgttcgtttgataaaaatatatgcgccagaaatgtacgtattttgcatagcaaaatcttcattaatataaaatgtgctaacactgatgcagagagcagcccgcgatagctgtggatgaaattccctacacaagtttacaattcataagtagaaaccaattacggtaatgc

SEQ ID NO: 26156 - DNA, 702 bp, Schizosaccharomyces pombe; identical to SEQ ID NO: 26155

SEQ ID NO: 26157 - DNA, 1113 bp, Schizosaccharomyces pombe
atgtgtgcaaagaaaatcgtcgtcttaccaggagaccatattggccctgaaattgttgcttctgccttggaggttttgaaagtcgttgagaagaagcgacctgagttaaaactcgagtttgaagaacacaagattggaggtgcctctattgatgcctatggaacccctttgactgacgagactgtgaaggcttgtttggaagctgacggtgttcttttgggtgccgttggtggtcctgaatggaccaaccccaattgtcgtcctgagcaaggtttattgaagcttcgtaagagtatgggtgtttgggccaaccttcgaccttgcaactttgccagcaagtctttagtcaagtacagccctttgaagcctgaaatcgttgaaggtgtcgatttttgtgttgtacgagaacttactggaggttgttactttggtgagcgcactgaggacaacggatcgggttatgctatggacacttggccttacagtttggaagaagtttctcgtattgctcgtttggctgcttggttagctgaaacttccaaccctcctgctcccgtcacattactcgacaaagctaatgttttggcaacttctcgtctttggcgcaagactgtagctaagatttttaaggaggaatatcctcaccttaccttaaaaaaccagctcattgactccgcagccatgcttttggtcaagagccctcgtacacttaacggtgttgttttgactgacaacttgtttggtgacattatttcagatgaggcttctgtcattcctggtagcttgggccttttgccttctgcctccctttccggtgtggtaggaaaatcagaagaaaaggttcattgtttggttgagcccattcacggtagcgctcccgatatcgctggcaagggcattgttaatcctgttggtacaattttatctgcttcccttctccttcgttatggtttgaatgctcctaaggaggctgaagctatcgaagccgccgtacgcaaggtcttggatgatacttcaattggtggacgtggtctttatactcgcgatttgggaggtgaggcttctaccgctgatattactaaggctgttgttgaagaacttgaaaaaattttg

SEQ ID NO: 26158 - DNA, 4514 bp, Schizosaccharomyces pombe
atgtccattgatgcggatttctccgactatgaagatgaagcgtctggagacgaaaacgttttacctaacacaaccaccaaaagggtatgcaagtgtttgtggaatttattattattttaaaatactaacaacttttttagaaagcatctacaacatcctcaaagtctcgcgccaagaaggcaagcactcctgacttaaggcaaactagcttgacatccatgacagcttctgaacagataccactagttaccaacaacggaaatggaaattctaatgtatctacacagtaccagcgtcttacaccgagagagcatgtgctaagacgtccggatacatacattggcagtattgagccaacgacttctgaaatgtgggtctttgactctgagaagaacaagctggattacaaagcagtgacctatgttccaggcctttacaagatatttgacgaaataattgtcaatgctgctgacaacaaagttcgcgacccaaacatgaataccctaaaggtgactttggatcctgaagcaaatgtcatatcaatttataacaatggcaagggcattcctatagagattcatgataaagagaaaatttacatccccgagcttatttttggtaacttgcttacttcaagcaattacgacgataatcaaaagaaggtaacaggaggaagaaatggttacggcgcaaaactttgcaatattttttctactgaatttgtcgttgagacagctgataaggaaaggatgaagaaatataaacaaacttggtatgacaatatgtccagaaagtctgagccagtgatcacttctctcaagaaacccgatgaatacacaaaaattacattcaaacccgatttagcaaaatttggtatggacaagattgatgatgatatggtatctattataaaacgccgtatttatgatatggcaggtaccgttcgtgaaactaaagtttacctgaacaatgaacgcatcagtataagtggatttaagaaatatgtggagatgtatcttgcttctgacactaaacctgatgaagagcctcctagggtaatttatgaacatgttaatgaccgttgggacgtggcctttgctgtttcagatggacagtttaagcaggtttcgtttgttaacaatatttctaccattcgtggaggtacacatgttaattatgttgccaataaaattgtcgatgctatagatgaagtcgtcaagaaggagaataaaaaggcacccgttaaagcgtttcaaataaaaaattacgtacaggtatttgtcaattgtcaaatagagaacccatcctttgattcccaaacaaaggagactctcaccacgaaagtttctgcttttggctctcaatgcacattaagtgataaatttttaaaagctatcaaaaaatcttctgtagtggaggaggttttaaaatttgctaccgctaaggcagatcagcaactcagtaagggcgatgggggtttgcgttctcgtataacgggtttaaccaaactcgaagacgcaaataaagcgggtaccaaagaatcccataagtgtgtccttatcctcactgagggagattctgctaaatctttagctgtttcgggtctcagtgttgttggtagagactattatggagtttttccgttaagaggaaaactactgaatgtacgggaggcttctcattcccaaatcctaaataacaaagaaattcaagctatcaagaaaatcatgggattcactcataaaaaaacttataccgatgtgaaaggtcttcgttatggtcatttaatgattatgacagatcaagatcatgatggatcacatattaaaggtttaattattaattatttagaatcctcgtatccttctcttttgcaaattcctggattcttgatccaatttatcacacctatcattaagtgcactcgtggcaatcaggttcaagcattttacactttacccgagtacgaatactggaaggaagctaataacaatggacgtggttggaaaattaaatactacaagggtttgggaacaagtgaccatgacgatatgaaaagttatttttcagaccttgatcgtcacatgaagtactttcatgccatgcaggagaaggatgctgaattaattgaaatggcatttgccaagaaaaaggccgatgtgcgtaaggaatggcttagaacgtatcgacctggtatatatatggattatactcaacctcagattccgattgatgacttcattaatcgagagcttatccaattcagtatggctgataatatccgttcgattccttcagtagtagatggcttgaagcctggtcagcgtaaagttgtctattattgttttaaacgcaatctcgtccatgaaactaaagtcagtagacttgccggctatgttgctagtgaaactgcataccaccatggcgaggtttcgatggagcaaactatagttaatcttgcccaaaattttgttggcagtaacaacattaatttgctgatgcctaatggacaattcggtacacgatctgagggtggaaaaaatgcatcggcttcaaggtatctaaatacagctttatcacccttagcacgtgttttatttaattccaatgatgaccagcttcttaattaccaaaacgacgaaggccagtggattgaaccagagtattatgtgccaattcttcccatggtacttgtcaatggagccgaaggtattggtactggctggtctacttttattcctaattataaccctaaggatataactgctaatttaagacatatgcttaatggcgagcctttggaaattatgactccctggtaccgcggctttcgtggaagtataacgaaagttgcgcctgacaggtacaaaatatctggtataattaaccaaattggtgaaaacaaagtagaaattactgaattgcctatacgattttggactcaggatatgaaggagtatctggaggctggtcttgttggtacggaaaaaattcgtaaattcatcgtggactatgaaagccatcacggtgaaggaaatgttcactttaatgtcacgcttaccgaagctggcatgaaagaagcattaaatgaatccttggaagttaagtttaaactgtcgcgtactcaagcaacgagtaatatgattgcttttgatgcatctggacggatcaagaagtatgacagtgttgaagatattttgaccgagttttacgaagtacgtttaaggacataccagagacgtaaagagcatatggttaatgaattggaaaaaaggtttgatagattttcaaatcaagcgcggtttattcatatgattatagagggggagcttgtagtttcaaaaaagaagaaaaaggatctcattgtggagctgaaggaaaagaagtttcaacctatcagtaaaccaaagaaagggcatttggttgatttagaagttgaaaatgctcttgctgaagaagaacaatctggtgatgtttcgcaagacgaggattcagatgcctacaattaccttctttcaatgcctttatggtctttgacctatgaacggtatgtggaacttctcaagaaaaaggacgaagtaatggccgaactggatgctttgattaaaaaaactcctaaagaattgtggcttcatgatttggatgcatttgagcatgcttggaataaggttatggatgatattcagagagaaatgttagaagaagagcaatcctctagagattttgtaaatcgaacgaaaaagaagcctcgaggtaaatccactggtactaggaaacccagggctattgccggatcctcctcaagtactgctgttaaaaaagaagctagcagcgaatccaaaccatctacaacaaatcgaaagcaacaaactttacttgagttcgcagcgtcgaaagaacctgagaaatcatctgacataaacattgtcaagacagaggataactctcatggcttatcagttgaagaaaatcgcatatctaagagcccgggattggatagcagtgatagtggaaaatcaagaaaaagaagtcaatctgttgactctgaagacgcaggtagtaaaaaacccgtcaaaaaaatagcagcctcggcgtctggaagaggaagaaagactaataaaccagttgctactaccatattttcttcagacgatgaagatgatttgttgcctagcagtttgaaaccttccaccataacatccacgaaggcttctgcgaagaataaagggaaaaaagcaagctcggtaaagaaacaatcacctgaagatgacgatgatgattttattattccaggtagtagttcaactccaaaagctagttcgactaacgcagagccaccagaagattcagattctccgattagaaagaggccaaccagaagagcagcggctacagtgaaaacacctatttacgttgatccctcgtttgatagcatggatgaacccagcatgcaagatgattcttttatcgtcgataacgatgaggatgtagacgattatgatgagagtgattag

SEQ ID NO: 26159 - DNA, 1633 bp, Schizosaccharomyces pombe
gatacaaatggcaaccgacaggttggccacaaggcccagatgtcaaatatacaagctgcgaaggctgtcgctgatgtacggtttttttccatcctcttaagctttaaactgaggtttgttatatattacgttgctgacattataggttattcgaacatgtttaggcccgagagctatgcttaaaatgttgctcgatccagttgggagtgttttgcttacaaacgatggacatgccattttacgtgaaattgaagtcgcacatccggctgctaaaagcatgattgagcttgcgagaacccaagatgaagaagttggtgatggcactacttcggtgattatattggctggtgaaatattggccgctgctagtccattgcttgatcgtaaaattcatcccgttgtcatgatccgctcgtttaaacaagctttggaagatgcattatctattattgatgagataacgttacccgtgaatgtcgatgacaatgctgaaatgtttcgtcttattcgaacatgtatcggcactaaattagttgcgagatggagcgatttgatgtgtcatcttgctcttcgtgctgtccgtaccgttgcttctacttcaaatggtagaatggaaatagacattaagcgttatgcccgtgtggaaaaggtcccaggtggtgaaattgagtcaagctgcgtattagatggtgttatgcttaacaaagatgttacacatcccaaaatgcgtcgtcgcatagaaaatccaagaattgtcctgttggattgtcctttagagtaccgaaaaggtgaatctcaaactaatattgaaatttccaaagacaccgattggaaccgtattcttgaaattgaagaagaacaagtcaagcgtatgtgtgattatatcattgcagtaaaacctgatcttgtcatcactgaaaaaggtgtatctgaccttgctcaacactacttgttaaaagctaacattactgctctgcgtcgaacacgtaaatctgataacaaccgtattgctcgtgcgtgtggtgccaatatcgttaatcgtcttgaagatttacgtgagaaggatgtaggtacaggctgtggcttattttacatcgataaattaggtgatgagtattatacctttttaacaggctgtaaaaatcccaaggcatgtactattttactacgtggaccaagtaaagacattattaatgaggttgagcgcaatttacaggatgctatggctgtagccagaaatgtgttcttccatcctaaactttcccctggcggtggtgctactgagatggctgtcagtgttcgtcttgcggaaaaggcacgttctattgagggcgttgcccaatggccttaccgagctgttgcagatgctattgaaatcattcctcgtactttagttcagaattgcggtgccaatccaattaaagcacttaccgaacttcgcgcgaaacatgcggaaggtcaacatagctttggtattgacggggaaactggtcgagttgtcgacatgcatgagtacggtgtttgggaacctgaagccgtcaaattacagtcaattaagaccgcgattgaaagtgcttgcctcttattgcgcgtagacgatattgtttctggtgtacgcaagcactccgaataa

SEQ ID NO: 26160 - DNA, 552 bp, Schizosaccharomyces pombe
atgtttgtcacccccattgaacacgcggttcaaaaaagaaaaaaacaaaaacaaagggtttgtttaaatttacaaaggaactgatctaatggatgatagagcgttgtcgatccagttactcgtgaacgacaattaaaacgaaaccttgcagacttggagaaggataatttttcggacattagatttgaaatcccaaaagatttgcgtatgtaatctgatctatgatacgtctgctcaatctaacttgttacagttcagagacgagttctacctataagtgttcgacgaattctatcttcgaggaaaacattcgttaattaccttgatgaaactgtatgcaaattgtaagctgattttatttactctaaccatatatagccaaatagtaggtataatacctgtgttgcaaaaccgtcttacaaacctccgcgaaaattctgtaatgtatgtggttattggggaaaatatgcttgtcaaaattgtggaactagttattgctcaaaagggtgtgaggttatacattctgaaacaaggtgtatgaaagtatatgcc

SEQ ID NO: 26161 - DNA, 2712 bp, Schizosaccharomyces pombe
atgtatactactacactttcagtccagggtatgacatgcaccagttgtgtggcctctatccaatccatgttggaaggagtggaaggaattgaacaattcactatatcgttgcttcttgagcgtgctattgccgttcatgatcctagcattatctcaccggatcagatcgctgagaaaattgaagattgtggatttgatgcgtctgtgatttcttcaacagagggtgaacatggtgtcatggctaattatttattactttctcctatgcaggcggaacaatggaccaaagtacataatcatatcaatgaactgcaaggcgttttgtccgtcaattgctcttcctccccggatgcagctatacgtgtcatttatgattctgagattactggccctcgttccatcatgaaggaaatattatctatgggtgtcaaatgtacatttcaaccagtagattcctccacctctcgtattctgtcacttcaacgagggagtcaaattagagtatggaaaatccgatttattatttcaatatcattctctttggcggtgatgtttttaccccagatattcgattcttgtgattccatgcgtgctgcttttttggtcccccattattttggtatatgtgctggccacatcatcagcctagtattatcccttcccgtccagtttggtgttggaagggtctactattctgccgcatatcatgcactgaaaagaggaacagccaatatggatgttttagtatctttgggctccactgtagccttcgctgccagtatctttttcatgattctctacagcgctagacatgctgataatcctgctcctatattttttgataccgctgatatgctattgacgtttgttacgttaggtcgttatttggaaagtaaagctaaaggttctacatcagctgctctttctcaactgttgagccttgctccttccagtgcaacgataatagaagacaatgaacaaattgagatcttagctgatctcatcgagcgtggagacctcattctagtcaagcctggcgaaataatccctgtagacggtacggttgttgaaggctcttcctacgtcgatgaaagttctgtttctggagaacccgttccagtgcataaaacaattgacgatgaacttttgagcggaacagctaacgggaatggacgactgcttgtaaaagcaacaaaatcacctagagaatcacagttagctgtgattgttgatcttgttcagagggctcaaatctcacatgctcctatccaacaatttgccgatcgcgttgctggaatttttgttccagtaattgttgctctttcaatttcaacttttacattttggtttttattcactaaatattcttcaaaatacccatcggtgtttgatgatccaatgggaaagtttgcagtttgcctaaaattgacaattagtgtcgtcgttgtcgcctgcccatgcgcactggggttaagtacccctacagccgttatggttggaaccggtgttggtgctctgaacggtatcatcatcaaaggtggtgaaattttagagcgtctaaatcaggttgacactgttgtctttgataagacaggcacacttacagtgggtaagctaagtgtcaccgacataagcattgtagataatttggaggaattacttgacattcctaagaatattttttgggcttttgttaaagcttcagagtcttcaagtgaacatccaattggaaaagctattactgagaaagcttcagaatttaccgatgtttctgaaattggaattgaatcattcaatgctgtgccaggtgaaggtgttgatgttgtacttaggtggaaagagcggacttttcatgctttgcttgggaattcactgttactggaacataacaacgtgtcgatacctgatgactttgattcaaagctgaagctttcttctagtagtgggcttacttgtgttcgtatcgctatcgatggccagtttgtaggtttcttgggctgtatggaccaagtgcggcccgactcgtaccaaactgtatccgctttaaaacaattaggtaaaaaggtttgtttattgacgggtgatcaaaaagccactgcccgacgcgttgcccaaggactagaaatcgatttctctgatgtttacgcggaagcagttccctctcaaaaggctgaaattattcagaagttaaaagatcagaagcattgtgtcgctatggtaggtgatggtataaatgattcgccttcacttgtgttggctgatgttggcattgctcccattaatggatcaggcattgctttagaaagtgcagatgtaatacttgtacgtaaaggcgttctacttgataccgcagtatcctttgatttgtctagagttatcgttaaaagaattaaaatgaaccttgtgtgggcttgcatatataactttgtcatgattcctattgcaatgggcttcttccttccatggggaatctacttaaatcctatgtgggctagtgctgctatgatgttttcttctcttagtgttcttgcaagtagcttacttctcaggagatggaaaaagcctaagagccttatattcagtgaagcagatgatgttgaaacagagagttcaactaattctagtgtattacagaaggtatacacagcgacaaggtcgatatttggtaggaataagtcgagcaacaaataccagccagtggctaatgaagtc

SEQ ID NO: 26162 - DNA, 558 bp, Schizosaccharomyces pombe
atggccaataatgtggacacaagatccgccaatacgaactcacctactaccaccaccagcttttcttggtttacaaacaatatgttacaaacacgtttaggacttggagcacttcgtcaaggacgtcttctttttgcagttaaatcttttagcacaaccagtgttgcgaaaattttccctcctccccctcagaccattaagggaactgttaatgatgctgctgttttccctcaccacagtaagctccacggaagctatcattgggactttgaaagaattattgctattgccatggttcctcaagtcatgatccctttgttcaccggaacttctcatcccttaatggacgctgcattggcttgcaccttgattacgcatgcccacttggggtttgaatcttgtgtgattgactacttccctgcaagaagatttaagaagttatctcctttgatgcactggatcttacgtggatgtactgttcttacacttattggcgtctatgagttcaacacgaatgatattggccttacggagggtattaaaaagctttggaaatct

SEQ ID NO: 26163 - DNA, 1371 bp, Schizosaccharomyces pombe
atgctgaggcttcagaatttgccaaagctagtacgtcgttttgcgactactgctttaccaaaaacagaaaccactactttaaaaaatgggcttacagttgctacggaacatcatccgtatgcccaaacagcgaccgtccttgtgggcgttgatgctggctcaagagctgagacggcaaaaaataatggcgctgctcactttttggaacatttggcgttcaaaggaacgaaaaatcgctcccaaaaagcattggaattggaatttgaaaatactggtgcacatttgaacgcatacacctctcgtgaacaaaccgtttattatgcacatgcgttcaaaaacgctgtacctaatgcagttgccgttttggccgatatcctgacaaattcaagcatttctgcctcggcggttgagcgtgaacgccaagtcatcttaagagagcaagaagaggttgacaaaatggccgatgaagtagtctttgatcatttacatgctaccgcttatcagggtcatcctcttggacgtacaattttgggtcctaaggaaaacatcgaatctcttacccgtgaggaccttctccagtatattaaggacaactaccgtagtgatagaatgattatctcttctgccggttcgatatctcatgaggagcttgtaaagctcgccgaaaaatattttggccatttggagccttcagctgagcaattgtcgcttggtgctcctcgtggactcaaacctcgtttcgtcgggtctgaaatccgtgctcgtgacgatgattcaccaactgccaacattgccattgctgttgaaggtatgagttggaaacacccagattactttactgcattagtcatgcaagccatcattggtaactgggaccgtgctatgggagcatctccccatttgtcttctcgtcttagtactattgttcaacaacatcaacttgccaatagcttcatgagtttcagtactagttatagtgatactggactttggggtatttatcttgtcactgagaaccttggccgtattgatgatctcgtccactttaccctccaaaactgggctcgtttaaccgttgcaactcgtgctgaggttgaacgtgccaaggcacaactccgtgcttcgcttttactttctttggattcaacgaccgccattgcagaggacattggtcgccaattgcttacaactggtcgtcgtatgagccctcaagaggttgatctccgtatcggtcaaatcactgaaaaagatgtagcccgcgttgcttccgagatgatttgggacaaggacattgctgtttctgctgttggttccattgagggtttgttggactacaaccgtattcgtagcagtatttctatgaaccgttgg

SEQ ID NO: 26164 - DNA, 1299 bp, Schizosaccharomyces pombe
atgactagcgcattttatggcggagatgaagtttcagctattgtaattgatcctggaagcaaatggactcgaataggtttttctggagaagatattcccaaatgcgtactccctagctactgtggagagttcagtgatggcagacggttgttcggtgaggaatacatatataaatcaaaccctggaatggaaataaaaaatgcaattcgtaatggttgggttgaaaattgggatgttactgtagatctctggcgttatggattagagcagcagttgaagactaatcctttagagcatccaatcttgattacggaaccatttgataatcccccagaaaatcgagtgaaaacactagaaacgatgtttgaatctttgcgttgtcctgcaacatacctcgccaagcaggagacgtgtgcggcgtttgcaagcgggaaaggtactgcttgtttagtagacattggtgcggagcgtagctcggtgtctgctatatatgatggttttgtgcttcaaaaaggctatcaggttcaacatttttctgggaatgcaattaacgatattttggcgcaaactctcagggataagaatttcgaagtgatgcctaagtacttagtgaaaagcaaaaatccagtggagatagggcagccagctaattgtgagttacgtcctcgtgatactacagattcttatcatcaatttcaggtccagcgagtctacgatgaatggaaagaagaatgtgctctcatttccgatgttccattttcatctgaaaccacgattgctgaatcagagttcgaatttccagacggttcccgtatgatgtttggcgcggaacgctatcaaattcctgaacatttgtttgtgccaggaagtgatgaagaaatgaacgaggaaccttcgaagccaatagaacaaaccgaaaataatgaggtatcacaacaagattcttcggttaccaacacttcttctcgcattttggggatacctcagttgttccagaactgtatttcggaatgcgatgttgatatccgtgcttctttgctcaacaatgttattgtttgtggaggcactagtttgatgcaaggattctctcttcgtctgcaaaatgaactttcaaaattatatcctggcagccgtcttaaaatccatgcttccggtcatgttgttgaacgcagttatgcttcatggttaggtggatctattttaagtagtcttggaacgtttcatcaattatggatatcacgtcaagaatatgaagaacatggttctgatcgtttggctttaatcgaaaaacgatgtaaa

SEQ ID NO: 26165 - DNA, 2712 bp, Schizosaccharomyces pombe; identical to SEQ ID NO: 26161

SEQ ID NO: 26166 - DNA, 552 bp, Schizosaccharomyces pombe; identical to SEQ ID NO: 26160

SEQ ID NO: 26167 - DNA, 891 bp, Schizosaccharomyces pombe
atgggtttaccagttcataaccagccccataaagcacactcgggctctcccgcatctaccttttccgctgctctggtttcttctgccattagcaatgttattgggtatcctcttgactcgattaaagttcgacagcaaacttacaatttcccaaccattcgctcttgtttccaaaacgctgttaaaaacgagggattaaaaggtttgtatcgtggtcttactctaccattgatatcagccactctatcgaggtcagtatcatttacggtgtatgattccttaaaacttacatttgctcatgtggatcctacacttcggtatttcatttccgggcttgggactggtacttttatatcactttttgcttgtccattcgagtattcaaagttatattcacaaattgacatgcttcttcgcaaaacaaatatgggccgtcggcaagagacaaattccaagctaagtgtcagacctcccttgtcatctttccagagcgcttctgacattgttcggaggtatggatttactgcattatggaatgggtatcgttatcatctaaccagagacgctctaggatcggcttgttattttacaatatacgaaacctttaagaaaaatctgatagcgaatgatgtgaagccgcattttgcttatgccttctctggtgctttttgcggcgctttgtcttggattttggtattcccggtggatacagccaaatccattgtacaaagaaatacactcttatcaattaaaacccctttgtcttccattccttggttatcgtttactatatatcgaggtataggtatttcattgatgcgaagcgctcttataaattcttgcaattttacgctttttgaattatttcgggaaactaaagtattaagcaaa

SEQ ID NO: 26168 - DNA, 1482 bp, Schizosaccharomyces pombe
atgttatcagaataccagtgtctaaaaaacatcgggttttcgcacaaaacggtattaaaacggaggctatttagaaaagaatgtacaccggcattaaaatcattttacagcactcaagaccctgcattaaacgaggtccgaactgaaaagcttaaaaatggtgtaacatatgtttgtgatccaagaccagggcacttttctggtttaggggtttatgtgaaagctggttcaagatacgaaacaaaaaaattctctggtgtgagccattttatggataggcttgcgtttcaggctactgagcgtactcccgttggagaaatgaaagcaaaactagaaaatttaggaggtaactatatgtgttctacgagtcgcgaatccatgatataccaagcagctgtttttaatgatgatgttaagtcaatgtccaagctattagcagaaaccgttttggcaccaaaaatacaagaagatgatctagttcattatcgtgatagtataatatatgaaaactccgagttgtggacgaaaccagatgctctactcggagagtttgctcacgttacggcattccaaaacaacacgcttggcaattgtctattgtgtacacctgataaagtcaacggtattactgctacttcaattagggaatacttaaaatatttttaccgaccggaacaccttactttggcgtatgctggaattcctcaagaaatagcaaaagaaattacgaaggagctatacggacatttacccagctcttctctacctccactggaagctataccttcgcattatactggaggctttatgggaattaaaaaatcggaagcacctcctgttccataccaacaggagtttacacatgttgtcattgctatggaaggattacctgttaccgatccggatatctatgctttggcatgcttacaatttctattaggtggaggtggttcatttagcgcaggaggtcctggaaaaggaatgtattctcgattgtacttgaatgttttaaatcagtatccttgggtcgaaacatgtatggctttcaatcatagctatacagatagcggtcttttcggtatgtttgttaccattttagatgatgcagctcatttagctgcaccactaataatacgtgaactctgtaatacagttttgtctgtcacctctgaggaaacagagcgggctaagaatcagctaaaaagctctctattaatgaatcttgagagcaggatgatctcactagaggacttggggagacagatccaaactcagaatggtctttatattactcccaaggaaatgattgagaaaattgatgcattgactccatccgatttaagtagggtcgcaagaagagttctgacgggaaacgtttccaatcctggaaatggtactggaaagccaacggtactcattcacggaaatgtggatgaagttggagatgtctttgctctttgtaaaaaagctgggattggtcat

SEQ ID NO: 26169 - DNA, 1482 bp, Schizosaccharomyces pombe; identical to SEQ ID NO: 26168

SEQ ID NO: 26170 - DNA, 1251 bp, Schizosaccharomyces pombe
atgacggaggtgctgaagactaacgttttacagagtaatgagaacatagttcaggtatgtaatagttatttaattaattgttaacataaaatgtagtattatacccaaaaaattcaagatgctgaacttgctattctccaaaagacacaaaatttacgacgattagaggctcaaagaaacggactaaatgcaagagttcgccttctaagagaggagattcagttgcttcaggaacccggaagttatgtcggtgaagtgattaagacaatgggaaagaacaaagttctagtcaaagtccatcctgaaggcaaatatgtcgttgatattagtccagatattgatattaaggagattaaacctaatattcgtgtagccttgaggaacgattcataccaattaattaaaatcctccccaacaaggttgatccacttgtctctctcatgatggtcgaaaaaattcctgactccacttatgagatggttggtggtcttgaaaagcaaatcaaagaaattaaagaagttatcgaattaccagtgaagcatccagaactttttgaaagcttaggtattcctcagcctaaaggtattcttctttatggtcccccgggaaccggtaaaaccttgttagctagagcagttgcccaccataccgattgcaaattcatccgtgtcagtggatcagaacttgttcaaaagtatattggcgaaggtagtcgtatggttcgtgaactatttgttatggctcgtgagcatgctccttctattattttcatggatgagatcgactccatcggctcttcacgatctgattctagtggtggaagtggcgatagcgaagttcagaggaccatgttagagctgttgaatcagcttgatggatttgaagcaaccaaaaatatcaaggtcattatggccactaaccgtatcgacatcttggatcctgctcttcttcgtccaggtcgtattgatcgtaaaattgaattcccacctccatctgctgaggcacgtgccgaaattttgagaatccattcgaggtccatgaatttaacacgtggcattgatttgaagagtatagcggagaaaatgaacggtgctagtggtgccgagctaaaaggtgtttgtactgaagccggtatgtttgcattgagagaaagacgtgttcatgttactcaagaagattttgaattagctgttgctaaagtattaaacaagggcgattctggagaaatgagtttacaaaagcttttcaag

SEQ ID NO: 26171 - DNA, 1317 bp, Schizosaccharomyces pombe
atgccggaatacgagattcaggtgccttcttatagagctgctgcattaaccgccgaagaacgtacacgattacttgcaagacccattcagaacactcaaaaaattcgtacgattgtccaaccgataatcgaggatgttaaatcaagaggagaagcttctctaatagattatgcttccaaatttgaaaaggttcaattgaagtcggctgtcttaaaggctccgtttgacgacgacttaatgaaaatatccccaatgattaaagaggatattgatattgcttttaacaatatttttgctttccattcatcacagctgcgtcctacaattgctgttcaaaccatgcgtggtgtagtctgtcaacggatgtctcgtcctattaaccgagttggtctttatatccctggaggaactgcagtgttgccatctactgctttgatgcttggagttccggcgaaggtagctggctgtcctcatgtagtgatttctacgccagtccgaaaggatggtacggttgcgcctgaaattgtatatattgcaaataaaattggtgctgaggctattattttggcaggcggggcgcaagcaattgcggccatggcatatggaatatccggtgttcctaaagttaacaaaatttttggccctggaaatcaatttgttacagctgcaaagatgcatgttcagaatgattacggggctttagttgctattgatcttcctgctggtccctcagaagttttggtaatagcagatgagacctgtaatcctgaaagtgttgccttggatttattgtctcaagcagagcatggtttggacagtcagatcattttgctgactgtctctctatctcccgaaatgtttgaccgtattcaaaaagcaattaatgatcacgctttacgactttctcgttcgtatatcatcaaacatgctatcaagaagtcggttattgtacaggttgacaatgttgatcaagcttttgaatggtctaatttgtatggtcctgagcacttggtcttgcacttaaaaaatgcttcttcatacattcccaaaatagataatgctggtagcgttttcgttggtccttggtcacctgtaagtatgggtgactatgcgtctggtaccaaccatacgcttcctacatacgggtacgcctcttcttattctggcgttagtaccgatagcttcttaaaatatatcactacccaagagctcactgaagaaggaatccagcggttgggccctactgttattcgtcttgctgagttgaagggtctcactgcgcatgccgatgctgttcgtgttcggggagttagactt

SEQ ID NO: 26172 - DNA, 976 bp, Schizosaccharomyces pombe
gaggttgtgtatgctagtcgggtcgcagaaacattcgttgagcagcttaagcaacatgttaacctttttgaatttgctcccaaactcgttgggtttctctcaaattctgatcctgctgctcgcatgtatgcgggtaagtgcctctaaaaatttaacgttcctgcttctaatcatgaacaatttagattggacaaacaaaacctgcacagaaattgggtttcagtatgaattgcgtgaagtgccaaaggatgatctggaggatgcaatcgttgaagcaaataatgatccatctgtaaatggtatcatgatctatttccctgtttttaacgatgggcaggatcaatatttacagcaggtggtctcccctgataaggacgttgaaggtttgtgtcataagtatgtgatgaacatgtatcataatatcagacatcttgatcctgagaaaactaaaaaatctatacttccatgtacacctttggcaattgtcaaaattctcgaatatcttggtgtttacaataaaatcatcaactacggaaatagactttatggcaaaaccattactatcgttaacagaagcgaaattgtgggccgacctcttgcagctttgttagcaaatgatggcgcgaaggtctactctgttgatattcacaatgttcagtgttttactcgtggtgctggaatacgtagcaaaaagcacgatgttgctgatacaaactttaagcttgaagacgtagcacctatatctgatgttatcatttgtggtgtcccttctgccaattacaaattcccttctaaccttgtccgtgatggcgctgtttgcatttgcttttctagcgagaaaaattttgacgcggcgtctctcaaggaacacgctggtatatatgttcctagtattggtaaggttactattgccatgctcttgagaaatctcattcgccttacttcgtatcagctcaataagcccgtcgacatctag

SEQ ID NO: 26173 - DNA, 2202 bp, Schizosaccharomyces pombe
gatcatcaagagtttgaaagtgaagatgataaatatcgtagaaattcttattctagctggtctggaagtaatttcgagtcttccaatggatctaatcgtcggcggtatcgaactcaaatggaagaacctttatcctcaaaacgcagaaatcggtttggtaatggttctcgaagagacgtcgatagctctaaatattcgcacgatagtgattattcttatggtgcacacagctcttgggatgcccgcgacgttgagtaccccgaagaagatcccgagagtaaagctgatcgtcaacgttgggaagaggagcaagctcacttggatcgtgattggtacatgaattccgagtcgcaaaatttacttggcgatgaagttcacaatccattctccgattttgaaactgtcgaagatcgtgcacatgaagctgagtttatcgaaaagcagaaaaagcatttgtcaattgaagcatcagacagatttaaagaaaattctatgtgggaaaaaaatagaatgatcacatctggtgtttcaaaagctccagggctcgaatctgattactcccttatggaagagaggcgtgttcacttgcttgtcgatgaactgcgtcctcattttttggatggggccgaattttcttctaagaaagtcggtgatattacatcggttcgagatccacaaagcgaccttgcaataaatgctagattaggatctcgtcttgtacgtgaacgaagagaatttcgggagcgtcaaaaagcagcaagtgctgctacatcccttgctggtacatctttgggtaacgtgatgggtctcaaagattctaatgatgaagatgccaaggccggtaccacacctgttaaagtagctggacgttctgaacagtcgaataagaaggatactgagttcgctcgcacgaaatcatatagagaacaaagagagttcctacctgcctttgccgtgcgtgaacagcttctttctgttatacgtgataaccaagttcttattgtagttggtgagactggttctggtaaaactacccaattagctcaattcttatatgaggatggctatcatagaaatggcatgatagggtgtactcaacctcgtcgtgtcgccgccatgtcagttgcaaaaagggttagtgaggaaatgggtgttcgtctaggttcaacagttggttattcaattcgtttcgaagatgttactggaccggataccgtaattaagtacatgactgacggtgttttactaagagaatccttgatgcaaaataatctagaaaaatatagcgtcattataatggatgaagcacatgagcgatcccttaatacagatattttaatgggtttactaaaaaaggtgttatccaggagaagagatatcaagttgctcgttacatccgctactatgaattcccagaaattctctgatttttttggaggcgccccacagtttacaattccaggtcgtacttacccggtggatattatgtttgctaaagccccttgctctgattacgttgaagcagctgtacgacaggtattgcagattcacctctctcagcctgcaggtgatatcttagtttttatgacagggcaggaagatattgaagctacatgcgagatcattgcagataggttaaatcagttgcatgatgcaccacgcttgtccattttgcctatctactcacaaatgcctgcggatttacaagcaaaaatttttgattccgccgagccaggtgttagaaaggttgtggtcgcaactaatattgcggaaacttcgctcactgtgcacggaatatcatatgttgtagatactggatattgtaaactgaaaatgtataattctaagttgggtattgatactctgcaagttacacctatttcgcaagctaatgcgaatcaaagagccggtcgtgctgggcgtactggacccggtattgcatatcgcctttataccgaaatggcttatattcgtgaaatgtttgaaacgaccttacctgaaattcagcgtaccaatctatcaaacacagttcttattttaaaatcccttggtgttgaagaaatttcggattttgatttcatggaccgtcctccaaatgatacgttaatggcatctctgtatgaattatggactttaggagccctcgacaattttggaaaacttactactttaggaaagaaaatgtcgttatttccaatggat

SEQ ID NO: 26174 - DNA, 1338 bp, Schizosaccharomyces pombe
atggcggaaaatcttgatatttcagaattgtcaccgattcacccagctattatatctagacaggcaacgatcaatattggtacaattggtcacgtagcccacggaaagagtacagtggtcaaagctatttccggtgtgcacacggttcgtttcaaaaatgagttggagcgtaatatcacaatcaagctgggttatgctaacgctaagatttacaaatgttccaatgaagagtgtcccagacccggatgttaccgttcctactcttccaacaaggaagatcaccctccttgcgaaatttgtaattctccgatgaacttggttcgccatgtatcgtttgtcgattgcccgggtcacgatattcttatggctactatgctgaacggtgccgctgtcatggacgccgccttattgctgattgctggtaatgagtcctgtcctcaacctcaaactagtgaacacttggctgccatcgaaattatgcagttaaagcacataatcatccttcagaacaaagtggatttgattcgcgaatcagctgctgaggaacactatcaatctattttgaagtttattaagggtaccgttgctgagaactctcctatagtccctatttctgcccaacttaaatataacatcgatgccattctcgaatatattgttaagaaaattcccattcctgtccgtgactttaccactgctccccgtttaattgtaattcgttcttttgatgttaacaagcctggtgctgaagttgatgaccttaagggtggtgttgctggtggttctattttgactggcgttcttcgtttaaatgatgaaatcgaaattcgtcctggtattgttacaaaggatgatgatggccgcatcagatgccaacctattttctcccgtattatctccctattcgctgaacacaacgatttgaaaatagccgtgcctggtggtttgattggtgttggtacaacagtcgatcctactctttgccgtgccgatcgtctagttggtcaagttttgggttccaagggcaaccttccagaagtttataccgagctcgaaattaactactttttgctccgtcgtcttttgggtgtaaagagtggtgataaaaacaccactaaagttcaaaaacttgccaaaaacgaagtgttgatggtcaacatcggttccacttccactggtggccgtgttatgatggttaaagcagatatggcaaagatccttcttaccgccccagcatgtaccgaaattggtgaaaaggtggctctcagcagacgtattgaaaaacactggcggcttatcggttgggctaaggtggttgagggtaagactctaaaagtt

SEQ ID NO: 26175 - DNA, 3555 bp, Schizosaccharomyces pombe
atgacttctaaatatgatgcgttgttgcacaatcaaagtaccaacacaaaccctttcagcaagttgcaggatcgttcctccttgttaggagagaagtttaccaaggtgttggtagctaatcgatctgaaattgctattcgtgtcttccgaactgctcatgaactttcgatgcacactgtcgccatttactcgtatgaagacagactgtcgatgcatcgtcaaaaggccgacgaatcctatccaattggcaaggtcggtcagtacagtccagtaggagcttatctggctattgacgaaatcgtcagcatcgccaaacgcaccggtgccaacttggttcatccaggatacggtttcctttccgaaaacgccgaatttgccagaaaggtaaacgaagctggcatgcaatttgtaggcccctcccccgaagtcattgactctcttggtgacaaaacgaaagctcgtgcaatcgccattcgctgtggtgtcccagtcgttcctggtactccaggtcccgtcgaacactatgaagaagctgaggcttttgttaaggaatatggcctccccgttatcatcaaggctgccatgggtggtggtggccgtggtatgcgtgtcgttcgttctgccgataccttgaaggagtcatttgagcgtgctcgttctgaggcccttgcttcatttggtgatggcactgtgttcattgaacgctttttggataaacccaagcatattgagattcaacttatggctgataaggctggaaatgtcattcatttacatgagcgtgattgttccgtacaacgtcgtcatcaaaaggtcgtggagattgctccggccaaagatttggatcctaagatccgtcaagcactttatgacgatgccatcaagattgccaaggaagtgaagtattgcaacgccggtactgcagaattcttgctcgatcaaaaaggacgtcactattttattgagattaatcctcgtattcaggttgaacatacgattactgaggaaattaccggtgtcgatattgtatcggctcagttgcacgttgctgctggttttacccttccagaaattggtttgacccaagataaaattagcactcgcggctttgctattcaatgccgtgttaccactgaggatcctaacaatggctttgctcccgacattggtaagattgaagtttatcgttccgctggtggaaatggtgtccgtttggatggtgctaacggtttcgcgggttctgtcattactcctcattatgactctatgctcgtcaagtgtacatgccatgatgctacatatgaatatacccgtcgtaagatgattcgttcattaatcgagttccgtgtccgtggtgtcaaaaccaacattccttttgttttgcgtttattgatgcacgatacttttatccaaggaaactgttggacaacttttattgatgacactcctgaattgtttcaactttatcgttcccgtaatcgcgctcaaaaacttctggcctacctcggtgatcttgctgtcaacggcagctctattaagggccaaaatggtgagccagctcttaagtcggagattgtcatgcccgttttgttagacagtacaggaaatcaaattgatgtttctcatccatctgaaaaaggttggcgtaaattattgttagacaacggtcctgctgcctttgccaaggctgtgagaaatcacaagcgtggtcttatcatggacaccacttggcgcgatgcccatcaatccttattggctacccgtgttcgtaccattgatctggtaaatattgctccatatacgagccatgcccttgcttccgcttattctttggagatgtggggaggtgccacctttgacgtctctatgcgattccttcatgaatgtccatgggatcgtttgcgtagactccgtaagttggttcctaacattcctttccaaatgcttttacgtggtgccaatggtttatgctattcaagtttgccggataacgttatttactttttctgtgaacaagccaaaaagaacggtatcgatatcttccgtgttttcgatgccttgaacgatgttaataacctttctcttggaattgatgctgccaagcgcgccggcggtgttgttgaggccactatgtgttactctggcgatatgttaaatcccaagaagaagtataaccttgattactatgttaaccttgttgataaaatggttgaaatgggtattcacattttaggtatcaaggatatggctggcgttatgaaacctaaagctgctcgtcttcttatttctgccattcgggagaaacatccagagttacctattcatgttcacacccacgattctgccggtactgctgttgcttccatggctgcggctttggaggcaggagctgacgttgttgatgttgcaactgatagcatgtctggtcttacatcccaacctagctttggcgccgttttggcctctgtcgatggtactgataagcaattggagtttgataacaatcaattacgcgaaattgatagttattgggctcaaatgcgtttgctttactctccgtttgaatctgaaatcaagggtactgactcagatgtgtataaccacgaaattcccggtggtcaattaaccaaccttaaattccaagctacctcccttggattgggcactcaatgggctgaaactaagaaagcgtacattgaagccaataaattgcttggagatattattaaggtcactcccacttcaaaggtggttggtgatttagcccaatttatggttcaaaataaacttagtgctgaggatgttgagaatcgtgcgaccactttggacttccctgcttcagtactcgatttcttccaaggcttaatgggtcaaccatatggcggttttccagagcctttgcgtactaatgtacttaaaggtcgtcgtcaacctttgactgatcgtccaggtaaattccttcctgctgctgatttcgatgctatccgcaaattattgtcagagaagtttggtgtttcttcagattgtgatatcgctgcctacacccaatttcctggtgtctttgaggaatatcgtcaatttgtcgatcgctatggtgatttgaccactgttcctactaaattcttcttatctagacctgaaatgaacgaagaaatgcacgttgaaattgatcaaggtaagactttaatcgttaaatttgtcgctcttggaccattgaaccctcgtactggacaacgtgaagtttatttcgagttgaacggtgagaaccgccatgttactgttgaagataagaaagcagctatagaaactgttaccagacctcgtgctgatcctggtaatcctggacacgttgcagcccccatgagtggaacaattgtcgaaattcgtgttaaggaaggtgcgaaggttaagaagggagatattattgctgttttaagtgctatgaagatggaaattgttattagtgctcctcacagtggtgtgctcaagtctttggccgttgttcagggtgattctgtgaatggtggtgatttgtgtgctgttcttgaacacgag

SEQ ID NO: 26176 - DNA, 1317 bp, Schizosaccharomyces pombe
atggccattcagaaagtctttgctcgtcaaatctacgactctcgtggtaaccccactgtcgaggtcgacctcaccaccgagaccggtatccaccgtgctatcgtcccctctggtgcctccactggtatatgggaggctcttgagatgcgtgatggtgacaagaccaagtggggtggtaagggtgttttgaaggctgttggcaatgtcaacaacatcattgcccctgccgtcgttaaggccaaccttgacgttaccgaccaaaaggccgccgacgagttcttgcttaagctcgacggtactgagaacaagtccaagttgggtgctaacgccatcttgggtgtctccatggctatctgccgtgccggtgctgcccaaaagaagctccctctctggaagtacattgccgagaactttggcaccaagggtccctatgtcctccccgttccctctttcaacgtcttgaacggtggttcccacgctggtggtgacttggctttccaagaattcatgatcctccccaccggtgctccctctttctccgaggctatgcgttggggtgctgagacctaccacactctcaagtccattgccaagaagcgttatggttcttctgccggcaatgtcggtgatgagggtggtattgctcccgatttgcaaacccctcaagaggctcttgaccttattgttgaggccatcaacaaggctggttacgagggtaagatcaagattggtcttgatgttgcctcctccgagttctacgttgacggcaagtacgaccttgacatcaaggccgccaagcccaagcccgagaacaagcttacctaccaacaacttaccgacctttacgtcgagctctccaagaagtaccccattgtctccattgaggaccccttcgaccaagatgactggtctgcctggactcacatgaaggctgagaccgacttccaaattgtcggtgacgatttgactgttaccaacgtcaagcgtcttcgtaccgccatcgacaagaagtgcgctaacgctcttcttttgaaggtcaaccaaatcggttccgtcaccgagtctttgaacgccgtccgcatgtcctacgaggctggttggggtgttatggtttctcaccgttccggtgagaccgctgacaccttcatctcccacttgactgttggtattggtgccggtcaacttaagtctggtgctccttgccgttccgagcgtttggccaagtacaacgagcttctccgtatcgaggaggaactcggttccgagggtgtttacgctggtgcccatgctggcaagtacatcaaggctgctaagttt

SEQ ID NO: 26177 - DNA, 1350 bp, Schizosaccharomyces pombe
atgcgtacatactggttattcttactccttgggggggtcgtatctgcagaaagcttactttcccctaataaaagaagcaaggaagcttctatggatgaatggacggatcagcaaaagggtattgctatgggacatatgctgaacaatatcggtgacagcggtatgcatgctaaggatattaatcctggatgtattattgcttccccttcaactgattcccctgattactattatcaatgggttcgtgatagtgcattgacgatcatgactattttagatcgtttctttgaaggggacaaaggacttgagccgattatcgtcaaatatatggatgaaatggtcaggctccaaaaggtcccgaacccaagtggagacttttacgccggaggtcttggtgagcctaaatttaatgttgatgggacaagctatgacggagattggggacgtccccagaatgattcccctgctcttcgggctattgcatttatcaaatacatgaattatttatttgaaaatggtaaagaggtccatgaagttactgtctggattgaggctgtattagccgacttggattatactgcaaatcactggacagaggcaagctttgatctttgggaagaaattaaggacgttcattactttactctagccgttcagaagcgtgccatgcaagatggtacagcttttgcaaagagaattggagcacctgaccaagccgcactctaccaacgcacgatcgagcctattgatctaaaactgggagagttctgggatcctggaatgggtgttattaagggttataaaggcagagtcgatcgctcaggacttgattgctccactttgcttgcaagcctttactcaaatgagtttgatatgcacatccttccaaccttgttgaagttgcaagaaaccatgaccagagattatcccgtcaatcagggatggaagcaagcaatgggacgctatcccgaggatgtatacgatggtgtctctaagtctattggtaacccttggttcatttgcacaagcagcgctgccgagattatctacaaagcaatcgcatactacgataataaaggtttaccagaattgactgaatataacatccatttctttatgaaatttgctgagtttggagatccatacaactggtccgttatcaggaaaaacatgcacacatatgctgataactttttaaaagctgttgctgagttccaacatccaaatggttcaatgtctgaacaattttcgcgtgacgatggtcaccaaaaaggtgcaagagatttgacatggagttattcatccttattaaatgccatctacagaagagaggcaatcaaaggctctgtc

SEQ ID NO: 26178 - DNA, 1731 bp, Schizosaccharomyces pombe
atgtgtgaaactccaataggttgtcatacacctcgaagatgcaatcgttttatagattctgcagccttgattgactgtactaacaaaactaatcaaagggagcattcaccttccttttcaatagagattccgactacacccagcagaaaacgtacgctggctagctcacatttccaaacacccacaaaaagaataaaatatgaactaggagaactgcaagaggagaaaactgacctttatcctaattttcctgctcagttaaaggagaataagaaacctaaattacccacaacacctcaaactcctaaaacccccaaaaggaccattcaaattgttacacccaaatcattaaatcgtacatgtaatcctgttccatttgctactcgccttttgcaatcgacacctcaccgtcaactttttcctcccactccttcgacaccctccactccgtcctataattctactgccaaattgagtttacgtaaatcatatcgttcagcaggagtcgtgggtcgtgaaaatgagaagtcaattgtggaatctttctttcgtcaacatcttgatgctaatgctggaggtgcattgtacgtaagtggtgcccctggcacaggaaagaccgttctgcttcacaacgtgctggatcatgtagtgagcgattatcccaaagttaatgtttgttacattaattgtatgactattaatgaaccaaaagcaatttttgaaaaaattcactctaaaattgttaaagaggaaattttagaaaatgaagatcatcacatcaatttccaatgtgaactagagtcgcatttcacccagtccgccaatgaattatataacccagtcattattgttttagatgaaatggatcacttgattgctcgcgaacagcaggttctgtacacgctttttgaatggccctctcgaccgacttcgagattaattttggtaggcattgcaaatgccttagacatgacagatcgatttctccctcgtttacgaacaaagcatattactcccaaattactctcttttacgccttatactgctcaagaaatctcaacaattataaaagcgcgtttgaaaaccgccgctaccacatcagaaaaaaacaatccttttactcctattaaatcaatctctgaagtaagcgatgatagtataaatgttgtatctcagcatgctgatgaaacaccttttatacatcctgctgcaattgaattatgtgcccggaaagttgcagcttcaagtggtgacttgagaaaagcattagacatatgtaggcatgcaattgaacttgcggaaagagaatggaaagctcaacatgacaacacattatcttctgttgatataccaagagcatcaattgctcatgttgtccgagcgacatctgctatgagccaatctgctagtgctcgtttaaaaaaccttggtcttcaacagaaagccatcctttgtacgcttgttgtttgtgaaaaaacctcattgagtgttgccgatgtatttgaaaaatacagttctttgtgtcttcgagatcgtttgatttatccattaacaagttcggaattttgcgatgtcgcgaattctttagaaactcttgcaatcattcgtttgcgcacgaagcagcgtaacggaaagcctcaggaccgaatcattagtttgcttgttccagaaatggatgtcattacagctgttggagacattggtaccttaaaacgattttttgacagaaga

SEQ ID NO: 26179 - DNA, 4284 bp, Schizosaccharomyces pombe
atggctaaaaaaaaatcaaaagcttcgaactctgctcgtgggtatgccactacatccattccatctcgaagtgcctcctctccggcaaataaaaatcaggttaaaggagagaaaaataataaaacccaaaaggttgagcccaaaaatgctttcaaagttgagaatcaatcaaatgatataggggttgacaccgttgatgcatttgaccatctcctactagacaaaacgcttccaactattgatgccgaaactgaagtcataaaaaatacctctttatcaaactcaaagtcatttttacattcttggcaaacggatataagacttcgtaaaaatgacaacgtccttggcttgaccgaagatgaaattcaacaaattttgaaaacatttcgggactcttggaaatcttctctaaaagaaagttatgctttctcaaatcgatccagtttttctctgaggaaacggtatctttggactacatttctttcacttaaaggtatggggtttgaagaatcagaaatatttggcgccttctcatctatccctatagtttcgatagatgaatatatcacttggatgataacagagaatttaatcaattctgaaccttctaattcatctttttcttacgaagtgcaacctagtaattacactactttttgtaggatgctcgatgaaccgttacctgccaataatccggttcaatcaaatagtagacttgtcccattaatgaaggatttttctaacgatataaagcacacacctaataaagaaactcagccctctaatcaagtcgatgattcattgaaatctaaggattcaaagccactcacaatgtcagaggtacttacccaattgcctgaagatgacattccatttgatgatccttttgacttgacttctcaatatgttaaagttaagctgaaaatgttacgactacaaattgccaataaaaaaaattcagaagaatttagtacactgaatttgcaactagaaagcattactagccaatatcttttttcgtctaaagaggcagaaattgtgtttcgtaaaagcagaatcgagtttatgaacaagttaaaagctctccaacaaaaattagaaaacgagagaattgtagaagaaataaaaaaaaatggcatccaagaagattctcaaagcactgatgactccagtaaagatgatgataataattctgaaagcaatgatatgtcaccacacaacgatgcagaaactagagcggatgacgatgcttaccttatgggagatttatttaatcaagaagaagaagacattcaggatactgaaaatgatttacttaatgcaaactacacacttcttcctttaactaccgataaatctggaacacgtccaagtactacgttgcaatatgagcttcacaaaatcggatcaaacattaaagcagagttcaaaactatgccaatcggcaaaataggatatcagtccacctgttttgttagatgttctaccggccagaagactttttccgacctgaaaactgttttgcctactgccacattggctgcagattatatttcaatgatagttttatttagattaatggccaattttactaaaatttcgttacaaacgtttccaaaatcgtttaaagaggtttatggaaagttttctgcagaaaaacaaaacactgacttagcagaagatgcaaagatttccgagaagttggattccattataaagagcaaagaattggagaccccaacaagcgctaccacttctaaactcatggcccctatggataatattggcaagttttctggatttgaaaggccacctgagactttactaaacaaatggcgacaacaacttgaaagtgaatcagccgaaaaatttaaggttttccgtaatcagttgccagctacgatgtttagagagacaattattgatgctgtcaataatagtcaactcttaattatatcaggagacacaggttgcggtaaaagtacgcaaattcctgcttttctgttggaaaattctacaaaaaatggaaaagcagtcaaaatttatgttacagaacctcgaaggatcagtgccatatcgttagctaatcgtgtttctcaggaacttggcggcaatcctccttcagctcgttcgcatgagcttgttggttattctgttcgtctggattccaaatgtacgcctttaacacctttaacttatgttactacaggtacatttctgcgtctcctagaagttggaaacgaaatagagtctgtgactcatctgattattgatgaagttcatgagcgcagcattgactcggatcttcttttaattcatgtacttcatttacttaaacaacatcctcatcttaagattataattatgagtgcaactttaaacgccgaaaagtttcagttatactttgaaggaagtaatttaatcacaatacctggtaaaacatatccagtgcatagattttatttagaagatatactttcccagtttggaaatgataagtcgttcggtaacgctgccggacaggatgttatagaggaagatgactatgaaaccgaccaacaagatgcgagcatctcaaacaaatctgcggaggatgccattgttgaaatgaacctaattccagcttggtataacgagaaagccattaactatggtttaatcgtttatctcttaaagtatatattcactgaaggagatccgaaattcagtaagtgtgtattagtattcttacctggtatttcggagatccttcgtgtaaaatctcttatcgaagatatgcctatgtttcgaaatcatcgtaagttctgtatatacatgctacactctacactatcctctgcgcagcaacagtccgtttttaacatccctcccaaagggtgccgcaagattgtattgtcgacaaatatcgctgaaactggtgttactattccagatgtcacttgtgtgattgatacaggagtacatagggaaatgcgttataatagtagaagacatctttctcggttaactgatacatttgtatctaaggccaatgccaagcaacgtagtggacgtgctggtcgtgttcaggaaggtatctgctatcatttgttctcaaaattcaaacatgatacccaatttttgtcttaccagacacctgaaattctgagacttaatctgcaagaagttgttttgcgagtaaagatgtgccaaatgggtgatgtacaagatgtcttaggcaaggcgttagatccaccttcctctaccaatattattcgtgctttagaaaagcttcatcaagtgggagcgctctctgaaaacgaaaaattaacaaaactcggcaaatttttgtcgcaattacctgttgatgcaaatttaggaaaaatcttggttttgggatgcttctacaaatgtgtagatgccgcttcttcaatagtagccatgttaacaatcggttcaccttttaggaaatctgttgacaatgaattttctgcaaacaaagcccgattatcattcgctaaggagaataccaggagtgatttagttttgatgtattatgcttactgcgcttggcgagagatttgcctttcacctttaggccctgatgaagattcttttgccaaagaaaagtacttaaatttagaggctttaagtatgacagaatcactaaaaatccaactgctttctgagttgaaggatatgaaacttttaggcgcttcggatgttgatacttgcaaaagcctaaaacgttcaatatgccggcgttttgccgttatccccaaagagcatgatattaactcaggaaatgcagaaattctgtgtggcgtaattgctgcatctctgtatccaaacattttaaggtatgattacgaaaaaagacagtggtcaaccttgagtaccaacaagcgtgttagaattttagatgtatcggtgaataataggtctgagttacctaacatgccgtccaaattcgttgcttacacgaacatgatgtcttccactcgagctagtgagtatgttaatgaaactactatggttactcttcgccagcttctaatgatgtgcggccttaaagtcgaaaatagagtatcagttggacaagcaaagcttgacaactttacagtatattttgaaaatgtttacgtttcggcatctttaagtattttacgtcgctttattgaaacttctctaaacgaattttttgctgaacctgataaacgcttattgaattcccatcttgaggttattgttaacatagtttcacggttaaattacggaaccaaatttcagaaacgtctcaaagat

SEQ ID NO: 26180 - DNA, 645 bp, Schizosaccharomyces pombe
atgagtgacattaacaataatgagccagctgaaaatattgaacagcccaagcaagaaccagaagatggaaataattcgatgagtgttgatgaacaacccgaaacgtcttccacaaatctgccaactggtgacaatctcgccccaatgagtgtagaatcccctgcacatttaaataacgaggattctcccaaaagcgatgattctagagaaaggcatggctcgaattatgttatagaaccgcatttagaattgcgagatatggccaaagacaaaacacttgaaaatttcttggcccaaatggatgattactctcccttaattccagatgtgttattggattattacctcagtttatctggatttaaatgtgttgacccacgcttaaaaaagcttcttggtcttacagctcaaaaatttatttctgatgttgctcaagacgcctatcaatattctaaaatccgaaccggtagtagcaatgcatcttcaactacgtttggtgcgcagaattttggagccggaggcgcttccgggattggatctagcggaagaagaggtgaccgtggaaaaaccgtgctcactgtagatgacttaagtgccgctcttaatgaatatggaattaatttgaaaaggcccgatttcttccgt

SEQ ID NO: 26181 - DNA, 1389 bp, Schizosaccharomyces pombe
atgcagttgtgtatcatttctctctggttcttagctgcgttcatcgtcaatgccgataatgttcagtttgaggattatgaaagcaattttttcttcaaggaacatctcggaacattaagtccttatcatgagccctactttgatggtcttgattctgctttccctgaaacctgtgagatccaacaagttcatcttcttcaacgtcacggttccagaaacccaacgggcgatgtaactgccactgatgtatatagttcacaatatttaaataattttcaggaaaagcttttaaacggctcaatacccgtaaacttcagctaccccgagaatcccttatgttttattaagcagtggactcctgtaatagatgcagaaaatgccgatcaactttccagccgtggtcgtctcgaacttttcgacttgggtcgtcagctataccagcgttactataaactttttgattcatacgtttacgacataaatacggctgaacaggaacgtgttgttgaatctgcaaaatggtttacttatggattatttggtgataaaatgtacgaaaaaaccaattttatccttatttctgaaggtaaggcagcaggtgccaactccttatccatgtacaacgcatgtcccgtgtttaaagataataactttcataaaaatgcaactgatgctgcccatgctgtatggcgcaatatttttattgagcccattgtgaatcgtttggctaaatattttgacagcagttataaacttacgatcaatgacgttcgtagtctcttttatatctgcgaatatgaaattgctataaaagatcacagtgatttttgttccatatttaccccatcagaatttttgaactttgaatatgactcagatctcgatcaggcatatggaggtggtcctgtttccgaatgggcttcaaccttaggtggggcctatataaataatcttgcagactcacttcgtaatgtgactaatcccgacttcgatcgtaaagtatttttagcatttactcatgattctaatatcattcctgtggaagctgctttgggattctttcctgacattactccgcaaaatcctttgccgactgataaaaacatttatacatactcccagaaaacttcttcattcgttcccttcgctggaaatttaattactgagttgttcttttgttctgacagcaaatattatgtacggcatctcgtcaaccagcaagtttatccccttatcgattgtgggtatggacctagtggaacttctgatggactttgcgagttacaggcttatttgaattcaccgattcgggcaaattctacctctaatggtatttccattttcaacacagaatgtcaagcgcgtcctaccaacgttaccatttacttt

SEQ ID NO: 26182 - DNA, 2127 bp, Schizosaccharomyces pombe
atggcggacgaaccattgcttctcaattttgttgttgataatgctcaatcaagaaagcctgaagccttgaagtctagtcgtcgctggactgatcgcgctagagatagaaaaaggcaaaaacgcaattctaatgaatcatcaaaatcaaccgttaaaagaaattcaggcacaaatggtgcttccactgattataaaaattcacaaaaggaaaaagtaataaatcctgtgtttgatcctagaaaaccagctcatgagctaaaaggcaacaagcgcgataatacttttgttacatctttgtttacgggtgatgattctgagcatttttcacaggacgttggtcaaaatcttgaggataatcaaattagtaatattgggactacaaaggaggcatccaacgcacctattaaaactaccaactttgctggtgttcaattagatactcaactggctgatcatttaaataataaaatgaacattagcgctcccactgctatccaaagctgttgtcttccagcattgctaaacacagatgataaggatgcgttcattgaagcacaaaccggatcgggtaaaactttggcttatttactaccaattgtgcaacgattgattcgacttcctaaaaacttacacacccgtactagcggtatatatgctgtgattatggctccaacccgggagttatgccaacaaatttataacgttgctaacaagctcaacaataatccgttatcacactggattgtctcctgtaatgtgataggtggtgagaagaaaaaaagtgaaaaggctcgcatacgaaagggtgttaatattttaattggaacgcctggtcgtttggcggatcatttagaaaatacggaagcactggatgttagtcaagtacgatgggtcgttttggatgaaggtgataggttgatggatatggggtttgaagaaactttgactaaaattttatcttatttggaatcacaaagcagtattattaagaaggatctcagtattccttctcgtaaggttacaatgctttgctccgctacaatgaaagataccgtaaagcgtttaagtgattccgctttaaaagatgctttgtacttaaaatcatctattgtggaggaaaccaatgacggttatagccaggcacccgagcagcttcttcaaagatatgttgttgttcctccaaaactgaggcttgtaagcttggttgccctattgcgaagtcatgttagatcatataagaaaataataatttttctttcttgttcagatagtgttgattttcactttgaagcttttagatgtgcgataaacgctgatgaaatggaagaggccgtgaaagagaaaccggactctgagggtgatatcatttcaaatgctccagctctgagaatagatggcaaatcaaatgtataccgattacacggttccttgtctcaacaaatcaggacttcgacgctgaatcttttttcttcaagtgaagattctggttcacatatacttttgtgtacagatgtggcagcccgtggtcttgatctgccaaatgttgatttggttgtgcagtatgatgctccgtttagtaccgacgattatttgcatagaattggcagaacagctagggctggacacaatggtgcagctattatgtttttactcccgaaggaaagtgaatatattaatttgttaaagtcttcagttagcgctaatatattggagcagcctaatggtccatctgggttgttgagtgctggtttttcgcaaggtaaaacaaacaccaatgattggcaagatcgtgcaacagaatggcagttggaattggagcgttttatattagaaaatgaacctatgaggaatattgcaaaaagggcttttacttcttatgtgagggcttatgcaacacatctttcatcagaaagaagtatttttaacatgcgtgaccttcatttgggacatattgctaagtccttcgctttgcgagaagcgccgggcaaaatatctggtgcaaattcttcaaagccaagaaagcagggtggttcggttgataaaggtaaaagtaaatcatcgaaagacattgctgctttgatgcacagaaaagcaatggaacattattcaacggaacacaatatagga

SEQ ID NO: 26183 - DNA, 648 bp, Schizosaccharomyces pombe
atgaggagggcttttgtagaaagaaatacgaacgaaacgaaaatcagcgttgccatcgctttggacaaagctcccttacctgaagagtcgaattttattgatgaacttataacttccaagcatgcaaaccaaaagggagaacaagtaatccaagtagacacgggaattggattcttggatcacatgtatcatgcactggctaaacatgcaggctggagcttacgactttactcaagaggtgatttaatcatcgatgatcatcacactgcagaagatactgctattgcacttggtattgcattcaagcaggctatgggtaactttgccggcgttaaaagatttggacatgcttattgtccacttgacgaagctctttctagaagcgtagttgacttgtcgggacggccctatgctgttatcgatttgggattaaagcgtgaaaaggttggggaattgtcctgtgaaatgatccctcacttactatattccttttcggtagcagctggaattactttgcatgttacctgcttatatggtagtaatgaccatcatcgtgctgaaagcgcttttaaatctctggctgttgccatgcgcgcggctactagtcttactggaagttctgaagtcccaagcacgaagggagtgttg

SEQ ID NO: 26184 - DNA, 2826 bp, Schizosaccharomyces pombe
atgagtggagaaaccgtgcatggaatttcgtgctactctgttgttgcaaacactgaggacacatataatcagactctcgacttctaccaaaagcttggcttcaagaaggttgccagcttcggtaccagcgattctgacaatgcccgtgtttgcaacgagtctctccgtgaggactggatgcatgtcgctggaaacaactctgctgaaagcgtcaccatcaagttccgtttagtccccggtgaattgagcctttcccccgctgccgaagattctgaatggcgcggacaaaagagttctcttgttttttactatcccaacttgcttgacttgcttaagcaactcagtgccgatgccattaaataccaagctttccccaacgagaagaagcctgatgaggtttatgtcgaggatcccttgggtaatttgattggcttctccgaccgttacaatcctttcgcccatgctaaccttaagaagagcgaggagtctggtgctgcttctaacctcgagagcggtttggctactcccgtcgttgagactctcaagaaagctaccacttctgacaagcctgcaggtgtcaagaagaagattgcagttatgaccagtggtggtgactcccctggtatgaacgctgttgttcgtgccgtcgctcgtattgccattcaccgtggttgtgatgctttcgctatttatgaaggttatgaaggtcttgttcaaggtggtgatatgatcaagcaattgcaatggggtgatgtccgtggttggcttgctgagggtggtactcttattggtaccgctcgttgtatggctttccgtgagcgtcctggtcgtcttcgtgctgccaagaaccttatttccgctggtattgattccattattgtttgcggtggtgatggttctttgaccggtgctgatatcttccgttctgactggcccggtttggttaaagagttggaggacaccaaggctattactcccgagcaagccaagctctaccgccatcttaccattgtcggtttggtcggttcaatcgataacgatatgtcttcaactgacgttactatcggtgccttctcttctcttcaccgtatttgcgaagccgtcgactccatttcttctactgctatttcccattctcgtgctttcatcgttgaagtcatgggtcgtcattgcggttggttggctgttttagctgcattggctaccggtgctgatttcgtctttatccctgagagacctgctgaagtcggcaaatggcaagacgaattgtgcaattctttgagctctgtccgtaagttgggcaagagaaagtcaattgttattgttgcagagggtgctattgactccgagcttaaccacatttctcccgaagacatcaagaacttgttagttgagcgccttcacttggacactcgtgtcaccactctcggtcacgttcaacgtggtggtattccttgtgcttatgaccgtatgcttgctacccttcaaggtgttgatgccgttgatgctgttcttgcctctacccctgatactccatctcccatgattgctatcaatggtaacaagattaaccgcaagcctttgatggaggctgttaagttgactcatgaggttgctgatgctattgagaagaagcagttcgctcatgctatggagctccgtgaccccgaatttgctgattacttacacacttgggaaggtactacctttattgaagacgagtcacacttcgttcccaaggacgagagaatgcgtgtcgccatcatccatgttggtgctcccgctggtggtatgaactctgctactcgtgctgccgttcgatattgtttgaaccgtggtcacactcctcttgccattgacaatggtttctctggcttcttgcgccatgattctattcatgaactttcatggattgatgttgatgagtggtgcattcgtggtggtagtgaaatcggtaccaaccgtgatacccctgatctcgacatgggcttcactgccttcaagttccaacaacataagattgatgctttgattattattggtggtttcgaggctttcaccgccctttctcaacttgagagtgcacgtgttaactacccttcattccgcattcccatggctatcatccctgccaccatttccaacaacgttcccggtaccgaattctctttgggttgcgatacttgtcttaatgccgttatggaatactgtgataccattaagcaaagtgctagtgctagccgtcgtcgtgtcttcgtttgtgaagttcaaggtggccgctctggttatatcgctactgtcggtggtctcattactggtgcctccgccatttacacccccgaggatggtatctccttggatatgttgcgtaaggatattgatcaccttaaggctacattcgccttagaagctggtcgtaaccgtgctggtcaacttatccttcgtaacgaatgtgcttctaaggtttacaccaccgaagttattggaaacatcatcagtgaagaagctcataagcgcttctccgctcgtaccgctgttcccggtcacgttcaacaaggtggtaaccccactcctatggaccgtgctcgtgctgctcgtctggctatgcgtgccattcgtttcttcgaaacttgccgtgccaacgacttgggtaatgaccccagctctgccgttgtcatcggtatccgtggtactggtgtctctttcagctctgttgctgatgttgagaacaacgaaaccgaaattgagatgcgtcgtcctaagaacgcttggtggcgtgatatgcacaacttggttaacatcttggccggcaagacctttgctgat

SEQ ID NO: 26185 - DNA, 1261 bp, Schizosaccharomyces pombe
atgtctatagatccagcaaatgatagtaagcttgctccggaggcgaatgacgctactctaggagacgttgacagatggatcgaacagttgaaaaaatgcgagcctctgagcgaagctgacgttgaaatgttatgcgataaggtaagtgaacactaaggagagtatatatgtgtatcaggcttggttggatatatcccaactttgcaagttctcattttctcttgatttcttgagattgttcagtttgatatgtttgagtttgaactatccagcttatttcggtttgatttctaaaaagattaatattacattaatgtcgggtttctagaaatctcatcctataaatatatggtggttaaaaattacgtcggagactctcatctataccagcatttttcgtgttttcgcagtttttgctaaccattttttctaggctcgtgaggttttatgtcaggaaaataatgtccaacctgtccgaaatccagttactgtttgcggtgatattcatggacagtttcatgatctgatggaattatttaaaattggaggtgatgtgcctgatatgaactatctttttatgggtgactatgttgacagaggttatcacagcgtcgaaactgtaagtttgcttgttgcaatgaagttacgctaccctaaccgaattacgattcttcgaggaaatcatgaatctagacaaatcactcaagtttacggattttatgatgaatgtttgcgtaaatatggatccgctaatgtttggaaacatttcacaaatttatttgactatttccctttaactgctttaattgaagaccgtattttctgcctacatggaggtctttccccgagcattgattcattagaccatgtacggactttggatcgtgtacaagaagttccccatgaaggtccgatgtgtgatttgctttggtcagaccctgatgatagatgtggttggggaatttctcctcgtggtgccggatacaccttcggacaagacatttctgagacatttaatcacgcaaatggattaagtttaacggcacgagcccatcagctagttatggaaggatttaattgggcacatgatggagacgtagttacaattttttctgccccaaattattgttatcgctgtggtaatcaagcagctattttggaagttgatgatacgatgaatcaagtctttttacaattcgatcctgccccacgagaaggcgaaccggtaatagctcgaaggacaccagactacttcctttaa

SEQ ID NO: 26186 - DNA, 1268 bp, Schizosaccharomyces pombe
atgcggatatcaagattgctgattagagtacttttgggattcgtgatacttttcattacatacatcctctttccttcaataccaaaagcattggtgaatactttaaatgtgtataaactagaggagcgtttaaactattacaatgatcgtttattagatggaaatttgaaatcgaaggaattggagaatgctacgttcgtaactttagcacggaatgcggacctttacgatttaattgaaacaataaatatatatgaaaatcggtttaattcgaagcacaactatccttgggtttttctaaatgatgaaccatttactcgaacttttgaagtggtcatgtctcgtctaactagtggtccaacatattttggtgtcgtgaacagtagtgaatgggatattccaaaatggatagatatggatattgcacattccaattggaatcgcctatcaagggaaggcgtactttatggaggcatgaaatcatatcgtcaaatgtgtcgatatttctctggatttttttggagacatcctttacttgatccttataaatattattggagagttgaaccttcaactaagcttttatgtgaagtgaacaaagatcctttccgacaactgagattactgaataaaacctatggatttgtcataacgttatttgagatcggacaaacagtaccatcattatggaatagtaccttggaatttattgagaaatatcctgaaacactggcgaaaaacaatttatgggaatggatttcagatgataatggaaaaaaatttagccactgccattttgtaagtgaagcgagtaacaatatttctatttactaactattgcaagtggtcaaactttgaaatagcggatctcgattttttcagaagtgattcttacagaaaatattttgattttttagataaaaagggtggctttttttatgaggtatgaccaaacgtcaacggaagaatttgcaacattgctaaaacaatttttagagatggggtgatgctccagtacattctatagcattaagtttatttctcgatagaaacaaactgcattactttgacgaaataggatattctcatgctcctcttcttcattgccctagaaagggacgttgcttctgtaaaccggaagagattgattgtaagtataattaatatactgcacatttgctgacaatttattagtatcgtccaactcttcttgcatagctaggttcattaacctaactaacgaagactacgatgaattataatgcttt

SEQ ID NO: 26187 - DNA, 2205 bp, Schizosaccharomyces pombe
atggaaccagctcagaagaaactaaggcaagagtcaaagaacccgtatttggcacacttaaacaatggtgatgattctgaggaagttgtttcttcgaaagggttgacgcgacgtgctacgactgttgcacaagcagctaaggctgaagaaggaccaaacaatttttttaatgataaaccttttagtcaaaattattttaagattttggaaactcgaagagagcttcctgtataccagcaaagagaagaatttctcaaaatttatcacgagaatcaaattattgttttcgttggtgaaactggttctggtaaaacaacacaaattcctcagtttgttctttatgatgaattgcctcatttaacaaatacacaaattgcatgtactcaaccacgtcgtgttgcagctatgtccgttgcaaaacgtgtcgctgacgaaatggacgttgacttgggcgaggaagttggttacaacattcgttttgaagactgtagtggacctaacactctgttaaaatatatgacagatggtatgcttttgcgtgaagccatgacagaccatatgctctctcgttattcttgtattattcttgatgaagcacatgagcgtaccttggcaactgatattttgatgggtctaatgaagcgtttggctacacgtagacccgaccttaagattattgtcatgtctgcaactttggatgctaaaaagtttcaaaaatacttttttgatgctccccttttagctgttccaggtagaacttaccctgttgaaatttattatacccaagaacctgagcgcgattatttagaagccgcgcttcgtacagtgcttcaaattcatgttgaagagggccccggtgatatcttagtgttccttacaggtgaagaagagattgaagatgcttgccgtaagattactttggaagctgatgatcttgtacgtgaaggagccgctggtccattgaaggtgtatccactttatggttctttaccgccaaatcaacagcaacgtatattcgaaccaactccggaagatacaaaatcgggttacggccgtaaagtagttatatctacaaacatcgcagaaacatccttaactatcgatggtatcgtttatgtggtggatcctggttttagtaaacaaaaaatttataatccccgaatccgagttgagtctttgcttgtaagtcctattagcaaagccagtgcacaacagcgtgctggtcgtgctggacgtactcgacctggtaaatgtttccgcctttacacagaggaagcttttcgcaaagaattgattgagcaaacgtatcctgagattttacgcagcaatctctcgagtactgtcttagaattgaagaaactaggtattgatgacctcgttcattttgattatatggatccacccgctccggagactatgatgcgtgctttagaagagctgaactatttgaactgtctggacgataatggcgacttgactcctttaggtcgtaaagcgtctgaattcccacttgatccaaatttggctgtaatgcttatcagaagtccagagttttattgctcaaacgaagttttatctttaacagctcttttatctgttcctaatgttttcgtcagacctaactctgcaaggaaattagcggatgagatgcgacaacaatttactcatcctgatggtgatcacttgaccttattgaacgtttatcatgcttataaatcaggtgaagggactgctgactggtgttggaatcatttcttgtcgcatagagcgctaatcagtgctgacaatgtaagaaaacaattgcggaggacaatggaacgtcaagaggttgaactcatatctaccccttttgatgacaaaaactactatgtaaatatccgccgtgctcttgttagtggatttttcatgcaagttgccaaaaagtctgcaaatggtaaaaactatgtgactatgaaagataatcaagtggtttcactgcatccttcatgtggtttgtcagtgactccagagtgggtggtttataatgaatttgtacttactaccaaaagttttattcgaaatgtcacagctattcgtcctgaatggttaatagaactagctcccaattactatgatttggatgatttcgacaataataaagaagtcaaatcagcactccaaaaagtatatcaaatggctgctagatcaaaaaagaacgctcgacgt

SEQ ID NO: 26188 - DNA, 2036 bp, Schizosaccharomyces pombe
atgttattgcgggatggccgtattccacagtacagtatttacccattgccagttccgccgatgaattctaaaacgcccactctaggaatagtttgttcagaggggaccatttccttgtctttggaagagggttttgagtttgttggagttccgttaagtggtgaaggtttaaagctacgagttgaagctctagctccgtcagagcgtttgcaggaattcctcgacgatgaagtagcttatcaccctgagggtatgtttcaaatttgaaagaaaatttatattaaccaattttactatagaaaatgtgcacaaggtggtcggtttatcctcagcttggctggagttagattctgaagacacactaatcgctgatcgatcagaagaagtgttattaaaggaagcatcatatgcttcttattgtgggttatcttcaatcatcctaaatggtccaacttcaccaatgaacgttatgcgttatgcgagagctgtatcttctgctttaaactcaacaatgaatctaaaattcttggtacaattggcaatcgaaagtggtcatgaagactattttgagacatggaaaatgtgggacacaattcgctcagcatgtggttatcaccctagattgaaggtggccttagagctacctcccgcttgttcacccccaatcgagctagtaaatcgatggtacgcggaaccgatagagatgattactatgtcatgtatggctttcgttcctaatcccaacggctatccagtacttggtcgtaagttgagggctatttatgctttatatctacgtctcaatcctcgaattttactttgggataatgacgcacccgagaaaataggtgattcccccgactacagcatatatatgaagcacctctttgattcacagcctccagctccacttgtagaagatctcgcggattcttataaagactatctgcaagttcctcttcaaccattgagctacaatttggaaaacattacttatgaaatatttgagcgagatcccgttaagtacgcccagtatgagcaagcaattttttctgcgttgatggatagagacgaatcttctgtcacgcgaattgccgttgtgggtgcgggaagaggtccattagtcgactgtgctttacgtgcggcaatttcttcatctagaacggttgatatgatcgcccttgagaaaaatcctaacgctttttccatgctattgatgagaaaccgccaggattgggctggcaaagttactctagtatttggagatatgagaacatggaatcctgattataaaattgacatccttgttagtgaacttttgggtagtatgggagacaatgaacttagtccggagtgtctagatggtgtacaacatgtgcttgatgaagaaactgggatatgcattccatcttcttacatctcctatgttactcctattatgtctcctaagctatggtctgaagctcgtaatatgaatgacccaaatgcttttgaaagacagtacgtggttttaatgaactcatttgactttttggctgcagatgatgagttccgttttcagtccctttggtccttccatcacccaaacaaagatagtgaggtttatactaaaaacttgcataacaaacgttttgctagtgttcgttttcaggcctctagtcctggaatccttcacggttttgcaggatattttgaagctacattatataaggatatttctctttcaattatgccagcaactatggaagcgaagtctcctgacatgttttcatggttccctatttatatgcccattaaggtaagttactatattttacgttgcactgtatactaatatttcctagaaacccatgtacgtcccagaaaacagccaattggaatttcacatgtggcgattgacggacggtatgcgggtttggtttgagtggtgtgccaatgcctatctggtgttgcggaatggaagtcaaatcaagttgtcttctacggaggtccacaacatttccggaaaagcgttctcgtgtaatatgtattaaaaa
